United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 4

SEQ ID NO: 6957 - DNA, 867 bp, Pseudomonas aeruginosa
gcgcgagtcgacactcgcgcggctttctttcaggtacagtcacgccccccgcatcaggtgccgctagagcgccgatgccctgccataacgacaaacattgcgaccgacagggagtcctccatgtccatcttccgtctggctctcggctgcgtcggcagcctggccctgctatgcgctagcgccctggcgcgcgccgaaaccctggtcctgctgaccgagaacctggtgccgttcaacatggcggtgaacggcggcaactacgccaaggacgatggcatcagcggcatcagcaccgataccgtgcgcgccgcctgcgagcgcgcgcagatcgagtgccagctgatcctgcgcttcccctgggaccgggtctaccagcaggcgctgagcgagcccggctatggcgtgttttccaccgcccgtacgccggagcgcgaggacaagttcaagtgggtcggcccgctggcggtcaacgactgggtactgatggcccgcggcgacagcagcatccacctgaacagcctggaagacgccgcgcgctaccggatcggcggctacaagaacgacgccatcagccagcacctggtcgaccgcggcctgcaggtgcaactggcgctgcgcgacaacgagaacgtcgacaagctggccagcgggcagatcgatctctgggtcaccgccgatccgagcgggcgctacgtcgcccagcgcgagggcctcaaggaggtgaaggtggtccagcgtttccataccgccgagctgttcctggcgctgaacaaggacaccccggacgagctggtgcagaagttgcaaacggcggtcgacgcgctgcgcagcgaaggcttgttgaagcagatccgcgagcgctactga

SEQ ID NO: 6958 - DNA, 843 bp, Pseudomonas aeruginosa
cgcctcgccggcgatgctggcaaaaggctggcctggcggcgcggcgctggttattctgcctcgctccaggcccctgacaggatgacaacaatgcaaagaagcctgctcttcgcgctgctcgcaaccctgctgctggtcggcggcgcgcgcgccgaaaccgatcccgactacagcatggtcctgctcacggagaacttcccgccgtacaacatggcgatcaacggcaagaacttcgcccaggaagacaacatcgacggcatcgccgtggatatcgtccgcgagatgttcaagcgcgccggcatcaagtacagcctgaccctgcgtttcccctgggaccgcatctacaagctggcgctggagaagcccggctacggggtgttcgtcaccgcccgcctggccgagcgcgaggacaagttcaagtgggtcggtccgatcggcccggacgactgggtgctgctggccaagggcgacagcccgatcaccctgggcagcctggacgaggcgaagaaataccggatcggcgcctacaagggcgatgccatcgccgagttcctcggcaagaacggtttcgaggccgacctggcgctacgcgaccaggaaaacgcgcagaagctggtcaagggccagatcgacctctgggccagcggcgatcccgccgggcgctacctggccaagcaggaaggcgtgaccggcctgaagacggtgctgcgcttcaacagcgaccagctgtacctggcgctcaactgcgagactcccgacgaagtggtgcagaagctccaggcagccctggacggcatgcgcaaggaaggcttcgtcgaggacatcctcaacagctatctctga

SEQ ID NO: 6959 - DNA, 891 bp, Pseudomonas aeruginosa
gccctgcgcttccccctgggaccgcctgtaccggttgaccctggacaagcccggctacgggctgttctccatgacctacacccccgagcgggtgccgcagttcaaatgggtcggcccgctggccgacaccagttgggtgttgctggcgccggccggcagcaagatcgccgtgaagaatctcaaggacgccgcccgctacaagctcggcgcctacaagaacgacgcggtcagccagcacctggaggcccagggcatcccggtgatcaacgccctgcgcgaccaggaaaacgtgaagaagcttaccggcgggcagatcgacctgtgggccaccaccgatccggtcggccgctacctggccaagcaggaaggcgtgtccggcctgcagacggtgctgcgtttcaacgaggccaagctctacctggcgttgaacaaggacactccggacgaggtggtggagcgcctgcaaaaggccctggagcagatgcgccaggaaggcttcgtcgacgaagccgtcgccaactacctctgactggcgggcgcccctccgccggcgcggcgagggggctcagttcaggtcgtaggcctggacgccgaggtcgcggctgtcgtaccagttgccgcgggcccagaacacccggtcgtgcgcctcgtcgaagccgagcacgccgaggtagccggcgatgtccaggcggcgccaggatgaaccccagtcgtccgagtagtacaccgcgttggcggagacgctcgccggctcctcgtcgggatacagccacagcggcacttcgtagtggctcatggtgttggccagcagcacattcctgcccatgtagaactcgcgcagcccggaactggacggcaggggccagaacgggctgggcagcttgccggtga

SEQ ID NO: 6960 - DNA, 735 bp, Pseudomonas aeruginosa
aaccgaggggaatcgcgcctgcgaccagcagggcggcggcgagcaggggcatgggaggggaagggcgggccatcggtgcgtccgtgcaggaatgacgaggacgtcaccttaaccgctgccgcgacgccggtaaacccggcttcagtgcggcgcctggcgtgggttgacgttgcggttgccgcgctcgccgatgagcatctgcggcggtaccagctcgatgccctgggcgcgcagcttcggcagctcccgcgccagcacgtcgagggtggccttgtgcgggtggccgatgagcaacgccgaaccctgcttgcgggccagggcgacgccggcctgcagttgtgcggagaccgcttccggtgtggcttcgttgtcgaggaacacatcgcgcgagacgctcgccaggccgatccgctgcgcctcgctggcggccacggtggcggcgctggtgcggctgtctaccaggtacaggccgcgacgctggagttcctcggcgagccaggccatcgccgggcgcaccgcggtcatgcggctgccctcgtggttgttcaggccttgcacaaacggcaccttggccagcgccgcgtccagccgccgcgcacgctcttcctgggtcagctccggccgccaggcgtatggaccgccggccgggtccatcggcatgtgcaggatcaccgtgcgcccgcgctggtgcgcctcgcgggccagttcggcggcatgcggggtttcccgggatga

SEQ ID NO: 6961 - DNA, 447 bp, Pseudomonas aeruginosa
tcacgagttcggcgcctatccctgtgcgcggcaccaggtaatagggtccgccgggcggccctgatggcgaatggcgaagtacacggccgggctactctggccgccgctggttccaacggtggcgatcgggtctccggccttcacggtgtcgccggcgtctttcagcaggctttgattatggccataaaggctgaggtagccgccaccgtggtcgaggatgaccaacaggccggctccgcgcaaccagtcggcgaataccacgcgtccgccgtgcaccgcgcggacggtgctgccggcgctcgccgaaatcagtacgccgtcccatttcgcccgcggatcgtcgccgcgctggctgccgaagcgcgccacgacgcggccattcaccggccacggcagcttgccgcgggccgagccgaacgcgccgccgtagaccgcgccagtgcttga

SEQ ID NO: 6962 - DNA, 189 bp, Pseudomonas aeruginosa
caggagaggaaggaggcggagcatggggtggcgggcacctgggaattggaccggcctagtatgcccgtggccgccgttaaaaaaaacgccccgcaccgcgcgctgtggggcgcttccacgtatttcagccggatggcagcggcggatgtcgtcgacgacgaaggccacgggcatcaggcgggtctgtag

SEQ ID NO: 6963 - DNA, 480 bp, Pseudomonas aeruginosa
ccgcggaacagcgcttcctcggcaagggaaacgaagaacaggttggccaggatgaactgccagagccaggccggcgcgtggagttccggccgcagcaggccgacgccgacagccagcagaagcagcgccggcaccgccgccacgagcagcagccagtaccaggggcggccgggagcgcgggcttcgtcgcggaacaggctcggcaggcaggccagtagcaggaacggcaccagtgccttgtcgaagttgaagtacatggtgaacggcaggctctgcgggccgaccaccgccttgtccaggatcctggggttggcgaagccgggtagcaggtgcaggaacaggcccaccgcgccggcgaccagcagcagctccaggcccagggcccaggcgcggcgtgccgccaggcgccggcgcaacagggcgaggacgcccagtgcagccagggcggcgaccgcaggcggagcgagaaccccgtcgtag

SEQ ID NO: 6964 - DNA, 261 bp, Pseudomonas aeruginosa
agtgacatgccgcccgtcgtgatctacaccaccgcctggtgtccgtactgcatccgcgccaagcagttgctgcaacgcaagggcgtggacttccaggagatcgcctgcgacggcaagcccgaactgcgcgccgagctggcacgcaaggcgggatcgaccaccgtgccgcagatctggatcggcgagacccatgtcggcggctgcgacgaccttcatgcactggagcgcgccggcaagctggacgcgctgctgtctgcctga

SEQ ID NO: 6965 - DNA, 516 bp, Pseudomonas aeruginosa
attgacccaagggaaggcccgaaaatgaccgagcaagctaccaacggcgctgccgacgagcagcaaccccagttctccctgcagcgcatctacctgcgcgacctgtcgttcgagtcgccgaagtcaccggaaatcttccgccaggaatggaacccgtccatcagcctggacctgaacactcgccagaagcagctggacggcgacttttacgaagtggtcctgaccgtatcggtgaccgtgaagaacggcgaggacaccactgccttcatcgccgaagtgcagcaggccggcatcttcctgatcaagaacctcgatccgtcgagcatgagccatacccttggcgcgttctgcccgaacatcctcttcccgtacgctcgcgaagccctggacaacctggtggtacgcggttcgttcccggcgctgatgctgtcgccggtgaacttcgacgccctctacgcccaggaaatcgcccgcatgcaggcctccggcgagatcccgacgccgtcggtccagtaa

SEQ ID NO: 6966 - DNA, 1266 bp, Pseudomonas aeruginosa
tgccgatttgtcgcctgctggtgcacgctgcccaaaatccgggcaagggccgctgccctgcacaaccggcggataaccgcgatgcggttattcgccctacgccatggtttgaccggtggtgccgggcgggcgccctgccgaggctggggctgtgctgcggacggtagggcaatgaaatggactcctccctcctacggcgtcaagcgccagactaatggtgcagccacaagtcccggagggggagtcagcatgaaccttagtcgcattggtctggatctggcaaaacaagtattccaggtgcacggcgttgatcgtcacgagcatgtggtatgtcgtcgccaactcaagcgggcacaggtgcgggatttctttcgccaactgccgccgtgcctggtggcgatggaggcctgcggcagtgcgcactactgggcgcgcgagttgcgggagctgggccacacggtacgcctgatcgcaccgcagttcgtcaaaccctacgtcaagggggacaagcacgatgcacacgacgccgaggcgatctgcgaagccgccagtcgtccgagcatgcgctatgtcccggtgaagagcgcagagcagcaggccgtgcagtcggtgcatcgggtgcgcagtcgtctggtgcgggcccgcacggcgttgtgcaatgaggtgcgtggcttgctgggcgagttcgggctgatcgcgacgcgacgtgggcgagcggcgacgatggccttgctcgaaacggtcacggctaccgaaccggcgcccttgccggccccgatgggcgagctgttgcgtgaattgaaagatgaattgcagacgctggaggcgcgcatcgctcgactggagcgacagattcaggctcacgtacgtggcgatgcccgcatccagcgcctgctggcggtggaaggcatcggcccgatcagcgccagcgcggtggcggcatccgccggtgatgcacggcaattccgcacgggccgccagtttgcggcctggctgggcctagtgccacggcagcactccacgggcgggcagcagcgcttgggcaacatcagcaagcgcggcgatacctacttgcggaccttgctcatccatggcgcccgtgcagtcgtgcgctgttgcgccaacaagaccgatgcccgcagccgctggctgcaaggtctgctgcaacggcgtcctgccaatgtcgtcgccgttgccctggccaacaagaatgcccggatcctttgggccttactcagccgggagacatgctaccggcccggttga

SEQ ID NO: 6967 - DNA, 525 bp, Pseudomonas aeruginosa
cgccccgggcgttattcgccctcccgtacccgtgtagaaggcggtcgatgccggcgcctcgatggaagcgccactcaggccgccaggcggccgccggcgatcgcctcggaggccttgagcatggcccgcaacagcaccgcgcagccggcggccaggtcgtcggggctggcgttctcgatctcgttgtggctgatgccgttctcgcagggcacgaagatcatccccgccggaccgagttcggcgaggaagatcgcgtcgtggccggcgccgctgacgatgtccatctgcggcatgcccagcgcctgcgccgcctcgcgcaccgcgccgacgcatccctggtcgaagtacagcggcgggaaatcggcggtcggcaccagctcgtattgcaagccatgcttctcgcaggtagcggcgatcacctggcggacttcggcgatcatcgagtccaggcgctccggttgcagatggcggaagtccagggtcatcttcacttcgccgggtatcacgttgcgcgaaccgggatag

SEQ ID NO: 6968 - DNA, 564 bp, Pseudomonas aeruginosa
ccgatggcgtccagcgcctcgcctacgctgacaccgtcggcatcgcgcttggccagggtctcctccagggtgaacttcccggcgaatacgcccgagcccatcatgcagggcgcgaagcgcgagccttcctcgttggtccacaccaccacctccagcggcgcctcggtttccaccccgaggtcgttgagggtgcggatcacctcgaggccggccatcaccccgaagcagccgtcgaacttgccaccggtgggctgggtgtcgatgtggctaccggtcatcaccgggggcaagtccgggttacgcccgggacgacgggcgaagatgttgccgacccgatcgacgctgaccgtgcagccggccgcttcgcaccattgcacgaagagatcgcgggcctggcggtcgagatcgctcagggccaggcggcagaccccacccttggcggtggcgccgaggcgggcgagatccatcagcgattgccagaggcgctggccatcgatgtgtcgctgggtggattgcaggacgttccgggcagtgctcattgtcgtctcctcaggcttggagtag

SEQ ID NO: 6969 - DNA, 1695 bp, Pseudomonas aeruginosa
gtgtcggcggctcgccggccgcctgtatgcccatcagggcagcggtttggccaatgccgccgggctccgcgcacggcggccgcagaggccgtagtagagcgcgccgccgagcagcgagccggtgaaccagccgtagtcgtagaaccagtggaactggcggttgccgagggccatgacggtcagcgccaccggcaccgcgaaggcggcgaagccgggccagttccaggccgggtagacgtcgtcgcggtagagtccggcgaggtcgaggcgttgcctgcgcaccaggaagtagtccaccaccatgatccccgcgatcggcccgagcaggctggagtagccgagcagccagttggagtagacgctttccaggctgaggtcggaaacgatccagccgagcttcttcagcaactcgtgggccatcagcgccaggccgatgaaaccggtgagccagacggcgcgggtgcggccgatgagtttcggtgcgatgttctggaagtcgttggtcggcgagacgatgttcgccgcggtgttggtcgagagggtggcgacgatgatcaacgccatcgccaccgccacccagccggggctggggatgtgcccgatcaggctgaccgggtcggaaaccgtctcgcccaccagcgaagccgaggcggcggtcatcaccacgccgagggcggcgaacaggaacatggtcagcggcaggccgaagatctgcccgagtatctggtccttctggctacgcgcatagcggctgaagtcggggatgttcagcgacagcgtggcccagaagccgaccatcgccgtcagcccggccatgaagtagccggtgacgctggcgccttccgggcgcttcggcggctgcgccagcagttcgctgaccgatatgtgcggcagcgcccacaccagcaggccgaggccgaccagcaccagcagcggtgccgagagtgtctccagccatttgatcgactccgcgccgcgcagcaccacccacaggttcagcccccagaacaggaggaaaccgatcacctcgccggtaccgccgagggctttccaggcgggaaagatcgaaccgaggaagagatggatcgccagcccgccgaacagcgtctggatgccgaaccagccgcacgcgaccacggcgcggatcaggcatggcacgttggagccgatgatgccgaacgaagcgcgcagcagcaccgggaagggaatgccgtagcgggtgccggcgaaggcattgagggtcagcgggatcagcaccaccaggttggccagcaggatcgccagcagcgcttcgccgacgctgaggccgaagtaggcggtgaggacgccgccgagggtgtaggtgggcacgcaaatggacatgccgatccacagcgcggtgatgtgccacctgttccaggtacgctgttccacccgggtcggggcgatgtcgtggttgtagcgggggctgtcgagtacgtcgctgccggcggacagctcgaccaagccgtcgcgctcggtcacttccgatctgctctgttgcatgggcctctccagaattcttttagttattcgctcatcgggctaatgcgatggccggagtaccgcaccaccagtactgcacctccggtccggacaatgccgtggcgggcggcactcaataagcgtgccgaaaaccccgcgacgtcactgggcaggccggtctactggaggtaa

SEQ ID NO: 6970 - DNA, 1524 bp, Pseudomonas aeruginosa
caggattataaaagtcctcggcgcatggcgaaaaaacaatttcaagaaccggcaacgaccggtcagcctgcgaggaaagacggcatgtccctgttgatccgtggcgccaccgtggttactcacgaagagagttatcgagccgacgtgctctgtgccaacggcctcatccaggccatcggcgagaacctcgaaaccccctccggctgcgacgtcctcgacggcggtggccagtacctgatgccgggcggcatcgacccccatacccacatgcagttgcccttcatgggcacggtggccagcgaggacttcttcagcggcaccgcggccgggctggccggagggaccacctcgatcatcgacttcgtcatccccaacccgcgacagtcgctgctggaggccttccacacctggcgcggctgggcgcagaaatccgctgcggactacggcttccacgtcgccatcacctggtggagcgacgaggtcgcccgggaaatgggcgagctggtggcacagcacggggtgaacagcttcaagcacttcatggcctacaagaacgccatcatggccgccgacgataccctggtggccagcttcgagcgctgcctggagctgggcgcggtgccgacggtgcacgcggagaacggcgaactggtcttccacctgcagcagaaactcctcgcccagggcctcaccggccccgaggcgcatcctctgtcgcgtccgccgcaagtcgagggcgaggccgccagccgcgccatccgcatcgccgagacgctgggtacgccgctgtacctggtgcatatttccagccgcgaggcgctggacgagatcgcctatgcccgcgccaagggccagccggtctacggcgaggtgctggccgggcacctgctgctcgacgacagcgtctaccgccacccggactgggccaccgcggccggatacgtgatgagcccgccgttccgtcccgtcgaacaccaggaagcgctgtggcgcggcctgcagtccggcaacctgcataccaccgccaccgaccactgctgcttctgcgccgagcagaaggccatgggccgcgacgacttcagcaagattcccaatggcacggccggcatcgaggaccgcatggcgctgctgtgggacgccggggtcaacagcgggcgcctgtcgatgcacgagttcgtcgcgctgacctccaccaacaccgcgaagatcttcaacctgttcccgcgcaagggcgcgatccgcgtcggcgcggatgccgacctggtgctctgggacccgcagggcagccgcaccctctcggccgccacccatcaccagcgggtcgatttcaacatcttcgaaggtcgcaccgtgcgcggcattcccagccacaccatcagccagggcaagctgctctgggccgcaggcgacctgcgcgccgaacccggcgccggacgctacgtggagcgcccggcctacccgtcggtgtacgaagtgctcggccgccgcgccgaacgccagcgcccggtcgccgtcgagcgctga

SEQ ID NO: 6971 - DNA, 1017 bp, Pseudomonas aeruginosa
aggccggacggtgccgtattgccgttgactgccccgagaagaaacctgaagagaggctacaaccgtgatcgattccctgaaccacctcccccgtccggacgccggcgcggacacgctcgccgagcgcttcgccgacctcgcgccgccgctcaacgcccgccaggccgccctggaaagcgcccgctgcctgtactgctacgacgcgccctgcgtcaacgcctgcccgaccgagatcgacatccccgggttcatccgcagcatcgcccaggagaatgtccagggcgcggcgcagaagatcctctcggcgaacatcctcggcggcagctgcgcccgcgtctgccccacggaaatcctctgccagcgggcctgcgtacgcaacaacgcccaggaatgcgcaccggtgctgatcggccagttgcaacgctacgccctcgaccacgccggcttcggcgaacatccgttcaagcgctcgccggccaccggcaagcgcatcgccgtggtcggcgccgggccggccgggctgtcctgcgcccaccgcctggccatgcacggccacgacgtggtgctcttcgaggcccgcgccaaggccggcggcctcaacgagtacggcatcgcccgctacaagctggtggacgacttcgcccggcgcgaagtggaattcctcctgcagatcggcggtatcgaactgcgccacggccagcgtctcggcgacaacctggcgctcggcgccctgcacgacgagtacgacgcggtgttcctcggcatcggcctggccgccagcaagcgcctcggcctggaagacgaggacgcccccggcctgctcgccgccaccgactacatccgcgagctgcggcagagcgacgacctgctcgacctgcccgtcgccgaccgttgcatcgtcatcggcgccggcaacaccgccatcgacatggcggtgcagatgagccggctcggcgcccgcgacgtcaacctggtctaccgccgtggcttcgaggaaatgggcgccaccggccatga

SEQ ID NO: 6972 - DNA, 1689 bp, Pseudomonas aeruginosa
gcaagagatcgccaaggccagccaggtgcgcctgctgacctgggcccgaccggaacgggtactgctcgacgagcatggccgggtgcgcggcatgcgcttcgcccgcacgcgcctggagaacggtcgcctgggcgacaccggcgagcacttcgaactggccgccgacgccatcttcaaggccatcggccaggccttcgaaggcgccagcctgggcgatccgctggcagcgcaactgcggcgcgacggcgagcgcatccaggtcgacggacagatgcgcaccagcatccccggcatctacgccggcggcgactgcgtggcgctcggcgaggacctcaccgtgcaggcggtgcagcacggcaaactggcggcggaagcgatccacgcccaactcatgctcaacgtggaggctgcgtgatggccgacctgtctatcgaattcgccggcatcaagtcgcccaaccccttctggctggcctccgcgccgcccaccgacaaggcctacaacgtggtccgcgcctaccaggcgggctggggcggggtggtctggaagaccctcggcgaagaccccgcggcggtcaacgtgtcgtcgcgttattccgcgcacttcggaccgaaccgccaggtgcaggggatcaacaacatcgagctgatcaccgaccgctcgctggagatcaatctgcgcgagatcgcccaggtgaagaaggactggccggaccgcgcgctgatcgtgtcgctgatggtgccctgcgtcgaggagtcgtggaaatacatcctgccgctggtggaagccaccggcgccgacggcatcgagctgaacttcggttgtccccacggcatgcccgagcgcggcatgggcgcggcggtaggccaggtaccggagtacgtggagatggtcacccgctggtgcaagacccactgctcgctgccggtgatcgtcaagctcacccccaacatcaccgacatccgccagtcggcgcgcgccgcccatcgcggcggcgccgacgcggtgtcgctgatcaacaccatcaactcgatcaccagcgtcgacctggagcgcatggtcgccctgcccgtggtcggcacccagagcacccacggcggctactgcggctcggcggtgaagccaatcgccctgaacatggtcgccgagatcgcccgcgacccgcagacccgcggcctgccgatctgtggcatcggcggtatcggcagttggcgcgacgcagcggaattcgtcgcgctcggctgcggcgcggtgcaggtatgcacggcggcgatgctgcacggcttccgtatcgtcgaggacatgcaggacggtctcgcgcgctggatggacagccatggctaccagcggctgtccgatttcagcggcggcgcggtgggcaataccaccgactggaagtacctggacatcaactaccaggtgatcgcccgcatcgaccaggacgcctgcatcggttgcggccgctgccatatcgcctgcgaggacacctcgcaccaggccatcgccagcctgccccgggccgacggtacgcaccgctacgaagtgatcgacgccgagtgcgtgggctgcaacctgtgccagatcacctgtccggtggagaactgcatcgaaatggtgccgcaggacaccggcaagccctatctcaactggacccaggatccgcgcaacccctaccgcgaagcctcctga

SEQ ID NO: 6973 - DNA, 912 bp, Pseudomonas aeruginosa
cgatgttcgccccaaatacccggtggccaaggccaccggcctcgacgtcaacctgctgatcctggtttccggagcgctgatgaccctcacggtgttcttcggcatcgccggtctgaccctgctgtcggccatcgcggtcccggcgatcgtcgttctcggcagctactcggtatggctcgcggtgcgcgacgccggcggcctggcggcgctgcagcaggtgacgccgagcgcgccgctgagcctctcgaccgcgatcgccctggtggtcggctcgttcgtcagcgccggcaccctcaccgccgacttcgtccgcttcggccgcagcgcgcgtaccgccgtggtggtgtgcctggtggcgttcttcctcggcaactcgctgatgttcatcttcggcgcggccggcgcggcggcggtgggcaagtcggacatctccgacgtgatgatcgcccagggcctgctgatcccggcgatcctggtcctcggcctgaacatctggaccaccaacgacaacgcgctgtatgcctccggcctcggcttcgccaacatcaccggcctctccagccgcttcctggcgatgctcaacggcgccctcggcaccctcgccgcgctctggctgtacaaccacttcgtcggctggctgaccttcctctccgccgccatcccgcccatcggcggggtgatcatcgccgactacctgagtcgccgccggcgctaccgccagcacccctgcgcggacatccaggcgatcaactgggcggcgatcctcgccgtcgcctgcggcaccgccgccggccactggctgccggggatagtgccggtcaacgcggtgctcggcgccgccatcgcctacctgctgctcaatcccctgctgagccgcagcccgaacaaaccagaagaggtcctccatgctga

SEQ ID NO: 6974 - DNA, 471 bp, Pseudomonas aeruginosa
aatggcagatcgccaacggcgtgcagcacgtgcgcagccacgtcgacgtctccgacccgaccctcaccgcgctcaaggccatgctcgaggtgcgcggcgaagtggcgccctgggtcgacctgcagatcgtcgccttcccccaggagggcattctctcctaccccaacggcctggaactgctggaggagtcgctgcgcctgggagccgacgtggtgggggcgatcccgcatttcgaattcacccgcgagctgggcgtcgagtcgctgcacaaggccatcgacctggccaagcgctacgacctgccggtggacgtgcattgcgacgagatcgacgacgagcagtcgcgcttcctcgagaccctggccatgctcgcccatcgcgacggcctcggcgcacgggtcaccgccagccacaccacggcgatgcactcctacaacggcgcctacacctcgcggctgttccgcctgctga

SEQ ID NO: 6975 - DNA, 1953 bp, Pseudomonas aeruginosa
ctcgaagcggttgccgttgagctgctggtcgtggcgctggaggaatgcgttggagcgcaccaccccgctgttgtcggcgttgtagcggtaggtctcgaggttgcggtaatcgcgctcggcgtcgtagtggtagaaggtgttgcgccagcgcgtgctgtcgctgacccggtattcgaggatcgagcgcagccagcgcacgcgctgttcgtagcggccatcggcgacattgtagttctcgcggcgacggctcttgtcgatcttcagctcgccggcgtagggattgagcaccggcgtgccccagtaggggctgtcttcctgctcgtcctggtactccagggccagggtgtgggaaaggtccggggtcaggtcgctgagcagggagaaagcgacgttccacgattcgcgcgaattgcggtcgacgtagccgttgccgccgctgcggctgacgtccaggcgcacgaagtgcttcggctcggggccgatgcccagggcctggttgaagccgaaggcgacttccgaatcgtcgtagctgccgtagcgcacccggccttccatgaaatcgccgtagcggtcggcgagcttgctgatgtagtccagcgagccgccgacggcaccggcgccgttgaggaaggaggacggaccgccgaccagctcgacgcggtcgacgatccagtcgtccagcggacgcatggcgctgctgtattgcaccggaatgccgttgaacaactggttgacctggttcgagctgaagccgcggtaggtgacgaagccgccgaagccgggcggcgccgaggcgttcacgccgggcaggctgttggcgatgtcctgggtgctgcgcaggccgcgccgctcgaagctggcacggttggccacgcttaccgagccgggagtctcgcgcaggctcaggcccaggcgcgagccgccgccggcgctgtcgtcgagatcgagggccggcggggtttccccggcggcgccggcgctgacggtgagggcgggcagttcggtgggttcctcatcggcccagagcaaggccggaacgccggccagggtgaggttgagacccagcgcgaggacgcggcgggccgtggagtgctttttcatcgagcgatcctgaagcaaggcatggtgggcacgcccgcctcgcccggatggacagcggcgagcgctgcgcggacgaggcaggacgggcgacggatgcaaatgcccggcgcggcgggcgttcaggatcaggcgggggaagcgcgcgggttggccggcggccagacgtatcggggcggcaccggctcgcgcgtggcgggcgggcggaaacgcgcctggcgtcgccgttgcaagcgccaggaccagatcaccccgagcgcgacgaacagcaccagagcgctgcacatcgggcagctcatcggcaactggggattgaccggtgccggatcgccggcggacccgtcgtcgggatccagggatagccattggctggcaccggcgacgcagaacagcccgacgctggccttctgccccttgtcgctgcccactcccagcgcctgcaggtgcaggacgccgcaagccagcgcgttgaccagcacgcaggcacagagggcgaagctcagccactgcagcagcggcgagcgggagttgggagcgattctcatgaccgcgcactctagcatcctgacccgcaaattccccgcgcttctgcgctgcggtgcatcgccgcagcccgaggacacgacgcacggcgacgagcggcgtatcaggggtgacttgggagtttcatatggcgccgctataatcgcccgctcaggcggcccttcgggtcgctcccgccttccgttcgaggggcgctgcagcaggcctaggcctgtcaggctcgaacggagcgcgctctcaggccggcctcgccggtctgtcaacgcaccaacggcgcccattcgcagacaacgaatggagagttacgcatga

SEQ ID NO: 6976 - DNA, 6855 bp, Pseudomonas aeruginosa
ggctcgtacaacagcgcctccggcacgctcgccagccaggccggcatgagcctgcgcctgggcggcggcgccctgcgcaaccagcaggacggcctgatcttcagccaggccggcgccctcgaggtgcaggccggcagcctggacaaccgccagggcacgctccaggcccagggcgacaaccggctgcgtatcggcggcgcgctggacaaccagggcggccgcctggacagccgggccggcaacctcgacctgcagagcggcagcctcgacaacggcgccggcggcgtgctcaacagcgccaagggttggctgaagctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggcggcggcctctacgccagcggcctgctcagcctcgacggccagcgcttcctcaaccagggcgcggcggcgggccagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagctcgcggttggtcgctggcggcctgaacaacgcctacggcgtgctggaaagcgccaaccaggacctcgacctgcaactgggcagcctggccaacgccggcgggcgcatcctccataccggcaacggcaccttcggcctggattccgggcaggtgatccgcgccggcggcgaactgaccaccaatggcctgctggacatccgcgccagcgaatggaccaacagcagcgtgctgcaagccggacgcctgaacctggacatcggcaccttccgccagacggccgagggcaagctgctggcggtgcagtccttcactggccgcggcggcgactggagcaacgacggcctgctggccagcgacggcagcttgcgactcgagctgagcggcggctaccgtggcaacggccgcgccaccagcctcggcgacttcgccctgaacgccgccagcctcgacctcggcaatgccgccagcctcgccggcggcgccaatgtcacgcttggcgccggcaacctgctggtcaaccgtgggcggatcaccgctgccggcgacctcgtggccagcgccgcgagcctgaacaactacggcaccctgggcggcggtggcaacctgcgattgaacgcgcccgccctgctcaacgagcgcgggttgctgttcagtggcgccgacatgaccctgcgcgccggcgacatcaccaacctctacggggatgtgtacagcctcggcaggctggatatcgcccgcgacgatgcggggggctgggcaaatcgcttggagaacatttccgggaatttagagagcacaggtgatatgcgtttctccgtgagttcacttctcaatagaagggaaaccctagagattgaaggtgacttgcagaatagcgctattggcgtccgctgtacggggtgtcagctttctgagaggtggggaaaaactaggtcttcgagcgagcttgtctggatcagggaatataagtctacattgggagagtcttctgccgctgcttcaattacggctggtcgagatctgcttgttgtaggtgcaagcctgcagaatattgcttctaatataagtgctgtaagagacgccacgctatctctgagtaatttcgaaaacaaaggttatgcgttaggggaatatgcggtcaggggcgtttattcgccgccgagtaaatttggcgaagaattgcttatgcgcatattggcgtataacgctgtcaacgatcccagttatggggagggatatgcgagcacaggggggagacttccgaatattcattatttcgacaagaattttaatgaaaaagtctctccgctggaggtcattcatggaaacgggaaaaatggtgggccgggttggcacctgtacttcggtaccttagatgttgagtatccgggcacagatcgctggaataaggctattggacgaataccggcgccgaattattcatcgaaaaaaacggatgctattccagatctacttaagggattggctcctctcgatgagttgacgattaacaaaggggcgaactcaacggttggtgctgtcgtgcaagctggcggtcgtgtaacggtgaatgctgcggagagtttcaataactctgtcctacagggatttcaggccgttcaggaaacccagttacctcatcaggacatagctgtttcaagcacgacgagcgccgtagtgactctgaagagtcaactgccagcggatttggcaaggcaacagatcaatcctctcaccttgccgggcttcagcctgcctcaaggccagaatgggctcttccgcctggcgtcccaaggagcccaggtgaaccaggcaagtggtgctctgaaatccgccagcgatctcacccagagcggccatggcgtatctgtatccgcacaggcaggcagtgacgcaagtggctggagtacccaggcgcgtcgtgtcggcgatgatcgggtcacctcgcttaccggttccgcctatcaaggccgggtagctgaggctatcgatgcgctacgggcttccgcgccaatctcgggcgacgggggaaacactggccgtttccaggccggtgagcaccaggcgaccacgggactgggtggactcgtcgagggcaatgcatcgggtcacagcggcaatggcgtcatcctcgccgatctgcgcggtggtctaccctcgttctcaagccttcccgcggctgatcgtattcaaggcacagcgcccggtcacgatgggaatggaactattctcgccaattggcagggtgcgcaggcgacggtccaggcctcgccttcgacagtgcgtgtagagggggtagtttccagtccaggtggcaatggcagcatccttgccgatctgccggctgagcagtcgtcggtgcaggcactgccttcggccgttagggctcagggcagcctgcctcgcctcgaagagcggagcgccgttcttgccgagcctccggttgggcagccagcgttgcaaaccctgccgtcggttgcgcgcgttgagggcgtgcccagcaatgccacaccgagcaacagccacaagtatctgatcgagaccaacccggcgctcaccgagctgaagcagttcctcaactcggactacctgctcggtggcctgggtatcaatccggatgacagcaagaagcgcctgggcgacggtttatacgagcagcgcctggtacgcgaagcgatcgtccagcgtacggggcagcgcttcatcgccggattgaacagcgacgaagcgatgttccgctatctgatggacaacgccatcgccagcaaggacgtattgggactgacccctggcgtcaccctcagcgccgcccaggtggccgcgctgacccacgacatcgtttggctggaagaagtcgaggtgaatggcgagaaggtcctcgcccccgtggtctacctggcccaggccgaggggcggttgggcccgaacggcgcgctgatccaggggcgcgacgtgaacctgatcaccggcggggacctgaggaacgccggtaccctgcgcgcgcagaacgacctcagcgcgacagccggcaacatcgacaacagcggcctgatcgaggccggcaaccgcctcgacctgctggccagcggctccatccgcaatgaccagggcggcatcattgccgggcgcgaggtaagcctctccgcccttaccggagacgtcatcaatgaacggacggtgacccagcaccagtcctcctacaggggaaccggtaccactgaggcatttgccgatagcgccgcgcgtatcgaggctgcgcagaagctgaccgtttcggcaggtcgcgatgtagccaatattggcggtgtcatcgacagcaagggcgacctcgccttgcaaggcggcagggatgtcctggtttcggctgcggtagcggagcggggctggacggcaggaagccaggcataccagacccagacgacccagatgggcgccgaagtcgtggcggggcgcgatatcagcgtcagcgccggacgcgatatcagcgtcgtgggcagccgcatcgacgctcgtcacgacgtgacattcgaggcgggtcgcgatgtgggcctggtcgcggctgccaacgaagagcatgcctatggcaagaccaagaaggtcactttccaggacgacaagatcacccagcaggccactcgcgtggacgctggcggcgacctggcgatcaatgccggacaggacctgcggctggtcgcgagccaggccagcgccggcgacgaagcctacctggtggccggcgacaagctggagctgctggccgccaacgacagcagttactacctctacgacaagaagagcaaaggcagcttcggtagcaagaagacccggcgcgacgaaatcaccgatgtgacggcagtgggcagccaaatatccagcggcggcgacctcaccctgctcagtggcggcgaccagacttaccagggcgcgaagctggaatcgggcaacgacctggccatcgtcagcggcggcgcggtgaccttcgacgcggtgaaggacctgcaccaggagagccacgagaagagcaagggcgacctggcgtggcagtcgtcgaagggcaagggccagaccgacgaaaccgtgcgccagagccagatcgtggcccaggggaatctggcgatcaaggccgtggaagggctgaagatcgacctcaagcatatcgaccagaagaccgtgagccagaccatcgacgcgatggtgcaggcggatccgcaactggcctggctgaagcagatggagcagcgcggcgatgtggattggcggcgcgtgcaggaactgcatgacagctggaagtacagcaactccgggctgggcgtcggcgcgcagttggcgatagcgatcgtcgtgacttacttcacggcgggcgcagccagcggggcgattgcaacggccggggccggaacctccatggcaggcgcgaccgcagccgctaccgctacgacttcggcgggctggttgaacgcggcaggtaccgcagcgctcagcggcgtggccagcaatggagcgatcagcaccatcaacaaccggggaaacctgggggatgtcgtcaaggacgtgacctccagcgatgcgctgaggggctatgtagtcgctggcacgactgcggggctgactgccggcgtctacgacaaatggacctcgacccagaccggcacctcgaccgctctaccgaacaccggggccgtggcgcccgccgcagggttgggcacctggcaaggcgtgggccagttcacctcgaaccagttgctgcagaatggtacttcggtgcttttggaccgggcgctgggcggcaagggcagcctgggcgatgcgttgcaaaacagcctggcaaatgcctttgcggcctacggcttcaagctgattggcgacaccacccatggcatgctggacgacggcagcctcggcaagatcggcttgcacgccctgatgggaggtctggccgccgaagcggtcggtggcgatttccgtaccggagccctggctgcgggagttaacgaggcgctggtggatagcctcgccaagcaatacgccagcctgcccatcgatgacaagaagggcctgctgatcatgagttcgcagttgatcggcgtgctggcggcttcgacgcagggcgatgcggacgccaagagcttgcagacgggggcctgggtggcggggaatgccacccaacacaactacctcagtcattggcaggaggagaagaagcggcaggaggtcgatggctgcaaagacaaacagctctgcaaaaccggaatagaagccaaatgggcaattatttcggcccagcaggatgtcggtatcatcgtaggtgttggaggaggcatcggtctttcgacagctgaaaccgcagtgggtgtttatgagctggtcaagaactggagggaaacctatgcagctctggagcagttggccacttcgccagagttccggcagcagtttggcgataactacctgaaggggctggaggagcgcgccgcattcttgacccaggcatacgaggatgccggctggcaaggttcggtcacagctggtgtcgagggcggtaggttcgctgcggaacttgttggcgttctgacggcagtgaaaggtggcgcgcagataaccgccaagctgccaacagcagccaagaacctggtcaacgcgattgcggagtcacctgtttccggtagtatgagttcgcagctcggggcagtgggggacttgggtcggctgggtgggggggcaaaaggagcgactcctaagactgaaacgtattttagagtcgaaggcggtggctccggtgcagcaacgagccaaaatcgaattactgtgaataccgatggcagtattaaaattaaccctggatgctctgggcagctttgtgtcagtgtggggagtgctgatcatgcgagctacttcttaactaacaagcgcccggacgggtcggtagtagtgtttgaggtagatgcaggtcttcataagcagataatggatagtgcgatacctcagcgcccagttccgggcgttccacgagatccgtcggcacccaaaattgtagatccgagccaaccaggcgttgctttagagctgcccaagatgtgggagtcgttacttgaaaagcactcaagcaatgcgcgcttatactctcatgacgagtttttgaaggagtttgggagatga

SEQ ID NO: 6977 - DNA, 1683 bp, Pseudomonas aeruginosa
ggcggggttgtcgctgcgttgggtgcggttgccgaccgcgtcgtaggcatagctgcgcccgccctggacgccgcgttcctcggtcaggcggtccagcgggtcgtactggtagtccagggtgccccagaggctgtggcggtgctgctggatattgccattggcatcgtgctggtagtcgctctgccaggggccgaccttctgccgcagcagttggtagtcctggtcgtactcgcggctgagagtgatgccgttgccccaggtcaggcgcagcagcgggccgaagggcaggtaggcgatctgcccgaccagggtgctcggcgccttgtcgcccactgccagggtcacgctggcgacctggccgccggcgttgcgcgggtagccgatggcgaggccggaggggtagccgatctccagcagttggttggccgcgtcgtagcggtaggtcacgcggtcgagcagggtctgctggtcgaggcggatgctgcgcacctgctcgaccaggttgccgcgctcgtcgtagcggtacaccaggctgtcgcgagcgccatcgatggcgcccaggcggccgatgcccttgttgccgtcggcggtgaggtcgtagcggtactgtacgtcgaggctcgggtcgctcggcgagcggcgctcgaccagccgattgagggcgtcgtagcgatactcggtgaccgcaccgcgagcgtcggtgcggcggatgacgttgccggcggcgtcgtgctcgaaggtggtggtgccgctgtccgggctgaccagtcgggtcaggttgccgaggccgtcgtattcgtagcgggtggtgacaccgcgcgggtccttgacctcggtgaggttgtcctgggcgtcgtaggcgagtcgggtcttgccgccgaggggatcgctctggccgaccagccggtcgagggcatcgaaggcctggctgtgggcgaactggcgcgggttggtttcgccgaccggattgtcgttgaggtcgtaggcgaagctgcgtgtctggccgccggcgccgaccgcacggagcagccggccaagctcgtcgtaggcccattgctgctggcgcaccaggctgccgctggcgtccttgatgcgctgggcggtgcgattgcccttggtgtcgacgtcgtattcgaggcgttcgccgaggttgttgccgatcgctaccaggcgccgtgcgtcgtcgtattcgtagctcagccaactgccgtcgccgcgggtgacgcgggtgatctggccgaccgcgtcatagtcgaagcgggtggtgctgccggcggtgctgacggaggccagccagccgtcgacgccggtgtaggcgaggctgctggtgacgccgttggcatcggtgatgctgccgggcttgccgcgctcgtcatagtcgccgaggcgggtgacctggccgagggcgttggtcacctgggtcaggttgccgcgactgtcgtaggcatagagggtgacgtcctgcacatcggtgcgcggaccgtcggcgcgcttgatcaggccgagggcgttgtagctgtagctccaggcgcgctcggccgcctgcgcgggcagggcgagggcgcaggccaggacgagggcgccgaggcgggggaagtatggggggatgcgcatgggggtcggccttgtcagcgggtggtgacggtctcgccggtcttgcgtccctcggcgtcgtactggtag

SEQ ID NO: 6978 - DNA, 1284 bp, Pseudomonas aeruginosa
ggtggaggaacttcagttgcagccagtcgcgctcggggccgaggcggcgtgggtcgaggactaccgcgccgatcaggcggccctggtcgaacaggccgaggaaccagccgccgcggtcgaagcagtcgagcaggatcggcgtgtaatgctcggcctcgccctccggccagccgcgcatgtcgtagaactcggggcgcagcaccagttggccggcctcgacggaatacaggtgttcgatcacttcgctgcggtcgatctcccagaccagggggatttcgtcgcggcgcagcaggcgttcttcggtcatcgtggtttccttgcgctgaggccgtacatcagcggcaggcgcggacgatcggcgggcggcagcatgcgtccgccgccgccgtcgcgcatgccgtcgaagccggcccagccgttggcgtaggggtattcctccagccgttcgagttgcaggccggcgccgagcagggcgccgatcacatcggccaggccccactggaactcgtagctgggatgagggttgctgaagttctcgacgccggcgcggtagccggagggcgccaggctggcgccggactcggcgacatagtcgctgacgccgctctcggcgatcggctcgcggctgaagtagtcgtaggccggttgccagtgtgggtcgaagtacagggcgaaaggatggaactccaccaggacgaagcgcccgccgggaaccagtacctgggcgatgccgtcggcccagcgcttgaggtcggagagccagaccagcgtgccgtaggaggcgaagacccgttcgaagcgttcgccgcgggtggcggcgacgggcagccagcggaggatgtcgtcgcgctggaagtcggcggcgatgccgctgtcgcgggacagctggcgggcgaagtcgatggcgctgtcggcgatgtcgaccccggtgacgcgggcgccaaggcgcgccaggctcaggctgtcctgtccggcgttgcattgcagatgcagcaggcgcaggccgtcgagatggccgagcagttgcagttcctcgggatagagcgtggaaccgccgttgcggaagaaggcggcctggtcggccttgtggctgttgtgcgcccgggtggcggcgttccacgacagccggttggcctcgtgcaggtcggatcgcatggttcgactccttccctggagtgcgccaccgcgcggatggcgggtccgggggattacatgtccttgatgctgcgcacctggtccttgttgacgcgggtgcgcttgccgtccagttgctccagttcgtag

SEQ ID NO: 6979 - DNA, 963 bp, Pseudomonas aeruginosa
gggacaatcggcgttcgcctcaatcgaacgacaaggatgttctcgatgcgccgactcttgcgcccggtattctgcgccgcgctcttctgcctgtacccagcgctggtccaggctgccgccgaaagcgaaatcctcggcctgttccagcgctggcaggccgcccacgggcagcgcagcggcaaggccctggaaggggtctatgcgccgcgcctggactactatggccgcgcgcagacgcgcgagcgcaccctctccgccaagcaggccttcttcgcccgccatcccgacttcgagcagcgcatcgtcgctgcgccgcagatcgtgccgggcgaccaggaaggccgctacgaggtgcgcttcgtcaagcaggtacgcctcgacggacgcctgcgcaactatccggggctgctcctggccgagcgcgccgggccgggcgatacctggcgcttcgtcggcgagagcgacgagatcacccgctacgccgtcgacccgcgctacaccccgctggctcgcggccgcttcgccggtgccgaagcggacttcgcctgggtagtggcccacgcgccgaacagcgccgccttgtgcgacgaatacgaggattgccgctgcgacctctggagcgccgacgcgcgcgtcccgcccaagccgctgggcagttgcaccggcgcggtgctcagcgtcctcggcggcctcgacgacagcggccgcgagcgcctgcaactgctgcgtacctggtggaccagcacctggaccaagtcgtcgctgctggaaatccgcgacggccagtgggtgcgggtgctgccggacatctccaccacctgggacgacgccgaggccgaactggtgctgtacaaggccgacccgcagcagccgggccgggtgctggtgaccgaaaccgtgatggacgacgagggcgactggagccaccgcacccgcagcgaggcgctgcgccccgtaccctga

SEQ ID NO: 6980 - DNA, 1617 bp, Pseudomonas aeruginosa
cgccggccccttgggctgggcggcgccaggccgtacaatcgacggctttatggcgagcgtcgccgcagtccaggttcccgcatgcgcatccacgtctccttcatcgaccgtgtcggcatcacccaggaggtgctggcgctgctgggtgggcgcaacctgaacctggatgcggtggaaatggtgccgccgaacgtctacatcgacgcgccgaccctcagtcccgaagtgctggaggaactgcgcgcagcgctgctgggcatccgtggcgtgcaggcgatgaccgtggtcgacatccttcccggccagcgccgccgcctgcagctcgatgcgttgctggcggcgatggccgatccggtgctggcggtggacggcaagggcctggtgctgctggccaacccggccttcagcgagcgctgcggacgcgacccggccggcgagcggctggccagcctgttcgacgatgaaaccctggaggatgcgctggtcgagcagggcttccgcctgccgctgcgcgaagtgaccttcatgggccaggccctgctgctcgatgccacgccgatcaccgaagggccgggcgagggcgagcggcacctggccggcggcctgctgaccctctacgaaccgaaccgcatcggcgagcgcctggcggccttgcaccatgaccatgccgaggggttcgagatgctcctcggcgattcccagccgatccgcaccctgaagacccgtgcgcagcgcgtggcggcgctcgacgcgccgctgctgatccacggcgagaccggtaccggcaaggaactggtggcgcgcggctgccatgccctgagtgcgcggcacaactcgccgttcctggcgctgaactgcgcggcgttgccggagaacctggccgaaagcgagctgttcggctacgcccccggcgccttcaccggcgcccagcgcggcggcaagccgggcctgctggagctggcccaccagggcacggtgttcctcgacgagatcggcgagatgtccccctatctgcaagccaagctgctgcgcttcctcagcgacggcagcttccgccgggtcggcggcgaccgcgaggtgagggtcgacgtgcggatcctcagcgccacccaccgcaacctggagaagatggtcgccgagggcagcttccgcgaggacctgttctaccgcctcaacgtgctcagcctggaagtcccgccgttgcgagagcgcggccacgacatcctgctgctggcgcggcacttcatgcagcaggcctgtgcgcagatccagcgcccggtgtgccggctggcgccgggcacctacccggcgctgctgagcaaccgctggccgggcaacgtgcgccagttgcagaacgtgatcttccgtgccgctgcgatctgcgagagcagcctggtggatatcggcgacctggagatcgccggcaccgccgtggcgcggcagaacgacggcgaggtgggcagcctggaggaggcggtggagggcttcgagaaagccctgctggagaagctctacgtcagctatccatcgacccgccagttggcggcgcgcctgcaaacctcgcacaccgccatcgcccaccgcctgcgcaagtacggcatcggtccgcgcgcctga

SEQ ID NO: 6981 - DNA, 1014 bp, Pseudomonas aeruginosa
cgtggcccgggcaaggcgagactagccaaagcgccggcccggcagaaccgggcgcgacgcacaacacttgtgccggaacggaaggagtcgatggacaaattgaatgccctggcgatgttcgtcgccactgccgaaaccggtagcttcagccgtggcgccgagcgcctgggcaagacgccctcggcgctgaccaaggccgtcgcccacctggaagcggaactcggtgcccgcctgttcgagcgcaccacccgcagcctggcgctgaccgaggccgggcagatctacctggaggcggctcgtcagtccctggaaacgctgcgcacggcggggcaggagatcgaactgctggagtcggagttgcgcggcgaactgcgcctcgccgcgccgccgtcgttcgccgcggcgttcctccagcaggcctgcgccagcttcctcgaggcgcatccgcggatcagcctgcgggtggacctcgacgaaaccttcctcgatctcagcgaaggcggctacgacctcggcctgcgcgacggccccattgacctgccggggctggtggcgcggccgctggcgccgaaccagatcgtgctttgcgccagccccgcctacctggcgcggcaacccgcgccgcaaggcccggaggatttcgagcggcacgcctggctggtcttccagcacccttcgctgaaccagaacttctggtggatggagcgcgacggcgcccgccagcgtatcgaccagccgcgcccgcgactggccagcgacaactacgacttcctgctcgcccacctgctggccgggctgggcctgcagttctgcccgcagtggagcgtcgcgccgctgctcggtgaagggcggctggtgcgcctgctcggcgactaccacttcgacccggggccgttcgggccctccatccatgtcctctatccggggcaccggcgcaacacgcggaaggtccgcgcgttcctcgagcacctgcgcgccagcttgcagcgacaggggctgtgccatcggctgtaa

SEQ ID NO: 6982 - DNA, 393 bp, Pseudomonas aeruginosa
ggatccagcatgagcaagttgcgctttaccaccgaccacgaatggctgcgccaggacgacgacgggctgctgaccgtcggcatcaccgcctacgcccaggacgccctcggtgacgtggtattcgtgcagttgccggaactcggcgaacacgccgccggcagtgaagtggcggtgctggagtcggtcaaggccgccagcaacatcctgatgccgctggacggcgaggtggtggcgatcaacgacgcgctgccggacgccccggagctggtcaaccaggatccgctcggcgaggcctggttcttccgcttccgtccggccgacgccggcgcctgggaaaagctgctcgaccaggccgcctacgaccgcctgctgaacgccaacgccgacgcctga

SEQ ID NO: 6983 - DNA, 1329 bp, Pseudomonas aeruginosa
cctgaacctcggcgccatcgacctgggcaccgacgacgaattcatcgcccgccatatcggcccgcgtgccgccgacacccaggccatgctccagcgcctgggctacgactcgctggacgcgctgatcggcaacgtgatccccgacagcatcaagggcagcagcgtgctcgacctgccggccggcatgggcgaggccgaggcgctggccagcctgaaggcgatcgccgcgcgcaatcgcgcgttgcgttccttcattggccagggctactacaactgccacaccccggcaccgatcctgcgcaacctcctggagaacccggcctggtacaccgcctacacgccgtaccagccggaaatctcccagggccgcctggaggcgctgctgaacttccagaccctggtcagcgacctgtccggcctgccgatcgccaacgcctcgatgctcgacgaggcgaccgccgccgccgaggccatgaccttctgcaagcgtctgtcgaagaaccgcaccagccaggcattcttcgcctcccgccattgccacccgcagaccctcgacgtgctgcgcacccgtgccgagccgctgggcatcgaggtggtggtcggcgacgagagcaccatcgaagacttctccgcctacttcggcgcgttgctgcaataccccacctgcgacggcgagatcgtcgactaccgcgaactggtcagccgcttccatgcggtcgatgcgctggtcgcggtggccgccgacctgctggcgctgaccctgctgaccccgccgggcgagttcggcgccgacgtggccatcggcagcgcccagcgcttcggcgtgccgctcggcttcggcggcccgcacgcggcctatttcgccacccgcgacgccttcaagcgggacatgccgggacgcctggtcggcgtctccatcgaccgccacggcaagccggcctaccgcctggccatgcagacccgcgagcagcacatccgccgcgagaaggccaccagcaacatctgcaccgcccaggtgctgctggccaacatcgccagcatgttcgccgtctaccacggcccgcagggcctgctgcgcatcgcccggcgcacccaccggctgaccgcgatcctcgccgccggcctggagcgcctgggcgtggccgtcgagcagaagcatttcttcgacaccctgagcctggccaccggcgcgcgtaccgcggcgatccatgccaaggcccgcgccgccgggatcaacctgcgcgagatcgatgccggccgtctcggcctgtcgctcgacgagaccgtccgccaggccgacgtggaaacgctctggggcctgctggctga

SEQ ID NO: 6984 - DNA, 1656 bp, Pseudomonas aeruginosa
agagggccaggcgctcccggacttcgccacccttgccgccagcagcggggaccgcctgccggtcgagctgctgcgccagtcggcgatcctcagccacccgatcttcaaccgccatcactcggaaaccgagctgatgcgctacctgcgcaagctggcggacaaggacctggcgctggaccgcacgatgatcccgctgggctcctgcaccatgaagctgaacgccgccagcgagatgatcccggtgacctgggccgaattcggcaacctgcacccgttcgccccggccgagcagagcgaaggctaccgccagctcaccgacgaactggaggcgatgctctgttccgccaccggctacgacgccgtgtcgttgcagcccaacgccggctcccagggcgagtacgccggcctgctggcgatccgtgcctaccaccagagccgcggcgacagccagcgcgacatctgtctgatcccgtcctccgcccacggtaccaacccggctaccgccagcatggtcggcatgcgcgtggtggtggtggcctgcgacgcgcgcggcaacgtcgacgtcgaggacctgcgcaacaaggccagcgagcacaaggaacgcctggccgcgctgatgatcacctatccgtccacccacggcgtgttcgaggaagcgatccgcgagatctgcgccatcgtccacgactgcggtggccaggtgtacatcgacggcgccaacatgaacgccatggtcggcctgtgcgccccgggcaagttcggtggcgacgtttcccacctgaacctgcacaagaccttctgcatcccccacggcggcggcggcccgggcgtcggcccgatcggcgtgcgcgcgcacctggcgccgttcctccccggccacgctcgcggcgagcgcaaggaaggcgcggtgagcgcggcgccgtacggcagcgcgagcatcctgccgatcacctggatgtacatccgcatgatgggcggcgaaggcctcaagcgcgcctcggaaatggccatcctcaatgccaactacatcgcccatcgcctggaggagcactacccggtgctctacgccggcggcaacggcctggtcgcccacgaatgcatcctcgacctgcgtccgctcaaggacagcagcgggatcagcgtcgacgacgtggccaagcgcctgatggacttcggcttccatgcgccgaccatgtccttcccggtggccggcacgctgatgatcgagcccaccgagagcgagtcgaaggccgagctggatcgtttctgcgacgcgatgatccgcatccgcgaggaaatccgcgcggtggaacgcggcgagctggacaaggaagacaacccgctgaagaacgcgccgcacaccgccgccgaactgctcggcgaatggaaccacgcctacagccgcgagcaggccgcctatccgctggccagcctggtggaggccaagtactggccgccggtgggccgcgtcgacaacgtctacggcgaccgcaacctgacctgctcctgcccgcccatcgaggcgtacagcgaggagtgacggacgaggagggcgccgccagcggcggcgtcctcgcgtttccggcgatacccctttcccggcgccgcgcttgcgtagcggcgccgcggccacgctcgcgccagcgagcgtcctga

SEQ ID NO: 6985 - DNA, 1290 bp, Pseudomonas aeruginosa
ccactcgcggtttccgcgaaggcgagtgccgcgaactggccggctggatctgcgacatcctcgacgatatcgacaatcccgaggtcggcgaacgggtcaggggccaggtcggcgaattctgccggcacttcccggtctacgctgattgaacaggagcgccgccatggtggcggccaatccgcaagcggagacgagcatgtccctgagtgtcttcgatctgttcaagatcggcatcgggccgtccagctcccacaccgtggggccgatgcgtgccgccgcgcgctttgccgaggggctgaggcgcgaggggttgctggaggccactgccagcgtcaaggtcgagctgtacggctcgctcggcgccaccggcaagggccacggcagcgacaaggcggtactgctcggcctggagggcgagcagccggacacggtggataccgccgcgattcccgctcggctcgatgccatccgttccagcggcgagctgcgcctgctcggcgagcggccgatccgcttcgtcgagaaggaacaccttgcgctgatccgcaagccgctggcctaccatcccaatggcatgatcttccgtgccttcgacgccgccggcctgcaggtccgcagccgcgagtactactcggtgggcggcggtttcgtggtcgacgacgaggccgccggcctcgaccgcatcgtcgaggaccgcacgccgctggcgttccccttcaagaccgcgcggcaactgctcgaccattgcgtccgcgaaggcctgtcgatcagccagttgatggccgagaacgagaaggcctggcgccccgccgaggaaacccgcgccggcctgctgcgtatctggcaggtgatgcaggattgcgtcgaggccggctgccgcaacgagggcatcatgcccggcggactgaaggtcaggcgccgcgcggcggcgctccaccgccagttgtgccagcggccggaggccggcctgcgcgatgctctcagcgtgctcgactgggtcaacctctacgccctggcggtgaacgaggagaacgccagcggcggccgcgtggtgaccgcgccgaccaacggcgcggcggggatcattccggcggttctgcattactacgcgcgcttcatccccggggccgacgacgacggcgtggtgcgcttcctgctcaccgccgcggcgatcggcatcctctacaaggaaaacgcctcgatctccggcgccgaggtcggttgccagggcgaggtcggggtggcctgttcgatggccgccggggcgctctgcgaagtgctcggcggtag

SEQ ID NO: 6986 - DNA, 957 bp, Pseudomonas aeruginosa
cgtgcagcaggtcgagaacgccgccgaaatcggcatggagcacaacctcgggctgacctgcgacccggttggcgggctggtccaggtgccctgcatcgaacgcaacgcgatggcttcggtgaaggccatcaacgcggcgcgcatggccctgcgcggcgacggccagcacttcatctctctcgacaaggtcatccgcaccatgcgccagaccggcgccgacatgaaaagcaaatacaaggaaaccgcgcgcggcggcctcgccgtgaacatcatcgaatgctgaaccgcgccgctgcgccggcgcttcttttctctttcccgacaatcgatcgcggctctccggcagacaggaggccgggatgccatggagtgaaacatgaccgcagaaaccctcgccaagacgcccctgcacgccctgcacctggaactgggggcgaagatggtgcccttcgccggctacgacatgccggtgcagtacccggccggggtgctcaaggagcacctgcacacccgcgagcaggccggtctgttcgatgtctcgcacatgggccagatccgcctggtgggcgccgatgcggcgctggccctggaaagcctggtgccggtggacatcctcgacctgccggtgggccagcagcgctacgcgttgttcaccgacgagcagggcgggatcctcgacgacctgatggtggccaacctcggcgattgcctgctgctggtggtcaacgccgcctgcaagcaccaggacctggcgcacctgcgtcgtcacctggaagaccgttgcagcgtcgagccgctgttcgaggagcgtgccttgctcgccctccagggaccggcggcggtgcgggtgctggagcgcctggcgccgcaggtggcgcagatgaccttcatgcagttcgcccgcgtcgagctgctcggccaggactgctacgtcagccgctccggctataccggtga

SEQ ID NO: 6987 - DNA, 702 bp, Pseudomonas aeruginosa
agacggctacgagatctccgtgcccgccgcccatgccgaggccctggcgcggcgcctgctggccgagccggaagtggcgccgatcggcctcggcgcgcgcgactcgctgcgcctggaagccggcctgtgcctctacggccacgacatggacagcgccaccacgccggtcgaagccagcctcggctgggccatttccaaggcgcgccgcgccgacggcgtgcgcgccggcggcttccccggcgccgagcggatctttgcccagcaggcgcagggcgttgccagcaagcgcgtcggtttcctgccgcaggggcggatgccggtgcgcgagggcgccgagatcgtcgatgcccaggggtgggcgatcggcaaggtcagcagcggcggtttcggtccgagtctcaacgcgccgctggccatgggctacgtgccgagcgagctggccggcctgggcaacgaggtgacggcgatggtgcgcggcaagccggtgaccctggtggtcagcaagatgcccttcgtggcgcagcgctactaccgcggttgagcactggccctctctcgcctcggcgggagaaggcggcgaccggcctcacgggtgtttcggccgctgccgttgcaggcccagcttcttggcccggtggaataccgctgcggcgggtcttgccggtctgctgcgcgcaccatagcgagccgcgctgctggtag

SEQ ID NO: 6988 - DNA, 1449 bp, Pseudomonas aeruginosa
gagtcgacctggacgccgagggcgtcgccgccgaatcgctgccgcgtttccagcaggcgccccggcagttgcgccagctgtggcgatgggcagcggccagcgtcgccttggccgccgtctgcgccgtgctggggttcttcatcggcctgttcgccgccgactcgctctggccgccgctgctgtacaacctcggcgcggcctggctggtcctgttcgccggtctgcacgcggtctaccgggtcccggccctggccgttgcgtggtcctcggcgcggaggcccagcgcgcgggctgcctggctgcgctggcagcgggacgaacccgacgccaccgccgacagcgcctatgaacggttgctggagcgcctggggccaggccatcgcccacggcttggcccagatcgggcacgctgcgctgtggctggcggcgagcgcggcgctggcgttgtgcctggtagccgccggctggcgtctcgacatgccgcgggccagttccgggcaagcggccgacctcgccatcggtatctgcctgctgctggccttcgcggtgctggtgctggaacgtcgcctcgccagccaagggccggtgcagtggccggaagccccggtcctcgggcaactggcgcgggcgttgatcggtaccctggtgctggccgccctctgtctgttcctggctcgccagggacacccctgggccccgcgcctggcggtactgctcggcctgttgccggcggcgctggcgctggagttgctgggcagggcgatcctggcgatgttcgcgccgcagcgtgccggcctcgaaccgcgcctggtcgccaccagcctgctggccgacctgttgcgctggccgccgcgtcccctgcagcgtctgcagcatgagttgcaccagcgcttcggcatcgacctgcgccaggtctgggccttcggtttcatgcggcgggcgttcctgccggtgctggcggtggtgttgctgaacggctggctgctcagcggcgtacgcgagatcggcatggatgcacggggtgtctacgagcgcttcggcaagccggtcgcggtgctcggccccggcctgcacctggggctaccctggccgctggggcgggtgttggcggtggagaacggggtggtccacgagttggccaccagcgtcgccgccggcgacggcggagccgagccgctcgcgcccgccgaaggtccggccccggatagcgccaaccgcttgtgggacgcctcccacgtcagcgagaaatcgcaggtcatcgccagcctggccgaccgtcggcagagcttccagatcgtccaacatggacgtgcgcatcgtctgccgcatcgctctcgacgacgcggcagcgctggcggcgacctaccgcagcgccgacgtgccgacgctggtgcgcagcaccgccagccgcgtactggtgcatgccttcgcctcgcggaccctcgatga

SEQ ID NO: 6989 - DNA, 1602 bp, Pseudomonas aeruginosa
ggtcctcggcgagcagcgcgcgggcctggccgagcagatcggccaggccgtgcaggccgatctcgaccgcctcggcagcggcgtcgaggtactgggcgcggcggtcgaggcgatccatccgccggccggtgcggcgaacgcctaccacgcggtgcaggccgcgcagatcacagcccaggcgctgatcgcccgcgagcgcgggcaggccgccgcgcagcgcaacgaggcgcaactacaggccagcgtggcgcacgaccgggccagcgcgaaggcccgcgagaccctggccgccgcgcaggccgccgaccggcgtttcgccgccgagcgggaaggctatgccgacgccggccaggctttcctgctggaggcctactaccgccaactcggacgcggcctgggcaaggccaacctgctgctcatcgaccaccgcatcgccggcgccggcgcgccgaccatcgacctgcgcagcttcggcctcggccgcctggattccccgtcttcgtcccgtccgtccgccgctccggcgtccgcggccgggcaatccgcaccatgaggagagcgctcttgagcctcggtcactcccactcgcacagccaccacgagcatcatcacgatcacgatcacgatcacgatcacgatcacgatcacgatcacggcgcacaggccgcgccgccctggcgccggctgctggtcgccgcgctgctggtgctgttcgccgtcgccgccgcttgcctggtgcaggtacgttccggcgaggcgatggtcatcacccgtttcggcaacccggcgcgggtcctgctcgaaccgggcctggcctggcgcctgccgttgccgttcgagagcgcgatcccggtcgacctgcgcctgcgcaccacctccagcggcctgcaggacgtcggtacccgcgatggcctgcggatcatcgtccaggcctacgtggcctggcaggtccagggcgacgccgacaacgtgcagcgcttcatgcgcgcggtgcgcaaccagccggacgaggctgcccggcagttgcgcaccttcgtcggctcggcgctggaaaccaccgccagcgcctatgacctggccgacctggtgaatacggaggcgtcgcgggtgcgtatcggcgacttcgaagcgcgcctgcgcgaacagatcgaccatcagttgctggcgacctacggggtcaaggtggtgcaggtcggcatcgagcgcctgaccctgcccaaggtgaccctcggcgccaccgtcgaccgcatgcgcgccgagcgcgagaccatcgccaccgagcgtaccgccgagggccgtcgccaggctgcggagatccgttcggcggcggagcgcgacgcccgggtgatccaggccgaggcttcggtgaaagccgcggagatcgaggcccaggcacgggtcgaggcggcgcgcatctacggcaaggcctacgccggttcgccgcagctatacaacctgctgcgctcgctggacaccctcggcaccatcgtcaacggcgatacccggctggtcttgcgcaccgatgccgcaccgttccgcgtgctggtcgacgggccgccggcgttccccgccgaagcgccggccaacgggcgccggccatga

SEQ ID NO: 6990 - DNA, 960 bp, Pseudomonas aeruginosa
ccctcctggcggcgctggcctgggcgttttccaacgtccgccagatcggcccggagaaccgtcgccgtagtgctgcgcctgggcgcgctggagcgcctggccggtcccggcctgctgctggcctggccgcagccgctggagcaggtggtgctgctgccgtccgccgaacaggtgatcgaacgccgcgtcgagggcctgctgcgttccgagcaggcgcgtcgcgccgatctcgacgtcagcctgtccagcgacgcgctggccggctccggctacctgctgaccggcgacgccggggtggtgcaactggacgtgcgggtgttctacaaggtcgacgacccgtacgcctacgtcctccagggcgcccacgtgctgccggcgctggaccggctggtggcgcgcaacgccgtgcaggtctgcgccgcgcgcgacctggacaccatcctggtggcgcgcccggagttgctcggcaacgacagcgcggtcgccgagcgccgcgaacgcctgcgcggcgacctggtgcagggcatcaaccacagcctggcggcgttggccgcggccggcagcgggctgggcatccaggtggtgcgggtcgacgtgcagtcgagcctgccgcgcaatgcggtaagcgccttcaacgcggtgctgaccgccagccaactggccgagcagaacgtcgccaaggcgcgcaccgaggcggagaaactcacccaggccgccaccgagggggccgaccgcaccctgcagctcgcccgcgccgaggccggcgaacggctggcccaggcgcgccgcgacaccgccagcatcgttggcctggccccggcgctgggcgcgaccgatgccggcctgctctggcgcctgtaccgcgaacgggtgccggcgatcctcggcaaggccggttcggtcggcagcgtcgatccgcgcgacgatggccgcctgattctgcaaggtgggcagccatga

SEQ ID NO: 6991 - DNA, 528 bp, Pseudomonas aeruginosa
aacggctaccctgcgtcggcatcaaccttcggtacgcgcttccgccagcggaacgcggcgccgagtcgaacaaccaggcgaacgggacgggcaatgacggcaggcggtattccattcacgggcaacggtgcgcggctatcacccggcagggccctgctgtgcgggctggcgctgttgctgtgcggcggcgaggcgctggcgcggcagttgccgagcgacatgctggtgggcttcgtggccagcgcgcagtacccggtcatcaccctgaagaagcccaagcagagcctgctgcgcagcgtgctcaccctggggctggggaagaagaccgtcagctattcggtggcgccgtcggtgcgcatccgcacggcgcagaacctgttcatcgtctatggccgcatgccccagctcaagggcagtttcgtcggcctgaagagcgacaacaacgggcaggtcaagcagatctgggagctcaccgagaaggaagccctggactacgtacgccggccggacgcgcgcttcccgcaatag

SEQ ID NO: 6992 - DNA, 786 bp, Pseudomonas aeruginosa
gcgatatccgcgaacgccaggggttcggcgtggtcgcacgaacagcggcgggcgaagccgccctcggccggcccgaactgttccagcaactgggcatcgacgccagcgaggtgccggagcatgagggaccgatcgccggaatcgccctggacgggcgcttcctcggctggctgctgctgggccgacagcgtacgcgcggaggccgccgaggccatggccgatctgcgcgaactgggtctgggccggcaactgttgctgaccggcgatcgccgggcggtggccgacgccgtggccaagcaggtggggattcgccaactggtggcgcaggcgttgccggaggacaagctgcgccaggtcggcgcggagatcggcagcggtttccggccgatggtggtcggcgacggcatcaacgattcgctggcgctgaaggccggtgtggtcggggtggcaatgggtgccggcggcgccgacatcgccctggcctcggcggatatcgtgctgatcggcagcgacctgcgccggctcggcacctgcgtgcggctcagccggcaatgccggcggaccctgcaggtcaacgtggcgatcggcctcggctggaccctggcgatcgtcgccgcggcagcctttggcctgctcggcgcggccggggcgatggtcgcggcgctgctgcacaacctcagcaccttgctggtgctgggcaatgccggacgcctgctgcgtttcgaggagcccctcgggcagccccggccggccgtggagggacgcgaagaggagggtacaccgtga

SEQ ID NO: 6993 - DNA, 870 bp, Pseudomonas aeruginosa
gcggccacggatttccttgcgccttctagactggaagcgaacccgccgcatgaaccccgaacgagaaaccagcatgtcgagtcgcttcatcgccgcctggtccgcggccaaccgttgcctggaggtgcggggccgggcatggaagggctgaaattctacgcccgcttgctctggcggccgccgcgggaaaccctgctgttcgccctgcgcaccgtcgccgccgggctgctgaccctgtacctggccttcctcttcgacctggagcagccgaagtgggcgctgatgaccgtggtcatcgtcagccagccgctggccgggatggctctcaagcgcagtttcgcccaggtcctcggtaccttcgctggcgccgtggtggcggtgctgatcatggcgctgttcgcccagcaaccgttgccgttcttcgtcgccctgggactctggctggccgctctgcaccgccggcggcaccttgctgcgctacaccgactcgcacgccttcgtgctcagcggcttcaccgcggtgatcgtcgccgtgctgtcgattcccgatccggaaaacaccttcatgctcgccgtggtgcgggtcaccgagaccctgctgggcgtcgcctgcgtggccctggtcagcctgctcagcgcgcgaccgcaggcggtggcgaagggctacttcgcccaggtcgacggcctgatccgcagtaccgcgcggcacgccgcggcggtgatccgcggcgacgagggcgacgagtcgttcaaccagcggcagatgcaactggtcgccagcatcaccgcgctggacggcctgcgccggcacctctatttcgacgcgccgaacctgcgccgcgccgatggcctggtgcagttgctgggtaa

SEQ ID NO: 6994 - DNA, 1125 bp, Pseudomonas aeruginosa
cctgctggtgctgatggcctcgcggctgttgctgctgcgccagcatcgcctgctggtgcgggcgcactgggtcgggccgttgccggcggatatccaggcactgctggatcgtgcgttgcgggtgctggacgcgctggccgagcaggggcgggcggtaccctccgaggtgctggaggagttccaggcggtgcgccaggccttcgatgccgcggcgacgcgcgcggagtcctacgacgaggcgctgagcccggcgctgcgcccgcaggtggcgatcctgcgctgggaatacgcgcggctgttccagcgcctgggcgaagtgctcgaactcaacgatgcgatccagtccggccgccacgccagcagtttctaccgccgtggccaggcgcaggcgctgcacctggactgggcgctggcctcgatgaacgccgtgcgcgctttcgtcgccttgtcctgcgccgcctggctgtggatcaccagcgcctggaacggcgccctcagcagcctgctgctggtcggcgtgatgtgctcgctgatggcgaccttcccgcgtccgctgctggcggcgcagaacttcctgcgcgggctgctgctggcgatcctgatctcggcggcgctgctgttcgtgctgttgccggcatccgccgacttcgagtggctggcgctgtggatggcgttgctgctgtacgtggtcgcggtcggcctgagcagcccgctgagcgccgggatcgccatgggcatcggcctggagaccttgctgatggtggcgccacagaatatcgcggtctactacagcaacgcttcgcagtggttcgagttcgtcggcggcttcctcgccgcggcggtcctcgccgtgctggtgttcgccctggtctatccgttccgcgccgacccgcgcctgcgccggctgctctacctgtcgcgccaggacgtcgcggaaatgtcgcgctgcgaggccagcgaggcgcagcgcttcgccttcgagacgcggatgatcgatcgcctggcggtgatggtcggcctgctgccggcgagccaggagccggctgcggcggaacgtttccagtgcgccctgggctgcgtggtgatgggcgtggcgttgaaccgcctgcgcgagccgctgcatga

SEQ ID NO: 6995 - DNA, 960 bp, Pseudomonas aeruginosa
actggcggtgctgcgcgccgagcgcgcggtgaacgtggcgcgggcggcgctgggcgagtcgcgcgcggcgatcgaggccagccaggcccagttgcgccagcgccgcagcgaggcgcaacggcgctcggcattgcagaagcgctcgatgctatcggtggaagagaacgaaaaggcccagaccgacgtcagcctggcccaggccgagttgctgaggaaccaggccagcctcggcctggcccaggccaacgtggagcttgccgaagccgccttgcagcaggcccgtctcgatctcgaacgtacccaggtgcgcgccccggtcagcggctacgtgaccaacctgcagacccgcgagggcgactacgcccacgccggggtgccattgctggcgctggtggaccgcgattcgttctatgtcagcggatacttcgaggagaccaagttgccgggcatccgcgtcggcagccgggcgcgggtggaactgatgagcggcgagcgcttcgacgggcgcgtgcagagcatcgcccatgccatcaccgaccgggagaatgccgagggctcgcgcctgctggcgaacatcaacccgagctatacctgggtcaagctggcccagcgaattccggtgcgcatcgccatcgatcccgcctatcgccagcgcaacaccttgcgcgccggcgtgaccgcgaccatccgggtgctgcccgcggaggacaccgcgaaagtcgattccgcggcgcccgggactgccttgcggccttgagtcaggccgaaccggtcagtctgtgccggtcatggctcagggttgttcgcggacgatttccgccaggtgcaggatcaatcgctcgtcagcctggttgccgctctgctggcggaattgcctggcctcctcgcgggcgcgctggaaggccgcatcgacgctggcctggccatggctgtcgcgaatccacaggtagaggcccatga

SEQ ID NO: 6996 - DNA, 474 bp, Pseudomonas aeruginosa
ccggccatgcttccgtccccagcctccagcctgtcgtttccgtcgcccctcgagcgccgcgaggccgatccatatgcccgctgcgacaggcagcggcctgcgtgcaacgagtcgcacgagccggcgcaggagcgtcctgaacctgtcgcgacctgcgcattcatcgaggaggagcgccggcgtggcgatcccacgggcttgctttacgcccttgggccgcgggagcggggagagccggagcgggtggcggagtggttggcggcgctggtccaccatttctacctggacggtcccgttgagccgccgaggacaacgctgggaaaggagcgctgcgaaaccgcgccgggcctttgccgctgctgcggccaacccttcgattttcgccacaagcgcgcggcgctgttgctgctgggaacccatttcgccgccagggccgaggcgcaggcggcgtcggtgcgccgctaccggcgctga

SEQ ID NO: 6997 - DNA, 10023 bp, Pseudomonas aeruginosa
acgcgcaactgtccgccgccaacgccccgcaactgctctgcgtcgaccagttggacccggccgttgccgatgcctgggacgagccgcgagtgcgtcccggagcacatcaccttcctccaatacacctccggttcaaccgcattgcccaagggcgtgcaggtcacccatggcaacctggtcgccaacaaggtgctgatccgccgaggcttcggcatcggtgccgacgacgtgatcgtcagctggctgccgctgtaccaccacatgggcctgatcggcggcctgctgcaaccgatcttcagcggcgtaccctgcgtgctgatgtcgccgcgctacttcctcgaacgtccggtgcgctggctggaagccatcagccagtacggcggcaccgtcagcggcggtcccgatttcgcctaccggctgtgcagcgagcgggtcgccgagtcggccctgcagcgtctcgacctgagcggctggcgggtagccttctccggttccgagccgatccgccaggacagcctggaacgcttcgccgagaaattcgccgccagccgcttcgatgcgtccagtttcttcgcctgctacggcctcgccgaggcgaccctgttcgtcaccggcggccagcgcggccagggcattcccgccctggcggtggatggcgaggcgctggcgcgcaaccgcatcgccgaaggcgaaggcagcgtgctgatgtgctgcggccgcagccagccggaacacgccgtgctgatcgtcgacgcggcgagcggcgaggtcctcggcgacgacaacgtcggcgagatctgggccgccgggccgagcatcgcccacggctactggcgcaacccggaagcttcggcgaagaccttcgtcgagcgtgacgggcgcacctggctgcgcaccggcgacctcggcttcctccgcgacggcgaactgttcgtcaccgggcgcctgaaggacatgctcatcgtccgcggccacaacctctatccgcaggacatcgaacgcaccgtcgagagcgaggtgccgtcggcgcgcaagggcagggtcgcggccttcgcggtcacggtcgatggcgaggaaggcatcggcatcgccgccgagatcggtcgcggcgtccagaaatcggtgccggcccaggagctgatcgactcgatccgccaggcggtggccgaggcctaccaggaagcgccgaaggtggtggcgctgctcaatcccggcgccttgccgaagacgtccagcggcaagctgcaacgttccgcctgccgcctgcgcctggaagacggcagcctggacagctatgcgctgtttcccggcctccaggccgtgcaggaggcgcagccgccggcaggcgacgacgaactgctggcacgcatcggcgagatctggaaggcccggctgggcgtggcgcaggtagcgccgcgcgatcacttcttcctgcttggcggcaattccatcggcgccgcccaggtggtcgcccaggtgcgcgacagtctcggcgtcgccctcgacctgcgccaactgttcgaggcgccgaccctgcaggccttcagcgccacggtggcccgccaactggccgccggcctgccggccgaggcaccgatggcgcacctgccgcgcggtgtcgacctgccgcagtcggcggcgcagcagcgtctctggctgacctggcagatcgatccgcagagcgccgcctacaacatccccggcggcctgcgcctgcgcggcgagctggacgaagcggcgctgcgcgccagcttccagcggctggtcgaacgccacgaagcgctgcgcacgcgtttcctcgagcgcgacggcgcggccttgcagcgtatcgacgagcggggcgagttcgcctggcagttcgtcgacctcgccgcgctggccgagcacgaacgcgccgcggctgccgcgcagcgccgcgaagccgaggcgcagcagccgttcgacctggaaaaggggccgctgctgcgggtcagcctggtgcgcctggacgaacaggagcaccagctctgggtcaccctgcatcacatcgtcgccgatggttggtcgctgaacctgctgctcgacgaattctcgcggctctacgccgaagcctgcggcggccagccggccgacctggcgccgctggaactgcactacgccgagttcgctgcctggcaacggcagtggctggacgcgggcgagggcgcccgccaactggcctactggcgggaacgcctgggcgacacggcgccggtgctggaactggccaccgaccatccgcgcacggcgcgccaggcgtcgcccgccgcgcgctacagcctgcgggtcgacgaagccctggcgcgggctatccgcgaggccgcgctggaccatgaggcgagtgtcttcatgtggctgctggcggcgttccaggcgctgctgcatcgccacagcgggcagggcgagatccgcatcggcgtgcccagcgccaaccgccagcgcctggagacccaggggctggtcggcttcttcatcaacaccctggtcctgcgcggcacgccccgggcgcgccagccgttcgccgcattgctcggcgaggctcgcgaggcgaccctcggcgcccaggccaaccaggacctgccgttcgaccaggtgctcgcggcctgcggccagggcggccagttgttccaggtgctgttcaaccaccagcagcgcgacctgtcggcgttgcgccggctgcccggcctgctcgccgacgagctgccctggcacagccgcgaagccaagttcgacctgcaactgcagagcgaggaggacgctcgcggtcgcctgaccctgaatttcgactacgccgcggacctcttcgacgaggccagcatccggcgtttcgccgcgcaatacctggagctgctgcgccaggtcgcggaagacccgcagcgctgcctcggcgatatcgccctggtcgacgccgagcaggcggcgcacctcgccgaatggggcagcgcgccctgcgagccggcgcgcgcctggctgccggagctgctggagcggcaactggtgcagtccgccgaacgcgtcgccctggagtgggacggcggcagcctcggctacgccgaactgcacgcccgggccaaccgcctggcccactacctgcgcgacaagggcgtcggcccggacgtgcgggtagcgatctgcgccgagcgttcgccgcaactgctggtcggtctgctggcgatcgtcaaggcgggcggcgcctacgtgccgctggacccggactaccccagcgaacgcctggcctacatgctcgccgacagcggcgtcgagttgctgctgacccaggcccatctgttcgagcgcctgcctggcgcggagggcgtcacgccgatctgcctggacagcctcaagctcgacaactggccgagccaggcaccgggcctgcacctgcacggcgacaatctcgcctacgtcatctacacctccggctccaccggccagccgaagggcgtgggcaacacccacgcggcgctggccgagcgcctgcaatggatgcaggccacctacgccctcgacggcgacgacgtgctgatgcagaaggcgccggtgagcttcgacgtgtcggtgtgggagtgcttctggccgctggtcaccggttgccggctggtcctcgccgcccccggcgagcaccgcgatccggcgcgcctggtggaactggtgcggcagttcggggtgaccacgctgcacttcgtgccgccgctgctgcaactgttcatcgacgaacccggcgtcgccgcctgcggcagcctgcgccgcctgttctccggcggcgaggcgcttccggcggagctgcgcaaccgcgtgttgcaacgcctgccggcggtggccctgcataaccgctacgggccgaccgagaccgccatcaacgtcacccattggcagtgccgcgcggaagacggcgagcgttcgccgatcggccgaccgctgggcaacgtgctctgccgcgtgctggacgccgagttcaacctgctgccggccggcgtcgccggcgagctgtgcatcggcggcctgggcctggcccgcggctacctggggcgcccggcgctgagcgccgagcgcttcgtcgccgatccgctctcggccgctggcgagcgcctgtaccgcaccggcgaccgcgcgcgctggaacgccgacggcgtgctggaatacctcggccgcctcgaccagcaggtcaagctgcgtggcttccgcatcgagccggaggaaatccaggcacgcctgctggcgcagccgggggtggcccaggcggtagtggtgatccgcgaaggcgtggccggcagccagttggtcgggtactacactggcgctgtcggcgccgaggcggaagccgagcagaaccagcgtctgcgcgccgcgctacaggccgaactgccggaatacatggtcccggcgcagttgatgcgcctggcgcagatgcccctcggcccgagcggcaagctggatacgcgggcgctgccggagccggtctggcagcagcgcgagcacgtcgagccgcggaccgagctgcaacggcgcatcgccgtgatctggagcgaagtgctcggcctgccgcgggtcggcctgcgcgacgatttcttcgagctcggcgggcattccctgctggccacccgcatcgtctcgcgcacccgccaggcctgcgacgtcgaactgccgttgcgcgcgctgttcgaggccagcgaactggaggccttctgcgaacaggtccgcgcagcccaggccgccggacgtaccgacagccacggcgcgatccgccgcatcgaccgcgagcagccggtgccgctgtcctactcgcagcagcgcatgtggttcctctggcaactggagccggacagcccggcctacaacgtcggcggcctggcacgcctgagcgggccgctggacgtggcgcgcttcgaggccgcgctacaggccctggtgcagcgccacgagaccctgcgcaccacgttccccagcgtcgacggcgtgccggtacagcgcgtgcacggcgatggcggcctgcacatggactggcaggacttctccgcgctcgaccgcgacagccgccagcagcacctgcagaccctcgccgacagcgaggcgcaccggcccttcgaccttgagagcgggccgttgctgcgggtctgcatggtgaagatggccgagcgcgagcactacctggtggtgaccctgcaccacatcgtcaccgaaggctgggcgatggacatcttcgcccgcgaactgggcgcgctctacgaggccttcctcgacgaccgcgaatcgccgctggagccgttgccggtccagtacctggactacagcgtgtggcagcgcgagtggctggagagcggcgagcgccagcgccagctcgactactggaaggcccagctgggcaacgagcatccgctgctcgaactgccgggcgaccggccacgcccgccggtgcagagccaccagggcgacctctaccgcttcgacctgagccccgagctggccgagcgcgtgcgtcgcttcaacgccgcccgcgggctgaccatgttcatgaccatgaccgccacccttgcggccttgctctaccgctacagcggccagcaggacctgcgtatcggcgcgccggtggcgaaccgcatccgcccggagagcgaagggctgatcggcgccttcctcaatacccaggtgctgcgctgccggctcgacggacagatgagcgtcggcgagctgcttgagcaggtgcggcagaccgtgatcgatggccagtcgcaccaggacctgccgttcgaccacctggtggaagccctgcaacctccgcgcagcgccgcctacaacccgttgttccaggtgatgtgcaacgtccagcgctgggagttccagcagacccggcaactggccgggatgaccgtcgagtacatcgccaacgatgcgcgggcgaccaagttcgacctcaaccttgaggtcaccgacctcgaccagcgcctcggctgctgcctgacctacagccgcgacctgttcgacgaaccgcgcatcgcgcggatggccggacactggcagaacctgctggaggcgctgctgggcgacccgcagcggcgcattgccgaattgccgctgttcgccgccgaggagcggaagcaactgctgctcgccggcacggccggcgaggcagggctccaggacaccctccatggcctgttcgccgcccgcgtggcggccagcccccaggccccggcgctgaccttcgccggacagaccctgagctatgccgaactcgatgcccgctccaaccgtctggcgcgcgtcctgcgcagtcacggcgtcggcccggaagtgcgggtcggcctggccctggagcgttcgctggagatggtcgtcggcctgctggcgatcctcaaggccggcggcgcctacgtgccgctggacccggaatatccgctggagcgcctgcaatacatgatcgaggacagcggcgtacgcctgctgctcagccacgcggcgctgttcgaggccctcggcgagctgccggcaggcgtggcgcgctggtgcctcgaggaggacggcccggcgctggacgccgaggaccccgcgccgctggcagcgctgagcgggccgcagcaccaggcctacctgatctatacctccggctccaccggcaagccgaagggcgtggcggtctcccacggcgagatcgccatgcactgcgccgcggtgatcgagtgcttcggcatgcgcgccgaggattgcgaactgcacttctattcgatcaacttcgacgctgccagcgagcgcctgctggccccgttgctgtgcggcgcccgcgtggtgctgcgggcccagggccagtggggcgcggaggaaatctgcgagctgatccgcgcggagggcgtgagcatcctcggcttcaccccgagctacggcagccagctcgcccagtggctggagagccagggccggcagttgccggtgcgcatgtgcatcaccggcggcgaagcgctgaccggcgagcacctgcaacggattcgccaggccttcgccccggcgtcgttcttcaatgcctacggaccgaccgagacggtggtcatgccgctggcctgcctggctcccgaacgactggaggagggtgccgccagcgtgccgatcggcagcgtggtcggcgcgcgggtcgcctacatcctggatgccgacctggccctggtgccgcagggcgcgaccggcgaactctacgtcggcggcgccggcctggcgcgcggctaccatgagcgtccggcgctcagcgccgagcgcttcgtgcccgatcccttcgctgccgagggcggccgcctgtaccgcaccggcgacctggtgcgcctgtgcgacaacggccaggtggaatatgtcggccgcatcgaccaccaggtgaagatccgtggcttccgcatcgaactgggcgagatcgaggcgcgcctgctggagcatccgcaggttcgcgaagcgctggtcctggcgctcgacagcccgagcggcaagcagttggccggttatgtcgccagcgcggtggccgagcaggacgaggacgcccaggcggcgctgcgcgaggcgctgaaaacgcatctcaagcagcaattgccggactacatggtgccggcccacctgctgttgctcgccagcctgccgctgaccgccaacggcaagctcgaccgccgcgcgctgccggcgcccgacccggcgctcaaccggcaggcctacgaggccccgcgcagcgtgctggagcagcaactggccggggtctggcgcgaggtgctgaacgtcgagcgggtaggtctcggcgacaacttcttcgaactgggcggcgattcgatcctgtcgatccaggtggtcagccgcgcccgccagctcggcatccacttcagcccccgcgacctgttccagcaccagaccgtgcagagcctcgccgcggtggcccggcacagccaggccagccaggccgagcaggggccggtgcagggcgacagcgcgctgacgccgatccagcactggttcttcgacctgccgctggcgcgccgcgaacactggaaccaggcgctgctgttgcagccgcggcaggccattgacctcggtctgctgcgcaagtccctgcaacgcctggtcgaacagcatgatgccctgcgcctggcgttccgccaggtcgacggcgagtggctggcgcagcatcgtccgctgcgcgaacaggaactgctctggcacgtcccggtgcaatccttcgacgaatgcgccgagctgttcgccaaggcccagcgcagcctcgacctcgaacaggggccgctgctgcgcgcggtgctggtggacggcccggccggtgagcaacgcctgctgctggcgatccaccacctggtggtggacggggtgtcctggcgggtgctgctggaggacctgcaacaggtctaccgtcagttcgccgagggcgccgaaccggcgctgccggccaagaccagcgccttccgcgactgggccggacgcctgcaggcctacgccggcagcgaatcgctgcgcgaggagctgggctggtggcaagcccggctgggtgggcagccggtcgagtggccgtgcgaccgcccgcagggcgacaaccgcgaggcgctggcggaaagtgtcagcctgcggctcgacccgcaacgtacccggcaattgctgcaacaggcgccggcggcctaccgcacccaggtcaacgacctgctgctgaccgccctcgctcgcgtgctctgccgctggagcgggcagccatcgacgctggtgcagttggaagggcatggccgcgaggcgctgttcgacgatatcgacctgacccgcagcgtcggctggttcaccagcgcctacccgttgcgcctgaccccggcgcagagcccgggcgagtcgatcaaggcgatcaaagaacagctccgcgcggtgccgcacaaaggcctcggctacggcgtgctgcgctacctcgccgatccggcggtgcgccaggcgatggccgcgctgcccacggcgccgatcaccttcaactacctcggacagttcgaccagagcttcgccgacgccctgttccagccgctggaccagcccaccgggccgatccacgacaagcaggcgccgttgcccaacgagctgagcgtcgatggccaggtctacggcggcgagtctggtgctgcgctggacctacagccgcgagcgctaggacgcgcggacggtgaacgagctggcgcaggcctatctcgccgaactgcaggcgctgatcgagcattgcctggaagacggcgccggcggcctgaccccgtccgacttcccgctggcgcaactgagccaggcgcaactggacgccctggcggtgccggccggcgagatcgaggacgtctatccgctgaccccgatgcaggaagggttgctgttacacaccctgctggaaccgggcaccggcatctactacatgcaggaccgctaccggatcgacagcccgctcgatcccgagcgcttcgccgccgcctggcaggcggtggtggcccgccacgaggcgctgcgtgcgtcgttcgtctggaatgccggcgaaacgatgttgcaggtgatccacaagcccggtcgcacccgcatcgagttcctcgactggagcgaactgccggaggacggccacgaggaacgcctgcaagcgctgcacaagcgcgagcgcgaggccggcttcgacctactcgaacagccgccgttccacctgcgcctgatccgcctgggcgaggcgcgctactggttcatgatgagcaaccaccacatcctcatcgatgcctggtgccgtggcctgctgatgaacgacttcttcgagatttacggcgccctcggcgaaggccgcccggcgaacctgccgacgccgccgcgctaccgcgactacatcgcctggctgcaacgccaggacctggagcaatcgcgacgctggtggagcgagagcctgcgcggcttcgagcggccgaccctggtgcccagcgaccgcccgttcctccgcgagcacgccggcgaaagcggcgggatgatcgtcggtga

SEQ ID NO: 6998 - DNA, 2274 bp, Pseudomonas aeruginosa
cctcggcctgcacctgtcctacgaccagcgctacttcgaggcgccgaccgtcgagcgcctgctcggcgagttcaagcgcctgctgctggccctggccgacggtttccacggcgaactggaggccttgccgctgctcggcgaggacgagcgcgacttcctcctcgacggctgcaaccgcagcgcccgcgactacccgctggagcaaggctacgtgcggctgttcgaggcgcaggtggcagcccatccgcagcgcatcgccgccagttgcctggaacagcgctggagctacgccgagctgaaccgacgggccaaccgcctcggccacgccctgcgcgccgccggcgtcggcatcgaccagccggtggcactgctggccgagcgcggcctcgacctgctcggcatgatcgtcggcagcttcaaggccggtgccggctacctgccgctcgaccccggccatccgacccagcgcctgacccggatcgtcgagctgagccgcacgccggtgctggtctgcacccaggcctgccgcgagcaagcgctggcgctgttcgacgaactcggctgcgtcgaccggccgcgcctgctggtgtgggacgagatccagcagggcgagggcgccgagcacgatccgcaggtctacagcgggccgcagaacctcgcctacgtgatctacacctccggctccaccggactgccgaagggcgtgatggtggagcaggcgggcatgctcaacaaccagttgagcaaggtcccgtacctggaactggacgagaacgacgtgatcgcccagaccgcctcgcagagcttcgacatctcggtctggcagttcctcgccgcgccgttgttcggcgcccgcgtggcgatcgtgccgaacgccatcgcccacgatccgcagggcctgctggcgcacgtcggcgaacagggcatcacggtgctggaaagcgtgccgtcgctgatccagggcatgctcgccgaagagcgccaggccctcgacggcctgcgctggatgctgcccaccggcgaggcgatgccgccggaactggcgcgccagtggctcaagcgctacccgcggatcggcctggtgaatgcctacgggccggcggaatgctccgacgacgtggcgttcttccgcgtcgacctggcctccaccgagagcacctacctgccgatcggcagtcccaccgacaacaaccgcctgtacctgctcggcgccggcgccgacgacgccttcgaactggtgccgctgggcgcggtgggcgagctgtgcgtggccggcaccggcgtcggtcgtggctacgtcggcgatccgctgcgcaccgcccaggccttcgtcccgcatccgttcggcgcgccgggcgagcgtctgtaccgtaccggcgacctggcgcggcggcgcgccgacggagtgctggagtatgtcgggcggatcgaccaccaggtgaagatccgcggcttccgcatcgagctgggcgagatcgaggcgcgcctgcacgaacgcgccgacgtccgcgaggcggcggtggcggtgcaggaaggggcgaacggcaagtacctggtgggctacctggttcccggcgagacacagcgttccagcgccgactcgccggccggactgatggtggagcagggcgcctggttcgagcggatcaagcagcaactgcgcgccgacctgccggactacatggtgccgctgcactggctggtgctggaccggatgccgctcaacgccaacggcaagctcgaccgcaaggcgctgccggcgctggacatcggccagatgcagaaccaggcctaccaggccccgcgcaacgaactggaggaaaccctggcgcggatctgggccgaggtgctgaaggtcgagcgggtcggggtgttcgacaacttcttcgaactcggcgggcattcgctgctggccacccaaatcgcctcgcgggtgcagaaggccctgcaacgcaacgtgccgctacgggcgatgttcgaatgcaccacggtggaagagctggccagctacatcgagtccctggccccgagcgagatcagcgagcagaaggccgagcgcctgaacgacctgatgtcgaagctggaaatgctctgaggcacgcgccccgccacaggacggatacctgtgcggggcgcgtggcggaaaggcatgaaaaaggcccgccgaagacgcccgggcgtccttggcgggcctttctacaaatccgctctaggcaaaccagccctctgaccttgagggagaggggcgttcggagcggcgaacccgcccgctag

SEQ ID NO: 6999 - DNA, 198 bp, Pseudomonas aeruginosa
gcctatgagggtaggctcttgtccactgtctatatggcggtgaactgctcgcagccgaacccgttccctgagcatttcctggttatctgcgtggcactgggctggcccggaaaacctatagccatttggcggaaaacaggagcggcgggtttttccctgccagaaaccctcttttttcgaggtctcgtaacttgctga

SEQ ID NO: 7000 - DNA, 195 bp, Pseudomonas aeruginosa
gtgttccaccacctgcggcccgcgtcttttttgccctcagaaaatagagggcagtgccgttcggtcctgtccctgcgggacggatttgccggcccctccatcatcctcctactgggtttttatccaattcccgggcttctgagagagcctgcggaaatgtccgggggagctgtccggcgtttccagggcctgtag

SEQ ID NO: 7001 - DNA, 411 bp, Pseudomonas aeruginosa
agctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggcggcggcctctacgccagcggcctgctcagcctcgacggccagcgcttcctcaaccagggcgcggcggcgggccagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagctcgcggttggtcgctggcggcctga

SEQ ID NO: 7002 - DNA, 354 bp, Pseudomonas aeruginosa
atagattttccccgttcagtaattccctgttctttaataatttactttttcgattttaaaagaagagcactgacctccctttcgctacttccgcagagtcctgaacctccggccccgccatccctggcgggtcgctcgccggggcaacgtatgcgttgcctggagaagaagggcctgctgaccatgagttcgcagttgatcggcatgctggcggcttcgacgcagggcgatgcggacgccaagagcttgcagacgggagcctgggtggcggggaatgccacccaacacaactacctcagtcattggcaggaggagaagaagcggcaggaggtcgatggctgcaaggacaaatag

SEQ ID NO: 7003 - DNA, 291 bp, Pseudomonas aeruginosa
ctctgcaaaaccggaatagaagccaaatgggcaattatttcggcccagcaggatgtcggtatcgtcgtaggtgttggaggaggcatcggtctttcgacagctgaaaccgcagtgggtgtttatgagctggtcaagaactggagggaaacctatgcagctctggagcagttggccacttcgccagagttccggcagcagtttggcgataactacctgaaggggctggaggagcgcgccgcattcttagcgaataaaggggacagatttattttccctgctctaattctctga

SEQ ID NO: 7004 - DNA, 603 bp, Pseudomonas aeruginosa
cgatggtcggggtggagcagccggccaggacggcgaatgcggacgaaagcaacagggcgggcagcagacgggaggtcatcggaattttccttcggacggttttcgaggcggcggattctactccagtcgcggcgcaaccgctctagcctggatcacagcggcaaatttccgctgcgatcgtacgtctcttccggtgagccgcccggatggcggcgcctcttcgaagggagattccatgtctgccgtttccacctcgttgttgcttttcctcaacctgctgaccccggcccaggccgcccagcccgtgccgctggccgatggccgcatcgagatcgctgccggcgagagccgccagcgctacctcgaccttgcccccggcgagttgcagttgctcgacctggaggtcgaccgcggccgcgtccgcctgcgcgccaccacgcccgacggcaaggcgttgcgcgcgacggagctggccggacgccagtcgctcggcctgcaggccggcgagcgccagggcctgcgcctgaccttcagcgccgacgaagacaccgcactgaccctgacccccacccagcgcctcaccccgcagaccccggcgcttga

SEQ ID NO: 7005 - DNA, 792 bp, Pseudomonas aeruginosa
ttcgccggcgccgcagagcccgaccctgcaacgcctgcaggcggagcttgcggaaaagcgccccggcgcgctgaaggcgttctggaagcaggtggcgaagcagggcacgccgctggtggagccgctggatgccgaacgtgtgctggtcaccttcctctggcgccagcagcgtcccggcgacgtgcgcctgctgtggccgaccccggaggtcaacacccgccgcttcgaggccctggccggcagcgacgtgcgctacctgagcctgccgctgcgccgcgacgcgcgggtttcctaccagctcagcgccgacctgccggacctgcaacaggccgatcgcggcaccttgcgcctggcgttgcaggcggcggcgcggccggacccgctgagccgtacgccgtggctcaacagccgcgcgctgccgcgggccgagcaggcctcgctggtgcagctcggcggcgcccctgccgagacctgggaccagccgcgcaaggacgtgccgcgcggcaaggtggagcgcctcggctataccagccaggccctggccaaccagcgccagctgacgctctacacgccgccgggctacgatcccgagggccagcgctatccgctgctggtgctgttcgacgaggaccactacgcgcgcgacgtaccgaccccgaccatcctcgacaacctgatcgctgccgggcgcatccgcccgaccctggcggtgattgtcggcaatgtcgacgccagcagccggggccgcgagctgccctgcaacgaggccttcgccgacatgctcgcccatga

SEQ ID NO: 7006 - DNA, 1131 bp, Pseudomonas aeruginosa
gctgctgccctggttgcagcagcgctatgcattgagcgaggagcctgccgatcgcgtgctttccggttccagctacggcgggctggcctcgggctgcatcgcctaccgttacccggaacgcttcggcaaggtgctgagcctgtccggctcgttctggtgggggccggacgagcagcagccgcagtggctggtacggcagttcgccgctggcgagcgtttgccgctggcgttcttcctcagttccggcctgctcgaggagcccgaggcggacggcattctcggcagcaaccgcagcctgcgcgcggcgctgcaaggcaagggctacccgctgcactaccgcgagttccccggcggtcacgactacgcggcgtggagcctggagcttgccgaagggttgcaggccttgttgccggcgcattgagccggctggctggcgtggggcggatagctgcttgcggttatccgccgtgccgcggcctggaggtgggggaagactgtccggagcgtgtccgcaatgcccaccgcgttgcggaatcggaaaaaatcgtccagggccatttgccagcgtcggcggataggggacaatcggcgttcgcctcaatcgaacgacaaggatgttctcgatgcgccgactcttgcgcccggtattctgcgccgcgctcttctgcctgtacccagcgctggtccaggctgccgccgaaagcgaaatcctcggcctgttccagcgctggcaggccgcccacgggcagcgcagcggcaaggccctggaaggggtctatgcgccgcgcctggactactatggccgcgcgcagacgcgcgagcgcaccctctccgccaagcaggccttcttcgcccgccatcccgacttcgagcagcgcatcgtcgctgcgccgcagatcgtgccgggcgaccaggaaggccgctacgaggtgcgcttcgtcaagcaggtacgcctcgacggacgcctgcgcaactatccggggctgctcctggccgagcgcgccgggccgggcgatacctggcgcttcgtcggcgagagcgacgagatcacccgctacgccgtcgacccgcgctacaccccgctggctcgcggccgcttcgccggtgccgaagcggacttcgcctgggtag

SEQ ID NO: 7007 - DNA, 336 bp, Pseudomonas aeruginosa
tggcccacgcgccgaacagcgccgccttgtgcgacgaatacgaggattgccgctgcgacctctggagcgccgacgcgcgcgtcccgcccaagccgctgggcagttgcaccggcgcggtgctcagcgtcctcggcggcctcgacgacagcggccgcgagcgcctgcaactgctgcgtacctggtggaccagcacctggaccaagtcgtcgctgctggaaatccgcgacggccagtgggtgcgggtgctgccggacatctccaccacctgggacgacgccgaggccgaactggtgctgtacaaggccgacccgcagcagccgggccgggtgctggtga

SEQ ID NO: 7008 - DNA, 594 bp, Pseudomonas aeruginosa
accagaacttctggtggatggagcgcgacggcgcccgccagcgtatcgaccagccgcgcccgcgactggccagcgacaactacgacttcctgctcgcccacctgctggccgggctgggcctgcagttctgcccgcagtggagcgtcgcgccgctgctcggtgaagggcggctggtgcgcctgctcggcgactaccacttcgacccggggccgttcgggccctccatccatgtcctctatccggggcaccggcgcaacacgcggaaggtccgcgcgttcctcgagcacctgcgcgccagcttgcagcgacaggggctgtgccatcggctgtaacgcttcggttacgagtggaacgaattcgttccgattgccggaaaaacctttgctgtcaggcgtttgcgctctggttcgggaaatgtccggcgggtctgtaacgaaagcgttccatggcggccctgtccgggtttcccccgcgcccggccacgccccgtggcgacagggccggggccgcttggcaccctgcttgctacgggcagccgcagaacaaagtcccgtcccgaccgggcgacccgctgacaatgaggatccagcatga

SEQ ID NO: 7009 - DNA, 2910 bp, Pseudomonas aeruginosa
acgccaacgccgacgcctgaggatcccgtcatgaccgataacctgaacctcggcgccatcgacctgggcaccgacgacgaattcatcgcccgccatatcggcccgcgtgccgccgacacccaggccatgctccagcgcctgggctacgactcgctggacgcgctgatcggcaacgtgatccccgacagcatcaagggcagcagcgtgctcgacctgccggccggcatgggcgaggccgaggcgctggccagcctgaaggcgatcgccgcgcgcaatcgcgcgttgcgttccttcattggccagggctactacaactgccacaccccggcaccgatcctgcgcaacctcctggagaacccggcctggtacaccgcctacacgccgtaccagccggaaatctcccagggccgcctggaggcgctgctgaacttccagaccctggtcagcgacctgtccggcctgccgatcgccaacgcctcgatgctcgacgaggcgaccgccgccgccgaggccatgaccttctgcaagcgtctgtcgaagaaccgcaccagccaggcattcttcgcctcccgccattgccacccgcagaccctcgacgtgctgcgcacccgtgccgagccgctgggcatcgaggtggtggtcggcgacgagagcaccatcgaagacttctccgcctacttcggcgcgttgctgcaataccccacctgcgacggcgagatcgtcgactaccgcgaactggtcagccgcttccatgcggtcgatgcgctggtcgcggtggccgccgacctgctggcgctgaccctgctgaccccgccgggcgagttcggcgccgacgtggccatcggcagcgcccagcgcttcggcgtgccgctcggcttcggcggcccgcacgcggcctatttcgccacccgcgacgccttcaagcgggacatgccgggacgcctggtcggcgtctccatcgaccgccacggcaagccggcctaccgcctggccatgcagacccgcgagcagcacatccgccgcgagaaggccaccagcaacatctgcaccgcccaggtgctgctggccaacatcgccagcatgttcgccgtctaccacggcccgcagggcctgctgcgcatcgcccggcgcacccaccggctgaccgcgatcctcgccgccggcctggagcgcctgggcgtggccgtcgagcagaagcatttcttcgacaccctgagcctggccaccggcgcgcgtaccgcggcgatccatgccaaggcccgcgccgccgggatcaacctgcgcgagatcgatgccggccgtctcggcctgtcgctcgacgagaccgtccgccaggccgacgtggaaacgctctggggcctgctggctgaagagggccaggcgctcccggacttcgccacccttgccgccagcagcggggaccgcctgccggtcgagctgctgcgccagtcggcgatcctcagccacccgatcttcaaccgccatcactcggaaaccgagctgatgcgctacctgcgcaagctggcggacaaggacctggcgctggaccgcacgatgatcccgctgggctcctgcaccatgaagctgaacgccgccagcgagatgatcccggtgacctgggccgaattcggcaacctgcacccgttcgccccggccgagcagagcgaaggctaccgccagctcaccgacgaactggaggcgatgctctgttccgccaccggctacgacgccgtgtcgttgcagcccaacgccggctcccagggcgagtacgccggcctgctggcgatccgtgcctaccaccagagccgcggcgacagccagcgcgacatctgtctgatcccgtcctccgcccacggtaccaacccggctaccgccagcatggtcggcatgcgcgtggtggtggtggcctgcgacgcgcgcggcaacgtcgacgtcgaggacctgcgcaacaaggccagcgagcacaaggaacgcctggccgcgctgatgatcacctatccgtccacccacggcgtgttcgaggaagcgatccgcgagatctgcgccatcgtccacgactgcggtggccaggtgtacatcgacggcgccaacatgaacgccatggtcggcctgtgcgccccgggcaagttcggtggcgacgtttcccacctgaacctgcacaagaccttctgcatcccccacggcggcggcggcccgggcgtcggcccgatcggcgtgcgcgcgcacctggcgccgttcctccccggccacgctcgcggcgagcgcaaggaaggcgcggtgagcgcggcgccgtacggcagcgcgagcatcctgccgatcacctggatgtacatccgcatgatgggcggcgaaggcctcaagcgcgcctcggaaatggccatcctcaatgccaactacatcgcccatcgcctggaggagcactacccggtgctctacgccggcggcaacggcctggtcgcccacgaatgcatcctcgacctgcgtccgctcaaggacagcagcgggatcagcgtcgacgacgtggccaagcgcctgatggacttcggcttccatgcgccgaccatgtccttcccggtggccggcacgctgatgatcgagcccaccgagagcgagtcgaaggccgagctggatcgtttctgcgacgcgatgatccgcatccgcgaggaaatccgcgcggtggaacgcggcgagctggacaaggaagacaacccgctgaagaacgcgccgcacaccgccgccgaactgctcggcgaatggaaccacgcctacagccgcgagcaggccgcctatccgctggccagcctggtggaggccaagtactggccgccggtgggccgcgtcgacaacgtctacggcgaccgcaacctgacctgctcctgcccgcccatcgaggcgtacagcgaggagtga

SEQ ID NO: 7010 - DNA, 1428 bp, Pseudomonas aeruginosa
ttgaacaggagcgccgccatggtggcggccaatccgcaagcggagacgagcatgtccctgagtgtcttcgatctgttcaagatcggcatcgggccgtccagctcccacaccgtggggccgatgcgtgccgccgcgcgctttgccgaggggctgaggcgcgaggggttgctggaggccactgccagcgtcaaggtcgagctgtacggctcgctcggcgccaccggcaagggccacggcagcgacaaggcggtactgctcggcctggagggcgagcagccggacacggtggataccgccgcgattcccgctcggctcgatgccatccgttccagcggcgagctgcgcctgctcggcgagcggccgatccgcttcgtcgagaaggaacaccttgcgctgatccgcaagccgctggcctaccatcccaatggcatgatcttccgtgccttcgacgccgccggcctgcaggtccgcagccgcgagtactactcggtgggcggcggtttcgtggtcgacgacgaggccgccggcctcgaccgcatcgtcgaggaccgcacgccgctggcgttccccttcaagaccgcgcggcaactgctcgaccattgcgtccgcgaaggcctgtcgatcagccagttgatggccgagaacgagaaggcctggcgccccgccgaggaaacccgcgccggcctgctgcgtatctggcaggtgatgcaggattgcgtcgaggccggctgccgcaacgagggcatcatgcccggcggactgaaggtcaggcgccgcgcggcggcgctccaccgccagttgtgccagcggccggaggccggcctgcgcgatgctctcagcgtgctcgactgggtcaacctctacgccctggcggtgaacgaggagaacgccagcggcggccgcgtggtgaccgcgccgaccaacggcgcggcggggatcattccggcggttctgcattactacgcgcgcttcatccccggggccgacgacgacggcgtggtgcgcttcctgctcaccgccgcggcgatcggcatcctctacaaggaaaacgcctcgatctccggcgccgaggtcggttgccagggcgaggtcggggtggcctgttcgatggccgccggggcgctctgcgaagtgctcggcggtagcgtgcagcaggtcgagaacgccgccgaaatcggcatggagcacaacctcgggctgacctgcgacccggttggcgggctggtccaggtgccctgcatcgaacgcaacgcgatggcttcggtgaaggccatcaacgcggcgcgcatggccctgcgcggcgacggccagcacttcatctctctcgacaaggtcatccgcaccatgcgccagaccggcgccgacatgaaaagcaaatacaaggaaaccgcgcgcggcggcctcgccgtgaacatcatcgaatgctga

SEQ ID NO: 7011 - DNA, 1125 bp, Pseudomonas aeruginosa
aacatgaccgcagaaaccctcgccaagacgcccctgcacgccctgcacctggaactgggggcgaagatggtgcccttcgccggctacgacatgccggtgcagtacccggccggggtgctcaaggagcacctgcacacccgcgagcaggccggtctgttcgatgtctcgcacatgggccagatccgcctggtgggcgccgatgcggcgctggccctggaaagcctggtgccggtggacatcctcgacctgccggtgggccagcagcgctacgcgttgttcaccgacgagcagggcgggatcctcgacgacctgatggtggccaacctcggcgattgcctgctgctggtggtcaacgccgcctgcaagcaccaggacctggcgcacctgcgtcgtcacctggaagaccgttgcagcgtcgagccgctgttcgaggagcgtgccttgctcgccctccagggaccggcggcggtgcgggtgctggagcgcctggcgccgcaggtggcgcagatgaccttcatgcagttcgcccgcgtcgagctgctcggccaggactgctacgtcagccgctccggctataccggtgaagacggctacgagatctccgtgcccgccgcccatgccgaggccctggcgcggcgcctgctggccgagccggaagtggcgccgatcggcctcggcgcgcgcgactcgctgcgcctggaagccggcctgtgcctctacggccacgacatggacagcgccaccacgccggtcgaagccagcctcggctgggccatttccaaggcgcgccgcgccgacggcgtgcgcgccggcggcttccccggcgccgagcggatctttgcccagcaggcgcagggcgttgccagcaagcgcgtcggtttcctgccgcaggggcggatgccggtgcgcgagggcgccgagatcgtcgatgcccaggggtgggcgatcggcaaggtcagcagcggcggtttcggtccgagtctcaacgcgccgctggccatgggctacgtgccgagcgagctggccggcctgggcaacgaggtgacggcgatggtgcgcggcaagccggtgaccctggtggtcagcaagatgcccttcgtggcgcagcgctactaccgcggttga

SEQ ID NO: 7012 - DNA, 630 bp, Pseudomonas aeruginosa
gagcggcgtcgctgcggcatggcgggcgacggcgcgttcgcttcccgtggttcgggcggtcttccggcggagggcgactgcctgtcgcgcctccttgggaacgggctggaagccatgctcatgggcgggctccacgatagatgcgccaggccagccggccgggacgggcggcgatcgccgcatccacctcgatgcgcggcaggtccagcgggtcgcaacgggtatccaccaggccattgcgcgcgccgaaggcgaagcggtagccaagccgaccgagggcggcgcgcaggccgggttgcgcggcgggtgtggtgcgagcttggcagaacaccggcaggggggcggcgcaatgctgctggagctggcggtgggcgcggccgagacagtcctcggcgcaaaggcctgccgatgggtgcggctcctgtccgcgcaggccgaagcgaagcaggccgctgttttccaggcggcggacccgctcccagtcgccagcgctgtacggtgcgggaaccgggcaggccgcgtgcaaggcctgctgcgaggccggatcgaggcgttccagcttgcgcaggaggaggtcgaggttgcggctgcgacgctggtcgtcgccggtgcgttcgaacaccgccatga

SEQ ID NO: 7013 - DNA, 1029 bp, Pseudomonas aeruginosa
acggctggctgctcagcggcgtacgcgagatcggcatggatgcacggggtgtctacgagcgcttcggcaagccggtcgcggtgctcggccccggcctgcacctggggctaccctggccgctggggcgggtgttggcggtggagaacggggtggtccacgagttggccaccagcgtcgccgccggcgacggcggagccgagccgctcgcgcccgccgaaggtccggccccggatagcgccaaccgcttgtgggacgcctcccacgtcagcgagaaatcgcaggtcatcgccagcctggccgaccgtcggcagagcttccagatcgtccaacatggacgtgcgcatcgtctgccgcatcgctctcgacgacgcggcagcgctggcggcgacctaccgcagcgccgacgtgccgacgctggtgcgcagcaccgccagccgcgtactggtgcatgccttcgcctcgcggaccctcgatgaggtcctcggcgagcagcgcgcgggcctggccgagcagatcggccaggccgtgcaggccgatctcgaccgcctcggcagcggcgtcgaggtactgggcgcggcggtcgaggcgatccatccgccggccggtgcggcgaacgcctaccacgcggtgcaggccgcgcagatcacagcccaggcgctgatcgcccgcgagcgcgggcaggccgccgcgcagcgcaacgaggcgcaactacaggccagcgtggcgcacgaccgggccagcgcgaaggcccgcgagaccctggccgccgcgcaggccgccgaccggcgtttcgccgccgagcgggaaggctatgccgacgccggccaggctttcctgctggaggcctactaccgccaactcggacgcggcctgggcaaggccaacctgctgctcatcgaccaccgcatcgccggcgccggcgcgccgaccatcgacctgcgcagcttcggcctcggccgcctggattccccgtcttcgtcccgtccgtccgccgctccggcgtccgcggccgggcaatccgcaccatga

SEQ ID NO: 7014 - DNA, 1251 bp, Pseudomonas aeruginosa
agagcgacaacaacgggcaggtcaagcagatctgggagctcaccgagaaggaagccctggactacgtacgccggccggacgcgcgcttcccgcaatagccgccgcggctcgccccgggaggtgcgcatgagcgagccgaccgcccacggcagccatggcggctgcgcgcatcaccatcatcacctgccgttcggcggcggcctgctcagccgcgacgagcagcgccgtgccgcgcgccagctgagcctggcgatgctcgccctcggcctgttgctgctcggcctggcctggcgctggctggcggcggaccaggccggggtcagccagatcctgctcggcgtcgcgtcgctgctggtggcgctgccggtggcccgctcgggcctgggacagcctgcggcatccgagcctgcacggcgtcaccgaccagttgatcgcgctggccatgctcggcgcctgggccagcggcgacctgctgaccgccgcgctggtgcagatcatcatgatcttgggccatgtgctggaggagcgcagcgtgatcggctcccaggaggccatcgccgccctcggcgagctgacccgcagccatgcccggcggatcgaggccgacggcagcctgagcgaggtggacaacgccagcctgcgagcgggcgaccaggtggaagtgcgcgccggcgaccgggttccggccgacgggcgggtcctgcagggccaggccagtctcgacaccgcgccgatcaccggcgagtcggtgccgctcgaggtggcgccggggatggaggtctacggcggcgcgatcaacctcgacggcctgctgcgcatcgagataacccgtaccggcgaggcctcgaccctgggcaaggtgatcggcctgatgcagcaggccgagcgcgccaagccgccgatcacccgcctgctggagcgctacgccgggcagtacatgttgctggtgttgctgatcgccgcggtcacctggttcgtcaccaacgatgcccaggccatgctcgccgtgctggtcgccgcctgtccctgcgccctggtgctgtccgccccggccacggctatcgccgggatcgccgtggccgcccgccacggtatcctgatccgcagctcggccttcctcgaggagctggcggacctgacttcgctggtggtcgacaagaccggcaccctgacccatggcagcctgcgcctgcaggcgctgcgcctggcagatgccgccgaggaggcgtcggtgctgcgcctggccgctag

SEQ ID NO: 7015 - DNA, 873 bp, Pseudomonas aeruginosa
tcggcagcgacctgcgccggctcggcacctgcgtgcggctcagccggcaatgccggcggaccctgcaggtcaacgtggcgatcggcctcggctggaccctggcgatcgtcgccgcggcagcctttggcctgctcggcgcggccggggcgatggtcgcggcgctgctgcacaacctcagcaccttgctggtgctgggcaatgccggacgcctgctgcgtttcgaggagcccctcgggcagccccggccggccgtggagggacgcgaagaggagggtacaccgtgaggcaggcgcaaacgcgacgcaacggctggcgctggctggccctggcggtcggcacgctgtccgcgctgagcctggccgaggcgtcgatggcgcgctggccggcgggctggcaggtcagcgacctgcccgccgcgcagcccggccaggccggcgccggccagcgccagcgcgcggtcaagttgcaggcagacggctcccaggcactggtgatggaagtgacgcggatgcccctgcagagcgggcaggcagtgaacctggagaaagtcctcgggcacatgcgcaagctggtgcagatcgagttcctgcgcaacggcctgcagaccgcctgcacctcgccgcagccgtccaccaccggcgggctggcggcgctggagaccacctgcaccattcgccagcgcggcgccgtggtgatgaagcagaccttgctcaccgcggccggcaagacctcggcctattcgctgtcctatgccggcctggccgaggcctacgacgccagccaggcggaaatccgcgcggtacgggaaagcctgcgcttcgagtgagcgaaatcggacgcggtcggggcgggggctggagtgtcggcggataa

SEQ ID NO: 7016 - DNA, 198 bp, Pseudomonas aeruginosa
ccgcgactcgtcgctccgtggccgaccgcacctgcccgcccccgtaggcggccacggatttccttgcgccttctagactggaagcgaacccgccgcatgaaccccgaacgagaaaccagcatgtcgagtcgcttcatcgccgcctggtccgcggccaaccgttgcctggaggtgcggggccgggcatggaagggctga

SEQ ID NO: 7017 - DNA, 1929 bp, Pseudomonas aeruginosa
tcatggcgctgttcgcccagcaaccgttgccgttcttcgtcgccctgggactctggctggccgctctgcaccgccggcggcaccttgctgcgctacaccgactcgcacgccttcgtgctcagcggcttcaccgcggtgatcgtcgccgtgctgtcgattcccgatccggaaaacaccttcatgctcgccgtggtgcgggtcaccgagaccctgctgggcgtcgcctgcgtggccctggtcagcctgctcagcgcgcgaccgcaggcggtggcgaagggctacttcgcccaggtcgacggcctgatccgcagtaccgcgcggcacgccgcggcggtgatccgcggcgacgagggcgacgagtcgttcaaccagcggcagatgcaactggtcgccagcatcaccgcgctggacggcctgcgccggcacctctatttcgacgcgccgaacctgcgccgcgccgatggcctggtgcagttgctgggtaacctgctggtgctgatggcctcgcggctgttgctgctgcgccagcatcgcctgctggtgcgggcgcactgggtcgggccgttgccggcggatatccaggcactgctggatcgtgcgttgcgggtgctggacgcgctggccgagcaggggcgggcggtaccctccgaggtgctggaggagttccaggcggtgcgccaggccttcgatgccgcggcgacgcgcgcggagtcctacgacgaggcgctgagcccggcgctgcgcccgcaggtggcgatcctgcgctgggaatacgcgcggctgttccagcgcctgggcgaagtgctcgaactcaacgatgcgatccagtccggccgccacgccagcagtttctaccgccgtggccaggcgcaggcgctgcacctggactgggcgctggcctcgatgaacgccgtgcgcgctttcgtcgccttgtcctgcgccgcctggctgtggatcaccagcgcctggaacggcgccctcagcagcctgctgctggtcggcgtgatgtgctcgctgatggcgaccttcccgcgtccgctgctggcggcgcagaacttcctgcgcgggctgctgctggcgatcctgatctcggcggcgctgctgttcgtgctgttgccggcatccgccgacttcgagtggctggcgctgtggatggcgttgctgctgtacgtggtcgcggtcggcctgagcagcccgctgagcgccgggatcgccatgggcatcggcctggagaccttgctgatggtggcgccacagaatatcgcggtctactacagcaacgcttcgcagtggttcgagttcgtcggcggcttcctcgccgcggcggtcctcgccgtgctggtgttcgccctggtctatccgttccgcgccgacccgcgcctgcgccggctgctctacctgtcgcgccaggacgtcgcggaaatgtcgcgctgcgaggccagcgaggcgcagcgcttcgccttcgagacgcggatgatcgatcgcctggcggtgatggtcggcctgctgccggcgagccaggagccggctgcggcggaacgtttccagtgcgccctgggctgcgtggtgatgggcgtggcgttgaaccgcctgcgcgagccgctgcatgacgccggggtggtgccgctggagttgcagccgctgctgggcgaggcgctgcgcgaggtcgccgcctacatagccggcggcgcggacgccccgcggcaggacctcgccctggccgccctgcggcgtttcggccggggcctggaggccttgctggcgcagccgtcgaaggacctcggggcgacgcggcagcgcttcatcatgaatgtcgcggtactgatcctgcagcagtcgctgcaacgctatcggacgctgctggaggaggaccgcggcgcaccggcggtcgtcgaagaaccagaagaggagggcggacatgcccgctga

SEQ ID NO: 7018 - DNA, 1200 bp, Pseudomonas aeruginosa
tgtcgaggtcgggggcgcctacctgccgccgatcgcccaggcgctgctgctggcctggctgatcctgctgctgctcaacccgctgttgcggcgcttcggcgtgttgcagcgggtctggcacgaagcgctgttccagggcgcgttgtactgcgcgatctgcgccggtctgatcctgtggatgggagagatgtcccgatgaacctgttgcaaggcaaatggccgcgcctggccaccctgctggcggtgctggtggcggcggcgctggtgttcctcgcctgggaacgctacacccgcacgccgtggacccgtgacgcgcgggtccgcgccgatgtggtgacgctgtcggcggacgtttccgggctgatcacccggttgccgctgagcgacaaccagcccgtggagaagggcgagctgctgctcagcatcgatccggcgcgctatgaactggcggtgctgcgcgccgagcgcgcggtgaacgtggcgcgggcggcgctgggcgagtcgcgcgcggcgatcgaggccagccaggcccagttgcgccagcgccgcagcgaggcgcaacggcgctcggcattgcagaagcgctcgatgctatcggtggaagagaacgaaaaggcccagaccgacgtcagcctggcccaggccgagttgctgaggaaccaggccagcctcggcctggcccaggccaacgtggagcttgccgaagccgccttgcagcaggcccgtctcgatctcgaacgtacccaggtgcgcgccccggtcagcggctacgtgaccaacctgcagacccgcgagggcgactacgcccacgccggggtgccattgctggcgctggtggaccgcgattcgttctatgtcagcggatacttcgaggagaccaagttgccgggcatccgcgtcggcagccgggcgcgggtggaactgatgagcggcgagcgcttcgacgggcgcgtgcagagcatcgcccatgccatcaccgaccgggagaatgccgagggctcgcgcctgctggcgaacatcaacccgagctatacctgggtcaagctggcccagcgaattccggtgcgcatcgccatcgatcccgcctatcgccagcgcaacaccttgcgcgccggcgtgaccgcgaccatccgggtgctgcccgcggaggacaccgcgaaagtcgattccgcggcgcccgggactgccttgcggccttga

SEQ ID NO: 7019 - DNA, 930 bp, Pseudomonas aeruginosa
cgtggagagcagcgcatggactcctatggcgatacctcgggccgcatcggtcgcgactggctcgatcgacacgacgaagagctggagcaggaactgctcgacgacgagctgaacctggacgagctgttcggtcccgagcaggaggatgcgcccggcgaattgagtcggcgccgctatttccgcgaactgttccgcctgcaacgggaactggtgaaactgcagaactgggtggtgcacaccgggcacaaggtggtgattctcttcgagggacgcgacgcggcgggcaagggcggcgtgatcaagcgcatcacccagcgcctcaacccgcgggtctgccgggtcgccgcgctgcccgcgccgaacgaccgcgagcagacccagtggtatttccagcgctacgtctcgcacctgccggccggtggcgagatcgtcctgttcgaccgcagctggtacaaccgtgccggggtcgagcgggtcatgggtttctgcaacgacgaacaatacgaggaattcttccgcagcgtgccggagttcgaaaagatgctggcgcgctcgggcatccagttgctcaagtactggttctccatctccgacgccgagcagcacctgcgtttcctcagccgtatccacgatccgctcaagcagtggaagctcagtccgatggacctggagtcgcggcggcgctgggaggcctacaccaaggccaaggaaaccatgctcgaacgcacccacatccccgaggcgccctggtgggtggtacaggccgacgacaagaagcgcgcgcggctgaactgcatccaccacctgttgcagcagatgccctaccgggaagttccgcagccgccggtacacctgccggagcgcctgcgccacgccgattacgtcaggcatccgacgcccggcgagatcatcgtgccggaagtctattga

SEQ ID NO: 7020 - DNA, 1221 bp, Pseudomonas aeruginosa
tggccgttcggccggacgccgggctggacgggtaaattcgcggcgggatgcgacgttactcaggcaagccccacgagtagccggccatgcttccgtccccagcctccagcctgtcgtttccgtcgcccctcgagcgccgcgaggccgatccatatgcccgctgcgacaggcagcggcctgcgtgcaacgagtcgcacgagccggcgcaggagcgtcctgaacctgtcgcgacctgcgcattcatcgaggaggagcgccggcgtggcgatcccacgggcttgctttacgcccttgggccgcgggagcggggagagccggagcgggtggcggagtggttggcggcgctggtccaccatttctacctggacggtcccgttgagccgccgaggacaacgctgggaaaggagcgctgcgaaaccgcgccgggcctttgccgctgctgcggccaacccttcgattttcgccacaagcgcgcggcgctgttgctgctgggaacccatttcgccgccagggccgaggcgcaggcggcgtcggtgcgccgctaccggcgctgaggaatgctcgccgccgtcagcggcgggcgctgagatgggtgacgttgtcgccctggcgctcggcggtgaccttgcggcagtgcaccagggcgtcgcggatcatgaagttgaccagggtcggcgagacgcccagttccttggcgatgtccttctgtggcacgccgtgcaggcggtacatctcgaaggcgtagcgggtgcgcttgggcagctcggtgagggcatccgcgatgtgttcgagggtcgcgtagttgatgtgcgaggtttccggcgaggcgccctggatcaccacgttcaggccttcttcctccggccccgagtatttctgttcgagcgcctgcttgcggtagtggtcgatggccaggttgcggacgatctggaacaggtagctgagctgtgccttgaacgacgaagtgatctgcggcgccgactggagcctgaagaacgcatcctggaccacatcttcggctcgcgagcggcaaccggtaatgcgggcggcgatcttcaccaggatcgtgcggttatcgacgaaagcctggaggagcgggtatcgcatctgcgggtagacagttgttccgacatggaaatcaccttgctgcggagggggctgcagagcactggcggtggggtaagacccacacatggcgcaacaaattatgttgaacgataa

SEQ ID NO: 7021 - DNA, 885 bp, Pseudomonas aeruginosa
cagcgcgggcaggtgcccggcgccccggcgtgcgcagcaggagacggaaatgccgatcgatcatgggaaagcgctctgccccggacgagggccacgacagcggcgcaaggaggtcggcaggtgagcccggccgtttccctgcaattgttctgcctgccttattcgggggccagcgccacgctgttccgccgctggcagcccagcctgccgggctggatccgcttgttgcccctggaattgccggggcgcggcctccgcttcggcgaggccctgcataccgatgccgccagcctggtcgcgcaattggccagcgagctgcacggcaccctcgacagcgcttctccctacgccttcttcggccacagcctgggcgggctgctggccttcgaactggcccatgccatgcgtcggcgcggcctcgaagggccgctggcgctattcctctccggtgtatccccgcccgccgaaaacgatgtcagcggctaccggcgcgccaaggccgacgccgaactggttgccgcgttgcgcgactacaggggtactccggaggccgtcctcaacgatccgtcgctgatgcagatgctgttgccagtggtgcgagcggactttctcgtcaccggcagctaccgctaccaggcgcatgggccgctggacgcggcgctgcacctgttcggcggacgcgaggacagcctgcgcagcgccgagttgctcggctggctgcatgaggccgggggcgacttcaccctcgacctgctcgacgggcagcactttttcatccgtgaacagcaggggcagttgctgcgcctgctgcgtcgctacgccggccagcatctgctgcgctggcacaaggacaaggtccggggaagcatgcgcgccgccagttga

SEQ ID NO: 7022 - DNA, 354 bp, Pseudomonas aeruginosa
aactcgattgcaagccgaattcaggcaggaaaacacatgatggacgccttcgaacttcccaccaccctggtccaggccctgcgtcgccgcgctgtccaggagcccgagcgcctggcgctgcgcttcctcgccgaggacgatggcgaaggcgtggtcctcagctatcgcgatctcgacctgcgcgcgcggagcatcgccgcggccctgcaggcccatgcgcagctggggcgatcgcgcggtactgctgtttcccagcggccccgactacgtcgcggcgttcttcggttgcctgtatgccggggtcatcgcggtgccggcctacccgccggaatcggcgcgccgccatcaccatga

SEQ ID NO: 7023 - DNA, 741 bp, Pseudomonas aeruginosa
acctgctgctcgacgaattctcgcggctctacgccgaagcctgcggcggccagccggccgacctggcgccgctggaactgcactacgccgagttcgctgcctggcaacggcagtggctggacgcgggcgagggcgcccgccaactggcctactggcgggaacgcctgggcgacacggcgccggtgctggaactggccaccgaccatccgcgcacggcgcgccaggcgtcgcccgccgcgcgctacagcctgcgggtcgacgaagccctggcgcgggctatccgcgaggccgcgctggaccatgaggcgagtgtcttcatgtggctgctggcggcgttccaggcgctgctgcatcgccacagcgggcagggcgagatccgcatcggcgtgcccagcgccaaccgccagcgcctggagacccaggggctggtcggcttcttcatcaacaccctggtcctgcgcggcacgccccgggcgcgccagccgttcgccgcattgctcggcgaggctcgcgaggcgaccctcggcgcccaggccaaccaggacctgccgttcgaccaggtgctcgcggcctgcggccagggcggccagttgttccaggtgctgttcaaccaccagcagcgcgacctgtcggcgttgcgccggctgcccggcctgctcgccgacgagctgccctggcacagccgcgaagccaagttcgacctgcaactgcagagcgaggaggacgctcgcggtcgcctga

SEQ ID NO: 7024 - DNA, 402 bp, Pseudomonas aeruginosa
ccggcgagcacctgcaacggattcgccaggccttcgccccggcgtcgttcttcaatgcctacggaccgaccgagacggtggtcatgccgctggcctgcctggctcccgaacgactggaggagggtgccgccagcgtgccgatcggcagcgtggtcggcgcgcgggtcgcctacatcctggatgccgacctggccctggtgccgcagggcgcgaccggcgaactctacgtcggcggcgccggcctggcgcgcggctaccatgagcgtccggcgctcagcgccgagcgcttcgtgcccgatcccttcgctgccgagggcggccgcctgtaccgcaccggcgacctggtgcgcctgtgcgacaacggccaggtggaatatgtcggccgcatcgaccaccaggtga

SEQ ID NO: 7025 - DNA, 3456 bp, Pseudomonas aeruginosa
gacgcgcggacggtgaacgagctggcgcaggcctatctcgccgaactgcaggcgctgatcgagcattgcctggaagacggcgccggcggcctgaccccgtccgacttcccgctggcgcaactgagccaggcgcaactggacgccctggcggtgccggccggcgagatcgaggacgtctatccgctgaccccgatgcaggaagggttgctgttacacaccctgctggaaccgggcaccggcatctactacatgcaggaccgctaccggatcgacagcccgctcgatcccgagcgcttcgccgccgcctggcaggcggtggtggcccgccacgaggcgctgcgtgcgtcgttcgtctggaatgccggcgaaacgatgttgcaggtgatccacaagcccggtcgcacccgcatcgagttcctcgactggagcgaactgccggaggacggccacgaggaacgcctgcaagcgctgcacaagcgcgagcgcgaggccggcttcgacctactcgaacagccgccgttccacctgcgcctgatccgcctgggcgaggcgcgctactggttcatgatgagcaaccaccacatcctcatcgatgcctggtgccgtggcctgctgatgaacgacttcttcgagatttacggcgccctcggcgaaggccgcccggcgaacctgccgacgccgccgcgctaccgcgactacatcgcctggctgcaacgccaggacctggagcaatcgcgacgctggtggagcgagagcctgcgcggcttcgagcggccgaccctggtgcccagcgaccgcccgttcctccgcgagcacgccggcgaaagcggcgggatgatcgtcggtgaccgctacacgcgtctggacgccgccgactgcgcgcgcctgcgcgaactggcgcagcgctaccagctcaccgtcaacaccttcgcccaggccgcctgggcgctgaccctgcgccgcttcagcggcgagcgcgacgtgctcttcggcgtcaccgtggccgggcgtccggtgggcatgccggaaatgcagcgcaccgtcggcctgttcatcaacagcatcccattgcgcgtgcagatgccggccgccggccagcgctgcacggtgcgcgaatggctgaaccggctgttcgagcgcaacctggagttgcgcgagcacgagcacctgcccctggtagccatccaggaaagcagcgagctgcccaagggccagccgctgttcgacagcctgttcgtgttcgagaacgctccggtggaagtctcggtactggaccgcgcgcagagcctgaacgccagttccgactccgggcgtacccacaccaacttcccgttgaccgtggtctgctatccgggtgatgacctcggcctgcacctgtcctacgaccagcgctacttcgaggcgccgaccgtcgagcgcctgctcggcgagttcaagcgcctgctgctggccctggccgacggtttccacggcgaactggaggccttgccgctgctcggcgaggacgagcgcgacttcctcctcgacggctgcaaccgcagcgcccgcgactacccgctggagcaaggctacgtgcggctgttcgaggcgcaggtggcagcccatccgcagcgcatcgccgccagttgcctggaacagcgctggagctacgccgagctgaaccgacgggccaaccgcctcggccacgccctgcgcgccgccggcgtcggcatcgaccagccggtggcactgctggccgagcgcggcctcgacctgctcggcatgatcgtcggcagcttcaaggccggtgccggctacctgccgctcgaccccggccatccgacccagcgcctgacccggatcgtcgagctgagccgcacgccggtgctggtctgcacccaggcctgccgcgagcaagcgctggcgctgttcgacgaactcggctgcgtcgaccggccgcgcctgctggtgtgggacgagatccagcagggcgagggcgccgagcacgatccgcaggtctacagcgggccgcagaacctcgcctacgtgatctacacctccggctccaccggactgccgaagggcgtgatggtggagcaggcgggcatgctcaacaaccagttgagcaaggtcccgtacctggaactggacgagaacgacgtgatcgcccagaccgcctcgcagagcttcgacatctcggtctggcagttcctcgccgcgccgttgttcggcgcccgcgtggcgatcgtgccgaacgccatcgcccacgatccgcagggcctgctggcgcacgtcggcgaacagggcatcacggtgctggaaagcgtgccgtcgctgatccagggcatgctcgccgaagagcgccaggccctcgacggcctgcgctggatgctgcccaccggcgaggcgatgccgccggaactggcgcgccagtggctcaagcgctacccgcggatcggcctggtgaatgcctacgggccggcggaatgctccgacgacgtggcgttcttccgcgtcgacctggcctccaccgagagcacctacctgccgatcggcagtcccaccgacaacaaccgcctgtacctgctcggcgccggcgccgacgacgccttcgaactggtgccgctgggcgcggtgggcgagctgtgcgtggccggcaccggcgtcggtcgtggctacgtcggcgatccgctgcgcaccgcccaggccttcgtcccgcatccgttcggcgcgccgggcgagcgtctgtaccgtaccggcgacctggcgcggcggcgcgccgacggagtgctggagtatgtcgggcggatcgaccaccaggtgaagatccgcggcttccgcatcgagctgggcgagatcgaggcgcgcctgcacgaacgcgccgacgtccgcgaggcggcggtggcggtgcaggaaggggcgaacggcaagtacctggtgggctacctggttcccggcgagacacagcgttccagcgccgactcgccggccggactgatggtggagcagggcgcctggttcgagcggatcaagcagcaactgcgcgccgacctgccggactacatggtgccgctgcactggctggtgctggaccggatgccgctcaacgccaacggcaagctcgaccgcaaggcgctgccggcgctggacatcggccagatgcagaaccaggcctaccaggccccgcgcaacgaactggaggaaaccctggcgcggatctgggccgaggtgctgaaggtcgagcgggtcggggtgttcgacaacttcttcgaactcggcgggcattcgctgctggccacccaaatcgcctcgcgggtgcagaaggccctgcaacgcaacgtgccgctacgggcgatgttcgaatgcaccacggtggaagagctggccagctacatcgagtccctggccccgagcgagatcagcgagcagaaggccgagcgcctgaacgacctgatgtcgaagctggaaatgctctga

SEQ ID NO: 7026 - DNA, 249 bp, Pseudomonas aeruginosa
ctcctacaggggacggtccggccgggagtcgcgcagcgttcgcttgcgcggcttctccttggtttcacgacgcatcttgcgaggctgacggaggcccgtcaggtcctggctgccctggtcatccgtgtagagatcgtccagaaggtttcgcgttatcttcatgccagcggtttcgtgctgtccgtgggaaaggagaggctaggcccgagtcgttgctctattgttaatggatggcgccgcaccgcttaa

SEQ ID NO: 7027 - DNA, 1524 bp, Pseudomonas aeruginosa
ccccccctatcctttgtggtgaggctcgtacaacagcgcctccggcacgctcgccagccaggccggcatgagcctgcgcctgggcggcggcgccctgcgcaaccagcaggacggcctgatcttcagccaggccggcgccctcgaggtgcaggccggcagcctggacaaccgccagggcacgctccaggcccagggcgacaaccggctgcgtatcggcggcgcgctggacaaccagggcggccgcctggacagccgggccggcaacctcgacctgcagagcggcagcctcgacaacggcgccggcggcgtgctcaacagcgccaagggttggctgaagctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggcggcggcctctacgccagcggcctgctcagcctcgacggccagcgcttcctcaaccagggcgcggcggcgggccagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagctcgcggttggtcgctggcggcctgaacaacgcctacggcgtgctggaaagcgccaaccaggacctcgacctgcaactgggcagcctggccaacgccggcgggcgcatcctccataccggcaacggcaccttcggcctggattccgggcaggtgatccgcgccggcggcgaactgaccaccaatggcctgctggacatccgcgccagcgaatggaccaacagcagcgtgctgcaagccggacgcctgaacctggacatcggcaccttccgccagacggccgagggcaagctgctggcggtgcagtccttcactggccgcggcggcgactggagcaacgacggcctgctggccagcgacggcagcttgcgactcgagctgagcggcggctaccgtggcaacggccgcgccaccagcctcggcgacttcgccctgaacgccgccagcctcgacctcggcaatgccgccagcctcgccggcggcgccaatgtcacgcttggcgccggcaacctgctggtcaaccgtgggcggatcaccgctgccggcgacctcgtggccagcgccgcgagcctgaacaactacggcaccctgggcggcggtggcaacctgcgattgaacgcgcccgccctgctcaacgagcgcgggttgctgttcagtggcgccgacatgaccctgcgcgccggcgacatcaccaacctctacggggatgtgtacagcctcggcaggctggatatcgcccgcgacgatgcggggggctgggcaaatcgcttggagaacatttccgggaatttagagagcacaggtga

SEQ ID NO: 7028 - DNA, 483 bp, Pseudomonas aeruginosa
cagcaagaagcgcctgggcgacggtttatacgagcagcgcctggtacgcgaagcgatcgtccagcgtacggggcagcgcttcatcgccggattgaacagcgacgaagcgatgttccgctatctgatggacaacgccatcgccagcaaggacgtattgggactgacccctggcgtcaccctcagcgccgcccaggtggccgcgctgacccacgacatcgtttggctggaagaagtcgaggtgaatggcgagaaggtcctcgcccccgtggtctacctggcccaggccgaggggcggttgggcccgaacggcgcgctgatccaggggcgcgacgtgaacctgatcaccggcggggacctgaggaacgccggtaccctgcgcgcgcagaacgacctcagcgcgacagccggcaacatcgacaacagcggcctgatcgaggccggcaaccgcctcgacctgctggccagcggctccatccgcaatga

SEQ ID NO: 7029 - DNA, 465 bp, Pseudomonas aeruginosa
caagaagacccggcgcgacgaaatcaccgatgtgacggcagtgggcagccaaatatccagcggcggcgacctcaccctgctcagtggcggcgaccagacttaccagggcgcgaagctggaatcgggcaacgacctggccatcgtcagcggcggcgcggtgaccttcgacgcggtgaaggacctgcaccaggagagccacgagaagagcaagggcgacctggcgtggcagtcgtcgaagggcaagggccagaccgacgaaaccgtgcgccagagccagatcgtggcccaggggaatctggcgatcaaggccgtggaagggctgaagatcgacctcaagcatatcgaccagaagaccgtgagccagaccatcgacgcgatggtgcaggcggatccgcaactggcctggctgaagcagatggagcagcgcggcgatgtggattggcggcgcgtgcaggaactgcatga

SEQ ID NO: 7030 - DNA, 630 bp, Pseudomonas aeruginosa
cgagtttttgaaggagtttgggagatgactcagtggcaactgttagctgatgatttgtggggtggtgaaaaaaatatatgcttttttgttcattcgggtgcgtgcttctgggttgtggatgataaattcaacttcagcttggatgcggagaaggattatcgtgcataccttgataagggtcatataactcaggagcaatatgcgtcggcatgcatgacgtttagaggtggggttcttaaacttacttctgagaattttttgaaatatttgagggcggaggagcggtgggtgttatcgcggcaagacctaaaagatatgtttgtgtgcgggcttgatttgagcgagtctttgcatggaagagttgaagattactatctttctggtgttgagttgagtgcaagctactttcatgatgctaatgctgttgcctctaggcttccaatgttctatgtgaatttcgatcgcaaaatttacatgcatatggactgtaatcgggcgcatgaagaattggcttactcagactggcttgctaagtgttcggatttttgccatttagtacccgatagggagaggtattgggttttagagggtatggattattggaagtatagatttttgcaatcggcataa

SEQ ID NO: 7031 - DNA, 642 bp, Pseudomonas aeruginosa
tcaggccgagggcgttgtagctgtagctccaggcgcgctcggccgcctgcgcgggcagggcgagggcgcaggccaggacgagggcgccgaggcgggggaagtatggggggatgcgcatgggggtcggccttgtcagcgggtggtgacggtctcgccggtcttgcgtccctcggcgtcgtactggtagcgggtgatccggccgggctcgctgacctgcaccgggaggaacagggtcgggtgccagtcggttgtgatggtgcgcgcctgcgcagtgccggcggcctcggtgcgcgaggtctccaggccacgggcgttgtactggtaggtggtcaggttgccgttgttgtcgcgtttgctggtgagcagaccctggtcatcgtaggtaaaggtggaattgctgctggggcagttgggagagggttcgccttcgatggcaacgatgcgtttgatgccctggatcacctggaagcggtaggtggcctgcttgccgtattcgttggtgacggtggtggagccgtcatcgttgtaggcgagggagaccttttcggcgccgttggcgtgttcgctggagatggcgcggccttggttgtcgtaggtccaggtggcgaagcgggctccattttcatccgttatcccggttaa

SEQ ID NO: 7032 - DNA, 2235 bp, Pseudomonas aeruginosa
cgcgggcgccaaggcgcgccaggctcaggctgtcctgtccggcgttgcattgcagatgcagcaggcgcaggccgtcgagatggccgagcagttgcagttcctcgggatagagcgtggaaccgccgttgcggaagaaggcggcctggtcggccttgtggctgttgtgcgcccgggtggcggcgttccacgacagccggttggcctcgtgcaggtcggatcgcatggttcgactccttccctggagtgcgccaccgcgcggatggcgggtccgggggattacatgtccttgatgctgcgcacctggtccttgttgacgcgggtgcgcttgccgtccagttgctccagttcgtagaagccggaactacgatcatagcgcggggtatccaccgcctggatctcgcggccatcgttgagggtgacgatggtcggggtggagcagccggccaggacggcgaatgcggacgaaagcaacagggcgggcagcagacgggaggtcatcggaattttccttcggacggttttcgaggcggcggattctactccagtcgcggcgcaaccgctctagcctggatcacagcggcaaatttccgctgcgatcgtacgtctcttccggtgagccgcccggatggcggcgcctcttcgaagggagattccatgtctgccgtttccacctcgttgttgcttttcctcaacctgctgaccccggcccaggccgcccagcccgtgccgctggccgatggccgcatcgagatcgctgccggcgagagccgccagcgctacctcgaccttgcccccggcgagttgcagttgctcgacctggaggtcgaccgcggccgcgtccgcctgcgcgccaccacgcccgacggcaaggcgttgcgcgcgacggagctggccggacgccagtcgctcggcctgcaggccggcgagcgccagggcctgcgcctgaccttcagcgccgacgaagacaccgcactgaccctgacccccacccagcgcctcaccccgcagaccccggcgcttgattcgccggcgccgcagagcccgaccctgcaacgcctgcaggcggagcttgcggaaaagcgccccggcgcgctgaaggcgttctggaagcaggtggcgaagcagggcacgccgctggtggagccgctggatgccgaacgtgtgctggtcaccttcctctggcgccagcagcgtcccggcgacgtgcgcctgctgtggccgaccccggaggtcaacacccgccgcttcgaggccctggccggcagcgacgtgcgctacctgagcctgccgctgcgccgcgacgcgcgggtttcctaccagctcagcgccgacctgccggacctgcaacaggccgatcgcggcaccttgcgcctggcgttgcaggcggcggcgcggccggacccgctgagccgtacgccgtggctcaacagccgcgcgctgccgcgggccgagcaggcctcgctggtgcagctcggcggcgcccctgccgagacctgggaccagccgcgcaaggacgtgccgcgcggcaaggtggagcgcctcggctataccagccaggccctggccaaccagcgccagctgacgctctacacgccgccgggctacgatcccgagggccagcgctatccgctgctggtgctgttcgacgaggaccactacgcgcgcgacgtaccgaccccgaccatcctcgacaacctgatcgctgccgggcgcatccgcccgaccctggcggtgattgtcggcaatgtcgacgccagcagccggggccgcgagctgccctgcaacgaggccttcgccgacatgctcgcccatgagctgctgccctggttgcagcagcgctatgcattgagcgaggagcctgccgatcgcgtgctttccggttccagctacggcgggctggcctcgggctgcatcgcctaccgttacccggaacgcttcggcaaggtgctgagcctgtccggctcgttctggtgggggccggacgagcagcagccgcagtggctggtacggcagttcgccgctggcgagcgtttgccgctggcgttcttcctcagttccggcctgctcgaggagcccgaggcggacggcattctcggcagcaaccgcagcctgcgcgcggcgctgcaaggcaagggctacccgctgcactaccgcgagttccccggcggtcacgactacgcggcgtggagcctggagcttgccgaagggttgcaggccttgttgccggcgcattga

SEQ ID NO: 7033 - DNA, 1557 bp, Pseudomonas aeruginosa
ctgcttgcggttatccgccgtgccgcggcctggaggtgggggaagactgtccggagcgtgtccgcaatgcccaccgcgttgcggaatcggaaaaaatcgtccagggccatttgccagcgtcggcggataggggacaatcggcgttcgcctcaatcgaacgacaaggatgttctcgatgcgccgactcttgcgcccggtattctgcgccgcgctcttctgcctgtacccagcgctggtccaggctgccgccgaaagcgaaatcctcggcctgttccagcgctggcaggccgcccacgggcagcgcagcggcaaggccctggaaggggtctatgcgccgcgcctggactactatggccgcgcgcagacgcgcgagcgcaccctctccgccaagcaggccttcttcgcccgccatcccgacttcgagcagcgcatcgtcgctgcgccgcagatcgtgccgggcgaccaggaaggccgctacgaggtgcgcttcgtcaagcaggtacgcctcgacggacgcctgcgcaactatccggggctgctcctggccgagcgcgccgggccgggcgatacctggcgcttcgtcggcgagagcgacgagatcacccgctacgccgtcgacccgcgctacaccccgctggctcgcggccgcttcgccggtgccgaagcggacttcgcctgggtagtggcccacgcgccgaacagcgccgccttgtgcgacgaatacgaggattgccgctgcgacctctggagcgccgacgcgcgcgtcccgcccaagccgctgggcagttgcaccggcgcggtgctcagcgtcctcggcggcctcgacgacagcggccgcgagcgcctgcaactgctgcgtacctggtggaccagcacctggaccaagtcgtcgctgctggaaatccgcgacggccagtgggtgcgggtgctgccggacatctccaccacctgggacgacgccgaggccgaactggtgctgtacaaggccgacccgcagcagccgggccgggtgctggtgaccgaaaccgtgatggacgacgagggcgactggagccaccgcacccgcagcgaggcgctgcgccccgtaccctgacgccggccccttgggctgggcggcgccaggccgtacaatcgacggctttatggcgagcgtcgccgcagtccaggttcccgcatgcgcatccacgtctccttcatcgaccgtgtcggcatcacccaggaggtgctggcgctgctgggtgggcgcaacctgaacctggatgcggtggaaatggtgccgccgaacgtctacatcgacgcgccgaccctcagtcccgaagtgctggaggaactgcgcgcagcgctgctgggcatccgtggcgtgcaggcgatgaccgtggtcgacatccttcccggccagcgccgccgcctgcagctcgatgcgttgctggcggcgatggccgatccggtgctggcggtggacggcaagggcctggtgctgctggccaacccggccttcagcgagcgctgcggacgcgacccggccggcgagcggctggccagcctgttcgacgatga

SEQ ID NO: 7034 - DNA, 1149 bp, Pseudomonas aeruginosa
ccatgccgaggggttcgagatgctcctcggcgattcccagccgatccgcaccctgaagacccgtgcgcagcgcgtggcggcgctcgacgcgccgctgctgatccacggcgagaccggtaccggcaaggaactggtggcgcgcggctgccatgccctgagtgcgcggcacaactcgccgttcctggcgctgaactgcgcggcgttgccggagaacctggccgaaagcgagctgttcggctacgcccccggcgccttcaccggcgcccagcgcggcggcaagccgggcctgctggagctggcccaccagggcacggtgttcctcgacgagatcggcgagatgtccccctatctgcaagccaagctgctgcgcttcctcagcgacggcagcttccgccgggtcggcggcgaccgcgaggtgagggtcgacgtgcggatcctcagcgccacccaccgcaacctggagaagatggtcgccgagggcagcttccgcgaggacctgttctaccgcctcaacgtgctcagcctggaagtcccgccgttgcgagagcgcggccacgacatcctgctgctggcgcggcacttcatgcagcaggcctgtgcgcagatccagcgcccggtgtgccggctggcgccgggcacctacccggcgctgctgagcaaccgctggccgggcaacgtgcgccagttgcagaacgtgatcttccgtgccgctgcgatctgcgagagcagcctggtggatatcggcgacctggagatcgccggcaccgccgtggcgcggcagaacgacggcgaggtgggcagcctggaggaggcggtggagggcttcgagaaagccctgctggagaagctctacgtcagctatccatcgacccgccagttggcggcgcgcctgcaaacctcgcacaccgccatcgcccaccgcctgcgcaagtacggcatcggtccgcgcgcctgaagcgggctcagccctcgctggaatacaccggcttgccggcgaaccaggtcttcagcaccttggtttcgcccagttgcgtctccggcacctcgaacacgtcgcggtcgaggacgatgaagtccgcctgcttgcccggctccaggctgccgatccggtgctccaggccgatggtccgcgcagcgttgcgggtgtag

SEQ ID NO: 7035 - DNA, 393 bp, Pseudomonas aeruginosa
cttcagccgtggcgccgagcgcctgggcaagacgccctcggcgctgaccaaggccgtcgcccacctggaagcggaactcggtgcccgcctgttcgagcgcaccacccgcagcctggcgctgaccgaggccgggcagatctacctggaggcggctcgtcagtccctggaaacgctgcgcacggcggggcaggagatcgaactgctggagtcggagttgcgcggcgaactgcgcctcgccgcgccgccgtcgttcgccgcggcgttcctccagcaggcctgcgccagcttcctcgaggcgcatccgcggatcagcctgcgggtggacctcgacgaaaccttcctcgatctcagcgaaggcggctacgacctcggcctgcgcgacggccccattga

SEQ ID NO: 7036 - DNA, 336 bp, Pseudomonas aeruginosa
ccccgccgggcgagttcggcgccgacgtggccatcggcagcgcccagcgcttcggcgtgccgctcggcttcggcggcccgcacgcggcctatttcgccacccgcgacgccttcaagcgggacatgccgggacgcctggtcggcgtctccatcgaccgccacggcaagccggcctaccgcctggccatgcagacccgcgagcagcacatccgccgcgagaaggccaccagcaacatctgcaccgcccaggtgctgctggccaacatcgccagcatgttcgccgtctaccacggcccgcagggcctgctgcgcatcgcccggcgcacccaccggctga

SEQ ID NO: 7037 - DNA, 1440 bp, Pseudomonas aeruginosa
cctgctcctgcccgcccatcgaggcgtacagcgaggagtgacggacgaggagggcgccgccagcggcggcgtcctcgcgtttccggcgatacccctttcccggcgccgcgcttgcgtagcggcgccgcggccacgctcgcgccagcgagcgtcctgacaccgacacgacaagaggccagcgccatgttcagcaagcacgaccagctccagggctacgacgacgaactgctcgccgcgatggacgccgaagaccggcggcaggaagaccacatcgaactgatcgcctcggagaactacgccagcaagcgggtcatgcaggcgcagggcagcggcctgaccaacaagtatgccgagggctatccgggcaagcgctactacggcggctgcgaacacgtcgacaaggtcgagcggctggccatcgaccgcgccaggcaactgttcggcgccgactacgccaacgtccagccgcactctggttcctcggccaacgccgcggtgtacctggcgctgctcaacgccggcgacaccatcctcggcatgagcctggcccacggcggccatctcacccacggcgccaaggtgtcctcctccggcaagctgtacaacgccgtgcagtacggcctggacaccgctaccgggctgatcgactacgacgaagtcgagcgcctggccgtggagcataagccgaagatgatcgtcgccggcttctccgcctactccaagaccctcgacttcccgcgcttccgcgccatcgccgacaaggtcggcgcgctgctgttcgtcgacatggcccacgtcgccgggctggtcgccgccggcctctacccgaacccgatccccttcgccgacgtggtcaccaccaccacccacaagaccctgcgcggcccgcgcggcggcctgatcctggcgcgcgccaacgaggagatcgagaagaagctcaactccgcggtattccccggcgcccagggcggcccgctgatgcacgtgatcgcggccaaggcggtgtgcttcaaggaagcgctggagccgggcttcaaggactaccaggcgcaggtgatccgcaacgccaaggcgatggccgaggtgttcatcgggcgcggctacgacgtggtttccggcggcaccgacaaccacctgatgctgatcagcctggtgaagcaggggctgaccggcaaggccgccgacgcggcgctcggagcggcgcacatcacggtgaacaagaacgccgtgccgaacgatccgcagagcccgttcgtcacctccggcatccgcatcggcaccccagcggtgaccactcgcggtttccgcgaaggcgagtgccgcgaactggccggctggatctgcgacatcctcgacgatatcgacaatcccgaggtcggcgaacgggtcaggggccaggtcggcgaattctgccggcacttcccggtctacgctgattga

SEQ ID NO: 7038 - DNA, 534 bp, Pseudomonas aeruginosa
ccttcatgcagttcgcccgcgtcgagctgctcggccaggactgctacgtcagccgctccggctataccggtgaagacggctacgagatctccgtgcccgccgcccatgccgaggccctggcgcggcgcctgctggccgagccggaagtggcgccgatcggcctcggcgcgcgcgactcgctgcgcctggaagccggcctgtgcctctacggccacgacatggacagcgccaccacgccggtcgaagccagcctcggctgggccatttccaaggcgcgccgcgccgacggcgtgcgcgccggcggcttccccggcgccgagcggatctttgcccagcaggcgcagggcgttgccagcaagcgcgtcggtttcctgccgcaggggcggatgccggtgcgcgagggcgccgagatcgtcgatgcccaggggtgggcgatcggcaaggtcagcagcggcggtttcggtccgagtctcaacgcgccgctggccatgggctacgtgccgagcgagctggccggcctgggcaacgaggtga

SEQ ID NO: 7039 - DNA, 939 bp, Pseudomonas aeruginosa
agttgcgggcgtttgcgccggcctggccggtaccttcgagttttgcctggagtgaagatgagagtcgacctggacgccgagggcgtcgccgccgaatcgctgccgcgtttccagcaggcgccccggcagttgcgccagctgtggcgatgggcagcggccagcgtcgccttggccgccgtctgcgccgtgctggggttcttcatcggcctgttcgccgccgactcgctctggccgccgctgctgtacaacctcggcgcggcctggctggtcctgttcgccggtctgcacgcggtctaccgggtcccggccctggccgttgcgtggtcctcggcgcggaggcccagcgcgcgggctgcctggctgcgctggcagcgggacgaacccgacgccaccgccgacagcgcctatgaacggttgctggagcgcctggggccaggccatcgcccacggcttggcccagatcgggcacgctgcgctgtggctggcggcgagcgcggcgctggcgttgtgcctggtagccgccggctggcgtctcgacatgccgcgggccagttccgggcaagcggccgacctcgccatcggtatctgcctgctgctggccttcgcggtgctggtgctggaacgtcgcctcgccagccaagggccggtgcagtggccggaagccccggtcctcgggcaactggcgcgggcgttgatcggtaccctggtgctggccgccctctgtctgttcctggctcgccagggacacccctgggccccgcgcctggcggtactgctcggcctgttgccggcggcgctggcgctggagttgctgggcagggcgatcctggcgatgttcgcgccgcagcgtgccggcctcgaaccgcgcctggtcgccaccagcctgctggccgacctgttgcgctggccgccgcgtcccctgcagcgtctgcagcatga

SEQ ID NO: 7040 - DNA, 426 bp, Pseudomonas aeruginosa
cgccaaccgcttgtgggacgcctcccacgtcagcgagaaatcgcaggtcatcgccagcctggccgaccgtcggcagagcttccagatcgtccaacatggacgtgcgcatcgtctgccgcatcgctctcgacgacgcggcagcgctggcggcgacctaccgcagcgccgacgtgccgacgctggtgcgcagcaccgccagccgcgtactggtgcatgccttcgcctcgcggaccctcgatgaggtcctcggcgagcagcgcgcgggcctggccgagcagatcggccaggccgtgcaggccgatctcgaccgcctcggcagcggcgtcgaggtactgggcgcggcggtcgaggcgatccatccgccggccggtgcggcgaacgcctaccacgcggtgcaggccgcgcagatcacagcccaggcgctga

SEQ ID NO: 7041 - DNA, 888 bp, Pseudomonas aeruginosa
tcgcccgcgagcgcgggcaggccgccgcgcagcgcaacgaggcgcaactacaggccagcgtggcgcacgaccgggccagcgcgaaggcccgcgagaccctggccgccgcgcaggccgccgaccggcgtttcgccgccgagcgggaaggctatgccgacgccggccaggctttcctgctggaggcctactaccgccaactcggacgcggcctgggcaaggccaacctgctgctcatcgaccaccgcatcgccggcgccggcgcgccgaccatcgacctgcgcagcttcggcctcggccgcctggattccccgtcttcgtcccgtccgtccgccgctccggcgtccgcggccgggcaatccgcaccatgaggagagcgctcttgagcctcggtcactcccactcgcacagccaccacgagcatcatcacgatcacgatcacgatcacgatcacgatcacgatcacgatcacggcgcacaggccgcgccgccctggcgccggctgctggtcgccgcgctgctggtgctgttcgccgtcgccgccgcttgcctggtgcaggtacgttccggcgaggcgatggtcatcacccgtttcggcaacccggcgcgggtcctgctcgaaccgggcctggcctggcgcctgccgttgccgttcgagagcgcgatcccggtcgacctgcgcctgcgcaccacctccagcggcctgcaggacgtcggtacccgcgatggcctgcggatcatcgtccaggcctacgtggcctggcaggtccagggcgacgccgacaacgtgcagcgcttcatgcgcgcggtgcgcaaccagccggacgaggctgcccggcagttgcgcaccttcgtcggctcggcgctggaaaccaccgccagcgcctatga

SEQ ID NO: 7042 - DNA, 2187 bp, Pseudomonas aeruginosa
cctggccgacctggtgaatacggaggcgtcgcgggtgcgtatcggcgacttcgaagcgcgcctgcgcgaacagatcgaccatcagttgctggcgacctacggggtcaaggtggtgcaggtcggcatcgagcgcctgaccctgcccaaggtgaccctcggcgccaccgtcgaccgcatgcgcgccgagcgcgagaccatcgccaccgagcgtaccgccgagggccgtcgccaggctgcggagatccgttcggcggcggagcgcgacgcccgggtgatccaggccgaggcttcggtgaaagccgcggagatcgaggcccaggcacgggtcgaggcggcgcgcatctacggcaaggcctacgccggttcgccgcagctatacaacctgctgcgctcgctggacaccctcggcaccatcgtcaacggcgatacccggctggtcttgcgcaccgatgccgcaccgttccgcgtgctggtcgacgggccgccggcgttccccgccgaagcgccggccaacgggcgccggccatgagcggcgaagcgcgcgaggggctgcgcagcccctggctgcaggccggacgcctggcgttcctcgcactgttcggcgtgaccctcctggcggcgctggcctgggcgttttccaacgtccgccagatcggcccggagaaccgtcgccgtagtgctgcgcctgggcgcgctggagcgcctggccggtcccggcctgctgctggcctggccgcagccgctggagcaggtggtgctgctgccgtccgccgaacaggtgatcgaacgccgcgtcgagggcctgctgcgttccgagcaggcgcgtcgcgccgatctcgacgtcagcctgtccagcgacgcgctggccggctccggctacctgctgaccggcgacgccggggtggtgcaactggacgtgcgggtgttctacaaggtcgacgacccgtacgcctacgtcctccagggcgcccacgtgctgccggcgctggaccggctggtggcgcgcaacgccgtgcaggtctgcgccgcgcgcgacctggacaccatcctggtggcgcgcccggagttgctcggcaacgacagcgcggtcgccgagcgccgcgaacgcctgcgcggcgacctggtgcagggcatcaaccacagcctggcggcgttggccgcggccggcagcgggctgggcatccaggtggtgcgggtcgacgtgcagtcgagcctgccgcgcaatgcggtaagcgccttcaacgcggtgctgaccgccagccaactggccgagcagaacgtcgccaaggcgcgcaccgaggcggagaaactcacccaggccgccaccgagggggccgaccgcaccctgcagctcgcccgcgccgaggccggcgaacggctggcccaggcgcgccgcgacaccgccagcatcgttggcctggccccggcgctgggcgcgaccgatgccggcctgctctggcgcctgtaccgcgaacgggtgccggcgatcctcggcaaggccggttcggtcggcagcgtcgatccgcgcgacgatggccgcctgattctgcaaggtgggcagccatgagccgctgcccgacggtgcccttcgcgggctgtgaaacaatggacggacaagcgaacgtgaaacggctaccctgcgtcggcatcaaccttcggtacgcgcttccgccagcggaacgcggcgccgagtcgaacaaccaggcgaacgggacgggcaatgacggcaggcggtattccattcacgggcaacggtgcgcggctatcacccggcagggccctgctgtgcgggctggcgctgttgctgtgcggcggcgaggcgctggcgcggcagttgccgagcgacatgctggtgggcttcgtggccagcgcgcagtacccggtcatcaccctgaagaagcccaagcagagcctgctgcgcagcgtgctcaccctggggctggggaagaagaccgtcagctattcggtggcgccgtcggtgcgcatccgcacggcgcagaacctgttcatcgtctatggccgcatgccccagctcaagggcagtttcgtcggcctgaagagcgacaacaacgggcaggtcaagcagatctgggagctcaccgagaaggaagccctggactacgtacgccggccggacgcgcgcttcccgcaatagccgccgcggctcgccccgggaggtgcgcatga

SEQ ID NO: 7043 - DNA, 2412 bp, Pseudomonas aeruginosa
gcctggcgatgctcgccctcggcctgttgctgctcggcctggcctggcgctggctggcggcggaccaggccggggtcagccagatcctgctcggcgtcgcgtcgctgctggtggcgctgccggtggcccgctcgggcctgggacagcctgcggcatccgagcctgcacggcgtcaccgaccagttgatcgcgctggccatgctcggcgcctgggccagcggcgacctgctgaccgccgcgctggtgcagatcatcatgatcttgggccatgtgctggaggagcgcagcgtgatcggctcccaggaggccatcgccgccctcggcgagctgacccgcagccatgcccggcggatcgaggccgacggcagcctgagcgaggtggacaacgccagcctgcgagcgggcgaccaggtggaagtgcgcgccggcgaccgggttccggccgacgggcgggtcctgcagggccaggccagtctcgacaccgcgccgatcaccggcgagtcggtgccgctcgaggtggcgccggggatggaggtctacggcggcgcgatcaacctcgacggcctgctgcgcatcgagataacccgtaccggcgaggcctcgaccctgggcaaggtgatcggcctgatgcagcaggccgagcgcgccaagccgccgatcacccgcctgctggagcgctacgccgggcagtacatgttgctggtgttgctgatcgccgcggtcacctggttcgtcaccaacgatgcccaggccatgctcgccgtgctggtcgccgcctgtccctgcgccctggtgctgtccgccccggccacggctatcgccgggatcgccgtggccgcccgccacggtatcctgatccgcagctcggccttcctcgaggagctggcggacctgacttcgctggtggtcgacaagaccggcaccctgacccatggcagcctgcgcctgcaggcgctgcgcctggcagatgccgccgaggaggcgtcggtgctgcgcctggccgctagcctcggcgccgccagcagccatccggtgagccgagcgctggcagccctggcggcgcacgatgcctatcatccattgagcgatatccgcgaacgccaggggttcggcgtggtcgcacgaacagcggcgggcgaagccgccctcggccggcccgaactgttccagcaactgggcatcgacgccagcgaggtgccggagcatgagggaccgatcgccggaatcgccctggacgggcgcttcctcggctggctgctgctgggccgacagcgtacgcgcggaggccgccgaggccatggccgatctgcgcgaactgggtctgggccggcaactgttgctgaccggcgatcgccgggcggtggccgacgccgtggccaagcaggtggggattcgccaactggtggcgcaggcgttgccggaggacaagctgcgccaggtcggcgcggagatcggcagcggtttccggccgatggtggtcggcgacggcatcaacgattcgctggcgctgaaggccggtgtggtcggggtggcaatgggtgccggcggcgccgacatcgccctggcctcggcggatatcgtgctgatcggcagcgacctgcgccggctcggcacctgcgtgcggctcagccggcaatgccggcggaccctgcaggtcaacgtggcgatcggcctcggctggaccctggcgatcgtcgccgcggcagcctttggcctgctcggcgcggccggggcgatggtcgcggcgctgctgcacaacctcagcaccttgctggtgctgggcaatgccggacgcctgctgcgtttcgaggagcccctcgggcagccccggccggccgtggagggacgcgaagaggagggtacaccgtgaggcaggcgcaaacgcgacgcaacggctggcgctggctggccctggcggtcggcacgctgtccgcgctgagcctggccgaggcgtcgatggcgcgctggccggcgggctggcaggtcagcgacctgcccgccgcgcagcccggccaggccggcgccggccagcgccagcgcgcggtcaagttgcaggcagacggctcccaggcactggtgatggaagtgacgcggatgcccctgcagagcgggcaggcagtgaacctggagaaagtcctcgggcacatgcgcaagctggtgcagatcgagttcctgcgcaacggcctgcagaccgcctgcacctcgccgcagccgtccaccaccggcgggctggcggcgctggagaccacctgcaccattcgccagcgcggcgccgtggtgatgaagcagaccttgctcaccgcggccggcaagacctcggcctattcgctgtcctatgccggcctggccgaggcctacgacgccagccaggcggaaatccgcgcggtacgggaaagcctgcgcttcgagtga

SEQ ID NO: 7044 - DNA, 1518 bp, Pseudomonas aeruginosa
gcgaaatcggacgcggtcggggcgggggctggagtgtcggcggataacgcctgcggcgctattcgccctacggagggttgcattgggggagggcggataaccgcttgcggttatccgccttgcgtctgtcgcggatcatttcttcccggcgttctgcaggatctgcagggcctgggtggtggcggtgatgcagcccttggtgtcgccgctggcctggtcctgcctggccttggcctggagttccttgacctcggtgacccgcgcaccggtgaccgaggtcttgccgcgcacggcgaggatatcgtccagcttctgcaggttggcgccgcacaggtcggtgctttcggcggcttgggcggtaccgccgagcagggcggcggcgatgagcagggtacgcacgatcatggcagttctcctttgtgggccgggtggccggacgggggagagacgacaggctcctgggagtcttctccgcatgcccagtatctgaccggagcctcgccggaatggttcggtcgctcagccgttgccccagggcgggatcgacagcgcctgctggagatgctggatgaacgccttgaccttcggcgacatcgccgccgcccgcgaatacatcgcgtagatcacgtcgtcgagtgggcgcaggccgggcgcggcgtccaccaggcggccgttcttgaggtcctcggcgacgatgaacagcggcagcaacgccagtccctggccgcgcagggcggcgtcgcgcatggcctggccgttgttgctgctgaagcgtccgcgtggcgagacggcgcggggcttggcaccggggaacgccggttcgaaggtccaaacctggctcggcgtggcgttgttgtagcccaggcactcgtgctgcatcagttgttcgagggtgtccagcgtgccgtggcgttccgcgtagtcggggctgcagcagaccacccgctggctgttggccagcggccgggcgatcagcgaactgtcgtccaggcgggtgacgcggatgctcaggtcgtagccttccttctcgaagtcggtgaggcggtcgtccatctgcaggacgatctccaggcgcgggtgctggctcatgaagtcggcgatgatcggcgacagccagagggtgccgaagctcatcggggtgacgatgcgcaattcgccgcacaggtcgttctcgcgcagggcgacaatctccgcggcgttgttgagttcctgcagcgaggccttggcggccttgtagaagaaatgcccggcctcggtcggctcgacgttgcgcgtggtgcgatagagcaggcggacgccgaggcgtcgttcgagatcgctgacacgcttgctgatcaccgacttggacaggctcatgcgctcggccgccgacgtcacgctgttgagttcggcgacgttgaggaaggcttcgatatcgtcgaaacgcaggctcatcggtgggcccacgatacagtggcaatcgctcgacgcattctcggctcctcctggtcgttttccttgggctttctatccgcttga

SEQ ID NO: 7045 - DNA, 303 bp, Pseudomonas aeruginosa
tcctgcagcagtcgctgcaacgctatcggacgctgctggaggaggaccgcggcgcaccggcggtcgtcgaagaaccagaagaggagggcggacatgcccgctgatgtcgaggtcgggggcgcctacctgccgccgatcgcccaggcgctgctgctggcctggctgatcctgctgctgctcaacccgctgttgcggcgcttcggcgtgttgcagcgggtctggcacgaagcgctgttccagggcgcgttgtactgcgcgatctgcgccggtctgatcctgtggatgggagagatgtcccgatga

SEQ ID NO: 7046 - DNA, 492 bp, Pseudomonas aeruginosa
tcaagcgcatcacccagcgcctcaacccgcgggtctgccgggtcgccgcgctgcccgcgccgaacgaccgcgagcagacccagtggtatttccagcgctacgtctcgcacctgccggccggtggcgagatcgtcctgttcgaccgcagctggtacaaccgtgccggggtcgagcgggtcatgggtttctgcaacgacgaacaatacgaggaattcttccgcagcgtgccggagttcgaaaagatgctggcgcgctcgggcatccagttgctcaagtactggttctccatctccgacgccgagcagcacctgcgtttcctcagccgtatccacgatccgctcaagcagtggaagctcagtccgatggacctggagtcgcggcggcgctgggaggcctacaccaaggccaaggaaaccatgctcgaacgcacccacatccccgaggcgccctggtgggtggtacaggccgacgacaagaagcgcgcgcggctga

SEQ ID NO: 7047 - DNA, 1272 bp, Pseudomonas aeruginosa
tggacgccttcgaacttcccaccaccctggtccaggccctgcgtcgccgcgctgtccaggagcccgagcgcctggcgctgcgcttcctcgccgaggacgatggcgaaggcgtggtcctcagctatcgcgatctcgacctgcgcgcgcggagcatcgccgcggccctgcaggcccatgcgcagctggggcgatcgcgcggtactgctgtttcccagcggccccgactacgtcgcggcgttcttcggttgcctgtatgccggggtcatcgcggtgccggcctacccgccggaatcggcgcgccgccatcaccatgaacgcctgttgtcgatcatcgccgacgccgagccgcgcctggtcctgaccaccgctgacctgcgcgagccattgctgcagatgaacgcgcaactgtccgccgccaacgccccgcaactgctctgcgtcgaccagttggacccggccgttgccgatgcctgggacgagccgcgagtgcgtcccggagcacatcaccttcctccaatacacctccggttcaaccgcattgcccaagggcgtgcaggtcacccatggcaacctggtcgccaacaaggtgctgatccgccgaggcttcggcatcggtgccgacgacgtgatcgtcagctggctgccgctgtaccaccacatgggcctgatcggcggcctgctgcaaccgatcttcagcggcgtaccctgcgtgctgatgtcgccgcgctacttcctcgaacgtccggtgcgctggctggaagccatcagccagtacggcggcaccgtcagcggcggtcccgatttcgcctaccggctgtgcagcgagcgggtcgccgagtcggccctgcagcgtctcgacctgagcggctggcgggtagccttctccggttccgagccgatccgccaggacagcctggaacgcttcgccgagaaattcgccgccagccgcttcgatgcgtccagtttcttcgcctgctacggcctcgccgaggcgaccctgttcgtcaccggcggccagcgcggccagggcattcccgccctggcggtggatggcgaggcgctggcgcgcaaccgcatcgccgaaggcgaaggcagcgtgctgatgtgctgcggccgcagccagccggaacacgccgtgctgatcgtcgacgcggcgagcggcgaggtcctcggcgacgacaacgtcggcgagatctgggccgccgggccgagcatcgcccacggctactggcgcaacccggaagcttcggcgaagaccttcgtcgagcgtga

SEQ ID NO: 7048 - DNA, 1479 bp, Pseudomonas aeruginosa
cgggcgcacctggctgcgcaccggcgacctcggcttcctccgcgacggcgaactgttcgtcaccgggcgcctgaaggacatgctcatcgtccgcggccacaacctctatccgcaggacatcgaacgcaccgtcgagagcgaggtgccgtcggcgcgcaagggcagggtcgcggccttcgcggtcacggtcgatggcgaggaaggcatcggcatcgccgccgagatcggtcgcggcgtccagaaatcggtgccggcccaggagctgatcgactcgatccgccaggcggtggccgaggcctaccaggaagcgccgaaggtggtggcgctgctcaatcccggcgccttgccgaagacgtccagcggcaagctgcaacgttccgcctgccgcctgcgcctggaagacggcagcctggacagctatgcgctgtttcccggcctccaggccgtgcaggaggcgcagccgccggcaggcgacgacgaactgctggcacgcatcggcgagatctggaaggcccggctgggcgtggcgcaggtagcgccgcgcgatcacttcttcctgcttggcggcaattccatcggcgccgcccaggtggtcgcccaggtgcgcgacagtctcggcgtcgccctcgacctgcgccaactgttcgaggcgccgaccctgcaggccttcagcgccacggtggcccgccaactggccgccggcctgccggccgaggcaccgatggcgcacctgccgcgcggtgtcgacctgccgcagtcggcggcgcagcagcgtctctggctgacctggcagatcgatccgcagagcgccgcctacaacatccccggcggcctgcgcctgcgcggcgagctggacgaagcggcgctgcgcgccagcttccagcggctggtcgaacgccacgaagcgctgcgcacgcgtttcctcgagcgcgacggcgcggccttgcagcgtatcgacgagcggggcgagttcgcctggcagttcgtcgacctcgccgcgctggccgagcacgaacgcgccgcggctgccgcgcagcgccgcgaagccgaggcgcagcagccgttcgacctggaaaaggggccgctgctgcgggtcagcctggtgcgcctggacgaacaggagcaccagctctgggtcaccctgcatcacatcgtcgccgatggttggtcgctgaacctgctgctcgacgaattctcgcggctctacgccgaagcctgcggcggccagccggccgacctggcgccgctggaactgcactacgccgagttcgctgcctggcaacggcagtggctggacgcgggcgagggcgcccgccaactggcctactggcgggaacgcctgggcgacacggcgccggtgctggaactggccaccgaccatccgcgcacggcgcgccaggcgtcgcccgccgcgcgctacagcctgcgggtcgacgaagccctggcgcgggctatccgcgaggccgcgctggaccatga

SEQ ID NO: 7049 - DNA, 1494 bp, Pseudomonas aeruginosa
ggcgagtgtcttcatgtggctgctggcggcgttccaggcgctgctgcatcgccacagcgggcagggcgagatccgcatcggcgtgcccagcgccaaccgccagcgcctggagacccaggggctggtcggcttcttcatcaacaccctggtcctgcgcggcacgccccgggcgcgccagccgttcgccgcattgctcggcgaggctcgcgaggcgaccctcggcgcccaggccaaccaggacctgccgttcgaccaggtgctcgcggcctgcggccagggcggccagttgttccaggtgctgttcaaccaccagcagcgcgacctgtcggcgttgcgccggctgcccggcctgctcgccgacgagctgccctggcacagccgcgaagccaagttcgacctgcaactgcagagcgaggaggacgctcgcggtcgcctgaccctgaatttcgactacgccgcggacctcttcgacgaggccagcatccggcgtttcgccgcgcaatacctggagctgctgcgccaggtcgcggaagacccgcagcgctgcctcggcgatatcgccctggtcgacgccgagcaggcggcgcacctcgccgaatggggcagcgcgccctgcgagccggcgcgcgcctggctgccggagctgctggagcggcaactggtgcagtccgccgaacgcgtcgccctggagtgggacggcggcagcctcggctacgccgaactgcacgcccgggccaaccgcctggcccactacctgcgcgacaagggcgtcggcccggacgtgcgggtagcgatctgcgccgagcgttcgccgcaactgctggtcggtctgctggcgatcgtcaaggcgggcggcgcctacgtgccgctggacccggactaccccagcgaacgcctggcctacatgctcgccgacagcggcgtcgagttgctgctgacccaggcccatctgttcgagcgcctgcctggcgcggagggcgtcacgccgatctgcctggacagcctcaagctcgacaactggccgagccaggcaccgggcctgcacctgcacggcgacaatctcgcctacgtcatctacacctccggctccaccggccagccgaagggcgtgggcaacacccacgcggcgctggccgagcgcctgcaatggatgcaggccacctacgccctcgacggcgacgacgtgctgatgcagaaggcgccggtgagcttcgacgtgtcggtgtgggagtgcttctggccgctggtcaccggttgccggctggtcctcgccgcccccggcgagcaccgcgatccggcgcgcctggtggaactggtgcggcagttcggggtgaccacgctgcacttcgtgccgccgctgctgcaactgttcatcgacgaacccggcgtcgccgcctgcggcagcctgcgccgcctgttctccggcggcgaggcgcttccggcggagctgcgcaaccgcgtgttgcaacgcctgccggcggtggccctgcataa

SEQ ID NO: 7050 - DNA, 1263 bp, Pseudomonas aeruginosa
ccgctacgggccgaccgagaccgccatcaacgtcacccattggcagtgccgcgcggaagacggcgagcgttcgccgatcggccgaccgctgggcaacgtgctctgccgcgtgctggacgccgagttcaacctgctgccggccggcgtcgccggcgagctgtgcatcggcggcctgggcctggcccgcggctacctggggcgcccggcgctgagcgccgagcgcttcgtcgccgatccgctctcggccgctggcgagcgcctgtaccgcaccggcgaccgcgcgcgctggaacgccgacggcgtgctggaatacctcggccgcctcgaccagcaggtcaagctgcgtggcttccgcatcgagccggaggaaatccaggcacgcctgctggcgcagccgggggtggcccaggcggtagtggtgatccgcgaaggcgtggccggcagccagttggtcgggtactacactggcgctgtcggcgccgaggcggaagccgagcagaaccagcgtctgcgcgccgcgctacaggccgaactgccggaatacatggtcccggcgcagttgatgcgcctggcgcagatgcccctcggcccgagcggcaagctggatacgcgggcgctgccggagccggtctggcagcagcgcgagcacgtcgagccgcggaccgagctgcaacggcgcatcgccgtgatctggagcgaagtgctcggcctgccgcgggtcggcctgcgcgacgatttcttcgagctcggcgggcattccctgctggccacccgcatcgtctcgcgcacccgccaggcctgcgacgtcgaactgccgttgcgcgcgctgttcgaggccagcgaactggaggccttctgcgaacaggtccgcgcagcccaggccgccggacgtaccgacagccacggcgcgatccgccgcatcgaccgcgagcagccggtgccgctgtcctactcgcagcagcgcatgtggttcctctggcaactggagccggacagcccggcctacaacgtcggcggcctggcacgcctgagcgggccgctggacgtggcgcgcttcgaggccgcgctacaggccctggtgcagcgccacgagaccctgcgcaccacgttccccagcgtcgacggcgtgccggtacagcgcgtgcacggcgatggcggcctgcacatggactggcaggacttctccgcgctcgaccgcgacagccgccagcagcacctgcagaccctcgccgacagcgaggcgcaccggcccttcgaccttga

SEQ ID NO: 7051 - DNA, 1299 bp, Pseudomonas aeruginosa
ggtcaccgacctcgaccagcgcctcggctgctgcctgacctacagccgcgacctgttcgacgaaccgcgcatcgcgcggatggccggacactggcagaacctgctggaggcgctgctgggcgacccgcagcggcgcattgccgaattgccgctgttcgccgccgaggagcggaagcaactgctgctcgccggcacggccggcgaggcagggctccaggacaccctccatggcctgttcgccgcccgcgtggcggccagcccccaggccccggcgctgaccttcgccggacagaccctgagctatgccgaactcgatgcccgctccaaccgtctggcgcgcgtcctgcgcagtcacggcgtcggcccggaagtgcgggtcggcctggccctggagcgttcgctggagatggtcgtcggcctgctggcgatcctcaaggccggcggcgcctacgtgccgctggacccggaatatccgctggagcgcctgcaatacatgatcgaggacagcggcgtacgcctgctgctcagccacgcggcgctgttcgaggccctcggcgagctgccggcaggcgtggcgcgctggtgcctcgaggaggacggcccggcgctggacgccgaggaccccgcgccgctggcagcgctgagcgggccgcagcaccaggcctacctgatctatacctccggctccaccggcaagccgaagggcgtggcggtctcccacggcgagatcgccatgcactgcgccgcggtgatcgagtgcttcggcatgcgcgccgaggattgcgaactgcacttctattcgatcaacttcgacgctgccagcgagcgcctgctggccccgttgctgtgcggcgcccgcgtggtgctgcgggcccagggccagtggggcgcggaggaaatctgcgagctgatccgcgcggagggcgtgagcatcctcggcttcaccccgagctacggcagccagctcgcccagtggctggagagccagggccggcagttgccggtgcgcatgtgcatcaccggcggcgaagcgctgaccggcgagcacctgcaacggattcgccaggccttcgccccggcgtcgttcttcaatgcctacggaccgaccgagacggtggtcatgccgctggcctgcctggctcccgaacgactggaggagggtgccgccagcgtgccgatcggcagcgtggtcggcgcgcgggtcgcctacatcctggatgccgacctggccctggtgccgcagggcgcgaccggcgaactctacgtcggcggcgccggcctggcgcgcggctaccatga

SEQ ID NO: 7052 - DNA, 831 bp, Pseudomonas aeruginosa
gcgtccggcgctcagcgccgagcgcttcgtgcccgatcccttcgctgccgagggcggccgcctgtaccgcaccggcgacctggtgcgcctgtgcgacaacggccaggtggaatatgtcggccgcatcgaccaccaggtgaagatccgtggcttccgcatcgaactgggcgagatcgaggcgcgcctgctggagcatccgcaggttcgcgaagcgctggtcctggcgctcgacagcccgagcggcaagcagttggccggttatgtcgccagcgcggtggccgagcaggacgaggacgcccaggcggcgctgcgcgaggcgctgaaaacgcatctcaagcagcaattgccggactacatggtgccggcccacctgctgttgctcgccagcctgccgctgaccgccaacggcaagctcgaccgccgcgcgctgccggcgcccgacccggcgctcaaccggcaggcctacgaggccccgcgcagcgtgctggagcagcaactggccggggtctggcgcgaggtgctgaacgtcgagcgggtaggtctcggcgacaacttcttcgaactgggcggcgattcgatcctgtcgatccaggtggtcagccgcgcccgccagctcggcatccacttcagcccccgcgacctgttccagcaccagaccgtgcagagcctcgccgcggtggcccggcacagccaggccagccaggccgagcaggggccggtgcagggcgacagcgcgctgacgccgatccagcactggttcttcgacctgccgctggcgcgccgcgaacactggaaccaggcgctgctgttgcagccgcggcaggccattga

SEQ ID NO: 7053 - DNA, 324 bp, Pseudomonas aeruginosa
ccgtggtctgctatccgggtgatgacctcggcctgcacctgtcctacgaccagcgctacttcgaggcgccgaccgtcgagcgcctgctcggcgagttcaagcgcctgctgctggccctggccgacggtttccacggcgaactggaggccttgccgctgctcggcgaggacgagcgcgacttcctcctcgacggctgcaaccgcagcgcccgcgactacccgctggagcaaggctacgtgcggctgttcgaggcgcaggtggcagcccatccgcagcgcatcgccgccagttgcctggaacagcgctggagctacgccgagctga

SEQ ID NO: 7054 - DNA, 357 bp, Pseudomonas aeruginosa
atgcctacgggccggcggaatgctccgacgacgtggcgttcttccgcgtcgacctggcctccaccgagagcacctacctgccgatcggcagtcccaccgacaacaaccgcctgtacctgctcggcgccggcgccgacgacgccttcgaactggtgccgctgggcgcggtgggcgagctgtgcgtggccggcaccggcgtcggtcgtggctacgtcggcgatccgctgcgcaccgcccaggccttcgtcccgcatccgttcggcgcgccgggcgagcgtctgtaccgtaccggcgacctggcgcggcggcgcgccgacggagtgctggagtatgtcgggcggatcgaccaccaggtga

SEQ ID NO: 7055 - DNA, 1212 bp, Pseudomonas aeruginosa
cccgtttgctcgatgataaagaagagcccggcggcaccctggcctacatcaacggtgcgttgctgtcgctgctcagcgatgccttgtccgaaatcgaggcgggccacccgagcctgtagcgccgctccctggcgcgacgcccccggcctggccgggggctttgcggcatcgccatcacaagacctttcgcgcccgaacggcacgcttgatcgccgtcccggtcctcgcgaaacggccgccaattgcccgaagcttccgacccttttttcggacgatttcttacgcccttataaatcagcaagttacgagacctcgaaaaaagagggtttctggcagggaaaaacccgccgctcctgttttccgccaaatggctataggttttccgggccagcccagtgccacgcagataaccaggaaatgctcagggaacgggttcggctgcgagcagttcaccgccatatagacagtggacaagagcctaccctcataggcctagctgttcagcgggcttgtgccatcggagacttcgtacaaggcttagccattgccgtcctacaggcgctgtcagtaggcttttttcgccggcgacttcggttcccggcaggccacagcctgctggcccaacacccacgagcggcctgtctccctgccgcgccggcagaagccaggcagcggacagctcagagaaggatttctcctatgcacggccatacccagcttgccccgcactacttcttccgacagcagcgattgctgcgcgcgctgctgatcgacgaccaggcctggttcgtcctcgacgacttcgcccggctgatcgaacacagccagcccgaacagatgctcgcccgcctggacgacgaccaggcgcgccgggagtcgttgcgttccgaacgtggcgaagaccaggcgcagtggctgatcagcgagtccggcgcgtatgccgcgctgatctaccagcagcgcggcgatggcagcgaattgcgccgctggctcagcggcgaggtggtgccggagttgcgcagcgccaccgacgacagcggcatgccacgctacgtcaagttgcgctgggagcgccaggtggtgcacatgctcgactggcagggcaagctctgggtgaatttcagcgagatgcccgacctcctcgaacgccagggcgaacccatggtgcaactgggttggcgacgctggttgcgcaagttgcgcccgctctag

SEQ ID NO: 7056 - DNA, 4242 bp, Pseudomonas aeruginosa
gtccagcgcagcaccagactcgccgccgtagacctggccatcgacgctcagctcgttgggcaacggcgcctgcttgtcgtggatcggcccggtgggctggtccagcggctggaacagggcgtcggcgaagctctggtcgaactgtccgaggtagttgaaggtgatcggcgccgtgggcagcgcggccatcgcctggcgcaccgccggatcggcgaggtagcgcagcacgccgtagccgaggcctttgtgcggcaccgcgcggagctgttctttgatcgccttgatcgactcgcccgggctctgcgccggggtcaggcgcaacgggtaggcgctggtgaaccagccgacgctgcgggtcaggtcgatatcgtcgaacagcgcctcgcggccatgcccttccaactgcaccagcgtcgatggctgcccgctccagcggcagagcacgcgagcgagggcggtcagcagcaggtcgttgacctgggtgcggtaggccgccggcgcctgttgcagcaattgccgggtacgttgcgggtcgagccgcaggctgacactttccgccagcgcctcgcggttgtcgccctgcgggcggtcgcacggccactcgaccggctgcccacccagccgggcttgccaccagcccagctcctcgcgcagcgattcgctgccggcgtaggcctgcaggcgtccggcccagtcgcggaaggcgctggtcttggccggcagcgccggttcggcgccctcggcgaactgacggtagacctgttgcaggtcctccagcagcacccgccaggacaccccgtccaccaccaggtggtggatcgccagcagcaggcgttgctcaccggccgggccgtccaccagcaccgcgcgcagcagcggcccctgttcgaggtcgaggctgcgctgggccttggcgaacagctcggcgcattcgtcgaaggattgcaccgggacgtgccagagcagttcctgttcgcgcagcggacgatgctgcgccagccactcgccgtcgacctggcggaacgccaggcgcagggcatcatgctgttcgaccaggcgttgcagggacttgcgcagcagaccgaggtcaatggcctgccgcggctgcaacagcagcgcctggttccagtgttcgcggcgcgccagcggcaggtcgaagaaccagtgctggatcggcgtcagcgcgctgtcgccctgcaccggcccctgctcggcctggctggcctggctgtgccgggccaccgcggcgaggctctgcacggtctggtgctggaacaggtcgcgggggctgaagtggatgccgagctggcgggcgcggctgaccacctggatcgacaggatcgaatcgccgcccagttcgaagaagttgtcgccgagacctacccgctcgacgttcagcacctcgcgccagaccccggccagttgctgctccagcacgctgcgcggggcctcgtaggcctgccggttgagcgccgggtcgggcgccggcagcgcgcggcggtcgagcttgccgttggcggtcagcggcaggctggcgagcaacagcaggtgggccggcaccatgtagtccggcaattgctgcttgagatgcgttttcagcgcctcgcgcagcgccgcctgggcgtcctcgtcctgctcggccaccgcgctggcgacataaccggccaactgcttgccgctcgggctgtcgagcgccaggaccagcgcttcgcgaacctgcggatgctccagcaggcgcgcctcgatctcgcccagttcgatgcggaagccacggatcttcacctggtggtcgatgcggccgacatattccacctggccgttgtcgcacaggcgcaccaggtcgccggtgcggtacaggcggccgccctcggcagcgaagggatcgggcacgaagcgctcggcgctgagcgccggacgctcatggtagccgcgcgccaggccggcgccgccgacgtagagttcgccggtcgcgccctgcggcaccagggccaggtcggcatccaggatgtaggcgacccgcgcgccgaccacgctgccgatcggcacgctggcggcaccctcctccagtcgttcgggagccaggcaggccagcggcatgaccaccgtctcggtcggtccgtaggcattgaagaacgacgccggggcgaaggcctggcgaatccgttgcaggtgctcgccggtcagcgcttcgccgccggtgatgcacatgcgcaccggcaactgccggccctggctctccagccactgggcgagctggctgccgtagctcggggtgaagccgaggatgctcacgccctccgcgcggatcagctcgcagatttcctccgcgccccactggccctgggcccgcagcaccacgcgggcgccgcacagcaacggggccagcaggcgctcgctggcagcgtcgaagttgatcgaatagaagtgcagttcgcaatcctcggcgcgcatgccgaagcactcgatcaccgcggcgcagtgcatggcgatctcgccgtgggagaccgccacgcccttcggcttgccggtggagccggaggtatagatcaggtaggcctggtgctgcggcccgctcagcgctgccagcggcgcggggtcctcggcgtccagcgccgggccgtcctcctcgaggcaccagcgcgccacgcctgccggcagctcgccgagggcctcgaacagcgccgcgtggctgagcagcaggcgtacgccgctgtcctcgatcatgtattgcaggcgctccagcggatattccgggtccagcggcacgtaggcgccgccggccttgaggatcgccagcaggccgacgaccatctccagcgaacgctccagggccaggccgacccgcacttccgggccgacgccgtgactgcgcaggacgcgcgccagacggttggagcgggcatcgagttcggcatagctcagggtctgtccggcgaaggtcagcgccggggcctgggggctggccgccacgcgggcggcgaacaggccatggagggtgtcctggagccctgcctcgccggccgtgccggcgagcagcagttgcttccgctcctcggcggcgaacagcggcaattcggcaatgcgccgctgcgggtcgcccagcagcgcctccagcaggttctgccagtgtccggccatccgcgcgatgcgcggttcgtcgaacaggtcgcggctgtaggtcaggcagcagccgaggcgctggtcgaggtcggtgacctcaaggttgaggtcgaacttggtcgcccgcgcatcgttggcgatgtactcgacggtcatcccggccagttgccgggtctgctggaactcccagcgctggacgttgcacatcacctggaacaacgggttgtaggcggcgctgcgcggaggttgcagggcttccaccaggtggtcgaacggcaggtcctggtgcgactggccatcgatcacggtctgccgcacctgctcaagcagctcgccgacgctcatctgtccgtcgagccggcagcgcagcacctgggtattgaggaaggcgccgatcagcccttcgctctccgggcggatgcggttcgccaccggcgcgccgatacgcaggtcctgctggccgctgtagcggtagagcaaggccgcaagggtggcggtcatggtcatgaacatggtcagcccgcgggcggcgttgaagcgacgcacgcgctcggccagctcggggctcaggtcgaagcggtagaggtcgccctggtggctctgcaccggcgggcgtggccggtcgcccggcagttcgagcagcggatgctcgttgcccagctgggccttccagtagtcgagctggcgctggcgctcgccgctctccagccactcgcgctgccacacgctgtagtccaggtactggaccggcaacggctccagcggcgattcgcggtcgtcgaggaaggcctcgtagagcgcgcccagttcgcgggcgaagatgtccatcgcccagccttcggtgacgatgtggtgcagggtcaccaccaggtagtgctcgcgctcggccatcttcaccatgcagacccgcagcaacggcccgctctcaaggtcgaagggccggtgcgcctcgctgtcggcgagggtctgcaggtgctgctggcggctgtcgcggtcgagcgcggagaagtcctgccagtccatgtgcaggccgccatcgccgtgcacgcgctgtaccggcacgccgtcgacgctggggaacgtggtgcgcagggtctcgtggcgctgcaccagggcctgtag

SEQ ID NO: 7057 - DNA, 4236 bp, Pseudomonas aeruginosa
cgcggcgcgcagacgctggttctgctcggcttccgcctcggcgccgacagcgccagtgtagtacccgaccaactggctgccggccacgccttcgcggatcaccactaccgcctgggccacccccggctgcgccagcaggcgtgcctggatttcctccggctcgatgcggaagccacgcagcttgacctgctggtcgaggcggccgaggtattccagcacgccgtcggcgttccagcgcgcgcggtcgccggtgcggtacaggcgctcgccagcggccgagagcggatcggcgacgaagcgctcggcgctcagcgccgggcgccccaggtagccgcgggccaggcccaggccgccgatgcacagctcgccggcgacgccggccggcagcaggttgaactcggcgtccagcacgcggcagagcacgttgcccagcggtcggccgatcggcgaacgctcgccgtcttccgcgcggcactgccaatgggtgacgttgatggcggtctcggtcggcccgtagcggttatgcagggccaccgccggcaggcgttgcaacacgcggttgcgcagctccgccggaagcgcctcgccgccggagaacaggcggcgcaggctgccgcaggcggcgacgccgggttcgtcgatgaacagttgcagcagcggcggcacgaagtgcagcgtggtcaccccgaactgccgcaccagttccaccaggcgcgccggatcgcggtgctcgccgggggcggcgaggaccagccggcaaccggtgaccagcggccagaagcactcccacaccgacacgtcgaagctcaccggcgccttctgcatcagcacgtcgtcgccgtcgagggcgtaggtggcctgcatccattgcaggcgctcggccagcgccgcgtgggtgttgcccacgcccttcggctggccggtggagccggaggtgtagatgacgtaggcgagattgtcgccgtgcaggtgcaggcccggtgcctggctcggccagttgtcgagcttgaggctgtccaggcagatcggcgtgacgccctccgcgccaggcaggcgctcgaacagatgggcctgggtcagcagcaactcgacgccgctgtcggcgagcatgtaggccaggcgttcgctggggtagtccgggtccagcggcacgtaggcgccgcccgccttgacgatcgccagcagaccgaccagcagttgcggcgaacgctcggcgcagatcgctacccgcacgtccgggccgacgcccttgtcgcgcaggtagtgggccaggcggttggcccgggcgtgcagttcggcgtagccgaggctgccgccgtcccactccagggcgacgcgttcggcggactgcaccagttgccgctccagcagctccggcagccaggcgcgcgccggctcgcagggcgcgctgccccattcggcgaggtgcgccgcctgctcggcgtcgaccagggcgatatcgccgaggcagcgctgcgggtcttccgcgacctggcgcagcagctccaggtattgcgcggcgaaacgccggatgctggcctcgtcgaagaggtccgcggcgtagtcgaaattcagggtcaggcgaccgcgagcgtcctcctcgctctgcagttgcaggtcgaacttggcttcgcggctgtgccagggcagctcgtcggcgagcaggccgggcagccggcgcaacgccgacaggtcgcgctgctggtggttgaacagcacctggaacaactggccgccctggccgcaggccgcgagcacctggtcgaacggcaggtcctggttggcctgggcgccgagggtcgcctcgcgagcctcgccgagcaatgcggcgaacggctggcgcgcccggggcgtgccgcgcaggaccagggtgttgatgaagaagccgaccagcccctgggtctccaggcgctggcggttggcgctgggcacgccgatgcggatctcgccctgcccgctgtggcgatgcagcagcgcctggaacgccgccagcagccacatgaagacactcgcctcatggtccagcgcggcctcgcggatagcccgcgccagggcttcgtcgacccgcaggctgtagcgcgcggcgggcgacgcctggcgcgccgtgcgcggatggtcggtggccagttccagcaccggcgccgtgtcgcccaggcgttcccgccagtaggccagttggcgggcgccctcgcccgcgtccagccactgccgttgccaggcagcgaactcggcgtagtgcagttccagcggcgccaggtcggccggctggccgccgcaggcttcggcgtagagccgcgagaattcgtcgagcagcaggttcagcgaccaaccatcggcgacgatgtgatgcagggtgacccagagctggtgctcctgttcgtccaggcgcaccaggctgacccgcagcagcggccccttttccaggtcgaacggctgctgcgcctcggcttcgcggcgctgcgcggcagccgcggcgcgttcgtgctcggccagcgcggcgaggtcgacgaactgccaggcgaactcgccccgctcgtcgatacgctgcaaggccgcgccgtcgcgctcgaggaaacgcgtgcgcagcgcttcgtggcgttcgaccagccgctggaagctggcgcgcagcgccgcttcgtccagctcgccgcgcaggcgcaggccgccggggatgttgtaggcggcgctctgcggatcgatctgccaggtcagccagagacgctgctgcgccgccgactgcggcaggtcgacaccgcgcggcaggtgcgccatcggtgcctcggccggcaggccggcggccagttggcgggccaccgtggcgctgaaggcctgcagggtcggcgcctcgaacagttggcgcaggtcgagggcgacgccgagactgtcgcgcacctgggcgaccacctgggcggcgccgatggaattgccgccaagcaggaagaagtgatcgcgcggcgctacctgcgccacgcccagccgggccttccagatctcgccgatgcgtgccagcagttcgtcgtcgcctgccggcggctgcgcctcctgcacggcctggaggccgggaaacagcgcatagctgtccaggctgccgtcttccaggcgcaggcggcaggcggaacgttgcagcttgccgctggacgtcttcggcaaggcgccgggattgagcagcgccaccaccttcggcgcttcctggtaggcctcggccaccgcctggcggatcgagtcgatcagctcctgggccggcaccgatttctggacgccgcgaccgatctcggcggcgatgccgatgccttcctcgccatcgaccgtgaccgcgaaggccgcgaccctgcccttgcgcgccgacggcacctcgctctcgacggtgcgttcgatgtcctgcggatagaggttgtggccgcggacgatgagcatgtccttcaggcgcccggtgacgaacagttcgccgtcgcggaggaagccgaggtcgccggtgcgcagccaggtgcgcccgtcacgctcgacgaaggtcttcgccgaagcttccgggttgcgccagtagccgtgggcgatgctcggcccggcggcccagatctcgccgacgttgtcgtcgccgaggacctcgccgctcgccgcgtcgacgatcagcacggcgtgttccggctggctgcggccgcagcacatcagcacgctgccttcgccttcggcgatgcggttgcgcgccagcgcctcgccatccaccgccagggcgggaatgccctggccgcgctggccgccggtgacgaacagggtcgcctcggcgaggccgtagcaggcgaagaaactggacgcatcgaagcggctggcggcgaatttctcggcgaagcgttccaggctgtcctggcggatcggctcggaaccggagaaggctacccgccagccgctcaggtcgagacgctgcagggccgactcggcgacccgctcgctgcacagccggtaggcgaaatcgggaccgccgctgacggtgccgccgtactggctgatggcttccagccagcgcaccggacgttcgaggaagtagcgcggcgacatcagcacgcagggtacgccgctgaagatcggttgcagcaggccgccgatcaggcccatgtggtggtacagcggcagccagctgacgatcacgtcgtcggcaccgatgccgaagcctcggcggatcagcaccttgttggcgaccaggttgccatgggtgacctgcacgcccttgggcaatgcggttga

SEQ ID NO: 7058 - DNA, 1485 bp, Pseudomonas aeruginosa
gcttgctcaaggctggatcgatttagcttgcgaatcaagcggatagaaagcccaaggaaaacgaccaggaggagccgagaatgcgtcgagcgattgccactgtatcgtgggcccaccgatgagcctgcgtttcgacgatatcgaagccttcctcaacgtcgccgaactcaacagcgtgacgtcggcggccgagcgcatgagcctgtccaagtcggtgatcagcaagcgtgtcagcgatctcgaacgacgcctcggcgtccgcctgctctatcgcaccacgcgcaacgtcgagccgaccgaggccgggcatttcttctacaaggccgccaaggcctcgctgcaggaactcaacaacgccgcggagattgtcgccctgcgcgagaacgacctgtgcggcgaattgcgcatcgtcaccccgatgagcttcggcaccctctggctgtcgccgatcatcgccgacttcatgagccagcacccgcgcctggagatcgtcctgcagatggacgaccgcctcaccgacttcgagaaggaaggctacgacctgagcatccgcgtcacccgcctggacgacagttcgctgatcgcccggccgctggccaacagccagcgggtggtctgctgcagccccgactacgcggaacgccacggcacgctggacaccctcgaacaactgatgcagcacgagtgcctgggctacaacaacgccacgccgagccaggtttggaccttcgaaccggcgttccccggtgccaagccccgcgccgtctcgccacgcggacgcttcagcagcaacaacggccaggccatgcgcgacgccgccctgcgcggccagggactggcgttgctgccgctgttcatcgtcgccgaggacctcaagaacggccgcctggtggacgccgcgcccggcctgcgcccactcgacgacgtgatctacgcgatgtattcgcgggcggcggcgatgtcgccgaaggtcaaggcgttcatccagcatctccagcaggcgctgtcgatcccgccctggggcaacggctgagcgaccgaaccattccggcgaggctccggtcagatactgggcatgcggagaagactcccaggagcctgtcgtctctcccccgtccggccacccggcccacaaaggagaactgccatgatcgtgcgtaccctgctcatcgccgccgccctgctcggcggtaccgcccaagccgccgaaagcaccgacctgtgcggcgccaacctgcagaagctggacgatatcctcgccgtgcgcggcaagacctcggtcaccggtgcgcgggtcaccgaggtcaaggaactccaggccaaggccaggcaggaccaggccagcggcgacaccaagggctgcatcaccgccaccacccaggccctgcagatcctgcagaacgccgggaagaaatgatccgcgacagacgcaaggcggataaccgcaagcggttatccgccctcccccaatgcaaccctccgtag

SEQ ID NO: 7059 - DNA, 1275 bp, Pseudomonas aeruginosa
tgccgacgcagggtagccgtttcacgttcgcttgtccgtccattgtttcacagcccgcgaagggcaccgtcgggcagcggctcatggctgcccaccttgcagaatcaggcggccatcgtcgcgcggatcgacgctgccgaccgaaccggccttgccgaggatcgccggcacccgttcgcggtacaggcgccagagcaggccggcatcggtcgcgcccagcgccggggccaggccaacgatgctggcggtgtcgcggcgcgcctgggccagccgttcgccggcctcggcgcgggcgagctgcagggtgcggtcggccccctcggtggcggcctgggtgagtttctccgcctcggtgcgcgccttggcgacgttctgctcggccagttggctggcggtcagcaccgcgttgaaggcgcttaccgcattgcgcggcaggctcgactgcacgtcgacccgcaccacctggatgcccagcccgctgccggccgcggccaacgccgccaggctgtggttgatgccctgcaccaggtcgccgcgcaggcgttcgcggcgctcggcgaccgcgctgtcgttgccgagcaactccgggcgcgccaccaggatggtgtccaggtcgcgcgcggcgcagacctgcacggcgttgcgcgccaccagccggtccagcgccggcagcacgtgggcgccctggaggacgtaggcgtacgggtcgtcgaccttgtagaacacccgcacgtccagttgcaccaccccggcgtcgccggtcagcaggtagccggagccggccagcgcgtcgctggacaggctgacgtcgagatcggcgcgacgcgcctgctcggaacgcagcaggccctcgacgcggcgttcgatcacctgttcggcggacggcagcagcaccacctgctccagcggctgcggccaggccagcagcaggccgggaccggccaggcgctccagcgcgcccaggcgcagcactacggcgacggttctccgggccgatctggcggacgttggaaaacgcccaggccagcgccgccaggagggtcacgccgaacagtgcgaggaacgccaggcgtccggcctgcagccaggggctgcgcagcccctcgcgcgcttcgccgctcatggccggcgcccgttggccggcgcttcggcggggaacgccggcggcccgtcgaccagcacgcggaacggtgcggcatcggtgcgcaagaccagccgggtatcgccgttgacgatggtgccgagggtgtccagcgagcgcagcaggttgtatag

SEQ ID NO: 7060 - DNA, 942 bp, Pseudomonas aeruginosa
ccccaggtgcaggccggggccgagcaccgcgaccggcttgccgaagcgctcgtagacaccccgtgcatccatgccgatctcgcgtacgccgctgagcagccagccgttcagcaacaccaccgccagcaccggcaggaacgcccgccgcatgaaaccgaaggcccagacctggcgcaggtcgatgccgaagcgctggtgcaactcatgctgcagacgctgcaggggacgcggcggccagcgcaacaggtcggccagcaggctggtggcgaccaggcgcggttcgaggccggcacgctgcggcgcgaacatcgccaggatcgccctgcccagcaactccagcgccagcgccgccggcaacaggccgagcagtaccgccaggcgcggggcccaggggtgtccctggcgagccaggaacagacagagggcggccagcaccagggtaccgatcaacgcccgcgccagttgcccgaggaccggggcttccggccactgcaccggcccttggctggcgaggcgacgttccagcaccagcaccgcgaaggccagcagcaggcagataccgatggcgaggtcggccgcttgcccggaactggcccgcggcatgtcgagacgccagccggcggctaccaggcacaacgccagcgccgcgctcgccgccagccacagcgcagcgtgcccgatctgggccaagccgtgggcgatggcctggccccaggcgctccagcaaccgttcataggcgctgtcggcggtggcgtcgggttcgtcccgctgccagcgcagccaggcagcccgcgcgctgggcctccgcgccgaggaccacgcaacggccagggccgggacccggtagaccgcgtgcagaccggcgaacaggaccagccaggccgcgccgaggttgtacagcagcggcggccagagcgagtcggcggcgaacaggccgatga

SEQ ID NO: 7061 - DNA, 1548 bp, Pseudomonas aeruginosa
cccgcgcagttggcgcgaagcggtggccgagacgctctggcaggccgatgcgactgccgccggacccttgctggaactgctggagggttacagcggcgcggcactcatggcggtgttcgaacgcaccggcgacgaccagcgtcgcagccgcaacctcgacctcctcctgcgcaagctggaacgcctcgatccggcctcgcagcaggccttgcacgcggcctgcccggttcccgcaccgtacagcgctggcgactgggagcgggtccgccgcctggaaaacagcggcctgcttcgcttcggcctgcgcggacaggagccgcacccatcggcaggcctttgcgccgaggactgtctcggccgcgcccaccgccagctccagcagcattgcgccgcccccctgccggtgttctgccaagctcgcaccacacccgccgcgcaacccggcctgcgcgccgccctcggtcggcttggctaccgcttcgccttcggcgcgcgcaatggcctggtggatacccgttgcgacccgctggacctgccgcgcatcgaggtggatgcggcgatcgccgcccgtcccggccggctggcctggcgcatctatcgtggagcccgcccatgagcatggcttccagcccgttcccaaggaggcgcgacaggcagtcgccctccgccggaagaccgcccgaaccacgggaagcgaacgcgccgtcgcccgccatgccgcagcgacgccgctctcagggatatggccagcccagctggcccggtatcagcaaggatcgtcccatgactgcagacacccctacctctgtcgctaccatcaaccacctgctgctcggcgcgccctacaccagcccactggtgatccccggcgactggctggtcgacgagctggaaggcgccgtggaggtcggcggcttcaccgacggcctgttccgctggccgacgcgcaagcgcagcggccgcccttcgccgattctctgcggcgacctgctgcgcgcggtacgtaccgaatgcgccgagtcggtgcagttctggtggggtttcagtccgagcctggtggggcgctggcgccgcgccctcggcgtgacccgccgcaacaatcccggcgaccaggcggtggcgcgcgcccgcgccgccctcgcccgctcgctggaccgcaaggcgccgccgaaggcaccggccgcctggtccagcgaagaagtcgagttcatccgccgccacggcagcaagcgcagcctggcctggtgcgcctacatgctcggccgcagctaccagagtgtctcccagcaaggccgaggagctttccccgcacagcgggcgcgaccgcaacaatgcgatctggagcaagtccgaggaagatctgttgcgccagcactaccagcagcgcggctcgctatggtgcgcgcagcagaccggcaagacccgccgcagcggtattccaccgggccaagaagctgggcctgcaacggcagcggccgaaacacccgtgaggccggtcgccgccttctcccgccgaggcgagagagggccagtgctcaaccgcggtag

SEQ ID NO: 7062 - DNA, 564 bp, Pseudomonas aeruginosa
ccggcgaagggcaccatcttcgcccccagttccaggtgcagggcgtgcaggggcgtcttggcgagggtttctgcggtcatgtttcactccatggcatcccggcctcctgtctgccggagagccgcgatcgattgtcgggaaagagaaaagaagcgccggcgcagcggcgcggttcagcattcgatgatgttcacggcgaggccgccgcgcgcggtttccttgtatttgcttttcatgtcggcgccggtctggcgcatggtgcggatgaccttgtcgagagagatgaagtgctggccgtcgccgcgcagggccatgcgcgccgcgttgatggccttcaccgaagccatcgcgttgcgttcgatgcagggcacctggaccagcccgccaaccgggtcgcaggtcagcccgaggttgtgctccatgccgatttcggcggcgttctcgacctgctgcacgctaccgccgagcacttcgcagagcgccccggcggccatcgaacaggccaccccgacctcgccctggcaaccgacctcggcgccggagatcgaggcgttttccttgtag

SEQ ID NO: 7063 - DNA, 462 bp, Pseudomonas aeruginosa
gccagcggcttgcggatcagcgcaaggtgttccttctcgacgaagcggatcggccgctcgccgagcaggcgcagctcgccgctggaacggatggcatcgagccgagcgggaatcgcggcggtatccaccgtgtccggctgctcgccctccaggccgagcagtaccgccttgtcgctgccgtggcccttgccggtggcgccgagcgagccgtacagctcgaccttgacgctggcagtggcctccagcaacccctcgcgcctcagcccctcggcaaagcgcgcggcggcacgcatcggccccacggtgtgggagctggacggcccgatgccgatcttgaacagatcgaagacactcagggacatgctcgtctccgcttgcggattggccgccaccatggcggcgctcctgttcaatcagcgtagaccgggaagtgccggcagaattcgccgacctggcccctga

SEQ ID NO: 7064 - DNA, 393 bp, Pseudomonas aeruginosa
tggcggttgaagatcgggtggctgaggatcgccgactggcgcagcagctcgaccggcaggcggtccccgctgctggcggcaagggtggcgaagtccgggagcgcctggccctcttcagccagcaggccccagagcgtttccacgtcggcctggcggacggtctcgtcgagcgacaggccgagacggccggcatcgatctcgcgcaggttgatcccggcggcgcgggccttggcatggatcgccgcggtacgcgcgccggtggccaggctcagggtgtcgaagaaatgcttctgctcgacggccacgcccaggcgctccaggccggcggcgaggatcgcggtcagccggtgggtgcgccgggcgatgcgcagcaggccctgcgggccgtggtag

SEQ ID NO: 7065 - DNA, 1758 bp, Pseudomonas aeruginosa
cccaggcgctggagcatggcctgggtgtcggcggcacgcgggccgatatggcgggcgatgaattcgtcgtcggtgcccaggtcgatggcgccgaggttcaggttatcggtcatgacgggatcctcaggcgtcggcgttggcgttcagcaggcggtcgtaggcggcctggtcgagcagcttttcccaggcgccggcgtcggccggacggaagcggaagaaccaggcctcgccgagcggatcctggttgaccagctccggggcgtccggcagcgcgtcgttgatcgccaccacctcgccgtccagcggcatcaggatgttgctggcggccttgaccgactccagcaccgccacttcactgccggcggcgtgttcgccgagttccggcaactgcacgaataccacgtcaccgagggcgtcctgggcgtaggcggtgatgccgacggtcagcagcccgtcgtcgtcctggcgcagccattcgtggtcggtggtaaagcgcaacttgctcatgctggatcctcattgtcagcgggtcgcccggtcgggacgggactttgttctgcggctgcccgtagcaagcagggtgccaagcggccccggccctgtcgccacggggcgtggccgggcgcgggggaaacccggacagggccgccatggaacgctttcgttacagacccgccggacatttcccgaaccagagcgcaaacgcctgacagcaaaggtttttccggcaatcggaacgaattcgttccactcgtaaccgaagcgttacagccgatggcacagcccctgtcgctgcaagctggcgcgcaggtgctcgaggaacgcgcggaccttccgcgtgttgcgccggtgccccggatagaggacatggatggagggcccgaacggccccgggtcgaagtggtagtcgccgagcaggcgcaccagccgcccttcaccgagcagcggcgcgacgctccactgcgggcagaactgcaggcccagcccggccagcaggtgggcgagcaggaagtcgtagttgtcgctggccagtcgcgggcgcggctggtcgatacgctggcgggcgccgtcgcgctccatccaccagaagttctggttcagcgaagggtgctggaagaccagccaggcgtgccgctcgaaatcctccgggccttgcggcgcgggttgccgcgccaggtaggcggggctggcgcaaagcacgatctggttcggcgccagcggccgcgccaccagccccggcaggtcaatggggccgtcgcgcaggccgaggtcgtagccgccttcgctgagatcgaggaaggtttcgtcgaggtccacccgcaggctgatccgcggatgcgcctcgaggaagctggcgcaggcctgctggaggaacgccgcggcgaacgacggcggcgcggcgaggcgcagttcgccgcgcaactccgactccagcagttcgatctcctgccccgccgtgcgcagcgtttccagggactgacgagccgcctccaggtagatctgcccggcctcggtcagcgccaggctgcgggtggtgcgctcgaacaggcgggcaccgagttccgcttccaggtgggcgacggccttggtcagcgccgagggcgtcttgcccaggcgctcggcgccacggctgaagctaccggtttcggcagtggcgacgaacatcgccagggcattcaatttgtccatcgactccttccgttccggcacaagtgttgtgcgtcgcgcccggttctgccgggccggcgctttggctag

SEQ ID NO: 7066 - DNA, 2751 bp, Pseudomonas aeruginosa
agacctggttcgccggcaagccggtgtattccagcgagggctgagcccgcttcaggcgcgcggaccgatgccgtacttgcgcaggcggtgggcgatggcggtgtgcgaggtttgcaggcgcgccgccaactggcgggtcgatggatagctgacgtagagcttctccagcagggctttctcgaagccctccaccgcctcctccaggctgcccacctcgccgtcgttctgccgcgccacggcggtgccggcgatctccaggtcgccgatatccaccaggctgctctcgcagatcgcagcggcacggaagatcacgttctgcaactggcgcacgttgcccggccagcggttgctcagcagcgccgggtaggtgcccggcgccagccggcacaccgggcgctggatctgcgcacaggcctgctgcatgaagtgccgcgccagcagcaggatgtcgtggccgcgctctcgcaacggcgggacttccaggctgagcacgttgaggcggtagaacaggtcctcgcggaagctgccctcggcgaccatcttctccaggttgcggtgggtggcgctgaggatccgcacgtcgaccctcacctcgcggtcgccgccgacccggcggaagctgccgtcgctgaggaagcgcagcagcttggcttgcagatagggggacatctcgccgatctcgtcgaggaacaccgtgccctggtgggccagctccagcaggcccggcttgccgccgcgctgggcgccggtgaaggcgccgggggcgtagccgaacagctcgctttcggccaggttctccggcaacgccgcgcagttcagcgccaggaacggcgagttgtgccgcgcactcagggcatggcagccgcgcgccaccagttccttgccggtaccggtctcgccgtggatcagcagcggcgcgtcgagcgccgccacgcgctgcgcacgggtcttcagggtgcggatcggctgggaatcgccgaggagcatctcgaacccctcggcatggtcatggtgcaaggccgccaggcgctcgccgatgcggttcggttcgtagagggtcagcaggccgccggccaggtgccgctcgccctcgcccggcccttcggtgatcggcgtggcatcgagcagcagggcctggcccatgaaggtcacttcgcgcagcggcaggcggaagccctgctcgaccagcgcatcctccagggtttcatcgtcgaacaggctggccagccgctcgccggccgggtcgcgtccgcagcgctcgctgaaggccgggttggccagcagcaccaggcccttgccgtccaccgccagcaccggatcggccatcgccgccagcaacgcatcgagctgcaggcggcggcgctggccgggaaggatgtcgaccacggtcatcgcctgcacgccacggatgcccagcagcgctgcgcgcagttcctccagcacttcgggactgagggtcggcgcgtcgatgtagacgttcggcggcaccatttccaccgcatccaggttcaggttgcgcccacccagcagcgccagcacctcctgggtgatgccgacacggtcgatgaaggagacgtggatgcgcatgcgggaacctggactgcggcgacgctcgccataaagccgtcgattgtacggcctggcgccgcccagcccaaggggccggcgtcagggtacggggcgcagcgcctcgctgcgggtgcggtggctccagtcgccctcgtcgtccatcacggtttcggtcaccagcacccggcccggctgctgcgggtcggccttgtacagcaccagttcggcctcggcgtcgtcccaggtggtggagatgtccggcagcacccgcacccactggccgtcgcggatttccagcagcgacgacttggtccaggtgctggtccaccaggtacgcagcagttgcaggcgctcgcggccgctgtcgtcgaggccgccgaggacgctgagcaccgcgccggtgcaactgcccagcggcttgggcgggacgcgcgcgtcggcgctccagaggtcgcagcggcaatcctcgtattcgtcgcacaaggcggcgctgttcggcgcgtgggccactacccaggcgaagtccgcttcggcaccggcgaagcggccgcgagccagcggggtgtagcgcgggtcgacggcgtagcgggtgatctcgtcgctctcgccgacgaagcgccaggtatcgcccggcccggcgcgctcggccaggagcagccccggatagttgcgcaggcgtccgtcgaggcgtacctgcttgacgaagcgcacctcgtagcggccttcctggtcgcccggcacgatctgcggcgcagcgacgatgcgctgctcgaagtcgggatggcgggcgaagaaggcctgcttggcggagagggtgcgctcgcgcgtctgcgcgcggccatagtagtccaggcgcggcgcatagaccccttccagggccttgccgctgcgctgcccgtgggcggcctgccagcgctggaacaggccgaggatttcgctttcggcggcagcctggaccagcgctgggtacaggcagaagagcgcggcgcagaataccgggcgcaagagtcggcgcatcgagaacatccttgtcgttcgattgaggcgaacgccgattgtcccctatccgccgacgctggcaaatggccctggacgattttttccgattccgcaacgcggtgggcattgcggacacgctccggacagtcttcccccacctccaggccgcggcacggcggataa

SEQ ID NO: 7067 - DNA, 627 bp, Pseudomonas aeruginosa
ggaagaacgccagcggcaaacgctcgccagcggcgaactgccgtaccagccactgcggctgctgctcgtccggcccccaccagaacgagccggacaggctcagcaccttgccgaagcgttccgggtaacggtaggcgatgcagcccgaggccagcccgccgtagctggaaccggaaagcacgcgatcggcaggctcctcgctcaatgcatagcgctgctgcaaccagggcagcagctcatgggcgagcatgtcggcgaaggcctcgttgcagggcagctcgcggccccggctgctggcgtcgacattgccgacaatcaccgccagggtcgggcggatgcgcccggcagcgatcaggttgtcgaggatggtcggggtcggtacgtcgcgcgcgtagtggtcctcgtcgaacagcaccagcagcggatagcgctggccctcgggatcgtagcccggcggcgtgtagagcgtcagctggcgctggttggccagggcctggctggtatagccgaggcgctccaccttgccgcgcggcacgtccttgcgcggctggtcccaggtctcggcaggggcgccgccgagctgcaccagcgaggcctgctcggcccgcggcagcgcgcggctgttga

SEQ ID NO: 7068 - DNA, 990 bp, Pseudomonas aeruginosa
ttccggcttctacgaactggagcaactggacggcaagcgcacccgcgtcaacaaggaccaggtgcgcagcatcaaggacatgtaatcccccggacccgccatccgcgcggtggcgcactccagggaaggagtcgaaccatgcgatccgacctgcacgaggccaaccggctgtcgtggaacgccgccacccgggcgcacaacagccacaaggccgaccaggccgccttcttccgcaacggcggttccacgctctatcccgaggaactgcaactgctcggccatctcgacggcctgcgcctgctgcatctgcaatgcaacgccggacaggacagcctgagcctggcgcgccttggcgcccgcgtcaccggggtcgacatcgccgacagcgccatcgacttcgcccgccagctgtcccgcgacagcggcatcgccgccgacttccagcgcgacgacatcctccgctggctgcccgtcgccgccacccgcggcgaacgcttcgaacgggtcttcgcctcctacggcacgctggtctggctctccgacctcaagcgctgggccgacggcatcgcccaggtactggttcccggcgggcgcttcgtcctggtggagttccatcctttcgccctgtacttcgacccacactggcaaccggcctacgactacttcagccgcgagccgatcgccgagagcggcgtcagcgactatgtcgccgagtccggcgccagcctggcgccctccggctaccgcgccggcgtcgagaacttcagcaaccctcatcccagctacgagttccagtggggcctggccgatgtgatcggcgccctgctcggcgccggcctgcaactcgaacggctggaggaatacccctacgccaacggctgggccggcttcgacggcatgcgcgacggcggcggcggacgcatgctgccgcccgccgatcgtccgcgcctgccgctgatgtacggcctcagcgcaaggaaaccacgatga

SEQ ID NO: 7069 - DNA, 2925 bp, Pseudomonas aeruginosa
ccagggtctgctcaccagcaaacgcgacaacaacggcaacctgaccacctaccagtacaacgcccgtggcctggagacctcgcgcaccgaggccgccggcactgcgcaggcgcgcaccatcacaaccgactggcacccgaccctgttcctcccggtgcaggtcagcgagcccggccggatcacccgctaccagtacgacgccgagggacgcaagaccggcgagaccgtcaccacccgctgacaaggccgacccccatgcgcatccccccatacttcccccgcctcggcgccctcgtcctggcctgcgccctcgccctgcccgcgcaggcggccgagcgcgcctggagctacagctacaacgccctcggcctgatcaagcgcgccgacggtccgcgcaccgatgtgcaggacgtcaccctctatgcctacgacagtcgcggcaacctgacccaggtgaccaacgccctcggccaggtcacccgcctcggcgactatgacgagcgcggcaagcccggcagcatcaccgatgccaacggcgtcaccagcagcctcgcctacaccggcgtcgacggctggctggcctccgtcagcaccgccggcagcaccacccgcttcgactatgacgcggtcggccagatcacccgcgtcacccgcggcgacggcagttggctgagctacgaatacgacgacgcacggcgcctggtagcgatcggcaacaacctcggcgaacgcctcgaatacgacgtcgacaccaagggcaatcgcaccgcccagcgcatcaaggacgccagcggcagcctggtgcgccagcagcaatgggcctacgacgagcttggccggctgctccgtgcggtcggcgccggcggccagacacgcagcttcgcctacgacctcaacgacaatccggtcggcgaaaccaacccgcgccagttcgcccacagccaggccttcgatgccctcgaccggctggtcggccagagcgatcccctcggcggcaagacccgactcgcctacgacgcccaggacaacctcaccgaggtcaaggacccgcgcggtgtcaccacccgctacgaatacgacggcctcggcaacctgacccgactggtcagcccggacagcggcaccaccaccttcgagcacgacgccgccggcaacgtcatccgccgcaccgacgctcgcggtgcggtcaccgagtatcgctacgacgccctcaatcggctggtcgagcgccgctcgccgagcgacccgagcctcgacgtacagtaccgctacgacctcaccgccgacggcaacaagggcatcggccgcctgggcgccatcgatggcgctcgcgacagcctggtgtaccgctacgacgagcgcggcaacctggtcgagcaggtgcgcagcatccgcctcgaccagcagaccctgctcgaccgcgtgacctaccgctacgacgcggccaaccaactgctggagatcggctacccctccggcctcgccatcggctacccgcgcaacgccggcggccaggtcgccagcgtgaccctggcagtgggcgacaaggcgccgagcaccctggtcgggcagatcgcctacctgcccttcggcccgctgctgcgcctgacctggggcaacggcatcactctcagccgcgagtacgaccaggactaccaactgctgcggcagaaggtcggcccctggcagagcgactaccagcacgatgccaatggcaatatccagcagcaccgccacagcctctggggcaccctggactaccagtacgacccgctggaccgcctgaccgaggaacgcggcgtccagggcgggcgcagctatgcctacgacgcggtcggcaaccgcacccaacgcagcgacaaccccgcctcaggcggcaccgccagcagccaggactaccagtacgcgcccgacagcaaccgattgaccgccatcggcgcgcaagcggtgaccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcgtcaccacctacctctatggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggccaccgacgccagcggccagatcgcctggcagtggcagtccgacgccttcggccgcggcgaagcgctgagccagggcagcacccaggtcaacctgcgcttccccgggcagtactacgatgcggagagcgggctgcgctacaactacttccgcgactatgatccggagactgggcggtatgtggagagtgatcctgtagaaactctaagaaagctcaacaaccctgaaatgacatttttaaattctggcgagagcatgctgcaagccactccgtattgggaacatggattcacgccgaatcataactacacatactccgataacaatccaactgcaaaaagcgacaagcatggtctttcaccaaaccctacggacaacttgatctacacacctgacaccaactgcacatgtacattagagtgcaagaaaaaatttactggaaatggaaagtctttccttgtgggagctctatgtagcaaagccaccaccccgttctttgggggagtagtatgcaatagcacaatagtaatgatctgcggagcatcttgcagccaagagtgcaatagagcaccaagctgcgaaaaagaaggaagcggcaatgagtag

SEQ ID NO: 7070 - DNA, 2016 bp, Pseudomonas aeruginosa
agcggtcgaggtgccggtctgggtcgaggtccatttgtcgtagacgccggcagtcagccccgcagtcgtgccagcgactacatagcccctcagcgcatcgctggaggtcacgtccttgacgacatcccccaggtttccccggttgttgatggtgctgatcgctccattgctggccacgccgctgagcgctgcggtacctgccgcgttcaaccagcccgccgaagtcgtagcggtagcggctgcggtcgcgcctgccatggaggttccggccccggccgttgcaatcgccccgctggctgcgcccgccgtgaagtaagtcacgacgatcgctatcgccaactgcgcgccgacgcccagcccggagttgctgtacttccagctgtcatgcagttcctgcacgcgccgccaatccacatcgccgcgctgctccatctgcttcagccaggccagttgcggatccgcctgcaccatcgcgtcgatggtctggctcacggtcttctggtcgatatgcttgaggtcgatcttcagcccttccacggccttgatcgccagattcccctgggccacgatctggctctggcgcacggtttcgtcggtctggcccttgcccttcgacgactgccacgccaggtcgcccttgctcttctcgtggctctcctggtgcaggtccttcaccgcgtcgaaggtcaccgcgccgccgctgacgatggccaggtcgttgcccgattccagcttcgcgccctggtaagtctggtcgccgccactgagcagggtgaggtcgccgccgctggatatttggctgcccactgccgtcacatcggtgatttcgtcgcgccgggtcttcttgctaccgaagctgcctttgctcttcttgtcgtagaggtagtaactgctgtcgttggcggccagcagctccagcttgtcgccggccaccaggtaggcttcgtcgccggcgctggcctggctcgcgaccagccgcaggtcctgtccggcattgatcgccaggtcgccgccagcgtccacgcgagtggcctgctgggtgatcttgtcgtcctggaaagtgaccttcttggtcttgccataggcatgctcttcgttggcagccgcgaccaggcccacatcgcgacccgcctcgaatgtcacgtcgtgacgagcgtcgatgcggctgcccacgacgctgatatcgcgtccggcgctgacgctgatatcgcgccccgccacgacttcggcgcccatctgggtcgtctgggtctggtatgcctggcttcctgccgtccagccccgctccgctaccgcagccgaaaccaggacatccctgccgccttgcaaggcgaggtcgcccttgctgtcgatgacaccgccaatattggctacatcgcgacctgccgaaacggtcagcttctgcgcagcctcgatacgcgcggcgctatcggcaaatgcctcagtggtaccggttcccctgtaggaggactggtgctgggtcaccgtccgttcattgatgacgtctccggtaagggcggagaggcttacctcgcgcccggcaatgatgccgccctggtcattgcggatggagccgctggccagcaggtcgaggcggttgccggcctcgatcaggccgctgttgtcgatgttgccggctgtcgcgctgaggtcgttctgcgcgcgcagggtaccggcgttcctcaggtccccgccggtgatcaggttcacgtcgcgcccctggatcagcgcgccgttcgggcccaaccgcccctcggcctgggccaggtagaccacgggggcgaggaccttctcgccattcacctcgacttcttccagccaaacgatgtcgtgggtcagcgcggccacctgggcggcgctgagggtgacgccaggggtcagtcccaatacgtccttgctggcgatggcgttgtccatcagatagcggaacatcgcttcgtcgctgttcaatccggcgatgaagcgctgccccgtacgctggacgatcgcttcgcgtaccaggcgctgctcgtataa

SEQ ID NO: 7071 - DNA, 483 bp, Pseudomonas aeruginosa
accgtcgcccaggcgcttcttgctgtcatccggattgatacccaggccaccgagcaggtagtccgagttgaggaactgcttcagctcggtgagcgccgggttggtctcgatcagatacttgtggctgttgctcggtgtggcattgctgggcacgccctcaacgcgcgcaaccgacggcagggtttgcaacgctggctgcccaaccggaggctcggcaagaacggcgctccgctcttcgaggcgaggcaggctgccctgagccctaacggccgaaggcagtgcctgcaccgacgactgctcagccggcagatcggcaaggatgctgccattgccacctggactggaaactaccccctctacacgcactgtcgaaggcgaggcctggaccgtcgcctgcgcaccctgccaattggcgagaatagttccattcccatcgtgaccgggcgctgtgccttgaatacgatcagccgcgggaaggcttga

SEQ ID NO: 7072 - DNA, 1509 bp, Pseudomonas aeruginosa
attcccggaaatgttctccaagcgatttgcccagccccccgcatcgtcgcgggcgatatccagcctgccgaggctgtacacatccccgtagaggttggtgatgtcgccggcgcgcagggtcatgtcggcgccactgaacagcaacccgcgctcgttgagcagggcgggcgcgttcaatcgcaggttgccaccgccgcccagggtgccgtagttgttcaggctcgcggcgctggccacgaggtcgccggcagcggtgatccgcccacggttgaccagcaggttgccggcgccaagcgtgacattggcgccgccggcgaggctggcggcattgccgaggtcgaggctggcggcgttcagggcgaagtcgccgaggctggtggcgcggccgttgccacggtagccgccgctcagctcgagtcgcaagctgccgtcgctggccagcaggccgtcgttgctccagtcgccgccgcggccagtgaaggactgcaccgccagcagcttgccctcggccgtctggcggaaggtgccgatgtccaggttcaggcgtccggcttgcagcacgctgctgttggtccattcgctggcgcggatgtccagcaggccattggtggtcagttcgccgccggcgcggatcacctgcccggaatccaggccgaaggtgccgttgccggtatggaggatgcgcccgccggcgttggccaggctgcccagttgcaggtcgaggtcctggttggcgctttccagcacgccgtaggcgttgttcaggccgccagcgaccaaccgcgagctgccgctgcggccgagggcgcgcaggctgccgccgctgttgtcgatcgcggcggcgcgcaggtgcagctcgctttcgctttccaactggccgaagcggttggccagcgcgccggccaggctgaagtcgatgcgcccggcgccgaccttgccgccctggcccgccgccgcgccctggttgaggaagcgctggccgtcgaggctgagcaggccgctggcgtagaggccgccgccctggttgtcgaagtcggcggtgacgatgcggttgtcgccgcccagcgccgagagatggccctgctggttgcgcacgccttgcccggcgcgaatctccagcgactgcgcctgggtgacgccggcgctgttgtcgaacagcccggtgaccagcttcagccaacccttggcgctgttgagcacgccgccggcgccgttgtcgaggctgccgctctgcaggtcgaggttgccggcccggctgtccaggcggccgccctggttgtccagcgcgccgccgatacgcagccggttgtcgccctgggcctggagcgtgccctggcggttgtccaggctgccggcctgcacctcgagggcgccggcctggctgaagatcaggccgtcctgctggttgcgcagggcgccgccgcccaggcgcaggctcatgccggcctggctggcgagcgtgccggaggcgctgttgtacgagcctcaccacaaaggataggggggggg

SEQ ID NO: 7073 - DNA, 804 bp, Pseudomonas aeruginosa
  unsure (287): Identity of nucleotide at the above locations are unknown.
cgcctgatcgcaccgcagtttgtcaaacctaagttcaagggggacaagcacgatgcacaggacgccgaggcgatttgcgaagccgccagtcgtccgagcatgcgttatgtcccggtgaagagcgcagagcagcaggccgtgcagtcggtgcatcgggtgcgcagtcgtctggtgcgggcccgcacggcgttgtgcaatgaggtgcgtggcttgctgggcgagttcgggctgatcgcgacgcgacgtgggcgagcggcgacgatggccttgctcgaaacggtcacggntaccgaaccggcgcccttgccggccccgatgggcgagctgttgcgtgaattgaaagatgaattgcagacgctggaggcgcgcatcgctcgactggagcgacagattcaggctcacgtacgtggcgatgcccgcatccagcgcctgctggcggtggaaggcatcggcccgatcagcgccagcgcggtggcggcatccgccggtgatgcacggcaattccgcacgggccgccagtttgcggcctggctgggcctagtgccacggcagcactccacgggcgggcagcagcgcttgggcaacatcagcaagcgcggcgatacctacttgcggaccttgctcatccatggcgcccgtgcagtcgtgcgctgttgcgccaacaagaccgatgcccgcagccgctggctgcaaggtctgctgcaacggcgtcctgccaatgtcgtcgccgttgccctggccaacaagaatgcccggatcctttgggccttactcagccgggagacatgctaccggcccggttga

SEQ ID NO: 7074 - DNA, 315 bp, Pseudomonas aeruginosa
tctcgctcggggccagggactcgatgtagctggccagctcttccaccgtggtgcattcgaacatcgcccgtagcggcacgttgcgttgcagggccttctgcacccgcgaggcgatttgggtggccagcagcgaatgcccgccgagttcgaagaagttgtcgaacaccccgacccgctcgaccttcagcacctcggcccagatccgcgccagggtttcctccagttcgttgcgcggggcctggtaggcctggttctgcatctggccgatgtccagcgccggcagcgccttgcggtcgagcttgccgttggcgttga

SEQ ID NO: 7075 - DNA, 591 bp, Pseudomonas aeruginosa
tccgctcgaaccaggcgccctgctccaccatcagtccggccggcgagtcggcgctggaacgctgtgtctcgccgggaaccaggtagcccaccaggtacttgccgttcgccccttcctgcaccgccaccgccgcctcgcggacgtcggcgcgttcgtgcaggcgcgcctcgatctcgcccagctcgatgcggaagccgcggatcttcacctggtggtcgatccgcccgacatactccagcactccgtcggcgcgccgccgcgccaggtcgccggtacggtacagacgctcgcccggcgcgccgaacggatgcgggacgaaggcctgggcggtgcgcagcggatcgccgacgtagccacgaccgacgccggtgccggccacgcacagctcgcccaccgcgcccagcggcaccagttcgaaggcgtcgtcggcgccggcgccgagcaggtacaggcggttgttgtcggtgggactgccgatcggcaggtaggtgctctcggtggaggccaggtcgacgcggaagaacgccacgtcgtcggagcattccgccggcccgtaggcattcaccaggccgatccgcgggtagcgcttga

SEQ ID NO: 7076 - DNA, 612 bp, Pseudomonas aeruginosa
accagtagcgcgcctcgcccaggcggatcaggcgcaggtggaacggcggctgttcgagtaggtcgaagccggcctcgcgctcgcgcttgtgcagcgcttgcaggcgttcctcgtggccgtcctccggcagttcgctccagtcgaggaactcgatgcgggtgcgaccgggcttgtggatcacctgcaacatcgtttcgccggcattccagacgaacgacgcacgcagcgcctcgtggcgggccaccaccgcctgccaggcggcggcgaagcgctcgggatcgagcgggctgtcgatccggtagcggtcctgcatgtagtagatgccggtgcccggttccagcagggtgtgtaacagcaacccttcctgcatcggggtcagcggatagacgtcctcgatctcgccggccggcaccgccagggcgtccagttgcgcctggctcagttgcgccagcgggaagtcggacggggtcaggccgccggcgccgtcttccaggcaatgctcgatcagcgcctgcagttcggcgagataggcctgcgccagctcgttcaccgtccgcgcgtcctagcgctcgcggctgtaggtccagcgcagcaccagactcgccgccgtag

SEQ ID NO: 7077 - DNA, 699 bp, Pseudomonas aeruginosa
acctgttgcaggtcctccagcagcacccgccaggacaccccgtccaccaccaggtggtggatcgccagcagcaggcgttgctcaccggccgggccgtccaccagcaccgcgcgcagcagcggcccctgttcgaggtcgaggctgcgctgggccttggcgaacagctcggcgcattcgtcgaaggattgcaccgggacgtgccagagcagttcctgttcgcgcagcggacgatgctgcgccagccactcgccgtcgacctggcggaacgccaggcgcagggcatcatgctgttcgaccaggcgttgcagggacttgcgcagcagaccgaggtcaatggcctgccgcggctgcaacagcagcgcctggttccagtgttcgcggcgcgccagcggcaggtcgaagaaccagtgctggatcggcgtcagcgcgctgtcgccctgcaccggcccctgctcggcctggctggcctggctgtgccgggccaccgcggcgaggctctgcacggtctggtgctggaacaggtcgcgggggctgaagtggatgccgagctggcgggcgcggctgaccacctggatcgacaggatcgaatcgccgcccagttcgaagaagttgtcgccgagacctacccgctcgacgttcagcacctcgcgccagaccccggccagttgctgctccagcacgctgcgcggggcctcgtag

SEQ ID NO: 7078 - DNA, 270 bp, Pseudomonas aeruginosa
tacccgaccaactggctgccggccacgccttcgcggatcaccactaccgcctgggccacccccggctgcgccagcaggcgtgcctggatttcctccggctcgatgcggaagccacgcagcttgacctgctggtcgaggcggccgaggtattccagcacgccgtcggcgttccagcgcgcgcggtcgccggtgcggtacaggcgctcgccagcggccgagagcggatcggcgacgaagcgctcggcgctcagcgccgggcgccccaggtag

SEQ ID NO: 7079 - DNA, 609 bp, Pseudomonas aeruginosa
cgcggcgacatcagcacgcagggtacgccgctgaagatcggttgcagcaggccgccgatcaggcccatgtggtggtacagcggcagccagctgacgatcacgtcgtcggcaccgatgccgaagcctcggcggatcagcaccttgttggcgaccaggttgccatgggtgacctgcacgcccttgggcaatgcggttgaaccggaggtgtattggaggaaggtgatgtgctccgggacgcactcgcggctcgtcccaggcatcggcaacggccgggtccaactggtcgacgcagagcagttgcggggcgttggcggcggacagttgcgcgttcatctgcagcaatggctcgcgcaggtcagcggtggtcaggaccaggcgcggctcggcgtcggcgatgatcgacaacaggcgttcatggtgatggcggcgcgccgattccggcgggtaggccggcaccgcgatgaccccggcatacaggcaaccgaagaacgccgcgacgtagtcggggccgctgggaaacagcagtaccgcgcgatcgccccagctgcgcatgggcctgcagggccgcggcgatgctccgcgcgcgcaggtcgagatcgcgatagctga

SEQ ID NO: 7080 - DNA, 822 bp, Pseudomonas aeruginosa
agcgctgccgcgtcgccccgaggtccttcgacggctgcgccagcaaggcctccaggccccggccgaaacgccgcagggcggccagggcgaggtcctgccgcggggcgtccgcgccgccggctatgtaggcggcgacctcgcgcagcgcctcgcccagcagcggctgcaactccagcggcaccaccccggcgtcatgcagcggctcgcgcaggcggttcaacgccacgcccatcaccacgcagcccagggcgcactggaaacgttccgccgcagccggctcctggctcgccggcagcaggccgaccatcaccgccaggcgatcgatcatccgcgtctcgaaggcgaagcgctgcgcctcgctggcctcgcagcgcgacatttccgcgacgtcctggcgcgacaggtagagcagccggcgcaggcgcgggtcggcgcggaacggatagaccagggcgaacaccagcacggcgaggaccgccgcggcgaggaagccgccgacgaactcgaaccactgcgaagcgttgctgtagtagaccgcgatattctgtggcgccaccatcagcaaggtctccaggccgatgcccatggcgatcccggcgctcagcgggctgctcaggccgaccgcgaccacgtacagcagcaacgccatccacagcgccagccactcgaagtcggcggatgccggcaacagcacgaacagcagcgccgccgagatcaggatcgccagcagcagcccgcgcaggaagttctgcgccgccagcagcggacgcgggaaggtcgccatcagcgagcacatcacgccgaccagcagcaggctgctga

SEQ ID NO: 7081 - DNA, 414 bp, Pseudomonas aeruginosa
gttcgagcacttcgcccaggcgctggaacagccgcgcgtattcccagcgcaggatcgccacctgcgggcgcagcgccgggctcagcgcctcgtcgtaggactccgcgcgcgtcgccgcggcatcgaaggcctggcgcaccgcctggaactcctccagcacctcggagggtaccgcccgcccctgctcggccagcgcgtccagcacccgcaacgcacgatccagcagtgcctggatatccgccggcaacggcccgacccagtgcgcccgcaccagcaggcgatgctggcgcagcagcaacagccgcgaggccatcagcaccagcaggttacccagcaactgcaccaggccatcggcgcggcgcaggttcggcgcgtcgaaatagaggtgccggcgcaggccgtccagcgcggtga

SEQ ID NO: 7082 - DNA, 987 bp, Pseudomonas aeruginosa
aaagcccaaggaaaacgaccaggaggagccgagaatgcgtcgagcgattgccactgtatcgtgggcccaccgatgagcctgcgtttcgacgatatcgaagccttcctcaacgtcgccgaactcaacagcgtgacgtcggcggccgagcgcatgagcctgtccaagtcggtgatcagcaagcgtgtcagcgatctcgaacgacgcctcggcgtccgcctgctctatcgcaccacgcgcaacgtcgagccgaccgaggccgggcatttcttctacaaggccgccaaggcctcgctgcaggaactcaacaacgccgcggagattgtcgccctgcgcgagaacgacctgtgcggcgaattgcgcatcgtcaccccgatgagcttcggcaccctctggctgtcgccgatcatcgccgacttcatgagccagcacccgcgcctggagatcgtcctgcagatggacgaccgcctcaccgacttcgagaaggaaggctacgacctgagcatccgcgtcacccgcctggacgacagttcgctgatcgcccggccgctggccaacagccagcgggtggtctgctgcagccccgactacgcggaacgccacggcacgctggacaccctcgaacaactgatgcagcacgagtgcctgggctacaacaacgccacgccgagccaggtttggaccttcgaaccggcgttccccggtgccaagccccgcgccgtctcgccacgcggacgcttcagcagcaacaacggccaggccatgcgcgacgccgccctgcgcggccagggactggcgttgctgccgctgttcatcgtcgccgaggacctcaagaacggccgcctggtggacgccgcgcccggcctgcgcccactcgacgacgtgatctacgcgatgtattcgcgggcggcggcgatgtcgccgaaggtcaaggcgttcatccagcatctccagcaggcgctgtcgatcccgccctggggcaacggctga

SEQ ID NO: 7083 - DNA, 384 bp, Pseudomonas aeruginosa
gcgaccgaaccattccggcgaggctccggtcagatactgggcatgcggagaagactcccaggagcctgtcgtctctcccccgtccggccacccggcccacaaaggagaactgccatgatcgtgcgtaccctgctcatcgccgccgccctgctcggcggtaccgcccaagccgccgaaagcaccgacctgtgcggcgccaacctgcagaagctggacgatatcctcgccgtgcgcggcaagacctcggtcaccggtgcgcgggtcaccgaggtcaaggaactccaggccaaggccaggcaggaccaggccagcggcgacaccaagggctgcatcaccgccaccacccaggccctgcagatcctgcagaacgccgggaagaaatga

SEQ ID NO: 7084 - DNA, 2472 bp, Pseudomonas aeruginosa
tccgcgacagacgcaaggcggataaccgcaagcggttatccgccctcccccaatgcaaccctccgtagggcgaatagcgccgcaggcgttatccgccgacactccagcccccgccccgaccgcgtccgatttcgctcactcgaagcgcaggctttcccgtaccgcgcggatttccgcctggctggcgtcgtaggcctcggccaggccggcataggacagcgaataggccgaggtcttgccggccgcggtgagcaaggtctgcttcatcaccacggcgccgcgctggcgaatggtgcaggtggtctccagcgccgccagcccgccggtggtggacggctgcggcgaggtgcaggcggtctgcaggccgttgcgcaggaactcgatctgcaccagcttgcgcatgtgcccgaggactttctccaggttcactgcctgcccgctctgcaggggcatccgcgtcacttccatcaccagtgcctgggagccgtctgcctgcaacttgaccgcgcgctggcgctggccggcgccggcctggccgggctgcgcggcgggcaggtcgctgacctgccagcccgccggccagcgcgccatcgacgcctcggccaggctcagcgcggacagcgtgccgaccgccagggccagccagcgccagccgttgcgtcgcgtttgcgcctgcctcacggtgtaccctcctcttcgcgtccctccacggccggccggggctgcccgaggggctcctcgaaacgcagcaggcgtccggcattgcccagcaccagcaaggtgctgaggttgtgcagcagcgccgcgaccatcgccccggccgcgccgagcaggccaaaggctgccgcggcgacgatcgccagggtccagccgaggccgatcgccacgttgacctgcagggtccgccggcattgccggctgagccgcacgcaggtgccgagccggcgcaggtcgctgccgatcagcacgatatccgccgaggccagggcgatgtcggcgccgccggcacccattgccaccccgaccacaccggccttcagcgccagcgaatcgttgatgccgtcgccgaccaccatcggccggaaaccgctgccgatctccgcgccgacctggcgcagcttgtcctccggcaacgcctgcgccaccagttggcgaatccccacctgcttggccacggcgtcggccaccgcccggcgatcgccggtcagcaacagttgccggcccagacccagttcgcgcagatcggccatggcctcggcggcctccgcgcgtacgctgtcggcccagcagcagccagccgaggaagcgcccgtccagggcgattccggcgatcggtccctcatgctccggcacctcgctggcgtcgatgcccagttgctggaacagttcgggccggccgagggcggcttcgcccgccgctgttcgtgcgaccacgccgaacccctggcgttcgcggatatcgctcaatggatgataggcatcgtgcgccgccagggctgccagcgctcggctcaccggatggctgctggcggcgccgaggctagcggccaggcgcagcaccgacgcctcctcggcggcatctgccaggcgcagcgcctgcaggcgcaggctgccatgggtcagggtgccggtcttgtcgaccaccagcgaagtcaggtccgccagctcctcgaggaaggccgagctgcggatcaggataccgtggcgggcggccacggcgatcccggcgatagccgtggccggggcggacagcaccagggcgcagggacaggcggcgaccagcacggcgagcatggcctgggcatcgttggtgacgaaccaggtgaccgcggcgatcagcaacaccagcaacatgtactgcccggcgtagcgctccagcaggcgggtgatcggcggcttggcgcgctcggcctgctgcatcaggccgatcaccttgcccagggtcgaggcctcgccggtacgggttatctcgatgcgcagcaggccgtcgaggttgatcgcgccgccgtagacctccatccccggcgccacctcgagcggcaccgactcgccggtgatcggcgcggtgtcgagactggcctggccctgcaggacccgcccgtcggccggaacccggtcgccggcgcgcacttccacctggtcgcccgctcgcaggctggcgttgtccacctcgctcaggctgccgtcggcctcgatccgccgggcatggctgcgggtcagctcgccgagggcggcgatggcctcctgggagccgatcacgctgcgctcctccagcacatggcccaagatcatgatgatctgcaccagcgcggcggtcagcaggtcgccgctggcccaggcgccgagcatggccagcgcgatcaactggtcggtgacgccgtgcaggctcggatgccgcaggctgtcccaggcccgagcgggccaccggcagcgccaccagcagcgacgcgacgccgagcaggatctggctga

SEQ ID NO: 7085 - DNA, 522 bp, Pseudomonas aeruginosa
ccggagccggccagcgcgtcgctggacaggctgacgtcgagatcggcgcgacgcgcctgctcggaacgcagcaggccctcgacgcggcgttcgatcacctgttcggcggacggcagcagcaccacctgctccagcggctgcggccaggccagcagcaggccgggaccggccaggcgctccagcgcgcccaggcgcagcactacggcgacggttctccgggccgatctggcggacgttggaaaacgcccaggccagcgccgccaggagggtcacgccgaacagtgcgaggaacgccaggcgtccggcctgcagccaggggctgcgcagcccctcgcgcgcttcgccgctcatggccggcgcccgttggccggcgcttcggcggggaacgccggcggcccgtcgaccagcacgcggaacggtgcggcatcggtgcgcaagaccagccgggtatcgccgttgacgatggtgccgagggtgtccagcgagcgcagcaggttgtatagctgcggcgaaccggcgtag

SEQ ID NO: 7086 - DNA, 591 bp, Pseudomonas aeruginosa
tctgcgcggcctgcaccgcgtggtaggcgttcgccgcaccggccggcggatggatcgcctcgaccgccgcgcccagtacctcgacgccgctgccgaggcggtcgagatcggcctgcacggcctggccgatctgctcggccaggcccgcgcgctgctcgccgaggacctcatcgagggtccgcgaggcgaaggcatgcaccagtacgcggctggcggtgctgcgcaccagcgtcggcacgtcggcgctgcggtaggtcgccgccagcgctgccgcgtcgtcgagagcgatgcggcagacgatgcgcacgtccatgttggacgatctggaagctctgccgacggtcggccaggctggcgatgacctgcgatttctcgctgacgtgggaggcgtcccacaagcggttggcgctatccggggccggaccttcggcgggcgcgagcggctcggctccgccgtcgccggcggcgacgctggtggccaactcgtggaccaccccgttctccaccgccaacacccgccccagcggccagggtagccccaggtgcaggccggggccgagcaccgcgaccggcttgccgaagcgctcgtag

SEQ ID NO: 7087 - DNA, 990 bp, Pseudomonas aeruginosa
cggatcgtcgatgagccgggggaagccatgcgaagcctgatcgggatgacgttcctgaactcctccgtaggccagcgccggctgcgccagaacggtatcgtgctgcgcctgggaccggtagtcgcggatcgccggcgcgcgaccctgccgcaccggcaaggccactgcctcgatcgtcagggcctggaaaccctgttgctatggctacagcggcacttcctctgcgtgcccctggaacacctgctcgaaggccccgctccagcctgcctgcggatcgccctgagcgtcgacggcaaccctgcggaactggccgagctggtctatccgctgctggaacgctacgaaatgccggcgagcgccttcatcggcggtgacccgcgcagttggcgcgaagcggtggccgagacgctctggcaggccgatgcgactgccgccggacccttgctggaactgctggagggttacagcggcgcggcactcatggcggtgttcgaacgcaccggcgacgaccagcgtcgcagccgcaacctcgacctcctcctgcgcaagctggaacgcctcgatccggcctcgcagcaggccttgcacgcggcctgcccggttcccgcaccgtacagcgctggcgactgggagcgggtccgccgcctggaaaacagcggcctgcttcgcttcggcctgcgcggacaggagccgcacccatcggcaggcctttgcgccgaggactgtctcggccgcgcccaccgccagctccagcagcattgcgccgcccccctgccggtgttctgccaagctcgcaccacacccgccgcgcaacccggcctgcgcgccgccctcggtcggcttggctaccgcttcgccttcggcgcgcgcaatggcctggtggatacccgttgcgacccgctggacctgccgcgcatcgaggtggatgcggcgatcgccgcccgtcccggccggctggcctggcgcatctatcgtggagcccgcccatga

SEQ ID NO: 7088 - DNA, 1875 bp, Pseudomonas aeruginosa
acagatcgaagacactcagggacatgctcgtctccgcttgcggattggccgccaccatggcggcgctcctgttcaatcagcgtagaccgggaagtgccggcagaattcgccgacctggcccctgacccgttcgccgacctcgggattgtcgatatcgtcgaggatgtcgcagatccagccggccagttcgcggcactcgccttcgcggaaaccgcgagtggtcaccgctggggtgccgatgcggatgccggaggtgacgaacgggctctgcggatcgttcggcacggcgttcttgttcaccgtgatgtgcgccgctccgagcgccgcgtcggcggccttgccggtcagcccctgcttcaccaggctgatcagcatcaggtggttgtcggtgccgccggaaaccacgtcgtagccgcgcccgatgaacacctcggccatcgccttggcgttgcggatcacctgcgcctggtagtccttgaagcccggctccagcgcttccttgaagcacaccgccttggccgcgatcacgtgcatcagcgggccgccctgggcgccggggaataccgcggagttgagcttcttctcgatctcctcgttggcgcgcgccaggatcaggccgccgcgcgggccgcgcagggtcttgtgggtggtggtggtgaccacgtcggcgaaggggatcgggttcgggtagaggccggcggcgaccagcccggcgacgtgggccatgtcgacgaacagcagcgcgccgaccttgtcggcgatggcgcggaagcgcgggaagtcgagggtcttggagtaggcggagaagccggcgacgatcatcttcggcttatgctccacggccaggcgctcgacttcgtcgtagtcgatcagcccggtagcggtgtccaggccgtactgcacggcgttgtacagcttgccggaggaggacaccttggcgccgtgggtgagatggccgccgtgggccaggctcatgccgaggatggtgtcgccggcgttgagcagcgccaggtacaccgcggcgttggccgaggaaccagagtgcggctggacgttggcgtagtcggcgccgaacagttgcctggcgcggtcgatggccagccgctcgaccttgtcgacgtgttcgcagccgccgtagtagcgcttgcccggatagccctcggcatacttgttggtcaggccgctgccctgcgcctgcatgacccgcttgctggcgtagttctccgaggcgatcagttcgatgtggtcttcctgccgccggtcttcggcgtccatcgcggcgagcagttcgtcgtcgtagccctggagctggtcgtgcttgctgaacatggcgctggcctcttgtcgtgtcggtgtcaggacgctcgctggcgcgagcgtggccgcggcgccgctacgcaagcgcggcgccgggaaaggggtatcgccggaaacgcgaggacgccgccgctggcggcgccctcctcgtccgtcactcctcgctgtacgcctcgatgggcgggcaggagcaggtcaggttgcggtcgccgtagacgttgtcgacgcggcccaccggcggccagtacttggcctccaccaggctggccagcggataggcggcctgctcgcggctgtaggcgtggttccattcgccgagcagttcggcggcggtgtgcggcgcgttcttcagcgggttgtcttccttgtccagctcgccgcgttccaccgcgcggatttcctcgcggatgcggatcatcgcgtcgcagaaacgatccagctcggccttcgactcgctctcggtgggctcgatcatcagcgtgccggccaccgggaaggacatggtcggcgcatggaagccgaagtccatcaggcgcttggccacgtcgtcgacgctga

SEQ ID NO: 7089 - DNA, 2160 bp, Pseudomonas aeruginosa
atctgcccggcctcggtcagcgccaggctgcgggtggtgcgctcgaacaggcgggcaccgagttccgcttccaggtgggcgacggccttggtcagcgccgagggcgtcttgcccaggcgctcggcgccacggctgaagctaccggtttcggcagtggcgacgaacatcgccagggcattcaatttgtccatcgactccttccgttccggcacaagtgttgtgcgtcgcgcccggttctgccgggccggcgctttggctagtctcgccttgcccgggccacgctacacaagaccaagaagcaaaggaaaccaccatgaagcaacggattcccaccctcctcgccggcgcctgcctggccatccccctgcacaccctcggcgccgccgacctgctggtggtcaacgccaggatcttcaccgccaatccgcagcaacccttcgccgaggccctggcggtggaggacgggcggatcctcgcggtcggcgacgaggccgggctgcgcgccctggccgatggcgacagccaggtcgtcgatctcggcggcaagcgcctgatgcccggcctgatcgacacccattcgcacgcggtgttcggcggcctggagctggccggcgcggacatgggcaacgaacaggtcggcctcgacgaactggaacggcgcctgcgcgcctggcgcgacaacggcaaggcgcgacatggcgacatgctcaatgtcagcggcatgcataccgcctactggagccaggtcaaggacttccgcgcgcgcttcgaccacggcgaatgggccgaccagccgctggccttcatcggcagcgaccaccacaccggctgggccaacgccgccatgctgaaacgcgccggcatcgacgccgcgcgggtccgcgccctgcccgaggaacagcgcaacaccatcggccacgacgccgacgccacccccaacggcttcctcgccgatgccggtctcgacgcggtgctcgcggtactgccggcgccgagcgcggaacagatgctagaagccggacgcagcgcggtgcgctacagcaactcgctgggcctgaccgcatggatggacccggccgccaatggctcgccgggcgacgccctgttcagcctcaggcccgacgagaacaccgtcggcgtgctaccggtctaccagcggctggccaagggcggcgaactcagcgcccacgtcgccgccctcctggtcgccaacccacgcagccggccggccgacctcgaggtgctggacaaggtgcgccagcgcttcctcggcagccccaacctgaccctgccgggaatcaaggtgttcgccgacggcgtaccggaatacccggcgcagaccgccgcgctcctcgagccctaccgcaacagcaggaagacgggcgaactgctgatcgacccggcgcacttcggcgaactggtcagcgccgccgacgcccgcggctggctggtccacgtccacgccatcggcgaccgcgcggtgcgcgaggcgctgaacggcatgcagcaggcgcggcgcgaccgcgacagcggcatcgcccattcgattacccacctgcaactggtcaatcccaaggagttcgagcgcttcaggccgcttggcgtgatcgcctcgatgcagctgtactgggccgccgccgacgaaaccacagtggacctgatgaagccctatatcagtgccttcgcctaccgctaccagtacccggcgcactccctgctgagcaagggcgcgaccatcgccggggccagcgactggccggtgtccagcctgtcgccgtggaaggccatccagcaggcggtgacccgcaagggcccgcagggcgtgctcaacgccggcgaacgcctggaccgccagaccatgttctacgcctacacccgcaacgctgcgcggaccatcggcctggagcaccggatcggcagcctggagccgggcaagcaggcggacttcatcgtcctcgaccgcgacgtgttcgaggtgccggagacgcaactgggcgaaaccaaggtgctgaagacctggttcgccggcaagccggtgtattccagcgagggctgagcccgcttcaggcgcgcggaccgatgccgtacttgcgcaggcggtgggcgatggcggtgtgcgaggtttgcaggcgcgccgccaactggcgggtcgatggatag

SEQ ID NO: 7090 - DNA, 420 bp, Pseudomonas aeruginosa
agggtcagcaggccgccggccaggtgccgctcgccctcgcccggcccttcggtgatcggcgtggcatcgagcagcagggcctggcccatgaaggtcacttcgcgcagcggcaggcggaagccctgctcgaccagcgcatcctccagggtttcatcgtcgaacaggctggccagccgctcgccggccgggtcgcgtccgcagcgctcgctgaaggccgggttggccagcagcaccaggcccttgccgtccaccgccagcaccggatcggccatcgccgccagcaacgcatcgagctgcaggcggcggcgctggccgggaaggatgtcgaccacggtcatcgcctgcacgccacggatgcccagcagcgctgcgcgcagttcctccagcacttcgggactgagggtcggcgcgtcgatgtag

SEQ ID NO: 7091 - DNA, 2028 bp, Pseudomonas aeruginosa
accccttccagggccttgccgctgcgctgcccgtgggcggcctgccagcgctggaacaggccgaggatttcgctttcggcggcagcctggaccagcgctgggtacaggcagaagagcgcggcgcagaataccgggcgcaagagtcggcgcatcgagaacatccttgtcgttcgattgaggcgaacgccgattgtcccctatccgccgacgctggcaaatggccctggacgattttttccgattccgcaacgcggtgggcattgcggacacgctccggacagtcttcccccacctccaggccgcggcacggcggataaccgcaagcagctatccgccccacgccagccagccggctcaatgcgccggcaacaaggcctgcaacccttcggcaagctccaggctccacgccgcgtagtcgtgaccgccggggaactcgcggtagtgcagcgggtagcccttgccttgcagcgccgcgcgcaggctgcggttgctgccgagaatgccgtccgcctcgggctcctcgagcaggccggaactgaggaagaacgccagcggcaaacgctcgccagcggcgaactgccgtaccagccactgcggctgctgctcgtccggcccccaccagaacgagccggacaggctcagcaccttgccgaagcgttccgggtaacggtaggcgatgcagcccgaggccagcccgccgtagctggaaccggaaagcacgcgatcggcaggctcctcgctcaatgcatagcgctgctgcaaccagggcagcagctcatgggcgagcatgtcggcgaaggcctcgttgcagggcagctcgcggccccggctgctggcgtcgacattgccgacaatcaccgccagggtcgggcggatgcgcccggcagcgatcaggttgtcgaggatggtcggggtcggtacgtcgcgcgcgtagtggtcctcgtcgaacagcaccagcagcggatagcgctggccctcgggatcgtagcccggcggcgtgtagagcgtcagctggcgctggttggccagggcctggctggtatagccgaggcgctccaccttgccgcgcggcacgtccttgcgcggctggtcccaggtctcggcaggggcgccgccgagctgcaccagcgaggcctgctcggcccgcggcagcgcgcggctgttgagccacggcgtacggctcagcgggtccggccgcgccgccgcctgcaacgccaggcgcaaggtgccgcgatcggcctgttgcaggtccggcaggtcggcgctgagctggtaggaaacccgcgcgtcgcggcgcagcggcaggctcaggtagcgcacgtcgctgccggccagggcctcgaagcggcgggtgttgacctccggggtcggccacagcaggcgcacgtcgccgggacgctgctggcgccagaggaaggtgaccagcacacgttcggcatccagcggctccaccagcggcgtgccctgcttcgccacctgcttccagaacgccttcagcgcgccggggcgcttttccgcaagctccgcctgcaggcgttgcagggtcgggctctgcggcgccggcgaatcaagcgccggggtctgcggggtgaggcgctgggtgggggtcagggtcagtgcggtgtcttcgtcggcgctgaaggtcaggcgcaggccctggcgctcgccggcctgcaggccgagcgactggcgtccggccagctccgtcgcgcgcaacgccttgccgtcgggcgtggtggcgcgcaggcggacgcggccgcggtcgacctccaggtcgagcaactgcaactcgccgggggcaaggtcgaggtagcgctggcggctctcgccggcagcgatctcgatgcggccatcggccagcggcacgggctgggcggcctgggccggggtcagcaggttgaggaaaagcaacaacgaggtggaaacggcagacatggaatctcccttcgaagaggcgccgccatccgggcggctcaccggaagagacgtacgatcgcagcggaaatttgccgctgtgatccaggctag

SEQ ID NO: 7092 - DNA, 285 bp, Pseudomonas aeruginosa
agcggttgcgccgcgactggagtagaatccgccgcctcgaaaaccgtccgaaggaaaattccgatgacctcccgtctgctgcccgccctgttgctttcgtccgcattcgccgtcctggccggctgctccaccccgaccatcgtcaccctcaacgatggccgcgagatccaggcggtggataccccgcgctatgatcgtagttccggcttctacgaactggagcaactggacggcaagcgcacccgcgtcaacaaggaccaggtgcgcagcatcaaggacatgtaa

SEQ ID NO: 7093 - DNA, 477 bp, Pseudomonas aeruginosa
gcctggcgcgccttggcgcccgcgtcaccggggtcgacatcgccgacagcgccatcgacttcgcccgccagctgtcccgcgacagcggcatcgccgccgacttccagcgcgacgacatcctccgctggctgcccgtcgccgccacccgcggcgaacgcttcgaacgggtcttcgcctcctacggcacgctggtctggctctccgacctcaagcgctgggccgacggcatcgcccaggtactggttcccggcgggcgcttcgtcctggtggagttccatcctttcgccctgtacttcgacccacactggcaaccggcctacgactacttcagccgcgagccgatcgccgagagcggcgtcagcgactatgtcgccgagtccggcgccagcctggcgccctccggctaccgcgccggcgtcgagaacttcagcaaccctcatcccagctacgagttccagtggggcctggccgatgtga

SEQ ID NO: 7094 - DNA, 504 bp, Pseudomonas aeruginosa
tgtacggcctcagcgcaaggaaaccacgatgaccgaagaacgcctgctgcgccgcgacgaaatccccctggtctgggagatcgaccgcagcgaagtgatcgaacacctgtattccgtcgaggccggccaactggtgctgcgccccgagttctacgacatgcgcggctggccggagggcgaggccgagcattacacgccgatcctgctcgactgcttcgaccgcggcggctggttcctcggcctgttcgaccagggccgcctgatcggcgcggtagtcctcgacccacgccgcctcggccccgagcgcgactggctgcaactgaagttcctccacctcagccacgcctaccgccgccgcggcctcggcgcccacctcttccacctcgccgccacccaggcccgccacctcggcgccagcgcgctctacgtttcggctacgccgtcgcagaacacggtggatttttatatgagactcggatgccggctgtgcatggaaccggatga

SEQ ID NO: 7095 - DNA, 1593 bp, Pseudomonas aeruginosa
ggagttgtatcggttggagccggaggatgttcaccttgtttatcaaatactcagcgcataaccctgagaatagcctgcaccatgaagacccgattaaatattttacaaaccctaatatacctgtccatcttcaaccccgtaatggcggacgtctattggtacggcaacggcacagaagacaaaaaaataaaaagccccaacgaactatgcagatactacgcagaacagcgcagaaaagactcctatgaaagacctggagccggaggacatatatctctaaggggaatcaaattaaagtatgtttccgagaatattcgcgattgtaatttttactacatattcatcagcggcgcgcaagcaggaagtgaaaactacggacaagcacgcctcctaaggaagggagaatgttctccttcagagtcatattcgcatgcaaccggaacatgtgaaaaaaatggggggcctgccgggaagtccccccctctctctaccacatgcaacatacctaactccacgataggaaaccctgttgtagtagggtatggtacaaaagcacatgaagagcccctgataacaaagcctttccccatatctctactctacaactccatcgatacggaatggaaaacctctttaagctataaagcactacgaggcagccaaacgacaatagtagtaactcctgatggcaaggagctgaaatacaaggccgacttcgactcattcatcccagaaacactagcccaaggtattctatcaataaacagcaacaaactgacctacaccgaaaagcaaaaggaaataactttcaacaacgaaaatcctgagaaaataaaatatcaccatgcgcattcaatttcattagagcacaaaggagacctactaatagcaacaaccaaggaacaagaaaaaattgaaataactttcaatgagcacggacaaccaaaatccttagagacatcaaacgcaagaatagatttattttacaaccagaatggaagcttaattaaaagaaaaaccagttcatccactttcaattcagaaagaaactatcattacgaaaacagtcaaaatccccgcctgttaaccgggataacggatgaaaatggagcccgcttcgccacctggacctacgacaaccaaggccgcgccatctccagcgaacacgccaacggcgccgaaaaggtctccctcgcctacaacgatgacggctccaccaccgtcaccaacgaatacggcaagcaggccacctaccgcttccaggtgatccagggcatcaaacgcatcgttgccatcgaaggcgaaccctctcccaactgccccagcagcaattccacctttacctacgatgaccagggtctgctcaccagcaaacgcgacaacaacggcaacctgaccacctaccagtacaacgcccgtggcctggagacctcgcgcaccgaggccgccggcactgcgcaggcgcgcaccatcacaaccgactggcacccgaccctgttcctcccggtgcaggtcagcgagcccggccggatcacccgctaccagtacgacgccgagggacgcaagaccggcgagaccgtcaccacccgctga

SEQ ID NO: 7096 - DNA, 438 bp, Pseudomonas aeruginosa
ccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcgtcaccacctacctctatggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggccaccgacgccagcggccagatcgcctggcagtggcagtccgacgccttcggccgcggcgaagcgctga

SEQ ID NO: 7097 - DNA, 435 bp, Pseudomonas aeruginosa
tcagcactccccacactgacacaaagctgcccagagcatccagggttaattttaatactgccatcggtattcacagtaattcgattttggctcgttgctgcaccggagccaccgccttcgactctaaaatacgtttcagtcttaggagtcgctccttttgcccccccacccagccgacccaagtcccccactgccccgagctgcgaactcatactaccggaaacaggtgactccgcaatcgcgttgaccaggttcttggctgctgttggcagcttggcggttatctgcgcgccacctttcactgccgtcagaacgccaacaagttccgcagcgaacctaccgccctcgacaccagctgtgaccgaaccttgccagccggcatcctcgtatgcctgggtcaagaatgcggcgcgctcctccagccccttcaggtag

SEQ ID NO: 7098 - DNA, 318 bp, Pseudomonas aeruginosa
cccatggctaagccgaatgatacgtccaaccccgaggtaacagaatcgtccccccgcttcgtcccgctgctacccacctcccaggccgacatgtgtccgcgtagcgccaccctgtacgtggacacccatgcactccccacgcacttgttcgacaacgcgaaagtgcgcttgaggtcggcgatcaacatcctggccatgacccgtttgctcgatgataaagaagagcccggcggcaccctggcctacatcaacggtgcgttgctgtcgctgctcagcgatgccttgtccgaaatcgaggcgggccacccgagcctgtag

SEQ ID NO: 7099 - DNA, 195 bp, Pseudomonas aeruginosa
cctctcctttcccacggacagcacgaaaccgctggcatgaagataacgcgaaaccttctggacgatctctacacggatgaccagggcagccaggacctgacgggcctccgtcagcctcgcaagatgcgtcgtgaaaccaaggagaagccgcgcaagcgaacgctgcgcgactcccggccggaccgtcccctgtag

SEQ ID NO: 7100 - DNA, 2823 bp, Pseudomonas aeruginosa
cggcacgttgcgttgcagggccttctgcacccgcgaggcgatttgggtggccagcagcgaatgcccgccgagttcgaagaagttgtcgaacaccccgacccgctcgaccttcagcacctcggcccagatccgcgccagggtttcctccagttcgttgcgcggggcctggtaggcctggttctgcatctggccgatgtccagcgccggcagcgccttgcggtcgagcttgccgttggcgttgagcggcatccggtccagcaccagccagtgcagcggcaccatgtagtccggcaggtcggcgcgcagttgctgcttgatccgctcgaaccaggcgccctgctccaccatcagtccggccggcgagtcggcgctggaacgctgtgtctcgccgggaaccaggtagcccaccaggtacttgccgttcgccccttcctgcaccgccaccgccgcctcgcggacgtcggcgcgttcgtgcaggcgcgcctcgatctcgcccagctcgatgcggaagccgcggatcttcacctggtggtcgatccgcccgacatactccagcactccgtcggcgcgccgccgcgccaggtcgccggtacggtacagacgctcgcccggcgcgccgaacggatgcgggacgaaggcctgggcggtgcgcagcggatcgccgacgtagccacgaccgacgccggtgccggccacgcacagctcgcccaccgcgcccagcggcaccagttcgaaggcgtcgtcggcgccggcgccgagcaggtacaggcggttgttgtcggtgggactgccgatcggcaggtaggtgctctcggtggaggccaggtcgacgcggaagaacgccacgtcgtcggagcattccgccggcccgtaggcattcaccaggccgatccgcgggtagcgcttgagccactggcgcgccagttccggcggcatcgcctcgccggtgggcagcatccagcgcaggccgtcgagggcctggcgctcttcggcgagcatgccctggatcagcgacggcacgctttccagcaccgtgatgccctgttcgccgacgtgcgccagcaggccctgcggatcgtgggcgatggcgttcggcacgatcgccacgcgggcgccgaacaacggcgcggcgaggaactgccagaccgagatgtcgaagctctgcgaggcggtctgggcgatcacgtcgttctcgtccagttccaggtacgggaccttgctcaactggttgttgagcatgcccgcctgctccaccatcacgcccttcggcagtccggtggagccggaggtgtagatcacgtaggcgaggttctgcggcccgctgtagacctgcggatcgtgctcggcgccctcgccctgctggatctcgtcccacaccagcaggcgcggccggtcgacgcagccgagttcgtcgaacagcgccagcgcttgctcgcggcaggcctgggtgcagaccagcaccggcgtgcggctcagctcgacgatccgggtcaggcgctgggtcggatggccggggtcgagcggcaggtagccggcaccggccttgaagctgccgacgatcatgccgagcaggtcgaggccgcgctcggccagcagtgccaccggctggtcgatgccgacgccggcggcgcgcagggcgtggccgaggcggttggcccgtcggttcagctcggcgtagctccagcgctgttccaggcaactggcggcgatgcgctgcggatgggctgccacctgcgcctcgaacagccgcacgtagccttgctccagcgggtagtcgcgggcgctgcggttgcagccgtcgaggaggaagtcgcgctcgtcctcgccgagcagcggcaaggcctccagttcgccgtggaaaccgtcggccagggccagcagcaggcgcttgaactcgccgagcaggcgctcgacggtcggcgcctcgaagtagcgctggtcgtaggacaggtgcaggccgaggtcatcacccggatagcagaccacggtcaacgggaagttggtgtgggtacgcccggagtcggaactggcgttcaggctctgcgcgcggtccagtaccgagacttccaccggagcgttctcgaacacgaacaggctgtcgaacagcggctggcccttgggcagctcgctgctttcctggatggctaccaggggcaggtgctcgtgctcgcgcaactccaggttgcgctcgaacagccggttcagccattcgcgcaccgtgcagcgctggccggcggccggcatctgcacgcgcaatgggatgctgttgatgaacaggccgacggtgcgctgcatttccggcatgcccaccggacgcccggccacggtgacgccgaagagcacgtcgcgctcgccgctgaagcggcgcagggtcagcgcccaggcggcctgggcgaaggtgttgacggtgagctggtagcgctgcgccagttcgcgcaggcgcgcgcagtcggcggcgtccagacgcgtgtagcggtcaccgacgatcatcccgccgctttcgccggcgtgctcgcggaggaacgggcggtcgctgggcaccagggtcggccgctcgaagccgcgcaggctctcgctccaccagcgtcgcgattgctccaggtcctggcgttgcagccaggcgatgtagtcgcggtagcgcggcggcgtcggcaggttcgccgggcggccttcgccgagggcgccgtaaatctcgaagaagtcgttcatcagcaggccacggcaccaggcatcgatgaggatgtggtggttgctcatcatgaaccagtagcgcgcctcgcccaggcggatcaggcgcaggtggaacggcggctgttcgagtag

SEQ ID NO: 7101 - DNA, 744 bp, Pseudomonas aeruginosa
cactttccgccagcgcctcgcggttgtcgccctgcgggcggtcgcacggccactcgaccggctgcccacccagccgggcttgccaccagcccagctcctcgcgcagcgattcgctgccggcgtaggcctgcaggcgtccggcccagtcgcggaaggcgctggtcttggccggcagcgccggttcggcgccctcggcgaactgacggtagacctgttgcaggtcctccagcagcacccgccaggacaccccgtccaccaccaggtggtggatcgccagcagcaggcgttgctcaccggccgggccgtccaccagcaccgcgcgcagcagcggcccctgttcgaggtcgaggctgcgctgggccttggcgaacagctcggcgcattcgtcgaaggattgcaccgggacgtgccagagcagttcctgttcgcgcagcggacgatgctgcgccagccactcgccgtcgacctggcggaacgccaggcgcagggcatcatgctgttcgaccaggcgttgcagggacttgcgcagcagaccgaggtcaatggcctgccgcggctgcaacagcagcgcctggttccagtgttcgcggcgcgccagcggcaggtcgaagaaccagtgctggatcggcgtcagcgcgctgtcgccctgcaccggcccctgctcggcctggctggcctggctgtgccgggccaccgcggcgaggctctgcacggtctggtgctggaacaggtcgcgggggctga

SEQ ID NO: 7102 - DNA, 429 bp, Pseudomonas aeruginosa
ggatcgccagcaggccgacgaccatctccagcgaacgctccagggccaggccgacccgcacttccgggccgacgccgtgactgcgcaggacgcgcgccagacggttggagcgggcatcgagttcggcatagctcagggtctgtccggcgaaggtcagcgccggggcctgggggctggccgccacgcgggcggcgaacaggccatggagggtgtcctggagccctgcctcgccggccgtgccggcgagcagcagttgcttccgctcctcggcggcgaacagcggcaattcggcaatgcgccgctgcgggtcgcccagcagcgcctccagcaggttctgccagtgtccggccatccgcgcgatgcgcggttcgtcgaacaggtcgcggctgtaggtcaggcagcagccgaggcgctggtcgaggtcggtga

SEQ ID NO: 7103 - DNA, 1008 bp, Pseudomonas aeruginosa
cgatgtggtgcagggtcaccaccaggtagtgctcgcgctcggccatcttcaccatgcagacccgcagcaacggcccgctctcaaggtcgaagggccggtgcgcctcgctgtcggcgagggtctgcaggtgctgctggcggctgtcgcggtcgagcgcggagaagtcctgccagtccatgtgcaggccgccatcgccgtgcacgcgctgtaccggcacgccgtcgacgctggggaacgtggtgcgcagggtctcgtggcgctgcaccagggcctgtagcgcggcctcgaagcgcgccacgtccagcggcccgctcaggcgtgccaggccgccgacgttgtaggccgggctgtccggctccagttgccagaggaaccacatgcgctgctgcgagtaggacagcggcaccggctgctcgcggtcgatgcggcggatcgcgccgtggctgtcggtacgtccggcggcctgggctgcgcggacctgttcgcagaaggcctccagttcgctggcctcgaacagcgcgcgcaacggcagttcgacgtcgcaggcctggcgggtgcgcgagacgatgcgggtggccagcagggaatgcccgccgagctcgaagaaatcgtcgcgcaggccgacccgcggcaggccgagcacttcgctccagatcacggcgatgcgccgttgcagctcggtccgcggctcgacgtgctcgcgctgctgccagaccggctccggcagcgcccgcgtatccagcttgccgctcgggccgaggggcatctgcgccaggcgcatcaactgcgccgggaccatgtattccggcagttcggcctgtagcgcggcgcgcagacgctggttctgctcggcttccgcctcggcgccgacagcgccagtgtagtacccgaccaactggctgccggccacgccttcgcggatcaccactaccgcctgggccacccccggctgcgccagcaggcgtgcctggatttcctccggctcgatgcggaagccacgcagcttga

SEQ ID NO: 7104 - DNA, 540 bp, Pseudomonas aeruginosa
cgatcgccagcagaccgaccagcagttgcggcgaacgctcggcgcagatcgctacccgcacgtccgggccgacgcccttgtcgcgcaggtagtgggccaggcggttggcccgggcgtgcagttcggcgtagccgaggctgccgccgtcccactccagggcgacgcgttcggcggactgcaccagttgccgctccagcagctccggcagccaggcgcgcgccggctcgcagggcgcgctgccccattcggcgaggtgcgccgcctgctcggcgtcgaccagggcgatatcgccgaggcagcgctgcgggtcttccgcgacctggcgcagcagctccaggtattgcgcggcgaaacgccggatgctggcctcgtcgaagaggtccgcggcgtagtcgaaattcagggtcaggcgaccgcgagcgtcctcctcgctctgcagttgcaggtcgaacttggcttcgcggctgtgccagggcagctcgtcggcgagcaggccgggcagccggcgcaacgccgacaggtcgcgctgctggtggttga

SEQ ID NO: 7105 - DNA, 426 bp, Pseudomonas aeruginosa
cccgcagcagcggccccttttccaggtcgaacggctgctgcgcctcggcttcgcggcgctgcgcggcagccgcggcgcgttcgtgctcggccagcgcggcgaggtcgacgaactgccaggcgaactcgccccgctcgtcgatacgctgcaaggccgcgccgtcgcgctcgaggaaacgcgtgcgcagcgcttcgtggcgttcgaccagccgctggaagctggcgcgcagcgccgcttcgtccagctcgccgcgcaggcgcaggccgccggggatgttgtaggcggcgctctgcggatcgatctgccaggtcagccagagacgctgctgcgccgccgactgcggcaggtcgacaccgcgcggcaggtgcgccatcggtgcctcggccggcaggccggcggccagttggcgggccaccgtggcgctga

SEQ ID NO: 7106 - DNA, 657 bp, Pseudomonas aeruginosa
caatcattatcgttcaacataatttgttgcgccatgtgtgggtcttaccccaccgccagtgctctgcagccccctccgcagcaaggtgatttccatgtcggaacaactgtctacccgcagatgcgatacccgctcctccaggctttcgtcgataaccgcacgatcctggtgaagatcgccgcccgcattaccggttgccgctcgcgagccgaagatgtggtccaggatgcgttcttcaggctccagtcggcgccgcagatcacttcgtcgttcaaggcacagctcagctacctgttccagatcgtccgcaacctggccatcgaccactaccgcaagcaggcgctcgaacagaaatactcggggccggaggaagaaggcctgaacgtggtgatccagggcgcctcgccggaaacctcgcacatcaactacgcgaccctcgaacacatcgcggatgccctcaccgagctgcccaagcgcacccgctacgccttcgagatgtaccgcctgcacggcgtgccacagaaggacatcgccaaggaactgggcgtctcgccgaccctggtcaacttcatgatccgcgacgccctggtgcactgccgcaaggtcaccgccgagcgccagggcgacaacgtcacccatctcagcgcccgccgctga

SEQ ID NO: 7107 - DNA, 1221 bp, Pseudomonas aeruginosa
atgcgcaggtcgcgacaggttcaggacgctcctgcgccggctcgtgcgactcgttgcacgcaggccgctgcctgtcgcagcgggcatatggatcggcctcgcggcgctcgaggggcgacggaaacgacaggctggaggctggggacggaagcatggccggctactcgtggggcttgcctgagtaacgtcgcatcccgccgcgaatttacccgtccagcccggcgtccggccgaacggccatcaatagacttccggcacgatgatctcgccgggcgtcggatgcctgacgtaatcggcgtggcgcaggcgctccggcaggtgtaccggcggctgcggaacttcccggtagggcatctgctgcaacaggtggtggatgcagttcagccgcgcgcgcttcttgtcgtcggcctgtaccacccaccagggcgcctcggggatgtgggtgcgttcgagcatggtttccttggccttggtgtaggcctcccagcgccgccgcgactccaggtccatcggactgagcttccactgcttgagcggatcgtggatacggctgaggaaacgcaggtgctgctcggcgtcggagatggagaaccagtacttgagcaactggatgcccgagcgcgccagcatcttttcgaactccggcacgctgcggaagaattcctcgtattgttcgtcgttgcagaaacccatgacccgctcgaccccggcacggttgtaccagctgcggtcgaacaggacgatctcgccaccggccggcaggtgcgagacgtagcgctggaaataccactgggtctgctcgcggtcgttcggcgcgggcagcgcggcgacccggcagacccgcgggttgaggcgctgggtgatgcgcttgatcacgccgcccttgcccgccgcgtcgcgtccctcgaagagaatcaccaccttgtgcccggtgtgcaccacccagttctgcagtttcaccagttcccgttgcaggcggaacagttcgcggaaatagcggcgccgactcaattcgccgggcgcatcctcctgctcgggaccgaacagctcgtccaggttcagctcgtcgtcgagcagttcctgctccagctcttcgtcgtgtcgatcgagccagtcgcgaccgatgcggcccgaggtatcgccataggagtccatgcgctgctctccacgtcatgccgaaataccgcgaatgctaggcgtgtcttcatgacggtttggtga

SEQ ID NO: 7108 - DNA, 357 bp, Pseudomonas aeruginosa
atgacttggcctaagctggccagcctctccgcactttccacatgctccgcgcaccccggcgaccgccggggcgaaccgcgcccttgcggcgccattgatcggagatcgaccatgcaagcgttttccaaacagcaactcatcgatgcgctgaatgcccagagcagcgacctggccaccctgcagagcctggtcatgggcctctacctgtggattcgcgacagccatggccaggccagcgtcgatgcggccttccagcgcgcccgcgaggaggccaggcaattccgccagcagagcggcaaccaggctgacgagcgattgatcctgcacctggcggaaatcgtccgcgaacaaccctga

SEQ ID NO: 7109 - DNA, 624 bp, Pseudomonas aeruginosa
ccggttcggcctgactcaaggccgcaaggcagtcccgggcgccgcggaatcgactttcgcggtgtcctccgcgggcagcacccggatggtcgcggtcacgccggcgcgcaaggtgttgcgctggcgataggcgggatcgatggcgatgcgcaccggaattcgctgggccagcttgacccaggtatagctcgggttgatgttcgccagcaggcgcgagccctcggcattctcccggtcggtgatggcatgggcgatgctctgcacgcgcccgtcgaagcgctcgccgctcatcagttccacccgcgcccggctgccgacgcggatgcccggcaacttggtctcctcgaagtatccgctgacatagaacgaatcgcggtccaccagcgccagcaatggcaccccggcgtgggcgtagtcgccctcgcgggtctgcaggttggtcacgtagccgctgaccggggcgcgcacctgggtacgttcgagatcgagacgggcctgctgcaaggcggcttcggcaagctccacgttggcctgggccaggccgaggctggcctggttcctcagcaactcggcctgggccaggctgacgtcggtctgggccttttcgttctcttccaccgatag

SEQ ID NO: 7110 - DNA, 573 bp, Pseudomonas aeruginosa
catcgagcgcttctgcaatgccgagcgccgttgcgcctcgctgcggcgctggcgcaactgggcctggctggcctcgatcgccgcgcgcgactcgcccagcgccgcccgcgccacgttcaccgcgcgctcggcgcgcagcaccgccagttcatagcgcgccggatcgatgctgagcagcagctcgcccttctccacgggctggttgtcgctcagcggcaaccgggtgatcagcccggaaacgtccgccgacagcgtcaccacatcggcgcggacccgcgcgtcacgggtccacggcgtgcgggtgtagcgttcccaggcgaggaacaccagcgccgccgccaccagcaccgccagcagggtggccaggcgcggccatttgccttgcaacaggttcatcgggacatctctcccatccacaggatcagaccggcgcagatcgcgcagtacaacgcgccctggaacagcgcttcgtgccagacccgctgcaacacgccgaagcgccgcaacagcgggttgagcagcagcaggatcagccaggccagcagcagcgcctgggcgatcggcggcaggtag

SEQ ID NO: 7111 - DNA, 1947 bp, Pseudomonas aeruginosa
gcgcccccgacctcgacatcagcgggcatgtccgccctcctcttctggttcttcgacgaccgccggtgcgccgcggtcctcctccagcagcgtccgatagcgttgcagcgactgctgcaggatcagtaccgcgacattcatgatgaagcgctgccgcgtcgccccgaggtccttcgacggctgcgccagcaaggcctccaggccccggccgaaacgccgcagggcggccagggcgaggtcctgccgcggggcgtccgcgccgccggctatgtaggcggcgacctcgcgcagcgcctcgcccagcagcggctgcaactccagcggcaccaccccggcgtcatgcagcggctcgcgcaggcggttcaacgccacgcccatcaccacgcagcccagggcgcactggaaacgttccgccgcagccggctcctggctcgccggcagcaggccgaccatcaccgccaggcgatcgatcatccgcgtctcgaaggcgaagcgctgcgcctcgctggcctcgcagcgcgacatttccgcgacgtcctggcgcgacaggtagagcagccggcgcaggcgcgggtcggcgcggaacggatagaccagggcgaacaccagcacggcgaggaccgccgcggcgaggaagccgccgacgaactcgaaccactgcgaagcgttgctgtagtagaccgcgatattctgtggcgccaccatcagcaaggtctccaggccgatgcccatggcgatcccggcgctcagcgggctgctcaggccgaccgcgaccacgtacagcagcaacgccatccacagcgccagccactcgaagtcggcggatgccggcaacagcacgaacagcagcgccgccgagatcaggatcgccagcagcagcccgcgcaggaagttctgcgccgccagcagcggacgcgggaaggtcgccatcagcgagcacatcacgccgaccagcagcaggctgctgagggcgccgttccaggcgctggtgatccacagccaggcggcgcaggacaaggcgacgaaagcgcgcacggcgttcatcgaggccagcgcccagtccaggtgcagcgcctgcgcctggccacggcggtagaaactgctggcgtggcggccggactggatcgcatcgttgagttcgagcacttcgcccaggcgctggaacagccgcgcgtattcccagcgcaggatcgccacctgcgggcgcagcgccgggctcagcgcctcgtcgtaggactccgcgcgcgtcgccgcggcatcgaaggcctggcgcaccgcctggaactcctccagcacctcggagggtaccgcccgcccctgctcggccagcgcgtccagcacccgcaacgcacgatccagcagtgcctggatatccgccggcaacggcccgacccagtgcgcccgcaccagcaggcgatgctggcgcagcagcaacagccgcgaggccatcagcaccagcaggttacccagcaactgcaccaggccatcggcgcggcgcaggttcggcgcgtcgaaatagaggtgccggcgcaggccgtccagcgcggtgatgctggcgaccagttgcatctgccgctggttgaacgactcgtcgccctcgtcgccgcggatcaccgccgcggcgtgccgcgcggtactgcggatcaggccgtcgacctgggcgaagtagcccttcgccaccgcctgcggtcgcgcgctgagcaggctgaccagggccacgcaggcgacgcccagcagggtctcggtgacccgcaccacggcgagcatgaaggtgttttccggatcgggaatcgacagcacggcgacgatcaccgcggtgaagccgctgagcacgaaggcgtgcgagtcggtgtagcgcagcaaggtgccgccggcggtgcagagcggccagccagagtcccagggcgacgaagaacggcaacggttgctgggcgaacagcgccatga

SEQ ID NO: 7112 - DNA, 417 bp, Pseudomonas aeruginosa
tgccgtcgccgaccaccatcggccggaaaccgctgccgatctccgcgccgacctggcgcagcttgtcctccggcaacgcctgcgccaccagttggcgaatccccacctgcttggccacggcgtcggccaccgcccggcgatcgccggtcagcaacagttgccggcccagacccagttcgcgcagatcggccatggcctcggcggcctccgcgcgtacgctgtcggcccagcagcagccagccgaggaagcgcccgtccagggcgattccggcgatcggtccctcatgctccggcacctcgctggcgtcgatgcccagttgctggaacagttcgggccggccgagggcggcttcgcccgccgctgttcgtgcgaccacgccgaacccctggcgttcgcggatatcgctcaatggatga

SEQ ID NO: 7113 - DNA, 741 bp, Pseudomonas aeruginosa
acctccatccccggcgccacctcgagcggcaccgactcgccggtgatcggcgcggtgtcgagactggcctggccctgcaggacccgcccgtcggccggaacccggtcgccggcgcgcacttccacctggtcgcccgctcgcaggctggcgttgtccacctcgctcaggctgccgtcggcctcgatccgccgggcatggctgcgggtcagctcgccgagggcggcgatggcctcctgggagccgatcacgctgcgctcctccagcacatggcccaagatcatgatgatctgcaccagcgcggcggtcagcaggtcgccgctggcccaggcgccgagcatggccagcgcgatcaactggtcggtgacgccgtgcaggctcggatgccgcaggctgtcccaggcccgagcgggccaccggcagcgccaccagcagcgacgcgacgccgagcaggatctggctgaccccggcctggtccgccgccagccagcgccaggccaggccgagcagcaacaggccgagggcgagcatcgccaggctcagctggcgcgcggcacggcgctgctcgtcgcggctgagcaggccgccgccgaacggcaggtgatgatggtgatgcgcgcagccgccatggctgccgtgggcggtcggctcgctcatgcgcacctcccggggcgagccgcggcggctattgcgggaagcgcgcgtccggccggcgtacgtagtccagggcttccttctcggtga

SEQ ID NO: 7114 - DNA, 426 bp, Pseudomonas aeruginosa
cgtcgagatcggcgcgacgcgcctgctcggaacgcagcaggccctcgacgcggcgttcgatcacctgttcggcggacggcagcagcaccacctgctccagcggctgcggccaggccagcagcaggccgggaccggccaggcgctccagcgcgcccaggcgcagcactacggcgacggttctccgggccgatctggcggacgttggaaaacgcccaggccagcgccgccaggagggtcacgccgaacagtgcgaggaacgccaggcgtccggcctgcagccaggggctgcgcagcccctcgcgcgcttcgccgctcatggccggcgcccgttggccggcgcttcggcggggaacgccggcggcccgtcgaccagcacgcggaacggtgcggcatcggtgcgcaagaccagccgggtatcgccgttga

SEQ ID NO: 7115 - DNA, 531 bp, Pseudomonas aeruginosa
ccatcgcctcgccggaacgtacctgcaccaggcaagcggcggcgacggcgaacagcaccagcagcgcggcgaccagcagccggcgccagggcggcgcggcctgtgcgccgtgatcgtgatcgtgatcgtgatcgtgatcgtgatcgtgatcgtgatgatgctcgtggtggctgtgcgagtgggagtgaccgaggctcaagagcgctctcctcatggtgcggattgcccggccgcggacgccggagcggcggacggacgggacgaagacggggaatccaggcggccgaggccgaagctgcgcaggtcgatggtcggcgcgccggcgccggcgatgcggtggtcgatgagcagcaggttggccttgcccaggccgcgtccgagttggcggtagtaggcctccagcaggaaagcctggccggcgtcggcatagccttcccgctcggcggcgaaacgccggtcggcggcctgcgcggcggccagggtctcgcgggccttcgcgctggcccggtcgtgcgccacgctggcctgtag

SEQ ID NO: 7116 - DNA, 585 bp, Pseudomonas aeruginosa
aaccgaaggcccagacctggcgcaggtcgatgccgaagcgctggtgcaactcatgctgcagacgctgcaggggacgcggcggccagcgcaacaggtcggccagcaggctggtggcgaccaggcgcggttcgaggccggcacgctgcggcgcgaacatcgccaggatcgccctgcccagcaactccagcgccagcgccgccggcaacaggccgagcagtaccgccaggcgcggggcccaggggtgtccctggcgagccaggaacagacagagggcggccagcaccagggtaccgatcaacgcccgcgccagttgcccgaggaccggggcttccggccactgcaccggcccttggctggcgaggcgacgttccagcaccagcaccgcgaaggccagcagcaggcagataccgatggcgaggtcggccgcttgcccggaactggcccgcggcatgtcgagacgccagccggcggctaccaggcacaacgccagcgccgcgctcgccgccagccacagcgcagcgtgcccgatctgggccaagccgtgggcgatggcctggccccaggcgctccagcaaccgttcatag

SEQ ID NO: 7117 - DNA, 1581 bp, Pseudomonas aeruginosa
gcgtcgacggcaaccctgcggaactggccgagctggtctatccgctgctggaacgctacgaaatgccggcgagcgccttcatcggcggtgacccgcgcagttggcgcgaagcggtggccgagacgctctggcaggccgatgcgactgccgccggacccttgctggaactgctggagggttacagcggcgcggcactcatggcggtgttcgaacgcaccggcgacgaccagcgtcgcagccgcaacctcgacctcctcctgcgcaagctggaacgcctcgatccggcctcgcagcaggccttgcacgcggcctgcccggttcccgcaccgtacagcgctggcgactgggagcgggtccgccgcctggaaaacagcggcctgcttcgcttcggcctgcgcggacaggagccgcacccatcggcaggcctttgcgccgaggactgtctcggccgcgcccaccgccagctccagcagcattgcgccgcccccctgccggtgttctgccaagctcgcaccacacccgccgcgcaacccggcctgcgcgccgccctcggtcggcttggctaccgcttcgccttcggcgcgcgcaatggcctggtggatacccgttgcgacccgctggacctgccgcgcatcgaggtggatgcggcgatcgccgcccgtcccggccggctggcctggcgcatctatcgtggagcccgcccatgagcatggcttccagcccgttcccaaggaggcgcgacaggcagtcgccctccgccggaagaccgcccgaaccacgggaagcgaacgcgccgtcgcccgccatgccgcagcgacgccgctctcagggatatggccagcccagctggcccggtatcagcaaggatcgtcccatgactgcagacacccctacctctgtcgctaccatcaaccacctgctgctcggcgcgccctacaccagcccactggtgatccccggcgactggctggtcgacgagctggaaggcgccgtggaggtcggcggcttcaccgacggcctgttccgctggccgacgcgcaagcgcagcggccgcccttcgccgattctctgcggcgacctgctgcgcgcggtacgtaccgaatgcgccgagtcggtgcagttctggtggggtttcagtccgagcctggtggggcgctggcgccgcgccctcggcgtgacccgccgcaacaatcccggcgaccaggcggtggcgcgcgcccgcgccgccctcgcccgctcgctggaccgcaaggcgccgccgaaggcaccggccgcctggtccagcgaagaagtcgagttcatccgccgccacggcagcaagcgcagcctggcctggtgcgcctacatgctcggccgcagctaccagagtgtctcccagcaaggccgaggagctttccccgcacagcgggcgcgaccgcaacaatgcgatctggagcaagtccgaggaagatctgttgcgccagcactaccagcagcgcggctcgctatggtgcgcgcagcagaccggcaagacccgccgcagcggtattccaccgggccaagaagctgggcctgcaacggcagcggccgaaacacccgtga

SEQ ID NO: 7118 - DNA, 2697 bp, Pseudomonas aeruginosa
ggccggtcgccgccttctcccgccgaggcgagagagggccagtgctcaaccgcggtagtagcgctgcgccacgaagggcatcttgctgaccaccagggtcaccggcttgccgcgcaccatcgccgtcacctcgttgcccaggccggccagctcgctcggcacgtagcccatggccagcggcgcgttgagactcggaccgaaaccgccgctgctgaccttgccgatcgcccacccctgggcatcgacgatctcggcgccctcgcgcaccggcatccgcccctgcggcaggaaaccgacgcgcttgctggcaacgccctgcgcctgctgggcaaagatccgctcggcgccggggaagccgccggcgcgcacgccgtcggcgcggcgcgccttggaaatggcccagccgaggctggcttcgaccggcgtggtggcgctgtccatgtcgtggccgtagaggcacaggccggcttccaggcgcagcgagtcgcgcgcgccgaggccgatcggcgccacttccggctcggccagcaggcgccgcgccagggcctcggcatgggcggcgggcacggagatctcgtagccgtcttcaccggtatagccggagcggctgacgtagcagtcctggccgagcagctcgacgcgggcgaactgcatgaaggtcatctgcgccacctgcggcgccaggcgctccagcacccgcaccgccgccggtccctggagggcgagcaaggcacgctcctcgaacagcggctcgacgctgcaacggtcttccaggtgacgacgcaggtgcgccaggtcctggtgcttgcaggcggcgttgaccaccagcagcaggcaatcgccgaggttggccaccatcaggtcgtcgaggatcccgccctgctcgtcggtgaacaacgcgtagcgctgctggcccaccggcaggtcgaggatgtccaccggcaccaggctttccagggccagcgccgcatcggcgcccaccaggcggatctggcccatgtgcgagacatcgaacagaccggcctgctcgcgggtgtgcaggtgctccttgagcaccccggccgggtactgcaccggcatgtcgtagccggcgaagggcaccatcttcgcccccagttccaggtgcagggcgtgcaggggcgtcttggcgagggtttctgcggtcatgtttcactccatggcatcccggcctcctgtctgccggagagccgcgatcgattgtcgggaaagagaaaagaagcgccggcgcagcggcgcggttcagcattcgatgatgttcacggcgaggccgccgcgcgcggtttccttgtatttgcttttcatgtcggcgccggtctggcgcatggtgcggatgaccttgtcgagagagatgaagtgctggccgtcgccgcgcagggccatgcgcgccgcgttgatggccttcaccgaagccatcgcgttgcgttcgatgcagggcacctggaccagcccgccaaccgggtcgcaggtcagcccgaggttgtgctccatgccgatttcggcggcgttctcgacctgctgcacgctaccgccgagcacttcgcagagcgccccggcggccatcgaacaggccaccccgacctcgccctggcaaccgacctcggcgccggagatcgaggcgttttccttgtagaggatgccgatcgccgcggcggtgagcaggaagcgcaccacgccgtcgtcgtcggccccggggatgaagcgcgcgtagtaatgcagaaccgccggaatgatccccgccgcgccgttggtcggcgcggtcaccacgcggccgccgctggcgttctcctcgttcaccgccagggcgtagaggttgacccagtcgagcacgctgagagcatcgcgcaggccggcctccggccgctggcacaactggcggtggagcgccgccgcgcggcgcctgaccttcagtccgccgggcatgatgccctcgttgcggcagccggcctcgacgcaatcctgcatcacctgccagatacgcagcaggccggcgcgggtttcctcggcggggcgccaggccttctcgttctcggccatcaactggctgatcgacaggccttcgcggacgcaatggtcgagcagttgccgcgcggtcttgaaggggaacgccagcggcgtgcggtcctcgacgatgcggtcgaggccggcggcctcgtcgtcgaccacgaaaccgccgcccaccgagtagtactcgcggctgcggacctgcaggccggcggcgtcgaaggcacggaagatcatgccattgggatggtaggccagcggcttgcggatcagcgcaaggtgttccttctcgacgaagcggatcggccgctcgccgagcaggcgcagctcgccgctggaacggatggcatcgagccgagcgggaatcgcggcggtatccaccgtgtccggctgctcgccctccaggccgagcagtaccgccttgtcgctgccgtggcccttgccggtggcgccgagcgagccgtacagctcgaccttgacgctggcagtggcctccagcaacccctcgcgcctcagcccctcggcaaagcgcgcggcggcacgcatcggccccacggtgtgggagctggacggcccgatgccgatcttgaacagatcgaagacactcagggacatgctcgtctccgcttgcggattggccgccaccatggcggcgctcctgttcaatcagcgtag

SEQ ID NO: 7119 - DNA, 327 bp, Pseudomonas aeruginosa
accgggaagtgccggcagaattcgccgacctggcccctgacccgttcgccgacctcgggattgtcgatatcgtcgaggatgtcgcagatccagccggccagttcgcggcactcgccttcgcggaaaccgcgagtggtcaccgctggggtgccgatgcggatgccggaggtgacgaacgggctctgcggatcgttcggcacggcgttcttgttcaccgtgatgtgcgccgctccgagcgccgcgtcggcggccttgccggtcagcccctgcttcaccaggctgatcagcatcaggtggttgtcggtgccgccggaaaccacgtcgtag

SEQ ID NO: 7120 - DNA, 3186 bp, Pseudomonas aeruginosa
ccctggagctggtcgtgcttgctgaacatggcgctggcctcttgtcgtgtcggtgtcaggacgctcgctggcgcgagcgtggccgcggcgccgctacgcaagcgcggcgccgggaaaggggtatcgccggaaacgcgaggacgccgccgctggcggcgccctcctcgtccgtcactcctcgctgtacgcctcgatgggcgggcaggagcaggtcaggttgcggtcgccgtagacgttgtcgacgcggcccaccggcggccagtacttggcctccaccaggctggccagcggataggcggcctgctcgcggctgtaggcgtggttccattcgccgagcagttcggcggcggtgtgcggcgcgttcttcagcgggttgtcttccttgtccagctcgccgcgttccaccgcgcggatttcctcgcggatgcggatcatcgcgtcgcagaaacgatccagctcggccttcgactcgctctcggtgggctcgatcatcagcgtgccggccaccgggaaggacatggtcggcgcatggaagccgaagtccatcaggcgcttggccacgtcgtcgacgctgatcccgctgctgtccttgagcggacgcaggtcgaggatgcattcgtgggcgaccaggccgttgccgccggcgtagagcaccgggtagtgctcctccaggcgatgggcgatgtagttggcattgaggatggccatttccgaggcgcgcttgaggccttcgccgcccatcatgcggatgtacatccaggtgatcggcaggatgctcgcgctgccgtacggcgccgcgctcaccgcgccttccttgcgctcgccgcgagcgtggccggggaggaacggcgccaggtgcgcgcgcacgccgatcgggccgacgcccgggccgccgccgccgtgggggatgcagaaggtcttgtgcaggttcaggtgggaaacgtcgccaccgaacttgcccggggcgcacaggccgaccatggcgttcatgttggcgccgtcgatgtacacctggccaccgcagtcgtggacgatggcgcagatctcgcggatcgcttcctcgaacacgccgtgggtggacggataggtgatcatcagcgcggccaggcgttccttgtgctcgctggccttgttgcgcaggtcctcgacgtcgacgttgccgcgcgcgtcgcaggccaccaccaccacgcgcatgccgaccatgctggcggtagccgggttggtaccgtgggcggaggacgggatcagacagatgtcgcgctggctgtcgccgcggctctggtggtaggcacggatcgccagcaggccggcgtactcgccctgggagccggcgttgggctgcaacgacacggcgtcgtagccggtggcggaacagagcatcgcctccagttcgtcggtgagctggcggtagccttcgctctgctcggccggggcgaacgggtgcaggttgccgaattcggcccaggtcaccgggatcatctcgctggcggcgttcagcttcatggtgcaggagcccagcgggatcatcgtgcggtccagcgccaggtccttgtccgccagcttgcgcaggtagcgcatcagctcggtttccgagtgatggcggttgaagatcgggtggctgaggatcgccgactggcgcagcagctcgaccggcaggcggtccccgctgctggcggcaagggtggcgaagtccgggagcgcctggccctcttcagccagcaggccccagagcgtttccacgtcggcctggcggacggtctcgtcgagcgacaggccgagacggccggcatcgatctcgcgcaggttgatcccggcggcgcgggccttggcatggatcgccgcggtacgcgcgccggtggccaggctcagggtgtcgaagaaatgcttctgctcgacggccacgcccaggcgctccaggccggcggcgaggatcgcggtcagccggtgggtgcgccgggcgatgcgcagcaggccctgcgggccgtggtagacggcgaacatgctggcgatgttggccagcagcacctgggcggtgcagatgttgctggtggccttctcgcggcggatgtgctgctcgcgggtctgcatggccaggcggtaggccggcttgccgtggcggtcgatggagacgccgaccaggcgtcccggcatgtcccgcttgaaggcgtcgcgggtggcgaaataggccgcgtgcgggccgccgaagccgagcggcacgccgaagcgctgggcgctgccgatggccacgtcggcgccgaactcgcccggcggggtcagcagggtcagcgccagcaggtcggcggccaccgcgaccagcgcatcgaccgcatggaagcggctgaccagttcgcggtagtcgacgatctcgccgtcgcaggtggggtattgcagcaacgcgccgaagtaggcggagaagtcttcgatggtgctctcgtcgccgaccaccacctcgatgcccagcggctcggcacgggtgcgcagcacgtcgagggtctgcgggtggcaatggcgggaggcgaagaatgcctggctggtgcggttcttcgacagacgcttgcagaaggtcatggcctcggcggcggcggtcgcctcgtcgagcatcgaggcgttggcgatcggcaggccggacaggtcgctgaccagggtctggaagttcagcagcgcctccaggcggccctgggagatttccggctggtacggcgtgtaggcggtgtaccaggccgggttctccaggaggttgcgcaggatcggtgccggggtgtggcagttgtagtagccctggccaatgaaggaacgcaacgcgcgattgcgcgcggcgatcgccttcaggctggccagcgcctcggcctcgcccatgccggccggcaggtcgagcacgctgctgcccttgatgctgtcggggatcacgttgccgatcagcgcgtccagcgagtcgtagcccaggcgctggagcatggcctgggtgtcggcggcacgcgggccgatatggcgggcgatgaattcgtcgtcggtgcccaggtcgatggcgccgaggttcaggttatcggtcatgacgggatcctcaggcgtcggcgttggcgttcagcaggcggtcgtaggcggcctggtcgagcagcttttcccaggcgccggcgtcggccggacggaagcggaagaaccaggcctcgccgagcggatcctggttga

SEQ ID NO: 7121 - DNA, 579 bp, Pseudomonas aeruginosa
cagcaaaggtttttccggcaatcggaacgaattcgttccactcgtaaccgaagcgttacagccgatggcacagcccctgtcgctgcaagctggcgcgcaggtgctcgaggaacgcgcggaccttccgcgtgttgcgccggtgccccggatagaggacatggatggagggcccgaacggccccgggtcgaagtggtagtcgccgagcaggcgcaccagccgcccttcaccgagcagcggcgcgacgctccactgcgggcagaactgcaggcccagcccggccagcaggtgggcgagcaggaagtcgtagttgtcgctggccagtcgcgggcgcggctggtcgatacgctggcgggcgccgtcgcgctccatccaccagaagttctggttcagcgaagggtgctggaagaccagccaggcgtgccgctcgaaatcctccgggccttgcggcgcgggttgccgcgccaggtaggcggggctggcgcaaagcacgatctggttcggcgccagcggccgcgccaccagccccggcaggtcaatggggccgtcgcgcaggccgaggtcgtagccgccttcgctga

SEQ ID NO: 7122 - DNA, 1920 bp, Pseudomonas aeruginosa
agctaccggtttcggcagtggcgacgaacatcgccagggcattcaatttgtccatcgactccttccgttccggcacaagtgttgtgcgtcgcgcccggttctgccgggccggcgctttggctagtctcgccttgcccgggccacgctacacaagaccaagaagcaaaggaaaccaccatgaagcaacggattcccaccctcctcgccggcgcctgcctggccatccccctgcacaccctcggcgccgccgacctgctggtggtcaacgccaggatcttcaccgccaatccgcagcaacccttcgccgaggccctggcggtggaggacgggcggatcctcgcggtcggcgacgaggccgggctgcgcgccctggccgatggcgacagccaggtcgtcgatctcggcggcaagcgcctgatgcccggcctgatcgacacccattcgcacgcggtgttcggcggcctggagctggccggcgcggacatgggcaacgaacaggtcggcctcgacgaactggaacggcgcctgcgcgcctggcgcgacaacggcaaggcgcgacatggcgacatgctcaatgtcagcggcatgcataccgcctactggagccaggtcaaggacttccgcgcgcgcttcgaccacggcgaatgggccgaccagccgctggccttcatcggcagcgaccaccacaccggctgggccaacgccgccatgctgaaacgcgccggcatcgacgccgcgcgggtccgcgccctgcccgaggaacagcgcaacaccatcggccacgacgccgacgccacccccaacggcttcctcgccgatgccggtctcgacgcggtgctcgcggtactgccggcgccgagcgcggaacagatgctagaagccggacgcagcgcggtgcgctacagcaactcgctgggcctgaccgcatggatggacccggccgccaatggctcgccgggcgacgccctgttcagcctcaggcccgacgagaacaccgtcggcgtgctaccggtctaccagcggctggccaagggcggcgaactcagcgcccacgtcgccgccctcctggtcgccaacccacgcagccggccggccgacctcgaggtgctggacaaggtgcgccagcgcttcctcggcagccccaacctgaccctgccgggaatcaaggtgttcgccgacggcgtaccggaatacccggcgcagaccgccgcgctcctcgagccctaccgcaacagcaggaagacgggcgaactgctgatcgacccggcgcacttcggcgaactggtcagcgccgccgacgcccgcggctggctggtccacgtccacgccatcggcgaccgcgcggtgcgcgaggcgctgaacggcatgcagcaggcgcggcgcgaccgcgacagcggcatcgcccattcgattacccacctgcaactggtcaatcccaaggagttcgagcgcttcaggccgcttggcgtgatcgcctcgatgcagctgtactgggccgccgccgacgaaaccacagtggacctgatgaagccctatatcagtgccttcgcctaccgctaccagtacccggcgcactccctgctgagcaagggcgcgaccatcgccggggccagcgactggccggtgtccagcctgtcgccgtggaaggccatccagcaggcggtgacccgcaagggcccgcagggcgtgctcaacgccggcgaacgcctggaccgccagaccatgttctacgcctacacccgcaacgctgcgcggaccatcggcctggagcaccggatcggcagcctggagccgggcaagcaggcggacttcatcgtcctcgaccgcgacgtgttcgaggtgccggagacgcaactgggcgaaaccaaggtgctgaagacctggttcgccggcaagccggtgtattccagcgagggctga

SEQ ID NO: 7123 - DNA, 1656 bp, Pseudomonas aeruginosa
cctcccgtctgctgcccgccctgttgctttcgtccgcattcgccgtcctggccggctgctccaccccgaccatcgtcaccctcaacgatggccgcgagatccaggcggtggataccccgcgctatgatcgtagttccggcttctacgaactggagcaactggacggcaagcgcacccgcgtcaacaaggaccaggtgcgcagcatcaaggacatgtaatcccccggacccgccatccgcgcggtggcgcactccagggaaggagtcgaaccatgcgatccgacctgcacgaggccaaccggctgtcgtggaacgccgccacccgggcgcacaacagccacaaggccgaccaggccgccttcttccgcaacggcggttccacgctctatcccgaggaactgcaactgctcggccatctcgacggcctgcgcctgctgcatctgcaatgcaacgccggacaggacagcctgagcctggcgcgccttggcgcccgcgtcaccggggtcgacatcgccgacagcgccatcgacttcgcccgccagctgtcccgcgacagcggcatcgccgccgacttccagcgcgacgacatcctccgctggctgcccgtcgccgccacccgcggcgaacgcttcgaacgggtcttcgcctcctacggcacgctggtctggctctccgacctcaagcgctgggccgacggcatcgcccaggtactggttcccggcgggcgcttcgtcctggtggagttccatcctttcgccctgtacttcgacccacactggcaaccggcctacgactacttcagccgcgagccgatcgccgagagcggcgtcagcgactatgtcgccgagtccggcgccagcctggcgccctccggctaccgcgccggcgtcgagaacttcagcaaccctcatcccagctacgagttccagtggggcctggccgatgtgatcggcgccctgctcggcgccggcctgcaactcgaacggctggaggaatacccctacgccaacggctgggccggcttcgacggcatgcgcgacggcggcggcggacgcatgctgccgcccgccgatcgtccgcgcctgccgctgatgtacggcctcagcgcaaggaaaccacgatgaccgaagaacgcctgctgcgccgcgacgaaatccccctggtctgggagatcgaccgcagcgaagtgatcgaacacctgtattccgtcgaggccggccaactggtgctgcgccccgagttctacgacatgcgcggctggccggagggcgaggccgagcattacacgccgatcctgctcgactgcttcgaccgcggcggctggttcctcggcctgttcgaccagggccgcctgatcggcgcggtagtcctcgacccacgccgcctcggccccgagcgcgactggctgcaactgaagttcctccacctcagccacgcctaccgccgccgcggcctcggcgcccacctcttccacctcgccgccacccaggcccgccacctcggcgccagcgcgctctacgtttcggctacgccgtcgcagaacacggtggatttttatatgagactcggatgccggctgtgcatggaaccggatgaggagttgtatcggttggagccggaggatgttcaccttgtttatcaaatactcagcgcataa

SEQ ID NO: 7124 - DNA, 453 bp, Pseudomonas aeruginosa
ccacctaccagtacaacgcccgtggcctggagacctcgcgcaccgaggccgccggcactgcgcaggcgcgcaccatcacaaccgactggcacccgaccctgttcctcccggtgcaggtcagcgagcccggccggatcacccgctaccagtacgacgccgagggacgcaagaccggcgagaccgtcaccacccgctgacaaggccgacccccatgcgcatccccccatacttcccccgcctcggcgccctcgtcctggcctgcgccctcgccctgcccgcgcaggcggccgagcgcgcctggagctacagctacaacgccctcggcctgatcaagcgcgccgacggtccgcgcaccgatgtgcaggacgtcaccctctatgcctacgacagtcgcggcaacctgacccaggtgaccaacgccctcggccaggtcacccgcctcggcgactatga

SEQ ID NO: 7125 - DNA, 1857 bp, Pseudomonas aeruginosa
cgcggtcggccagatcacccgcgtcacccgcggcgacggcagttggctgagctacgaatacgacgacgcacggcgcctggtagcgatcggcaacaacctcggcgaacgcctcgaatacgacgtcgacaccaagggcaatcgcaccgcccagcgcatcaaggacgccagcggcagcctggtgcgccagcagcaatgggcctacgacgagcttggccggctgctccgtgcggtcggcgccggcggccagacacgcagcttcgcctacgacctcaacgacaatccggtcggcgaaaccaacccgcgccagttcgcccacagccaggccttcgatgccctcgaccggctggtcggccagagcgatcccctcggcggcaagacccgactcgcctacgacgcccaggacaacctcaccgaggtcaaggacccgcgcggtgtcaccacccgctacgaatacgacggcctcggcaacctgacccgactggtcagcccggacagcggcaccaccaccttcgagcacgacgccgccggcaacgtcatccgccgcaccgacgctcgcggtgcggtcaccgagtatcgctacgacgccctcaatcggctggtcgagcgccgctcgccgagcgacccgagcctcgacgtacagtaccgctacgacctcaccgccgacggcaacaagggcatcggccgcctgggcgccatcgatggcgctcgcgacagcctggtgtaccgctacgacgagcgcggcaacctggtcgagcaggtgcgcagcatccgcctcgaccagcagaccctgctcgaccgcgtgacctaccgctacgacgcggccaaccaactgctggagatcggctacccctccggcctcgccatcggctacccgcgcaacgccggcggccaggtcgccagcgtgaccctggcagtgggcgacaaggcgccgagcaccctggtcgggcagatcgcctacctgcccttcggcccgctgctgcgcctgacctggggcaacggcatcactctcagccgcgagtacgaccaggactaccaactgctgcggcagaaggtcggcccctggcagagcgactaccagcacgatgccaatggcaatatccagcagcaccgccacagcctctggggcaccctggactaccagtacgacccgctggaccgcctgaccgaggaacgcggcgtccagggcgggcgcagctatgcctacgacgcggtcggcaaccgcacccaacgcagcgacaaccccgcctcaggcggcaccgccagcagccaggactaccagtacgcgcccgacagcaaccgattgaccgccatcggcgcgcaagcggtgaccagcgacgccgccggcaacctcacccaggaccgcgccgcgcgcaaactggcctacgacgcccagggccgcctgcaaagcgtcagcctcgacggccagcaggtcgccgaataccgctacaacgccctcggccagcgcatcgtcaagctcacccccgagagcgtcaccacctacctctatggtcccgacggccagttgctcggcgaagccgaacacgacggcagcggccggaaactgcgagcccagtactacctgtggctggacagcctgccgctggccaccatcgacgccgactacgacgcccagggcaaggtcggcaacccgaccctgctctacctccatggcgaccacctcgacaccccgcgcctggccaccgacgccagcggccagatcgcctggcagtggcagtccgacgccttcggccgcggcgaagcgctgagccagggcagcacccaggtcaacctgcgcttccccgggcagtactacgatgcggagagcgggctgcgctacaactacttccgcgactatga

SEQ ID NO: 7126 - DNA, 2334 bp, Pseudomonas aeruginosa
tgcgccgccatgacgcgtccccgatccccccgttcccgtaacagcaaagcacgcccggcacccggcctgaacaaatggctcggctgggccctcaagctcggcctcgtcggcctggtgctcctcgccggcttcgccatctatctcgatgccgtggtgcaggagaaattctccggccggcgctggaccatcccggcgaaggtctatgcccgcccgctggagctgttcaacggcctgaagctgagcagggaagacttcctgcgcgaactcgacgccctcggctaccgtcgcgagcccagcgtgagcggccctggaaccgtatcggtggcggccagcgcggtcgaactcaatacccgtggcttccagttctacgaaggcgcggaaccggcccagcgcgtgcgcgtgcgcttcaacggcaactatgtcagcgggctgagccaggccaacggcaaggaactggcggtggcgcgccttgagccgctgctgatcggcggcttgtatccggcgcaccatgaggatcgcatcctggtcaagctcgaccaggtgccgacctacctgatcgacaccctggtcgcggtcgaggatcgcgacttctggaaccaccatggcgtgtcgctgaaatccgtggcccgggcggtgtgggtcaacaccacggccggccagctgcgccagggcggcagcaccctgacccagcagttggtgaagaacttcttcctgagcaatgagcgcagcctgagccgcaagatcaacgaagcgatgatggcggtgctgctggaactgcactacgacaagcgcgacatcctcgagtcctatctcaacgaggtgttcctcggccaggatgggcaacgagcgatccatggcttcggcctggccagccagtatttcttcagccagccgctggccgagctcaagctcgaccaggtggcgctgctggtcggcatggtcaagggaccgtcctacttcaacccgcggcgttacccggatcgtgcgctggcgcggcgcaacctggtgctcgacgtgctcgccgagcagggcgtggcgacccagcaggaagtcgacgccgccaagcagcgcccgctcggcgttacccggcagggcagcatggccgacagctcctatccggccttcctcgacctggtcaagcgccagttgcgccaggactaccgcgacgaggacctgaccgaggaagggctgcgcatcttcaccagcttcgatccgatcctgcaggagaaggccgagacctccgtcaacgaaacgctcaagcgcctcagtgggcgcaagggagtcgaccaggtcgaggcggcgatggtcgtgaccaatccggaaaccggcgagatccaggccctgatcggcagtcgcgacccgcgcttcgccggcttcaaccgggccctggacgcggtgcggccgatcggttcgctgatcaagccggcggtttacctgaccgctctcgagcggccgagcaagtacaccctgaccacctgggtgcaggacgagcccttcgcggtgaaaggccaggacggccaggtctggcgaccgcagaactacgaccggcgctcgcatggcacgatcttcctgtaccagggcctggcaaactcctacaacctgtccaccgccaagctcggcctcgacgtcggtgtgcccaacgtgctgcagaccgtcgcccggctgggtatcaaccgtgactggccggcctatccgtcgatgctgctgggcgccggttcgctcagtccgatggaggtcgccaccatgtaccagaccatcgccagcggcggcttcaacacgccgttgcgggggatccgcagcgtcctcactgccgacggccagccgctcaagcgctatccgttccaggtcgaacagcgcttcgactcgggcgccgtctacctggtgcagaacgccatgcagcgggtcatgcgcgaaggcaccgggcgttcggtgtacagtcaattgccgtcgtcgctgaccctcgccggcaagaccggcaccagcaacgactcgcgcgatagctggttctccggtttcggcggcgacctccaggctgtggtctggctcggtcgcgacgacaacggcaagacgccgcttaccggcgccaccggtgccttgcaggtgtgggccagcttcatgcgcaaggcgcatccgcaatcgctggaaatgccgatgccggagaacgtggtgatggcctgggtggacgcgcagaccgggcagggctcggcggcggattgcccgaatgccgtacagatgccctatattcgtggcagcgagcccgcccagggcccaggctgcgggagccagaaccccgccggcgaggtgatggactgggtacgtggctggctgaattga

SEQ ID NO: 7127 - DNA, 1110 bp, Pseudomonas aeruginosa
cgtgaagaagattttcgtattcgccgcgcttgccggcagtgccgtgctcgcgggctgcgccagcccgcagcacggggcgatcccggtggtggattccggtactccggtgtccaaccaggaaagcggcggtttccgcatcacccgtacccaggtaccgcgtacccagcaaggcgccgccacccagggcattccccagggcggcgactccggtgtggtggtgatggtgccgcagggcgccaattccgcaccgatccagactttcccggcgcagtccggcgccgcgccgatcagcagcgctccgctcggcaccggcacccagtaccaggctccgcccagcagcgcctccacgccaccgctgggtggcagctacaacatgccgcccagcggcgccagtcgttccgcgcccaccggcattccggcctccggctcggccggcagcctggcggccgacgagcagttggacgggccggtcctggcgatgctcacaaccgcccagcaacagcagggcagcggcgacctgaacagcgccgccgccagcctcgagcgagcccagcgcatcgctccgcgcgagccgcaggtgctctatcgcctggcccaggtgcgcctggcccagggcgatgcggcccaggccgagcaggtcgcgcgccgtggcttgagctacgccaatggccggccggccttgcaggccgggctctgggaactgatcgcccaggctcgggagaagcagggagactccgccggcgctgcgctggcccggcagaaggccaaggtcagctcctgatggatcgacgggtctatgcgctggccgaccagttgttgctgatcgagcgtgagttgcgtgccctcggctggtggagcgaaagcagccccgccccggaagcgctggccagccccgagccgttctgcgtggatacgctggcgctcgagcaatggctgcaatggatcttcctgccacggatgaagctgattctcgaaagcgacagcgccttgccgcaagcctcgggtatcctggccatagccgaggtggcctatgcgcagcgtggcgaggaagtcgccggcctgctggcggcgcttggcgagttcgaccggctgatcggcgggccgtcatga

SEQ ID NO: 7128 - DNA, 1743 bp, Pseudomonas aeruginosa
cgttctagaggtgaaaacgtggagcttttatctggcgctgaaatggtcgtccgctcgttgcgcgacgaaggcgttaagtacatctacgggtacccgggtggtgccctcctgcatatctacgacgcgctcttcaaggagcacgacgtgacccacatcctggtgcgccacgaacaggcggctacccatatggccgacggctacgcccgcgccaccggcaagcccggtgtcgtgctggtgacttccggcccgggcgcgaccaacgccatcaccggtatcgccaccgcatacatggactccatcccgatggtgatcctgtcgggccaggtgccgagcaacatggtcggtaccgacgcgttccaggaaaccgacatggtcgggatctcccggccgatcgtgaagcacagcttcatcatcaagcatccctcggaaattcccgaggtgatcaagaaggccttttacctggcgcagtccggtcgtccggggccggtggtcgtggatattccgaaggacatgggcgacccgacgcagaagttcgaatattcctatccgaagaaggtcaagttgcgttcgtacagcccggccgttcgcggtcactcgggacagatccgcaaggccgccgagatgctcctggccgccaagcgcccggtggtctattccggcggcggcgtgatcatgggcaatgccgcggcgccgctgaccgagctggcgcagatgctcaacctgccggtgaccaacaccctgatgggcctcggcgggtatcccggcgcggaccgccagttccttggcatgctcgggatgcacggcagcttcaccgccaacctggcgatgcatcacagcgacgtgatcctcgcggtcggcgcgcgtttcgacgaccgggtcatcaacggcgcggcgaagttctgcccgaacgccaagatcatccacatcgacatcgatccggcgtcgatttccaagaccatcaaggccgacatcccgatcgtcggcccggtggacagcgttctcaccgaaatggtcgcgatcgtcagggaaatcggcgagaccccgaaccaggatgcccaggctgcctggtggaagcagatcgacgagtggcgtggtaaccgtgggttgttcccgtacgacaagggcgacggcagcatcatcaagccgcagaccgtcatcgagacgctctacgaggttacccatggcgatgccttcatcacctccgatgtcggccagcaccagatgttcgcctcgcagtactacaagttcaacaagcccaatcgctggatcaactccggcggtctcggcaccatgggcttcggcttcccggcggcgatgggcatcaagctcaacttcccggacgacgatgtcgcctgcgtgaccggcgagggcagtatccagatgaatatccaggaactgtctacctgcctgcagtacgacctgccggtgaagatcgtcaacctgaacaatggtgccctgggcatggtccgccagtggcaggacatgcagtacaacagccgttattcgcattcctacatggaatccctgccggacttcgtcaagcttgccgaagcctacgggcatgtcggcatgcgcatcaccgacctgaaggatctgaagccgaagatggaggaggcgttcgccatgaagaatcgcctggtcttcctcgacatccaggtggacgccagcgaacacgtctatccgatgcagatccgtgacggcgcgatgcgcgacatgtggctgagcaagacggagcgtacctga

SEQ ID NO: 7129 - DNA, 897 bp, Pseudomonas aeruginosa
agcctgggccggcggagttgtcttcctagtcagaagtgctgtcggcatattcgtaccccatcagttcccaaggaattgtccatgagtgaacgtcccgaggagccgaacaaggcctccgacgaagaaagcctgctgcccatcgacgaacatatagaagaagggcacgacgccgaagggcggaaggttcgtcaccgcggtatctacctgctgcccaacctgttcaccacggcggccctgttttccggcttctacgccatcatcaatggcatgagcggccagttcgccaacgccgccatcgctatcttcgtggccatggtcctcgatggactggacggccgtgtggctcgcctgaccaacacccagagcgccttcggcgccgagtatgactcgctgtccgacatggtcgccttcggtgtagcgccggcgctggtcgccttcgaatgggcgcttggcagcctcggcaaggtcggctggatggtcgccttcatctacgttgcgggcgcagccctgcgtctggctcgtttcaacacccaggtcggcaaggccgacaagcgctatttcatcggcctggccagtccggccgccgcggcgctggtggcgggcacggtatgggcgttcagcgatttcgagatccagggcgccaaggttgccttcctcgtcgccctgctggtcgccgccgctggtgtgctgatggtcagcaacatcaagtaccacagcttcaaggatctcgacctgcgcggccgggtgccgttcgtggcgatccttatcgtggtgctggccttcgccgtggtctttaccgacccgccgcgcatcctcctgttgctgttccttgcctacgcggcctccggtcctgtgcaatacctgctgcagctgcgtcgccggaagcagccgagctga

SEQ ID NO: 7130 - DNA, 1050 bp, Pseudomonas aeruginosa
tctactggcacaaagctggtcattgcggagcccgtcatgctgatcaagattccctcccgttccgactgttccgagtcggaagtcacgtccgaaaccctctacctgtcccgtcggcgtctgctcggtgcttccttcgccggattggcgctggccagcggcctgccgcgcctgggctttgccgacgaacagcgctatgccggcgtcgagccggtgccggcgccgggctggttcgccgaaaagctaccgcagacccgctggcaggcggtggatgtccagagggaggcgatcacgccattcaaggacgccacccactacaacaatttctacgaattcgggccgaacaagggcgacccggcggaaaacgcctcggccctgaagaccgagccctggtcggtggtgatcgacggcgaggtcggcaagccgggtacctatgccctcgaggatttcgtcaaaccctaccaactggaagagcgcatctatcggctgcgctgcgtggaagcctggtcgatggtgatcccttggctgggctttcccctggcggacctgctcaagcgggtcgaacccaatgggcaggcgaagttcgtccgtttcgaaaccctgcagcgtccggaacagatggtcggccaacgctccggtttctcggtgatcgactggccttatatggaaggcttgcgcatggacgaggcgatgcatcccctggcaattctggcggtgggcatgtacgggcggctgttgcccaaccagaatggcgcgccgttgcgcctggtggtgccgtggaagtatggcttcaagagcatcaagtccatcgtgcgtatcagtctggtccgcgagcagccgaagaccacctgggaaagcattgccgccaacgagtacgggttctatgccaacgtcaatccgcaggtcgaccacccgcgatggtcccaggctcgcgagcggcgcctgcccagtgggttgttcagccccaatgtacgggatacgcagatgttcaatggctacgggagcgaggtcgcttccctttatagcggcatggatctgaggaagtactactga

SEQ ID NO: 7131 - DNA, 1521 bp, Pseudomonas aeruginosa
gcccaagcgaacggatatccaaccgaattgcttgacgatcatagagcgttggaaccacctgatcccttcccgaactcagaagtgaaacgacgcatcgccgatggtagtgtggggtctccccatgtgagagtaggtcatcgtcaagctcctatcccaaaacccctggtcagcgatgaccaggggttttgcttttgcgcgtggaaaaaggcgtgcttcctcgcttcttttctcgactgcgaatgccggcggcgactgtcacaattgccctggaaactacccatcctgcatgaaacggatggacggctacctcccccaggcggatcgaaaacgcgctccagagggcctccccggcccctccgtgaaaggctggagcccttgtgtttccaggcttttaggggtgtggcagggcttctcccaaggcttgcggaaaaatgtcggaaggctgatggcatttcatccaactgtcacattcctttcatagagtcttcatgcggcctgacgatactggcccccgttccatccaaccccatcctgtccaaggagcaaggcatgaaactcaagcgtttgatggcggccctgacgttcgtcgccgcaggcgtaggcgccgcttccgcggtagccgcgatcgacccggcgctgccggaatatcagaaagccagcggtgtgtcgggcaacctgtcgagcgtcggctccgacactctggccaacctgatgaccatgtgggccgaggagtacaagcgcctctatccgaacgtgaacatccagatccaggctgccggttcttccaccgcgccgccggccctgaccgaaggcaccgccaacctgggcccgatgagccgcaagatgaaggacgtcgagctgcaggctttcgagcagaagtacggctataagccgaccgccgtcccggtcgctgtcgacgccctggcgatcttcgtgcacaaggacaacccgatcaaaggcctgaccatgcagcaggtcgatgcgatcttctccgctacccgcctgtgcggcagcaagcaggacgtgaagacctggggcgacctgggcctgaccggtgactgggcgaagaagccggtgcaactgttcggccgcaactcggtttccggcacctacggctacttcaaggaagaagccctgtgcaaaggcgacttccgtccgaacgtcaacgagcagccgggttcggcttccgtggtgcagtcggtcagccagtcgctgaacggcatcggctactccggtatcggctacaagaccgccagcgtgaagaccgtggccctggccaagaaggaaggcgctgccttcgtcgaggacaacgagcagaacgccctgaacggcacctacccgctgtcgcgcttcctctacgtctacgtgaacaaggcgccgaacaagccgctggacccgctggaggctcagttcctcaagctggttctgtccaagaccggccagcaggtcgtggtcaaggacggctacatcccgctgccggccaaggtggccgagaaggcgatcaaggaactgggcctgtaa

SEQ ID NO: 7132 - DNA, 387 bp, Pseudomonas aeruginosa
acggtcgctacaagctgctggaagaccccaacgccgaggtcaccgcgagcacccaactgctgggcggcatctcgctgctggtgggcgactccaagggtggcatcgcccagtggttcatggctcgcgataccgacggcgaaccgcgcctgtcgcacgttcgcgacttcaatctggatggcgcgccgatcagcgccatcgctccggaacaacggcgcaagggcttcatcgccctggacgagaagggcaacctcggcgtcttccacagcaccgcgcaccgtaccctgctggtccagccggtcgccgactcttccggggtcatcaccctgtcgccgcgggccaaccgcctgctgctggagcagggtggcaagatccaccgcttcgccctga

SEQ ID NO: 7133 - DNA, 1527 bp, Pseudomonas aeruginosa
tccgtcagcgtctgcgcaagaaatacgcgtcgttgtaagcggcggaggtatagctctgtgaaacagaaacaggaaaccgtcaaagcctggttcggcagcggctcgccctgggtgtggatgaacgccggcgcggtgtcgatcgcggtgatcatgaccatcggcctgctggcggtgatcgcggtacgcggcctcggccacttctggccggcgaacgtcatcgaggcgtcttaccagatccctggcgaagccgccaagaccgtgatcggcgaggtggtccaggccgaggaagtgccgcgcgcgcgcctgcgcagcgccggcatgccggtcccggaggccggccccgaattcatgacccgcgagctgctcaagctgggcaaccgcgagctttacggcagcgatttctcctgggtcgtcggcgagtggctgcaggacatcaagcgccccgaagcgctgatggttctcgaacgccgcgagtggggcaacttctacggctacctgctgagcgtcaaggagaacggccaggtggtcgctgaaggcgacgccgcggtaggcgagctgcagaagcgcatgcagcgggtggatgacctctacgccaagctctacaagctggagaagggcgacatcggcgggatcaaccacggtctcgagcgcctgcgcctgaaagagcgcaagttgcagttggacggcaagctggacgccgccgcccaggccgacctggccgccgagcgcagcgagttgcaggcgcgctacaaggtcctggaagagcagctcaacggcctgcaccaggagttcaaccgcgacagcgtggtaatgcgcgacgccagcggccgcgagagcgaaatcacccttggcaagctggtgcatgcctaccagcccaacgccatgggcctgggcaccaagatgacggtgtacttcaagaagctctgggagttcctcagcgacgatccgcgcgaggccaataccgagggcggtatcttcccggcgatcttcggcaccgtgatgatgaccctggtgatggcgctgatcgtcaccccgttcggcgtgatcgctgcggtctacctgcgcgagtacgccaagcaggggccgctgacccgggtgatccgcatcgccgtgaacaacctcgccggcgtaccggcgatcgtctacggcgtgttcggcctgggtttcttcgtctacgtgctgggcggttccatcgaccggctgttcttccccgaggccctgccggcgccgaccttcggtacccccggggctgttctgggcctcgctgaccctggcgatcctcgccgtgccggtggtgatcgtcgccaccgaggaaggcctggcgcggattccgcgcgcggtccgcgaaggctccctggcgctcggcgcgaccaaggcggaaacgctgtggaagatcgtcctgccgatggccagcccggcgatgatgaccggcctgatcctcgccgtggcccgtgccgccggcgaagtggcgccgctgatgctggtcggcgtggtgaaactggcaccgtcgctgccggtcgacggtaa

SEQ ID NO: 7134 - DNA, 774 bp, Pseudomonas aeruginosa
ctcgttgatgtcaccggtcgcagcggctccagaaggattccccacatgatcaacaaagacagtctcacccatcacatctcccagcagttcaacgccgagctggaggatgtgcgcagccacctcctggccatgggcgggctggtggaaaagcaggtcaacgacgcggtcaacgcgctgatcgacgccgactccggcctcgcccagcaggtccgcgagatcgacgaccagatcaaccagatggagcgcaacatcgacgaggagtgcgtgcgtatcctcgcccggcgtcagccggcggcctccgacctgcgcctgatcatcagcatctcgaagtcggtgatcgacctcgagcggatcggcgacgaggcctccaaggtcgcccgccgcgccatccagctgtgcgaggaaggcgagtcgccgcgcggctacgtcgaggttcggcacatcggcagccaggtacagaagatggtgcaggaggcactggacgccttcgcccgcttcgatgccgacctggcgctgtccgtggcgcagtacgacaagaccgtcgatcgcgagtacaagaccgccctgcgcgagctggtcacctacatgatggaagacccgcgggcgatatcccgcgtgctcaacatcatctgggccctgcgctcgctggagcgcatcggcgaccatgcgcgcaacatcgccgagctggtgatctacctggttcgcggcaccgacgttcgccacatcggcctgacccgcatgaaggaagaggtcgagaacaaccgcggcgagtga

SEQ ID NO: 7135 - DNA, 450 bp, Pseudomonas aeruginosa
ccaactggtggccaagatcaagaaggccctgagccgcagcggcaagctggaagccctggcggcccacgcgccgcgccgggagatcgccagcggcatggccaacgattcgctggccgccctgaccggtggtcgcgccgaggtgatcaagcctgccgccagtccggcaaaaccggcccccgcgccgaagccggcttcggctccccaggccagcgcgcgtcccgccggcagcggcaacccgctggggcaggcgcaattgcgcctgccgcagagcagcatgccctgcgtgatcaaggcggtcagtctgaaggaagcgcaactggtggtgaagcgcgccgacccgttgccgcaggtgctggaaagcgcggtgctggacctcgaggaaaacagcgacgtggcgcgcctgaacggctacctgcacgccatcgccgcgctggagccgaagccggatag

SEQ ID NO: 7136 - DNA, 1392 bp, Pseudomonas aeruginosa
tccagcgcaacgtcggcctggcgctggagtcgattccctacgacttcgcccagccggtcgacagcctgccgaacttcgccatcgtccgcgagccttgaaaagtcgccggcgccgtggcggcgccggctcgtctcagtcgagcttgaccaccttggccaggacgatcttcggaccgcgcatcttcttcacgatgatccgcaggccctcggtgtcgaggacttcctcttcctccggcacccgcttcagggtgtcgtagaccagcccggcgagagtgtccgcctcgacatgatcgaggtcgatgccgagcaggcgctcgagcttgaacagcggtgtgtcgccgcgcaccagcagcttgcccggctggtaggcgaggatgccgcgctcggtcttgcggtgttcgtcctggatgtcgccgaccagcacttccagcacgtcctccatggtcaggaagccgaccaccttgtgatcggcctcttccaccacggcgaagtgcgcgccgcccttgcggaactgctccagcaggcgcgacagtggggtgtgcttggtgacgatctccagcgggcgcaccagttcgtcgaggtcgaaggtctccggcaggctgtccagggcggacagcgccagcagcaggtccttgatgtgcagcaggccgatgaactcgcccttgtggctgtcccagaccgggtagcggctgtacttatggcggcggatcaccgcgaggatgtccgccagcggcgcgtcgtgctcgaggtagaccaggtcttcgcgggagttggcccagtcgaccacctccagttcgcccagctccaccgccgaggccagcacgcgcatgccctggtcgctggggtcctgggcgcggctggagtggaggatcagcttcagttcgtcgcggctgtagtgatgctcgtggtgcgggccgggctcgccctggccggcgatcttgaggatggcgttggcgctggcgttgagcagccagatcgccgggtacatcagccagtagaagaggtacagcggcaccgccgtccacagcgacagcagttccggcttgcggatcgcccaggacttgggcgccagctcgccgaccacgatgtgcaggtaggaaatgatgaagaacgcggtgaagaaggagataccgcggatcagttcgtcggaatgcacgccgatcatcgccagcagcggttccaggagttcggcgaaggccggctcgccgacccagcccaggcccagggaggccagggtgatgcccagctggcaggcggacaggtaggcgtccagctggttgtgaaccttgcgcaggatggcgccgcgccagccgtgctgcttggcgatggtttccacgcgggtggcgcggagcttgaccatggcgaactcggcggcggacgaagaagccattga

SEQ ID NO: 7137 - DNA, 1134 bp, Pseudomonas aeruginosa
cggcaagatgggcgcctggcacgtcgcccagccggacatggactagacggtcgccggcctgcgcgccgctcaacgcagcgcgtagtcggcgaccgtgccgaggaagatcgccaggccagcccagtggttgtgcaggaaggcgcggaagcaggcctgcgggtcgcggtcgcgggtcgaccaggcttcccagacgaagcaggccgccgccaccgccaggccgaggtagaagcacaggcccagttcgaagcggttgccggccagcgccagcaggagcagggtcaggccctgcaggctgccgatgatcaggcggtcggcatcgccgaagaggattgcggtggacttgatgccgatcttcaggtcgtcctcgcggtcggtcatcgcgtagtaggagtcgtaggcgaccgtccacagcacgttggccaggaacagcagccaggcgctggccggcagttcaccgcgctcggcggtgaaggccatcaggatgccccaggaataggcggcgcccagcaccacctgcggatagtaggtgtagcgcttcatgaaggggtagagcgaggccacggctaccgcgccgaacgacagccagacggtcgttgcgttggtcagcaggaccaggccgaagctcagcgcgaccaggacggcgaaggtgatccaggcctcgcgcacgctgatcttgccggtggccagcgggcgcgccttggtgcgtgcgacgtggccgtcgaaattgcggtcggcgaaatcgttgatcacgcagccggcggcgcgcatcaggatgacgccgaggacgaagatcagcaggttcttcagttccggcacgccgtccgcggcgatccacagcgaccagagggtcggccagagcagcaggtagatgccgatcggccggtccagccgcaccagttggacgaagtcccaggcgcgggggtgcaggcgggccagcggcttgatcagggtgacgaacatggggacctccggagtcgaccgggggattatacgtcggcgattcccgcctggtcccacaggcgcggtaggtacacctccgccaccagcaccccgagcgcgccgcgggaaaaccgtgagcgacggccccagagaccctcggcgcggacctcggcgggcagaccggccgccggatag

SEQ ID NO: 7138 - DNA, 1584 bp, Pseudomonas aeruginosa
acgcctgctggaccccggcgtccgcgcggtacaggctgtggacgcttgctgatcccgccgacaaccacaacaaggacagccgccatgaacatcctctacgacgagcgtctggacggtccgctgccgcaggtggacaaggatggcctgctggccgagttgcgcctccgcctgcccgacctcgaactgctgcacgccgcggaagacctgcgtccctacgagtgcgacggactctcggcgtatcgctgcacgccgttgctggtggcattgccggaacgcatcgaacaggttcagggcctgctcgccctctgccatcggctgaaggtgccggtcgtggcgcgcggtgccggcaccggcctgtccggcggcgcgctgccgctggagaacggcgtgctgctggtgatggcgcgtttccggcggatcctcgagatcgatccgctgggtcgtttcgcccgggtccagcctggcgtgcgcaacctggcgatctcccaggccgctgcccctcatggtctgtactacgcaccggacccgtcctcgcagatcgcctgctccatcggcggcaacgtcgcggagaacgccggcggcgtgcattgcctgaagtacggcctgaccgtgcacaacctgttgcaggtggacatcgtgaccctggaaggcgagcgcctgagcctggggtccagcgccctggacagcgccggcttcgacctgctggcgctgttcaccggctccgaagggctgctcggcgtggtggtggaggtcaccgtcaggctgttgccgcgcccgccggtggcgaaggtcctgctggccagcttcgacgatgtggaaagcgccgggcgggcggtggccgacctgatcggtgccggcatcgtcccggccgggctggaaatgatggacaacctgtcgatccgcgccgctgaggatttcatccacgccggttacccggtcgacgcggcggcgatcctgctctgcgaactggatggcgtggaagccgacgtgcacgaggattgcgagcgggtccgcgagctgttcgaggcggctggcgccacctcggtgcgacaggcccaagacgaggccgagcgccagcgcttctgggccgggcgcaagaatgcgtttccggcggtcgggcggatttcccccgattactactgcatggacggcagcatcccgcgccgcgagctgccgcgggtgctgcatggcatcgccgagctttcgcgcgaatacggcctgcgggtggccaacgtattccacgccggcgacggcaacatgcacccgctgatcctcttcgacgccaacctggcgggcgagctggagcgcgctgaagcgctgggcggcaggatcctcgagttgtgcgtggcggtaggcggcagcatcaccggcgaacatggcgtcggccgcgagaagatcaaccagatgtgcgctcagttcaatgccgacgagctgaccctgttccacgccgtgaaggcggcgttcgacccggccgggctgctcaatcccggcaagaacgtgcccaccctgcatcgctgcgccgagttcggcgccatgcacgtccaccacggtcgactgccgttccccgaactggagcgtttctga

SEQ ID NO: 7139 - DNA, 519 bp, Pseudomonas aeruginosa
gcctggacctgccggtggcgacggcgttgcgcaagctggccgagtggggaggccagccattgccgatcagtgcggcctgccacgacggcgaagccctgcgcctgcgcctggagggcggcgagggctcggtacgctcggcgcgcgaccgcctcggtggcgaagcgctcgaggacggcttctgggccgacctgcgcgagcagcgcctgccgttcttcgatcgacccgcgaccgctctggcgcctgtcgctgccggcgctggcgccggagacgccgttgcccggtcgtcagttgctggactggggcggggcgctgcgctggctgaagagcgacgcgccggccgcggacatccgtgcgtggaccgccgcccatggcggccacgccacctgctaccgcgccggccatctcgatgcgccgttccagccgctaccgcctggactgctcggcctgcaccgggcactcaaacgccagctcgacccgcagggcatcttcaatcccgggcggatgtacgccgaactctga

SEQ ID NO: 7140 - DNA, 1236 bp, Pseudomonas aeruginosa
ggaggcgcgatgcaaaccaacctctgcgattccgcccggcaacgcgccgaggccgccgaagccgagcgcatcctgcgcagctgcgtgcactgcggtttctgcaacgccacctgcccgacctaccaggagctgggcgacgaactcgacggcccgcgcggacggatctacctgatcaagcagttcctcgagcgcgacgaggccagcgagcgcacccgcctgcacctcgatcgctgcctgagctgccgcaactgcgaaaccacctgcccgtccggagtcgagtaccacaagctgctggatatcggccgcgacctcctcgccgaacgcctgccgcgcggcttccggcaacgcctgctgcgcgacgggctgcgcctgctggccccgcgcccggggttgttcggcgcgctggccggcactgccgggcggctgaggcctctgctgcctgaggcgatgcagggcaagctgccacgtcgggtcgcggcgccgggcaggcggccgcagccccggcatgcacggcgcgtgctgctgctcgaaggttgcgtgcagccggcgctgtcgccgaacaccaacgccgccgccgcgcgggttctggaccgcctgggaatcagcgtgacgccggcggccgcggccggctgctgcggcgcgctggatttccacctggatgcgcaggagcgcggccgccagcgcgcgcggcgcaatatcgacgcctggtggccgttgctgcgcgagggtgccgaggccatcgtgcagaccgccagcggctgcggcgccttcgtcaaggactacgcctacctgctgcgcgacgacccacggtacgcggacaaggcgcacgaggtcgccgccgctgcccgcgacctggtggaagtgcttcgcgacgagccgctggagtccctcggcctgcgctgcgaccagcgcctggcgttccactgcccatgcacactgcagcacgcgcaacgactgggcggggccgtggaggcggtgctgcggcgactgggcttccatctcaccgaggtggccgacggtcatctctgctgcgggtccgccggcacctactcgctgacccagccggcgctgtcccggcgtctgcgcgacaaccgcctggacgccctggaaagcggcgcgccggatgtcatcgccacggccaacgtcggttgccaggcccatctcgacggggccggacggaccccggtacgccactggatcgagctgctcgaccaggccttgcccggaggagagtga

SEQ ID NO: 7141 - DNA, 255 bp, Pseudomonas aeruginosa
cctccaggtgccggcagatcagcgagaaatgcggcgggaagacatgcgccaggaccaggtagccgaaattgtgcagcaggccgcccaggtagctcaggccggactccgggcgcagctcgcgcggcatggcgcgggtcaggccctcgatcaccgcggcggtgtaaatcgcttgctgccagtagggcgtggcctgctgtggctggtccttgggcaggctcaggctcttgcccagggcgaggccgagggccaggttga

SEQ ID NO: 7142 - DNA, 537 bp, Pseudomonas aeruginosa
ggaaatgctgctcggcgaggatctcggtcggcgccatcagcgccacctggtagccggcctctatggcttgcagggcggcgagggcggcgaccacggtcttgccggcaccgacgtcgccttgcaccaggcgcagcatcggctcgtcctgggccaggtcgtaggcgatctccgcgccgacccggcgttgcgcgccggtcggctggaagccgaggttggcaaggaagcgtttcggcaagcggctggccgccggcaagcgcggcgctgcctgcgagcgcacggcttcgcgcaggcgctgcagggataactggtgggtcagcagttcttcgaaggccaggcgcaactgcgcccagtgccggccttcggccagttcctcgatgtcggcatccggcggcggccggtgcaggtagcggatcgcctggtcgagcgggccaagttggtagtcgcgggccagttccgccggcagccagtcgggcaggctgctggggccgagcatggccagggcctgttggctcaactggcgcaggcgctgctgggtga

SEQ ID NO: 7143 - DNA, 867 bp, Pseudomonas aeruginosa
gaaggagacggcttcatgtcgcaaacagtgatgatcgccggctgcggcgatgtcggcgggcgcctcggcgaggcgctgctggccgatggctggcgggtccatggcctgcgtcgctcggtggacgccttgccgcaggggatcctgccggtggctggcgatctgcaggctccggagtgtcccgcgcagtggccgagcgagccgctcgactacctggtgtacagcgccgccgccagtcagcacgacgaggctggctaccgtgccgcctacgtcgacggcctgcgccatgtgctgggctggttgcaggcccgcggccagcggcccaggcgcctgctgttcgtctccagcaccggggtctacgcgcagaccgatggcggctggatcgacgaggagtcgccggcgctttcccaggtctattccggacggatcatgctcgacgccgagcaggtcgcgctggacagcgggataccggctacccgcgtgcgcctggccggcatctacggtccggggcgggagtggctgctcaaccaggtgcgtcaggggtaccgggtggtcagcgagccgcccctgtatgccaaccggatccacgccgacgatgcggccgggctgctggccttcctgttgcgcgccgatgccggcggccaggcgctggaggactgctacatcggtgtcgacgacgcgcccgtggcgatgcacgaggtggtcgactacctgcgccagcgcctgggcgtcagccaatgggccgacgaacattcggtacgccgcgccggcagcaagcgttgcagcaaccgccgcgcccgggcgctcggctgggtgccgcgctatcccagctaccgcgagggctacgcggcggtgctcggggacgcctga

SEQ ID NO: 7144 - DNA, 1599 bp, Pseudomonas aeruginosa
aatcgagtgggcgcgggggcgccggatgacacaggaaaaagcgggtcagctacgcaggcgggtgatccggatcactcccttgagggcgcgcagcttcttgatgacgcgggccaggtggacgcgatcgtgcacgctgacgaccagctggaccacgctgatgcgaccgtcgcgctcgtccatgctgatcttctcgatgttgccgtcggccgcgttgacgctggtggcgagcagggcgatcaggccacgctggtgctccagttcgacgcgcagttcgacattgaattcgccggtgacatccttggcccagctgagctggatgcatttttccgggttgtggcgtacttcgctgatgttcttgcagctttccaggtgcaccaccatgcccttgccggcggacaggtggccgacgatcgggtcgccgggaatcggcgtgcagcacttggcgtagctcaggaccaggccttcggtgccgcggatcgccagcggaccctcggcgcttggcgcttcctcgccctcgctggacagcaggcggcgggcgaccacgtaggccatgcggttgcccaggccgatctcttccagcaggtcctcgaagacttccatgcggtactcggcgagcacggcctggatgcgttcctgaggaatcttctcgaggtggctgtcgaagccggtaagggtcttgttcagcaggcgctcgccgaggttgatcgactcggagcggcgttgcagcttgagcgcatggcggatatgggtgcgcgccttgccggtgaccacgaagctcagccaggccgggttcggccgggcgcccggggcggtgacgatttccaccgtctggccgctctgcaacggctcggagagcggcgccaggcgacggttgatgcggcaggcgatgcaactgttgccgacgtcggtgtgcaccgcgtaggcgaagtcgaccgcggtggaacccttgggcagttccatgatgcggcccttgggcgtgaacacgtagacctcgtccgggaacaggtcgatcttcacgttctcgatgaattccagcgagttgccggcgcgctgctgcagttccagcacgcccttcacccattgccgggcgcgggcatgggtgcccttgggcgtctcgtcgttggacttgtacagccagtgcgcggcgatcccgtggttggccatctcttccatctcgcgggtacggatctggatctcgatgggcaccccgtgcatgccgaacagggtggtatgcagcgactggtagccgttggccttgggaatcgcgatgtagtccttgaagcgtccggggaacggcttgtacaggctgtgcacggcgcccagcacgcgatagcaggtatcgaccttgtcgacgatgatgcggaaggcgtagacgtccatgatctcgttgaacgccttacgcttgccgcgcatcttctggtagatgctgtagaggtgcttctcgcggccgatcacctggccttccatgccttcgcgggcgaggcagttgaccagcgactcctggatcttgccgacgatctcgcggcggttgccgcgggccttcttcaccgcctggcggatgcgctcggcgcgcatcgggtgcatggccttgaaacctag

SEQ ID NO: 7145 - DNA, 750 bp, Pseudomonas aeruginosa
aaaatcgccaatctttatggaagagccgatttaggcgagcagacgaccgagcagttcggcgtggcgttgctgctgggcgtcctggcgcaactggcgggcgcggaagatcgccttgaggtcgtccagggcgtgggcgaaatcgtcgttgatcaccaggtgatcgtactccacgtagtggctcatttcgctgacggcttcgcgcatgcgccgctcgatcacctcgtcgctgtcctggccgcggttggtcaggcgctggcgcagggcttcctggctcggcgggaggatgaagatcgattgggcctcgggcatcagccggcgcacctgctgggcgccctgccagtcgatctcgaggatcaggtcgaggccttcggcgagggttttctcgacccagcgctgcgaggtgccgtagaggttgccgaagacttcggcatgctcgaggaactcgttgcgctcgagcatggcgaggaattcctcgcggctggtgaagtggtagttgaccccgtccacctcgcccggacgcatgccgcgggtggtatgggagacggacacgcggacctcgggggcggcgtcgagcagggccttcaccaggctggtcttgccggcgccggagggagcggaaacgatgtacagggtgccggacatgaggtgttcctggtgcttcgtacgggttggaaagagatcgggcggaggcgcccgcgggtcattcgatgttctggacctgctcgcgcatctgctcgatcaggaccttga

SEQ ID NO: 7146 - DNA, 546 bp, Pseudomonas aeruginosa
ccagcgcgaggccagccgcggcaagcagggcggtcgtaccctggagatccagcgcctgatcggccgctccctgcgagcggcgctggacctcagcaagctcggcgagaacaccctgtacatcgactgcgacgtgatccaggccgacggcggcacccgcaccgcctcgatcaccggcgccaccgtggcgctgatcgacgccctggcggtgctgaagaagcgtggcgcgctcaagggcaatccgctgaagcagatggtcgccgccgtttccgtgggcatctaccagggcgtgccggtcctcgacctggactacctggaggattccgccgcggaaaccgacctgaacgtagtgatgaccgatgccggcggcttcatcgaggtgcagggaaccgccgaaggcgcgccgttccgtcccgccgagctgaacgccatgctcgaactggcccagcagggcatgcaggagctgttcgaacttcagcgcgccgcgctggccgaatgagcagacgcccggcactgcctgccgggccccggagaaggagcgctacatga

SEQ ID NO: 7147 - DNA, 699 bp, Pseudomonas aeruginosa
aggcctatcgcgcccaatacggtatctgaacctttcacaagggactggcatggtcggacaggatgtaatgcgttgcctgatggccctggggctggtgctccaggggatttccttcggcgcccaggcggcgccgggcggagcggtggagctgtaccgctacgtcaacgacaagggcgtggtggtgctcgaccgccagggtgtgccgccgcagtacatcggcaagggctaccaggtcctcaacgaccagggccgggttatccgcaccgtaccgccggcgccgaccgccgaggaactgcggcagcgcaaggcggcccaagcccaggccagctccgatgcgcagctgctgcgcctgtattccagcctcgaggacgtcgaccgcgctcgcgaacggcgcctggcggaactggacgggctgagcagcgtggcgcgcggcaacctgcagtcgctcaagctgcaacaggccaacctgcaaggccaggcggccaaccaggagcgtgccggacgtccggtggcgcaggcgctggtggaccagttggacgatctcaagcaggaggaaaagcgcctgcagggcgagatcgggcgtttccagaaggcccgcgaagacgcggaaagaacctatgccgccgaccgcgcgcggctctcccagctactcggcgtgagtccctgattccactggcgactgtcgctcgaacgccctga

SEQ ID NO: 7148 - DNA, 651 bp, Pseudomonas aeruginosa
agacgatgccctgcggatcgacctccgcccagcgaacccgcagggaatggaagaaggtgtagttctggcgctgtgctgcgctgctcatgccggctcctcgacgctgctgcagacatcgactctagaccgccatcgcgcggtgcgaaagggctggccgcagaaccccccgtcgctggcccgcattgccctcatcctcggggcgtcgcggccttagtgttgttcgacgagaacgcacgccgtgcgcaacgagagaggaacaccatgtcgtccacgctccgccccggaccgggcaactcgcgcctttgccgcccggggttgctgcttgccctgggcctgatgctggtggcctgcggagaatccacggagccgccggcgcgggccgccgattcccagcgtgtccctgcggaccctgcgttggcgcaggtgtattccgccagttgcaagctctgtcacgccaatcccgcctccggcgcgccgctgaccggcgatgccgctgcctgggcgccacgcctggcgcagggcatcgacaccctgctggaccacagcatcaacggctacaagggcatgccacccatgggcatgtgcatgcagtgctcggaaaaacagttccgggctttgatcgatttcatgtccgcagcgcaggaccgatag

SEQ ID NO: 7149 - DNA, 1296 bp, Pseudomonas aeruginosa
cctgaaaggagcgacgccgtgaatcgacgcaagttcatgttcgccggcctcggggccggcgcgctgctggcgggagctgccgcctggatgcgtcccgccgaccgtggcgggccgtacgacgactatttccgcgcgctgaaccgcgaactcaaggccaatggcccgatgtgcccggtgctgctcatcgacctcgatcgcctggaccacaacatcgatgtggtgatgcgttcggtccgccgcggcggcaagcatctgcggctggtggagaagtcgctgccctcgcccggcctgctggcgtacatcgccaggcgcgccggcacccggcggctgatgtccttccaccaaccgttcctcaaccacgacgcagtcgcttttgcggatgccgacatcctcctcggcaagccgttgccggtgcgttcggcggaactgttctaccgcgagcacaagggcgcgttcgacccggcgcggcagttgcaatggctgatcgatacgccgcagcgcttgcgtcagtacctggcgctggcccaggggctggggacccggatgcgcgtcaacatcgaactggacgtcggcctgcatcgcggcggggtggccgaccaggccgcgctgggtgaattgctggcgctgatcgcggcgcatccgcagcacctggagttcgccggcttcatgggctacgaccccttcgtcggaatgggtgtgccgggcatcctcggttcgcccgaggaactgttcgccaaggtcatggcgctctaccagggacatgtcgacttcgcccgccagcgcttcgccgcgctgtggacaccacagctgaccctgaataccgccggcagccccagctatcgcatgcacgagaaggaaacgctgagcagcgaggtctcggtgggcaccgccatgctcaagccgagccactacgacctggcgtccctggccgagcatgtgccggccgtctacatcgccacgccggtactcaagagcaccggcgcggtgcagatcccggcgctggacggcaagtcgcggctgttttcctggtgggaccccaaccagcgcggcaccttcttcatctacggcggcaactggatggccgacttcgcctcgcccgagggactgcgcagcaacggcatctacgggcgcagctcgaaccaggaaatggtcaacggctcgccttcggtgggcctggaggtggacgaccaggtcttcctgcggccgacccagagcgagtcggtgctgctgcaattcggcgacctgctggcgctgcgcggcgggcggatcgtcgagcgctggccggtttacgcctag

SEQ ID NO: 7150 - DNA, 528 bp, Pseudomonas aeruginosa
ggtgcaggtgttcgccatcgaggagttcttcgccagcctgctggtgtatgggcgtgccctggtcagcccggcgttcgaaccgctgggcatcgaactcatccatgccgctccgccctacgcgggcgagtacctgcgcctgctgggcccccaggtacgcttcggctgcctgcacaaccgcatggcgatcgccagccactggctggacatgcgcctgcccaaccacaacctgccggcgttgcgccaggcgctggccctgctggagcaggaaaacacccaggtgcaccggaaactcgacctggtccaggcggtggaacgggccatcgcccgcgacctcagcctgggcagccagatcgaaaggatttccgccgaactgaacatgagcagccgcaccctgcggcgccggctggccgaacacgggctgaccttcgaggcgttgctggagcaggtgcgacgagggcgggcgatgagcctgctgggcaaccctgggatgtccatcgaacgtatcaccgaggaagtgggataccgtga

SEQ ID NO: 7151 - DNA, 426 bp, Pseudomonas aeruginosa
  unsure (256): Identity of nucleotide at the above locations are unknown.
ggtaggtgccgaggatgccgccgagcagcgccagcagcgccgcgagtgccagcagcagcggcgaggcctgggtcgaagcgacgctgccgggcgtgtagttcagtttccagttcggattgccgctgtccagcgcttgcgcacccttgcccggcgccggcgtaccgcgttgcagcagcacctgggccggtgcgccggagaactgctggaccagttgtacctggccggcatcgcccggcaagggcggcagggcgcgcancagccgttgcaggtcgaccgccagcagcagcgtgccttgcaggctctggtcggcgccgcgcaccggcgcggcgctgtacagcagccagcgctggccgaccttgtaggcttcggcggcgacgttctggccactttccacccggtgcaggatatccagggcggcgaagctga

SEQ ID NO: 7152 - DNA, 945 bp, Pseudomonas aeruginosa
ccgggccggggctgtcgttgtcctgggcggcctggccgggcgcgttcaggtgggcatcgaccacgccgtcccaggccagcaggatgcgctgggcggcctcgatgcgggtggcgtcgccgctttgcagggcttcgagggcgagggggctggccgcggcggcgcgggtgtcggcggcgagttgctgcaaggcctggcgcaaggcgccggcctggccttcggcccaggccgcgtccaactggcgctgctgcgcctcaccggcgccgccgaagacgccgaaccagagcagggcgccggcggccgccacgcccagtaggctggcgcatatgccgggcaacaggtccttgccgtcagcgcgttcggacgctgccttggcgcggcttcttttccggttcgagcacgtcgcccaactcgttcccatccttgggcggtgcgctggaaaagcttcatgccgcgtctcctcggcgtctcgtcctgtgttcggggtcagtggctgccggaatggccgaagccgccggcgccgcgctggctttcgtcgaacgcttcgaccagctcgaaatgcgcctgcaccaccggcaccagtaccaactgcgcgatgcgctcgccgacggcgatggtgaacggcgactcgccgcggttccagcacgacaccatcagctcgccctggtagtccgagtcgatcaggccgaccaggttgcccagcacgatgccgtgcttgtgccccaggccggagcgcggcaggaccagggcggcgaggccgggatcggcgatgtagatggacaggccggtgggaatcagcagggtctggcccgggccgaggacgctgtcttccttgagcatggcgcgcaggtccaggccggccgagcccggcgtggcgtactgcgggagcgggaagtcggagcccaggcgggggtcgaggatcttggcttggagagagtgcatcagtaa

SEQ ID NO: 7153 - DNA, 1425 bp, Pseudomonas aeruginosa
ctctcggttcttgtggttctggccagttgggggcagggcggcgccagccgcccgcctggatcagacgctggcgcggatggcctgggccaggcgctcgacgatctggtcgatgtggggcttgtcgatgatcagcggcggcgacatggcgatgatgtcgccggtcacccggaccatcaggtcgtgctcccagaagcagcgctcgaagacgtcgtagccgcgcttgccggggccgtccgcgtgcggcgccagttgcacgccgccgaccaggcctacggcgcggatgtcgaccacgttgggcaggtcgcgcaggctgaacagcgcgtcctgccagtagccttccagttcgacggcccgctggaacaggtcgtcgcgacggtagatgtccagggtcgccagggcggcggcgcaggctaccggatggccggaataggtatagccgtggaagaactcgatggcgccctgcgggccttgcatgaaggcagcatggatcttctcgtcgacgaatacggcgcccatcgggatgctgccgttggtcagccccttggcgcaggtcagcaggtccgggacgacgccccagcgctgcgcggcgaaggcttcgccgacgcggccgaaaccggtgatcacttcgtcgaagatcagcaggatgccatgcttgcgggttatctcgcgcagccgctgaaggtagcccttgggcggcagcaccacgccggccgagccggacatcggctcgacgatcaccgcggcgatattctcggcgccgtgcagggtcaccaggcgttccagctcctcggccttttccacgccatgctcgggcaggccgacggtgaaggcgttgcgggcgacgtccagggtgtgcggcaggtggtcgacccccggcagcaggttggcggagaaggccttgcggttgttgaccataccgcctaccgacaggccgccgaagccgaccccgtggtagcccagttcgcggccgatcaggcgggtgcgggtgccccggccgatggcgcgctggtaggcaagggcgatcttcagcgcggtgtccgccgattccgagccggagttggtgaagaatactttgttcaggcccggcggggcgatttccgccagccgcgcggcgagttcgaacggcagcgggtgacccatctggaacggcggggcgtagtcgagggtggcgatctgccgggccaccgcttcgctgatctcgcgccggccgtggccggcattgcagcaccagaggccggcggtgccgtcgaggatgcggcgcccgccctgggcgatatagtggatgccttcggcgctttccagcaggcgcggccgcaccttgaactggcggttggcggtgaagggcatccagaagttgtcgaggctgctcgactgcggctcgttattcattgtcatagggccacccaggttgcacgcgagggatga

SEQ ID NO: 7154 - DNA, 552 bp, Pseudomonas aeruginosa
cgaagtcgccgccactccccatgccgagctgggcctggtgacccgcgagccggtcggcgtggtcgccgccatcgtgccgtggaacttcccgctgctgatgtcctgctggaaactcggtccggccctggccaccggcaactcggtgatcctcaagccctccgagaagtcgccgctgaccgccatccgcatcgcccagttggccgtcgaggccggcattccgaaaggcgtgttcaacgtgctgccgggctatggccacacggtaggcaaggcgctggcattgcacatggatgtcgacaccctggtgttcaccggttcgaccaagatcgccaagcaactgatggtctatgccggcgagtcgaacatgaagcgcgtctggctggaggccggcggcaagagcccgaacatcgtcttcgccgacgccccggacctgaaggccgccgccgaagccgctgccggcgccatcgccttcaaccagggcgaagtctgcaccgccggttcgcgcctgctggtggagcgctccatcaaggacaagttcctgcccctggtgattga

SEQ ID NO: 7155 - DNA, 1302 bp, Pseudomonas aeruginosa
gtcggcccttccgggccggctctctcgagccacacccgcggccgggtttccttctggaagcccggccgctgtgcttcgtgcgccggatatatccgctcgccccggcaaggctttcggggtgccaacgggagaatcgcaatgcgttggggaagctatttcgccgtctgttccgcagtcatcagcatcggtctcgcccttggcctgaccatgccgctggtctcgttgcgcctggagagctggggctacggcagtttcgccatcggcgtgatggccagcacgccggcagtgggcgtgctgctcggcgcgatgatcgccgggcgcctcgccgcgcgcgtcggcacgccgcggctgatgcagttgtgcctgctcaccggggcagcctccgtcggcctgctggcgctgctgcagagctacccggtatggctgttgctgcgcctgctgatcggcgtgcagctcaccgtggtgttcatcctcggggaaagctggatcaaccagttggcggtggagaagtggcgtggccggctggtcgcgctgtacggcaccggctacgccctcagccaactgtccgggccggtactgctgaccttcatcggtaccgccgacgaccgtggcttctggttcggcgtctgcctgctgattgctggctcgttgctgctgctgggccgcagcggtgcgcccagggtcgatccgcacagtgcctccgggcgcggtttgtgggccttctgccggggtctgccggcgatcgcctgggcggtggtgttgttcgctgccttcgaggcgatgatcctcaccctgctgccggtatacgggttgcgccagggctttccgcaagcggtggcgctggccatggtcagtaccgtggtggtgggcgatgcattgttgcagctgccgatcggctggctcgccgaccgggtctcgcgcagcggcctgttcggcggctgcggcctggtgctgctgctgagcagcctggcgattcccctgctgctgcagacgccgttgatctggccgctgctggtgctgttcggggccagcgccggcgggttgttcaccctggcgctgatcctgatcggcgagcgctaccgagacgatgccctggtccgggccaatgcccatgtcgcgcagctatggggcatcggctgcctgctcggcccgctggccaccggcgccgccagccagtggatcagcggtcacgccctgccgttgatgatggcgctcggcgcggcgggcttcgtggtgctggtgcggctgcgcggggcgattccggcggacgacgaggcgacaggcctggaagcctccgagtga

SEQ ID NO: 7156 - DNA, 1149 bp, Pseudomonas aeruginosa
aggaaatgcgaccttcctcctgcaggatgcggaggatgttgcggtcgatcttgtccagctcgcgcttgctctgatgctgggtacgcatggatggaggctccccgtctggctcggaaaatccggaaattttccgccaatataacgtcgaaagcagggaaaaacactggccagggaaaacgccttgatcttgcacgagggccccgccacccttggccgggtcggcaacggacagaggtgggacatgcgtttgcgcagaaggacgacgttgctgctggtatttgcagtgctgttgctgctggcgttcggctacggctggcatgcctggcgcagcctgttgcgcgagcagggtgtcgagcgcctggagtggcaaggcctgggcctgtccgccgaaggcatcgggctgcgacggctggcgctggagcggcgcggcgcggatggcgccagcctgcgactggacgtggaacacgcgctgctgcgctggcccgggctgtcgggttggcgtccgcgtctacccggcctgcgcgtggagcaagtggcgctcgcctggcaaccggctgccgcgagttccgacgacgacgccgctgcgctggactggacgtccctgcgcgagaccctcgcctggctgccggaacagatccacctcgaacgcttccatctcgacctgccttgtcccgccggccgctgcgagcaggacggcggactggacatcggccgcccgtcgggagcgctgtttccgctggctgcgcaactgcgcctgcaacaggaggcgcagcaggcccagctcgacgcccagctcttcgaggagcctactggttggcgcctgcggacgcgcgcgcaactcgaccggcaggcgctgctgacgctggacagccagctcgcgccgtccgatggcgacggcctctggcaggggcgcctggaggcgcccggcctgccggacacccgtggcctggtggtctggctcaatcgctggttgccggaagcccagcgcctgcccgacgcaccgcaagccctgcatctgcaagcggactggacgatccgcctggcgcctggcagcgactggctggagccgcgccgggtgctcgacggcggtggctcggcggcgctgctggtgcaggctccgcaagcctggccgctgcccggtctgggtaa

SEQ ID NO: 7157 - DNA, 870 bp, Pseudomonas aeruginosa
cgtcaccgcgttgcgcctggcgttcaccagcgagggcgcgagtacgctgaagctggagacgcggctcgacctgctgggcatctcgccgtgggccgccaggctggtggagggtcgcttgcaggtggacgcgccgcgcctgcaatacctgggctggaaagccgagcgactggtcgcggagattcccctggagggccggctggacgggcagcgcgccaacctctccttcggcaggggcgcgcggttgcaggcggcgtccctggccgagccgtcgacgctgcaccttggccagccccgcctcgacctcgccggggccgctctcgaactggcctaccagccgctggcgctgcatttcgccgggccgctgcaggcgcaggtcggacaactccgccaggccaacctcaaaccgttggcctggaccttcgaggggccgctcgacaccaccctcgagcgcaccagcctgaagggacggctgagcaacggcgcggggttggcggcggacatccagctgcagcgcgacgcgaagacgcccctggcgctctccgccaggctggccgaggtgttcttccgtaccggcaatccgctggccgcgaccctcgccgactggccggggctgctcgaactgggcaatgggcgagcgaccgccgcggccggctggaagctcgatgcggcgggcgcctcgtccctcgacctggacctgaccctgaaaggcctcgacggtatctacgaccgcagcgagctgaaggggctgggcggcagcctggccttgcgcctgcgtggcggtcagttgagcctggacagccccggcctgagcctggccgaggccaatcccggcctgccgctggggccggtgagtttccgcgggcgctatga

SEQ ID NO: 7158 - DNA, 270 bp, Pseudomonas aeruginosa
aaccattcgccaacgtgtgcaggagcgcatgcagaaacgcaaggcttcggcgccatgagccatacaggagaacccccgatgcgcctctgcgctctattcgctgtcctgctgctgggcagcctgacgatggcctgcacgcccaccgtgcagctggcggctcccagcgagccgatcaacatcaatctcaacgtgaaaatcgagcacgagatctacatcaaggtcgacaaggctctggacggcatcatcaacgagaacagcggcctgttctaa

SEQ ID NO: 7159 - DNA, 357 bp, Pseudomonas aeruginosa
aggagcggatccatgacaacccgtagcaaactcggtatcgccctgctggccctcggcatcagcctttccgccatggcgatggacctcggccaggccatgtcggcccttggcggcgccaaggcccagggcctggtcggcgagcaggcggacggctaccttggcgtggtcagcaacagcggccaggcggcggacatcgccgcgcagatcaatgccgcgcggcgtgccgaataccagaaggtggccaacagcagcggcgcttcgctggccgacgtggaggccatggccggcaagaaggcgatggagagaacccctgccgggcagtacgtccaggtcggcggcaagtgggtgaagaaatag

SEQ ID NO: 7160 - DNA, 216 bp, Pseudomonas aeruginosa
acaaggagcgcatggtccgcctgtccgagtacagccgcgattgcctcgacgaactgcgcgccgagaccggcatcgcctacgagggccgcaccctcggcaccacccaactgttccgcacccaggcgcagctggacgccgccggcaaggacatcgccgtgctcgagcgctccggcgtgccctacgaggttctcgaccgcgacggcatcgcccgcgtag

SEQ ID NO: 7161 - DNA, 432 bp, Pseudomonas aeruginosa
tggcgaagaagcgcccgcagatcagtaccgaaggcctggatatttcccgctatagcaattccccggagaacgccaagaatgcccatccagcgccagcacactaacgagcgtatgagccagatcgtcgtccacaacggcaccgtctacctggcgggccaggtgggcgaggacatgtccgcgggcgtcgagcagcagacccgcgagaccctggcggccatcgagcgtctgctggaagaggccggcaccgacaagactcggatcctctcggtgaccatctacctgaaggacatcgacgccgacttcgaaggcatgaaccgcgtctgggaccagtggctgccgcgcggcgtcgcgccggcgcgcgccaccgtcgaagccaagctctgcgagccggagatcctggtagagatgtcggtggtcgctgcgctgccctga

SEQ ID NO: 7162 - DNA, 1164 bp, Pseudomonas aeruginosa
gttttgtctggcccggccggagagccgggctttttttcgcctgatgaaaggtgcgcgatgccgcacctcgctgaagagagacccgtcgccatgcgccccgcccgtgccctgatcgacctgcaagcccttcgtcacaactatcggctggcccgcgaggccaccggcgcccgtgcgctcgcggtgatcaaggcggacgcatacggccacggcgcggtgcgctgtgccgaagcgctggtggccgaggccgatggcttcgccgtggcctgcatcgaggagggcctggagctgcgcgaggccggtatccgccagccgatcctgctgctggagggcttcttcgaggcgtccgagctggagctgatcgtcgcccacgacttctggtgcgtggtgcattgcgcctggcaattggaggcgatcgaacgcgccagcctggcccgcccgctgaacgtctggctgaagatggattcgggcatgcaccgcgtcggcttcttccccgaggacttccgcgccgcccacgagcgcctgcgggccagcggcaaggtggcgaagatcgtgatgatgagtcacttctcccgcgccgacgaactggattgcccgcgcaccgaggaacagctcgccgccttcgcggccgctagccagggcctggaaggcgagattagcctgcgcaattcgccagccgtgctcggctggccgaaggtgcccagcgattgggtacgtccgggcatcctgctctacggagccacgccgttcgagcgcgcacatccgctggccgaccgcttgcgcccggtgatgaccctggaatcgaaggtgatcagcgtccgcgacctgccggccggcgaaccggtcggctacggcgcgcgctacagcaccgagcgtagccagcgcatcggcgtggtcgccatgggctacgccgatggctatccgcgccacgccgccgacggcacccttgtgttcatcgacggcaagccggggcgcctggttggccgggtatcgatggacatgctcaccgtcgaccttaccgaccatccccaggccgggctgggcagccgggtcgaactatggggcccgaacgtgccggtcggcgccctggcggcgcagttcggcagcattccctaccagctgctgtgcaacctgaaaagggtgccgcgcgtctattccggggcttga

SEQ ID NO: 7163 - DNA, 627 bp, Pseudomonas aeruginosa
tacggccgacttggggtcgccagccgtgtgcggcctcgttttgccttgcctgccagaagaataaggaggactccacccttggacgtcggtgctcgtctgcaaaccatccgaaagctcaaaggtctttcccagcgcgaactcgccaaacgggcgggtgtcaccaacagcactatctcgatgatcgagaaaaacagcgtgagcccttccatcagttcgctgaagaaggtgctgggcggtatccccatgtccctggtggagttcttctccctggacctggagcaggacagccatacccaggttgtctacaaggcagacgaactgatcgacatttccagcggcgcggtgtccatgcgcctggtgggcaaggcgcacccgagccgggcgatcgccttcctcgacgaaacctacccgccgggctccgacaccggcgaggaaatgctcaaccacgaaggcgaggaggccggcgtgctggtcgacgggcgcctggaactgaccgtcggcagcgagacctatgtgctcgagcgcggcgacagctactatttcgagagcaacaagccgcaccgttttcgcaatccctacgatgtgccggcacgcttgatcagtgccaccacgcccgcaaatttctga

SEQ ID NO: 7164 - DNA, 753 bp, Pseudomonas aeruginosa
aagccgcgatcaagcatatgtccggtctgtaacaacgccgggacagtgtcgcgaaaagccgcctcctggcggctttttcgtatccgcggtgcgggtttttcccgctggcggatcgtcccgccggcaaacagggtccaaacttccggctacccattcgccggagggcatcgtcttgagccgaacctgttccatcgacgccgcagtcgatcacttgctgcagaccatcgagggcccgattcgcatgggcctgcccctcgggctgggcaagcccaaccgactggtcaatgcgttgtaccagcgcctgcggaccctgccggagcgccaactgacgctgtataccgcgctttccctggggcgtcccgccgctggcggcgacctgcaacggcgtttcctcgagcctttcgccgaacgggtcttcgccgactacccggagctggattacctgcacgccctacgccgcgacgaactgccggcgaacatccgcgtcgaggagttctacctgcagcccggcagcctgctggacagcgcgccggcgcagcagcactacatcagttgcaactacagccacgtcgcccgcgacatcaatgccaagggcgtcaacgcggtggcccagctggtggcgcggcatcccgagcggccgggcaagctgagcctggcctgcaacccggatatcaccctggacctcctgccgatgctggagaagcgtcgcgccgctggcgagaccatcgtcgccatcggcgtggtccacgatga

SEQ ID NO: 7165 - DNA, 459 bp, Pseudomonas aeruginosa
cgcggaagtgatcgccgcgctgctggccatcgccgactcgcgcttccagcaggcgctggccgagcaggcccagtcggccggcaagctgccgaaggatttcgtcctgcccgaacgctatcgcaacaataccccggagcgcctgcaggccttgcaccaggcccacgcagcggcgctgccggagtttcccctgggcagcgatttcgacgagatcgagcaggacctgctgcgggcgctgggttggctcaagcgcaagctgaagctgagcgagatcctcgaactgggcaaggcgaccctggatgcgccggagccagaagcctacccggcgcatctgcggcgcatggacctggacgatccgcaggggcttcgcgaggaactctaccagcgcttgctgctggccggcctgcgagccagccaggaagagcggggctgagtggcgctcagtcgaggaactcgacctga

SEQ ID NO: 7166 - DNA, 798 bp, Pseudomonas aeruginosa
cgtctcgacgtccttgaagcgcccgctgagcacggccttggcggcgtagagcgcggtgtcggcgacctggccgaactcgatcttcggcggcatcaccagctccgcagggttggtatgcacgtccagcagcgccggaccgggctgggcgaggaactcctgcaccgccgtctcgagctcctcggagcgcgtcaccttgcgtccgtggaagccgatcacttcggcgagacgggcgaagtccgggttgagcaggtcggtgtagctgtccagcaggccctcgaccttctgttccagctcgacgaagttcagcgaggcattgttcagcaccactaccttgatcggcagtttttcctggatggccgtcagcaggtcgccgagcagcatggccaggccgccgtcgccggagatcgagatcacctggcgctcggggtaggccttcttcagccccagcgcctggggcatggcgttggccatggtgccgtggaccaggctggtgagggtgcggcgcttgccgttgctgtggatgtgacgcaacagccagaccatcgccgagccgccgtcggcggtgaacagggcgtcctcgctggcgtgctggtcgagcaggctgaccaggtgctgcggatggatcagctcgcccttgccggcttgctcctctttttccagcgtccgcagcgagcgctcgcggtgctccaggcattcgtcgaggaagctgcgctcctcgcgggcttcgagcaacggcaagagctggggatcacgtcgccgaccacgccgagatcgatggggtggcggcggcccaggtga

SEQ ID NO: 7167 - DNA, 2187 bp, Pseudomonas aeruginosa
ctagctaattttggtcgcgcgtggagcggcaaaagttcctcgcccgaggctaggcatcgggcaagacacttttgtgaaaatcgagacagtcgaggcgcggcgggctcagcgcttgagcatggcgcggatgtcggcgagggcggcgttgcccttggccgccttgacctcttgcggggcgtcttccatgccttcccattcgaggtcttcggggggcagttcgtcgaggaagcggctcggcgagcagtcgatgatctcgccgtattgcttgcgcttggcggcgaaggtcatcgccaggttctgccgcgcgcgggtgatgccgacgtaggccaggcggcgctcctcttccaccgtgtcggcctcgatgctggaacggtggggcaggatctcttcctccatgcccatgatgaacacgtaggggaactccagccccttcgacgcgtgcagggtcatcatctgcacgccttcggcgccttcctcttcttcctgctggcgctccagcatgtcgcgcaggaccagcttggcgatggcctgctcgatggtcatgtcgccttcctcgtcgcgctcgagggtgttcttcagtgcctcgatgaggaaccagacgttgctcatgcggaattcggcgaccttgtcgctggaggcgttctgccgcagccagttctcgtagtcgatgtccatcaccatgctgcgcagcacggcgatcggctcgttctccgcgcactgtcggcggatatcgtccatccagcgcttgaagcgttgcaggcgttcgtggaaacggctgtcgaggtgctcggccaggcccatctcgtcgcaggcggcgtacatcgagatcttgcgctgggtggcgtagttgccgagcttctccagggtcgccgaaccgatttcccggcgcggcacgttgatcaccctgaggaaggcgttgtcgtcgtcggggttcaccagcaggcggaagtaggacatcaggtccttcacttcctggcgcccgaagaagctggtgccgccagagagccgatagggaatctggtggtgctggagcttcagctccatcagcttggcctggtggttgccacggtagaggatggcgaactcgctgtacggccgctcggtgcgcaggtgcagggtgaggatttccatggcgatgcgctcggcctcggcgtcctcgttgcggcagcggatcacccggatcggatcgccgtggcccatctcgctccacaactgcttctcgaatacgtgcgggttgttggcgatgaggacgttcgcgcacttgaggatgcggctggtggagcggtagttctgctccagcatcaccaccttcagcgaagggaagtcttccttcagctgcatcaggttttccggacgcgcgccgcgccaggcgtagatcgactgatcgtcgtcgccgaccacggtgaactgggcgcggtccttcaccagcagcttgaccagcaggtactggctggcgttggtgtcctggtactcgtccaccagcatgtagcgcaccttgttctgccacttctggaggacgtccggatgttcctggaacagcttcaccggttgcaggatcaggtcgtcgaagtccaccgcgttgtaggcgcgcagggtgcgctggtaatgcaggtagacgatcgcggcggtctgctccttggggttgcgggccttttccagcgcctcctccggaaggatcaggtcgttcttccaggcgccgatgtagttcttgatctcgtcgacgccgtcgtccccggaatactccttctgcatgatgtcggtcagcagcgccttgatgtccgactcgtcgaagatcgagaaaccgggcttgtagccgagccgttcgtgttccttgcggatgatgttcaggccgaggttgtggaaggtcgagacggtcaggcccttgccctcgccgccgcgcagcagggtgccgacgcgctccttcatctcccgcgcggccttgttggtgaaggtcacggcgacgatgtactgggcgcggataccgcactgctggacgagataggcgatcttgcgggtgatcacgctggtcttgccggagccggcgccagccaggaccagcaggggaccgccgacgtagttcacggcttcttgctgccggggattgagtcgggacataggaacaggccggaagagagggttgaagcgggggcgtattctaacaggctggctggcatccgcgagaattag

SEQ ID NO: 7168 - DNA, 1314 bp, Pseudomonas aeruginosa
acgcctgagagcgctggggcctgccttttcgctgagcatcgtcaccacctgggagggtgcggccaccctgttcgccgccgagccccgggggctgctcctggccacgccggcctgcctgccgctggggactccctgtccctggccggtgatcctgctgttgcagcaggagccggcgcaggcgccggttggggtggtcgactggctggccgccgaacagctttccgaggacagcctgcgccgctgcctgcgctacgcgcgcgagcgcctgggtttgcaggcgaccctgcaactgctcgccgagcaggatccgctgaccggcatcgccaaccgccagggcttccagaccctgctcgcggcgcgcctcagcgaattcgacgggcgtggcctggtgctcggccacctcgacctggacaacttccgtcacgtcaacgattccctcggccaccagggcggcgaccgcctgatcctgcaggtggtcaaccgcctgcgcggcttcatggagaacggcgacagcctggcgcgcctgggcagcgacgagttcgccctgctgctggacacccgtcgcgatccgcaacgcgccgagcgggtcgccgaacgcatcgtcgaatgcctcggcgagccctactggatcgatggcgagagcctgttgctgggttgcagcctgggactcgcccatgcccgtgccgacgaaggtgccgacccgctgatgtggcatgcgcacatcgccatgcagcaggccaagagccgccagggttgcaccttccatgtcttcgacgaacgcatcaaccgtggcgtgcgcagcctcgccgacctcgaagccgaactgcgccgggcgctgcgtcgcgacgagctggagctgcactaccagccgcgactgtgcctggacagcgggcgcatcgtcggcctggaggcgctggtgcgctggcgccacggcgagcggggcctgctcacgcccagcgagttcgtcccgctggccgaggagagcgggctgatcgtgccgctcggctactgggtcatcgcccgcgccctgcgcgacatgcagtggctcaacgggcgcggcctggagccgttgcacatggcggtgaacctgtcgttccgccagttccaggacagccagttgctgccgaccctgcaacggttgatcgaagagcacggcgtcgacgcgcgctggctcgagttcgaactgaccgagaccgccgtgatgcggcgcagcgaccaggtgctgcagaccatgcaggcgctcggccaactgggcgtgcgcttttcgctggacgacttcggcaccggtttctcgtccttcgtccacctcaatag

SEQ ID NO: 7169 - DNA, 1056 bp, Pseudomonas aeruginosa
ggctcaggaggagatggttgccgcgatggcctgtcggcgttgagaatgcggctattctcggtgcgactggcatggctccacaaaaggaaaaacaagatgccaggcatgagtaaaagtcatgaaagaggtaattccccaatgacccgtcgcctgcccccgctgtatgccctgcgcgccttcgaggctgccgcccggcacgcctctttcacccgcgccggcgaggaactggcgataacccagagcgcggtgagccggcacatccgtaccctggaggagcacttcggttgtcgtctgttcgagcgccatggccgccagttgcagctgaccgagccggcacgcctgctgctgcccgggctgcgcgacggcttcgatgcgctggaacgggcctgcaccgccctgcgtgtggacgacgccaccctgcgcctgaaggcgccttccacccttaccctgcgctggctgctaccgcgcctgagccgcttccgccacctgaacccggatatcgaggtgcagctcaccagtgcctggatggatgtggactcggtggacttccagcgcgagcctttcgactgcgcggtgttgctgggcagcggccagttcagcccggaatgggaaacggcagcgctgttcgccgaatggctggtgccggtctgcgatcccgacgaggccgtggagccctggaccctccaacgcctgcgtgacagcgagttgctgcaccctacgccggatcgtcgcgactggcgacgctggctgcaacggaccgggctgggggaggaggtgtcgctcaagggcggccaggtgttcgacacgctggaactgggcatcgtcgccgccgcgcgaggctatggcgtgtccatcggcgacctggtgatggtcgccgaggatgtcgcccagggccgcatcggcctgccctggccggtggcggtggccagcggcgaaagctatcacctggtctggcctcgtgcccgcaggggacaggaacgcttccagcgattgcgcgacttcctcctcgcggaggtggcggcgatgcgtctgcccgtcgtcgagcggctggcgtga

SEQ ID NO: 7170 - DNA, 1200 bp, Pseudomonas aeruginosa
  unsure (465): Identity of nucleotide at the above locations are unknown.
cgccgccggacaactcctggcgctgacgcgacgttacaggtcgctgccgtcgctgggccgggcgcagggtttgcgctagggtcgttggtcgttgcctgtcgggagcggcaggggacggagcttccttccaaccgcccaaaggaacccgccatgaccttcgccaaaggaatactcgccgcgctggcgctcgccgccgcagtcggccaggccagcgccaccgaactcgagcactggccggcccccgccgccaggcaactgaatgcactgatcgaggccaacgcgaacaagggcgcctatgccgtgtttgacatggacaacaccagctatcgctacgacttggaagaatcgctgctgccctatctggaaatgaagggcgtgctgacccgcgacaggctcgacctttcgctgaaactgatcccgttcaaggaccaggccgggcacaaggagagcctgttcagctactantaccggctttgcgagatcgacgacatggtctgctatccctgggtcgcccaggtgttctcaggcttcaccctcagggaactgaagggctatgtcgacgaactgatggcctacggcaagccgatccccgccacctattacgacggcgacaagctcgccacgctcgacgtcgagccgccgcgcgtgttcagcggccagcgcgagctgtacaacaagctgatggaaaacggcatcgaggtctacgtgatcagcgcggcccatgaggaactggtgcggatggtcgcggcggaccccaggtatggctacaacgccaagccggagaacgtcatcggcgtcaccaccctgctgaagaaccgcaagaccggcgagctgaccactgcgcgcaagcagatcgccgagggcaagtacgatcccaaggccaacctcgacctggaggtgaccccctacctgtggaccccggcgacctggatggccggcaagcaggctgcgatcctcacctacatcgaccgttggaagcggccgatcctggtcgccggcgataccccggacagcgacggttacatgctgttcaacggcaccgcggaaaacggcgtgcacctgtgggtcaaccgcaaggccaagtacatggagcagatcaacggcatgatcaagcagcattccgccgcacaggccaaggccggcctgccggtgacggcggacaggaactgggtgatcgtcactccggagcagatccagtag

SEQ ID NO: 7171 - DNA, 1305 bp, Pseudomonas aeruginosa
catgtccaccaccagcgcgccggagtcggccgaggtgacgaagaacaccaccaccatcagcaccgccaccagcgagatcacgctgcccagcgggaagtgctcgaggaaggcgaacagcgccaccgaactgtcctggttgaccacttcggccaactgggtgaagccctcctgcaggaccatgtggatggcggtatcgccgaacaccgtcatccacagcagggtgaagccggccgggacgaacagcacgccgcagacgaactcgcggatggtgcggccgcgcgagatacgggcgatgaacaggccgacgaagggcgaccaggacagccaccagccccagtacagcagggtccagccgccgatccaatcggtgggctcgtaggcgtacaggttgaaggtcttgttgacgatgtcggacaggtaggccccggtgttctgcacgtaggtctgcaggagaaacacggtcggcccgaggaccagcacgaagagcagcaggatcaccgccaggctcaggttcagttcggacaggatgcggatgccgcggtccagtccgctggccaccgagagcgtggcgaggccgcaggtggcggcgatcagggcgatctgcacggtctggttcaccggccagccgaacaggtggtgcaggccgctgttgatctgcagcacgccgtagccgagcgaagtcgccacgccgaacacggtgccgatgatcgcgaagatatccaccgcgtggccgatggggccgtagatacgttcgccgatcagcggatacagcgccgagcgcagggtcagcggcaggccgtggcgatagctgaagaaggccaggatcagcgcgacgatggcgtagatcgcccaggcatgcaggccccagtggaagaaggtcagcttcatcgcttccttcgccgcctgcacggtgttcggctcgcccaccggcggggtggtgaagtgcatcaccggttcggcaacgccgaagaacatcaggccgatgcccatgccggcggagaacagcatggcgaaccaggtggtgttgcggtagtcgggacgactgtggtcggggccgagcttgatgtcgccgtagcggctgacggcgaggaacaccacgctgatcaggatcagcgccacggccagtacatagaaccagctggcgttggtgatgatccattgctggacgtggttgaacagcgattgcgcttcttcctggaggagcacggtgaacagcaccagggccaggatcagggcggcggaggtatagaagaccggaggattcagggtgctccggggggtagtgggtgtctccatgtaagctag

SEQ ID NO: 7172 - DNA, 447 bp, Pseudomonas aeruginosa
gcaacaggttgtgcgcgccggcggcggccaccagcagggcgcgcttggcggcggcctggccctggacctcggccaggtctggataagggaagggcgcgcggagcaggccgcgggcctggtagggcggcagcggggcctggccggagaggtgtccggcgatctccagcaggtggtccacggcgaacaccgtcagcccgctggccaggctggcctcttcggcattttccttcggtaccaccagaacgcgccttgcgtcgcgcgccgccagcgcggccggcaatacgcctcgcactggccggatcgccccggacagggccagttcgccgaggcactccaggccgtcgagggcggtgccgggcaactggccgctggcggcgaggatgccgagtgcgatggccaggtcgaagcgaccgccgtccttgggtaggtcggcgggggcgaggttga

SEQ ID NO: 7173 - DNA, 543 bp, Pseudomonas aeruginosa
agcagtaccggtgcggcagatgaggcggttgcgggaggccggcaggttgcggcatcgaacggccgcagcagggccaggtcggggcggagggtcccgatcatgcttcccagagggaccggcgcgttacaaagccagacactgcgcttagactgtcctcgggttcgttttcctggggcgagtccaccaaacacgggagagagtttcatgaagctagtcactgccatcatcaagccgttcaagttggacgacgtccgcgagtcgttgtccgagatcggtgtgcagggcatcacggtgaccgaggtcaagggtttcggccggcaaaagggccacaccgagctgtatcgcggcgccgagtacgtcgtcgacttcctgcccaaggtgaagatcgacgtggcgatcgccgacgaccagctggaccgcgtcatcgaggcgatcaccaaggcggccaataccggcaagatcggtgacggcaagatcttcgtggtgaacctggaacaggccatccgcatccgtaccggcgaaaccgataccgacgcgatctaa

SEQ ID NO: 7174 - DNA, 1368 bp, Pseudomonas aeruginosa
gcccaaccgaacccccaaaagccccaggagaataccaacatgactctgcgtaagatcgcagggctaggagccctattgtccctcgctttgccgggcgtcgccctggccgccgaggagcccgtcctgaacagcggcgacaccgcctggatgctgatctccactgcgctcgtcctgctcatgaccatccccggcctggcgctgttctacggcggcatggtgcgagcgaagaacgtgctgtcgatcatgatgcagtgcttcgccatcaccggcctgatcaccattctctgggtggtctatggctacagcctggcgttcgataccaccgggatggagaagggcgtcctcaacttcaattccttcgtcggcggactggacaaggccttcctcagcggtctcaccgccgacggcctgacttccgccaccgcgctgttcccggaaagcgtgttcatcaccttccagatgaccttcgcgatcatcactccggcgctgatcgtcggcgccttcgccgagcgcatgaagttctcggcgatgctgatcttcatggcggtctggttcaccgtggtctacgcgccgatcgcgcacatggtctggagcggtgacggcgccctgatgtgggactggggcgtgctggacttcgccggcggcaccgtggtgcacatcaacgccggtatcgccggtctggtcgcctgcctggtgctgggcaagcgcaagggctacccgaccacgccgatggcgccgcacaacctcggctacaccttggtcggggcggccatgctgtggatcggctggttcggtttcaacgccggttccgccgccgccgccaacggcaccgccgggatggccatgctggtgacccagatcgccaccgccgccgcggccctggcctggatgttcgccgagtggatcacccacggcaagccgagcgccctgggcatcgcgtccggcgtggtcgccggtctggtggccatcaccccggccgccggcaccgccggtccgatgggcgcgctggtgatcggcctggcctccggggtgatctgtttcttcgccgccaccagtctcaagcgcgcgctgaaatacgacgattccctcgacgccttcggcgtacatgcggtcggcggtatcgtcggcgcgctgctcaccgggatcttcgcggcgccgtcgctgggcggcttcggcagcgtggaggacatcggcgcgcagttcttcgtgcagttcaagggcgtggccttcaccgtggtctacaccgccgtggtgaccttcgtgatcctcaaggtgctggacctggtcatgggcctgcgggtcaccgaggaagaggaagcggtcggcctcgacctggcgctgcacaacgagcgcggctacaacctgtaa

SEQ ID NO: 7175 - DNA, 2103 bp, Pseudomonas aeruginosa
cccctgcgacgatctgctgcaccagcggctcgctggcattgcggtcgatccggaggtgcatgtctgactcactgttcggttttttcaggcgaacagttaagcacaaatccgaacagctgttacttgttccgtagcgccgccgcgccggatagtcgacgcctcttctcgcgggctagccaatgcccaccgctctgccgcggcaggcccttgaacggagaaacgcatgagcaatacccgtcgccacgccgcatgcctggccttcggcctgtgcctgatcaccttggcggtgaacctccaggcgccgctgtacaccgcctacgcggagctttccggctacggcgcggcagctaccgccagcgctttctccggctatgtgctcggcgtactgccggtgctgctggtactcggcgggttgtccgatcggatcgggcgcaagccgccgatcgtcgtcgcgctgctgctgtcgatggtggccaccctggtgatggcgctctggccgcgcctggaggcgctcggcgtggcgcgcctgttgctcggcgtcggcacggccctggcatcggccaccgggacggcctacatgagcgaactgatcgcgggcggggattctcgcacctcggccaactgggtgaccgccagcacctcgctcggcttcggcctcggcgcggcactgaccagtctgttcctgctgttccgggagagcctggtgcccggcagcttctgggtccagctgggactggcctgcgtggccctggcggcggtggcgggcctgccggacgaggcgccgcgcgggcgcgatacgccgatgctgcggctgccgttctttcccgccggcagcctgccgtacggcctctcgatcctgctggcatgggccactgtgggtctggtcatcgcggtcctgccttcgctgctggcggcccacgggctggcgcgctggtcgggcttctcgaccttcaccgtgatcagctgcggcctgctgttccagccgctggcgcggcggatggcgccggcctcggcgacctgcctggggctggtgatcctgccgccgagctatgccctgctggcctggggcgcgatccacggctcactggctgcggtgctgttcggtgcgctgggcgcgagcagttcctgctacggcttcacctacctgggcgggctgtcggcggtgaatgtcctggccggtgcggaaaagccgcgggccagcgcgggctacttcctgttggcctacctcggcttcagcctgccggtgatcttcaccgggttgatcgcggatcgcttcggtgcgtcgacggcgttgctgcttttcggcgtgtcgctgacgttggctgccgttgcggtggcgttttccatcttgcgcggggtcgggcgcttaaaggccagcgcttcgcgtgcctaggcgctacccgcgaccgggggcccggtccgtcattgcaggcgggcgagcagggccggcagctcggcgaggctgcggatctccgcgctcggctcttcctccccggcccagggcttgccgcttgggttgaaccagatggcacgcatgccggcgcggcgcgctccggcgatgtcgtcgctggggtggtcgccgatgtgtaccgctgccgaggcctcgacgccggcgcgcttcagggcttcgcggaatggcgtcgggtcgggcttgccgacgcccagttcctcggcgcagagggcgaaccggaagtagtcggccaggcccaggcggcgcacgtcggcgttgccgttggtgagcacgccgagggtgaagcggtcggcgaggatctccagggtcgggtggacctcgggaaacagggtgacccggtggcgcgcttcgaggaatacctggaaaccggcctcggccaggctttccgcctccgcctgtggataaccggcgtcgagcagggcatggaacaggatgcgccggcgcagctcgctgagacggtggcgcagcatcggctcgcgatccagcaggcgggtgcggatcgcccacaagtgctcgatgggtaccggacccaggcgcgccgcgttgctcgccagccattcgcggagcagggccctcggcgttgttcatcaccggggcgacgtcccacagggtgtcgtcgaggtcgaaggtga

SEQ ID NO: 7176 - DNA, 675 bp, Pseudomonas aeruginosa
tcagtcgcaggctgctcatgggtcgttgcctccatcggcgttgcccttgcgcttggcgcggggatgggcgcggtcgtagaccgaggccaggtgctggaagtccaggtgggtatagatctgggtcgtggcgatgtcggcgtggccgagcagttcctgcacggcgcgcaggtcgccggacgactccagcagatggctggcgaaggagtgccgcagcatgtgcgggtgcaggtgctggcccagctcgcggacgccggcctggcgcacccgcagctggatcgcccgcggcgtcaggcgcttgccgccgcgaccgatgaacaccgcaccgtcttccggagcggcctgggcgcgcagcggcagccaggcttcgagcgcctggcgcgcggccttgccgaccggcagctcgcggaccttgttgcccttgccgcgcactcgcaccaggccttccttgaggtccagccattcgagatcgaggccgaccagttccgagaggcgcagcccggaggaatagaacagctccagcagggcctggtcgcggcgggcgatgaagtcatcctccacggcaccgtcgagcaattgcagggcgcggtcggcgtcgagggtcctgggcagcttgcgcggactcttcggcgcgctcaggccgttggcagggtcgtgccggcagcgcccttcgcgtag

SEQ ID NO: 7177 - DNA, 603 bp, Pseudomonas aeruginosa
caggtactggtagaggccgcgcgtcgccgagagcagccgtgccaggctgcggctggactggccctgctggtgcaggcgggcgacgaaggtgcgcaggctgcgggtgtcgagggcgttccagtcggagagcccggccttttcggcgagggcgaggatcttcagcaggtcgcggcggtagccgtcgagggtgtgcgcggagacctggcgctcgctgcgcagatgttcgaggaaggcatccaggtcggcgcgcatctcggaccgcccgccgcgctcagcggaccgagcgcagcggcgaggagaaacgcggcagcacgcgggccaggacctcggcgacgtagccgaggaacagggtgccgagggaactcttgtaatgctgcggatcgggactgccgatggcgagcacgccgtgtaggccctggaaactcagggagaccaccgctgcggagccgatctcgtcgcggtcgctctcgccgaagaggaacgccagttcgtgcggacgcagcacgccgcagacggtcttgccgccggagagcaggccgccgatggcctggtgcgcctccgcgctgctcaccgagcggcccaccgagacgctactgtcgctga

SEQ ID NO: 7178 - DNA, 432 bp, Pseudomonas aeruginosa
cgggctggccgggacctgcccactcgatgtgcaggcggccgccggggaggtcgatctgcaccggcgattgcagccagccctggcgaatcccggcaaccgccgcggcgcaggcgccggtgccgcaggcttgggtctcgccgacgccgcgctcccagacgcgcaggcgcgcatggtgcggatcgagcacctggaggaagccgatgttggccttcttcgggaagcgcggatggacttccagttgcggaccgaggctgtgtaccggtgcgctgtcgacgttctcgacgcgcagcacgccatggggattgcccatggataccgcggccagttcgacgcgctggccattcacctctatctcataggacaaggcttcgcgctcggcctggaacggtatctcggccggggccaggcgcggcggacccatgtccaccgtga

SEQ ID NO: 7179 - DNA, 585 bp, Pseudomonas aeruginosa
cagcgacctggacctcgacctggagaacgccggcggcgtgctcaccgtacgcttcgagaacggctcgcagctgatcctcagccgccaggcgccgttgcgccagctgtgggtggctgcgaagtcgggcggcttccacttcgattacgacgaggccagcggcctctggcgccacgatggcagccaggaaccgctgggcgcgctgctcaaccgggcgaccctggagcaggggggcgaggatgtcgagttccccggcctctgaggcttcgccgccggcggtggcctcgccctgccggcgcctgtgctgcctcgacgatgcggacgtttgcgtcggctgcggacgttccctggcggaaatccgcgagtggggcaaggccgacgattcccgccgcttgcagatcaggtcacaggccgctcgacgccagtcgctggcgggccgtctctcctgataggggggatgttgctaattcctgcgactgtgttagtgtccgggaaaaccccgccttcgggcggggtttttgcttttttgcgattcctgcttttcatcgatcaaccgaaccggaccaaggagcacgcctgcgatcatga

SEQ ID NO: 7180 - DNA, 1248 bp, Pseudomonas aeruginosa
ccgaccagggtcagcttgttgaacacagcgcgcgccgccggcggattctcgctttcgatctggttctcgatggcctggatcagtttttcctcggcgaagccgtcttcctggttgtcgtcctgttcgctcatcgggcgttcctcgttctggcgcaaagtaccgcttgtgcggcggcgggaagttgtccaccctgcttggccaacggatggccgcgaaggtagcgatacccgacatgatcacctattacatcctttccggcgaccgcctggagcgacgccagcacgacgatgcccagcgggggttgccgccgggcaccctgtggatcgacctgcatcacccgacccccgaagaggagcgcctgctcgaatcccacctgcaggtgaacatcccgacccgcgaggagatggccgagatcgaggattcgtcgcgcttctacgaggacggcaacgtcctctacatgaccacttcggtggtcggcgggatcaccgagcaccggccgagcacagaggaagtgaccttcgttctcagcgagaaatggctgattaccgtgcgctacgccgacctgcgttcgttccgcgagttcgagaaccgttgcatccgccagctcgacgccaaccgcagcagcacccagttgttcgccctgatgatggacagcctggtggaccgcatcgccgacgtgttggaggccgtacaggggcaactgagcagcatgtcgcgggagatcttcgccgagtccaccgcccagacccgcaagccgaagaccgacctgcagcagatcatcaagcacctcgggcgcagcagctcgctgctgtccaagctcaacgacagcctgctcagcatcaatcggatgaacagctatttccgccagggttgcaacggctggctttccgagccggcgaaggtgctggcgaagaccgtggagcgcgacgtgcgctcgctggacgagtacctggcgaagatgtccaccgagatcaacttcctcctcgacgcgacccttggcctgatcaacatcgagcagaacagcatcatcaaggtgttctccatcgccgccgtactgttcctgccgccgaccctggtgggcaccgtctacggcatgaacttcaaggacatgcccgagctggactggtccatcggctatccgatggcgctggggatgatggtggtatcggcgatccttccgtacctctggttcaagttcaagaactggctctgaggcactcggcaggtgtgcaactttttgctggataa

SEQ ID NO: 7181 - DNA, 2178 bp, Pseudomonas aeruginosa
cgccgtggccaggaaagcccgcgccgggtcgatgccgctttgtttgttgtaggcagcttccgatcgagcctgcgcgcccttgtctcgcccgcgccaggcaggacaatcgaatcggtcgcctgcgccagtgagggacaacggatgttcgcagcagccaaccagacccatttcagcctcgccatcgacggcctcgccctcgacctgcaggtgctctccttcagcggccgcgaagccatcagtcagccgttcgccttcgacctggagctggtcggcgaacgccccgtgccggacctcgaaagcctgctgcacaaacccgccttccttaccctcgggcccgccggcaacggtatccacggcctggtgcgcagcgccggacagggcgactcgggcaagcgcctgacccgctaccgcatcaccctcgtcccgcaactggcctacctcgcccagcgcaccaaccagcgcatcttccagcacctcacggtgccgcagatcgtcggtcgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccgggcggcggtcaagccgcttcggcgtacgcctggaaacccgcaccagccgcgtcacccgccgcgactacgacttcgagaaaccgcgcctgacgctggaaagcgccgcccgcggcgaagcccggccggacctcgaggactacgactatcccggtcgcttcgtcgaccgcgagcgcggcaagcacctggccaggcgtgccctcgaacggcagcgcagcgactaccgcctggccgagggccgcagcgaccaatcgttgctgctcagcggccacttcctgccgctggccgcccatccccaggcgggctggaacgacctctggctgctcaccgaggtgattcacgaggggcggcagccgcaggtgctggaagaaagcatcgtctccgacgtctctgcgagcccggacgacttccggcagggttaccgcaaccgcttccaggccacgccctgggaggcgttctttcgtcccccgccgacgccgccgaagccgcgcatcctcggcacgcagagcgcggtggtgaccggaccgaagggcgaggaaatccattgcgaccgctacggtcgggtgaaggtgcaattccactgggatcgcgagggccaggccgacgacagcagcagttgctggttacgcgttgcctccggctgggcgggaaggaactacggtgccatcgccatcccgcgggtcggcatggaggtgctggtgaccttcctcgaaggcgatcccgaccagccgctggtcaccggctgcctgtttcacagggaacatccggtgccctacgaactgccggggcacaagacccgcagcgtcttcaagagcctcagcagccctggcggcggtggctacaacgagctgcgcatcgaggaccgcaagggccaggagcagatattcgtccatgcccagcgcgactgggacgaaaacatcgagcacgaccagaagatccgcgtcggtcaccaacgccacgacaccgtgcaggcgaacagctacagcgagttcaaggccgaggaacaccgcaccacccacgccgagcgcaaggtggagatccgcgccagcgaccacctcaccgtagccaacgaccagcacctgaagatcgccagcggccagttcgtcgaggccggccaggagatccacctgagcagcggcctgaaggtggtactggaggccggcgccgaactgaccctcaagggcggcggcagcttcctcaagctcgacgccagcggcgtgaccctctccggggccaacgtccgggtcaactccggcggcagcccgggcagcggcagcggcgcggcgccgctgttgccggggccgctgcggcaggccgacagcgacaaggccggcgccctcctcaccccggcccagatcaataccctgaagcgcaacgcgcccttctgcgaagagtgcgagaagtgcaaggacggtgcctgtga

SEQ ID NO: 7182 - DNA, 1308 bp, Pseudomonas aeruginosa
cgagatgctcgcccgccgcggcctgggacgtgtgcaccaccgcgtgctgttcttcatcgcccgctatccgggcctcagcgtgaaggaactgctggccctgctcggcgtgaccaagcaggcgctgaacatcccgctgcgccagttgctggagatgaacttgatcggcagcgccaccgccgacgacgacaagcgcaaacgcctcctcggcctcaccgccgagggcgtgcggttggaaaaggcgctgcgtcgcgagcagtcgcggctgctccaacgctgcttcgaggaagccggcggcgaagcggtctccggctggctggcggtcaatcgcaccctggctcgggcgcatgcaggcagccgcggcgaagcggcgacggaggccgccgactgacgccccatgggcctggcgcatggacgctcgacaagccgaccggctgcccgctagctccgctccaactcccgcgccgcgcgccagcaggccagcgccatggccacggtggctgccagcagcggcagtaccgccagcaccagcaacagcaccgaagccagcatcgcgccgccggcgatgtccagccaggccatgatccgcagcgacggatagaggttttcctgcttgagcagacgcaggcccagccagagggtggtagcgccgatcagcgcaagcagcgcgaagtacaccagcgcctgccagttccagccctgcagcgcatcgtcggtaaccgccagcaggctccagccctcgcccagcagggtcaggagaatcgacaaccataccggccaggccagcgaggggccgcgaaagcgcgactcgaccaggtgcttgagccgcagcagcaggtaggcgccgagcaggctgaggagcaggcccagccagtcggcgtagaccctgaacgcggcgccgtcgccgaatgcctccagcaggctgagcaccatcagcaccacgccgccggctatcgaggccaggcagagccaggcgaggatgcgcagttgcgcgggcgtccagcgccggcggaaagcatccggtatgccctgctcgaccaattcgacacgcggcgtggcgtaggggtttgcatccatggcgaagctcctcggcaaatgccgggaagttaccagctccgccagcttccggcagctgcgactgtatggccaactatgtccgcggctgtaccgggacagcccctggccggctgtttaggctgcgcaaaacagaaaaagatgatcggcactccgcgcctcgcgcaacctgccccgtggctccgcccaccgccgtgcccggtcgtcccgcacactccatggaagtacccggcatga

SEQ ID NO: 7183 - DNA, 792 bp, Pseudomonas aeruginosa
tgcgcgcgctcggcgtcggcaaggtgctggtttcgaagcaccccggcttccaggccggcgactacgtcaacggcgccctcggcgtgcaagactatttcgtccgggaacccaatggtttctacaaggtcgaaccgtccccgcgcgccgctgccacgctatctctcggcgctgggcatgaccggcatgaccgcctacttcgcgttgctcgacgtcggccagccaaataacagggagaccgtggtgatctccggcgccgccggtgcggtgggcagcgttgccgggcagatcgccaggctcaagggctgccgggtggtgggcatcgccggcggcgccgagaaatgtcgcttcctggtcgaagaactgggcttcgacggcgccatcgactacaagaacgaagacctcgccgccggactcaagcgcgaatgcccgaagggtatcgatgtgttcttcgacaacgtcggcggcgaaatcctcgacacagtgctcacccgcatcgccttcaaggcacgcatcgtcctctgcggggcgatcagccagtacaacaacaaggaagcggtgcgcggcccggccaactacctgtcgctgctggtcaatcgggcgcgcatggaaggcatggtggtgatggactatgcccagcgcttcccagaaggcctgaaggagatggccacctggctggcggaaggcaagctgcaatcgcgcgaggacatcgtcgaaggcctggagacctttcccgaaacgctgctcaagctgttcagcggggaaaacttcggcaagttggtgttgaaggtctga

SEQ ID NO: 7184 - DNA, 1767 bp, Pseudomonas aeruginosa
cctgctccactaccgccgcgcctggttccgtccggatgtccaggccgggctgtcggtagcggcaatccagatccccaccgccatcgcttacgcccagatcgccggcttcccgccccaggtaggcctctatgcgtgcatcctgccgatgctgatctacgccctgatcggcagctcgcggcagttgatggtaggccccgacgcggcgaccgcggcgatggtcgccgccgccatcaccccgctggcggcgggcgatccgcagcgcctggtggacctgtcgatgatcgtcgcgatcatggtcgggctgttctccatcgtcgccggcctggcccgcgccgggttcatcgccagcttcctctcgcgaccgatcctggtcggctacctcaacggcatcggcctgagcctgctggtcgggcaactgggcaagctgttcggctacgaggcggcgaccagcggcttcgtcgccggcatcctcgcgctgctggagaacctgctgcacatccattggccgacgctgatcctcggcagcctctcgctcttgctgatggtgctgctgccgcggcgcttcccgcagttgcccggggcgctctgcggcgtcttcctggccagcctcgccgcggcgctgctgggcctggatcgctacggcgtggaactgcttggcgaggtaccggccgggctgccgcaactgagctggccgcagaccagcctggaggaactgaaaagcctgctgcgcgacgccaccggcatcacggtggtcagcttctgcagcgccatgctcaccgcgcgcagcttcgccgcccgtcacggctacagcatcaaccccaaccacgaattcgtcgccctcggcctggccaacatcggcgccggggtctcccagggcttcgccatcagcggcgccgactcacgcaccgcggtgaacgacatggtcggcggcaagacccaactggtcggcgtggtcgccgcgctggtgatcgccgccaccctgttgctgctgaacaagcccctgggctgggtgccgatgccggcgctcggtgcggtcctgttgctggccggctggggcctgatcgacgtgcaggcgctgaagggcttctggaagctcagccgcttcgagttcagcctctgcctgctgaccaccgtcggcgtgctcagcgtcggcgtgctgccgggaatcttcgtcgccgtcagcatcgccgtactgcgcctgctctactacacctatcgcccgagcgacgcggtgctcggctggatgcacggcatcgacggccaggtcgagctggccaagtacccgcaggccaccactcttcccggcctggtgatctaccgcttcgacgcccccctgctgttcttcaacgccgagtacttcaagcagcgggtgcttgccgtggtggacggcagcgagcggccgaatgcggtgctgctcaacgccgaagccatgaccaacctcgacatcagcggcctggccaccctccacgaggtgcaacagatcctcaaggcccagggcgtgcacctgtcgctggcgcgggtgaccgggcagacgctggacctgctgcaacgctcgagcatgctcggcgagatcaagccgccgctggtgttcagctcggtgcgctccggggtcagtgcctatcgctactggctgcgccagcaggaaagactcgccgcccaggccgcggctacaagcggaaatgcctgaccatgccctgtagttcgcggcccagctccgccagttgttcgctggacgaagccgtcgactgcatggcttgggccgactga

SEQ ID NO: 7185 - DNA, 1083 bp, Pseudomonas aeruginosa
tcggccacctcgcggatcgccgtgacgctgcggttgatctcctcggcgaccgcgctctgctgctcggaggccgcggcgatctgctggttcatctgctggatcagcgccaccgccgtggcgatgttgcccagcgccgcctcggtctgcaacgcgtcgtcgacgctctggtccaccaactggtggctgcgctgcatacgctgcaccgcctgctgcgtgccattctgcaaggcaccgatcagggtctcgatctcggccgtggactgttgggtgcgccgcgccagcgcccgcacctcgtcggcgaccacggcgaagcctcgaccctggtcgccggcccgcgccgcctcgatggcggcgttcagcgccagcaggttggtctgctcggccacgctcttgatcacgtccagcacgctgccgatgcgctggctgtcggcgctcagcgcctcgacgctggcggtggccgcgcgcaccgcctcggccagtcgctcgatccgctccagggtctggcgtaccacctcctggccgacgctgaccttgccgtcggcgctttccgccgcccccgcggcttcctcggcgttgtgcgccacttcatggacggtggcggccatctggttcatcgccgtggccacctgttcggtttccgcccgctggctgtcgattcccaggcgggtgcgcgtggtaacgccggacagcgcctcggaagcgccggcaatccgcccgacgccgtcctgcaactggctgacgataccgcgcaggctgccggtcatggcgcgcatcgcggccatcagttggccaacctcgtcgcgccgctcgctgtcgacccgtaccgcaaggtcgccttcggcgatccggtgcgccacacccatcgcctggcgcagcggacggacgatcagcaggctgatgccgaaggccgcgcccaggcccaccagcagcgccagcacggcggcgccgacgatcagcagggagtttgtccgcaggctgtggagcatggcctgctgctgcgcctcccagctacggtcaacacgcgccatcacctgcccggcgcgctcgcccatggcggcgtacatctgccgctcctggagctga

SEQ ID NO: 7186 - DNA, 1254 bp, Pseudomonas aeruginosa
cagtgttgggaaaggcgcccttgtggtactccaccggggcgcgcacatccatcagggggatatcgtcgagaaacagttcgcggtagtgctgggtgttgtcgcgcattacagcacctgtaccgcgagactctgtcgctcgaccagctcgccgatcggcgccagttgcaggccgagttccgccgccacggcgaggaactccgcctcgccttccggagccaccgccaccagcaggccgccgctggtctgcggatcgcaaagcaacagcttctgcacttccggcagtggcgcgatgcgctcgccatagctgtcgaagttgcgcagtgtgccgccaggcacgcagccctgctccaggtaatattcggcactggccaggcgcggtaccgcggcgtactccacgcgtgcggtgagcttgctgccgtcggccatttccaccaggtggccgagcaggccgaaaccggtgacgtcggtcatcgccttgacccccgccaaccggccgaagcgcgcgccgggcctgttcagggtgcacatccagtcacgcgccacgccgacgtcctcggcgcgcagcctggccttcttctcggcagtggtgaggatgccgatgcccagcggcttggtcaggtacagcctgcagccggcctcggcggtgtcgttgcgtttcatgaagcgcttctccaccacgccggtcacggccaggccgaagatcggctcgggggcgtcgatggagtgtccgccggccagcgggatgccggcttcctcgcaaaccttgcggccgccggcgatcacctcgcgggcgacttccgcggccagcacgttgaccggccagccgaggatggcgatggccatcagcgggtcgccgcccatggcgtagatatcgctgatggcgttggtcgcggcgatacggccgaaatcgaaggggtcgtcgacgatcggcatgaagaaatcggtggtggagaccaccccgcgctcctcgtcgagggcgtagacagccgcgtcgtcgcgcgaggcgttgccgacccagagcttcggatcgaggttctgcgcgccgctgccggcgaggatcacctccagtaccttgggcgaaatcttgcagccgcagccggcgccgtggctgtactgggtcaggcggatcgcctcgctcatcggtgtactcccgtggatgtcggaaaagtgcccattctagcaaagccggcgccgccgccagaggaccgatcgccgcgcccggctcagcgcccggcgcgcgactcacggatatag

SEQ ID NO: 7187 - DNA, 2880 bp, Pseudomonas aeruginosa
tacggaggaacttgcggatctgcggttcgtcgtcgatcagcaggatgctgttctgcaattgggtcatggcactcggcacggcaggtgaacacggcgacaggccagcggcggcgtcgcggaaacggcaggaatagcgcgagcgcaggcgccaggcaagtgcgccgggctcattcgtcgccctccagttgcccgaggtccggctgcggatgcagcggcaggtgcaggaccagcgtggtgccgcgaccgtcgaggccttcgccgacgctgatacgcccgccgtgggcgccgatcatgccctggcagatcgccaggcccaggccggtgccctggccaccgcggtcgccacgggcagcggtgtacaacatgtcgaagatcttctcccgctcgggcctcgggaatccccggcccctcgtcgctcaccgcgaaacgcagctcggcggcatcctggctgacctcgatgcgcaaccggccgtggctcggcgagaagcgcgcggcattttccagcacgttgatcagcgcctgttcgatcagcgccgcatgcacgtagagcaacggcaggtcgttggccacgatcgcctgcacccggtacggcgccagcaccgcgcgcaggcggttcagcgcgctgccgacgatgtcgcccggcgccacccagtcgcgcgccagcttcaggccaccgtggccgagacgggtcatgtcgagcaggttctggatatagcggtccagtcgctcggcctcgtcgcgggtgctttccagcagttcgcgacgatccgccggcgggatcgcctcgcccagcgccagcaggctgtcgatggaaccgcgcatggccgtcagcggcgtgcgcaggtcgtgggacaccgaggcgagcaaggcgctgcgcagttgctcggtctcgccgtgcaggcgcgcggcctccaggtcctcggccaggcgcgcacgggccagggcctgggccaggggctggccgagggcagcgagcaggcgccggcgctgcgggctcagcggctggccgtccagcggcgcgacgccgagcagtgccagcggtccctcttccgccgacagcggccaccaccaccagcgtcctccgggcagcgtgccagtaccgaggccggccggctggtcgtgggcccaggcccagtccgcggcgacccgttcctggtcggcgagttgccgctgcacgccggcctcggtcttccactcgccattgacctgaccgagcaggcagacctcgacgtccttccagtcgtcgaactgctgggcggcggcggccagcaccgcctggcggtcggtggcggcggtgagcttgcgcgacagctccagcagcaggctggtttcctcctgggtatcgcgcagcgcctccagctggcgccgctggcgtgccgccaggttgccggtgaggccggccatgaacaggaagaacgccaggctcagcaggtcttcgtggcgatggatggcgaaggaaaaatgcggcgggatgaacaggaagtcataggccaggaacgacgccaccgcgcacagcagtgccggcatcaggctggtgcgcactgccaccagcagcaccgccatcaggaacaccagggagatgttcggcagctccagcaggtgcgccacgatccaggccaggccgctggccagggcggtcgccagcagcgccagcagatagtcgttccacaccaccggatagcgtggccgcggttccgccgggcgcaggtcggcctcgctgtccagggcactgatctccaggccctggccgtcgcgcagcagacgcccggcgagaccaccgccgaaggcccggcggtaccagcggcgccgcgactggccaaccaggaccaggctggcgcggcgctcgcgggcatgttgcaggagggtccgcgccacctcgccggcgcgcagcacgacgatctcgccgccgagccgctcggccagttgctgcgcaccctgcaggcgcatccgcgcgtgctcgccgcgcaagccgccggtatcgacgtgtaccacgctccagggcaggtgccgacgttcggcgacccggcaggcgtggcgcaccaggcgttcggcctgttcgtcaccgtcgatgcccaccagcagccgcccgcgcaacgccggcgcttcctcgccgcgctggcggtagcggtggttgaggtcggcgtcgacccgcgcggcggcggtctgcatcgccagttcacgcagcgcggtgaggttggtctgcgagaagaacgcatcgatcgccgcccgcgcctgttccggcacgtagaccttgccctcgcgcaggcgctccagcagctcgcgcggcggcaggtcgatgaggacgatctcgtaggcctcctgcaacacccagtccggcaccgtctcgcggacctgcacgccggtgatgtcgcggacctggtcgttgaggctctccaggtgctggacgttgaccgttgtgtagacgtcgattcccgccgccagcaactcctggatgtcctgccagcgcttggcgtggcggctgccgggaacgttgctatgggccagttcgtcgaccagggccagcgccggcgggtcggcgaggagaccgtcgaggtccatttcctgcagtttcatccctcgatactcgaggctgcgcagcggctgctgcggcacgcctgcgaggagggactcggtttccgcccgcgagtgggtctcgaccaccccggcgcgcagtttcacgccctggcgcaactgggcctgggcggcctgcagcatggcgaaggtcttgcccacccccggcgccgcgccgagaaagactttcaggcggccgcgcccgtcagcgggcaggtcggccagcagcgcgtcggcgcgtgcggtgtcggtcatggatcggtcgtaatccgttgctctgcgccccgcacggcggacgatcacaagtga

SEQ ID NO: 7188 - DNA, 1425 bp, Pseudomonas aeruginosa
cggggcgagttcatgggcggcgtcctgtgcagaaggctcgccgtgagtatagaagagcagcggcacggcgcccgccctggaggggcgggcggcatggcagttcgttcagagaccgggcaggcgctggcgaatgccgtcgaccagcccgtcgaggctggccgcgtcgtgggtgtctacgcgcttgctctggaccgtctccgccgctgtcagcggctcgcgggtagcctgctgggtgcggatcacgtcgagagtcgcgtcggacgggtccttgccttccgcctggcgttgcgcaagccagccggcgatcaccgcttcgggcgcctggcagtcgaggatcaggaacggcacgccggtttcttccgcgatgtggcaagcggcctggcgctgactctgcttcaggtaggcggcatcgatcaccaccggatagccagcctggaggatcttcgcggccaactggtgaaggtgcgcataggtcgcttcgctggcctggctgctatagatgccggcggcgaactggcccctgtcgtgttccggctgctcgccgaacagacgcttgcgttcgacatccgagcgcaggcgcacggcgcccagagcctccaccagacgcatggccacctggctcttgccgaccgcggagacaccatgggtgaccgccaggaagcgcgagggaatggcgctgtagctttccgccaggttggcgtagttgcggtactggcgcagggtcgcggcgcgctgcacggcatcggtctggtagccgaggctgaacagcgcgaccttggcgcggaccatggcgcggtaggccttgtagaagttcagcagttccagggcctggtagtcgccggtgtgttccagatagaggctgacgaagcgtcgagcgtggcacttcaggccgcgatcttccaggtccatcgcgaggaaggcgaagtcggcgcagacatcggtgaagcggaacggttcgttgaattcgatgcagtcgaacagcactaccctgccgtcgatcagcgcggcgttgcccaggtggatgtcgccgtggcattcgcggatgaagcccttcgccttgcgctcctggagcaccggcagcaggcgttcgaagctgctttccgcccaggcttcgagggcatccagctgttgcaggtcggccttgtccttgagcagcgggcgaacctgctcgaaattctgccgcaccggcgccatgcaggactcggcggtgcccagcgggtgctccagcggcaccttcggagtgttctggtggaagtgcgcgatctgctcggccagttcgtcgatatgctggttggacagttcgccgcggccctggattgccgccagcaggttgtcctgcgggaactggcgcatcttcagcaggtattcgattgcctcgccgtcgccgccgatccgcggcgcctcttcgctgccggtgatcggtag

SEQ ID NO: 7189 - DNA, 801 bp, Pseudomonas aeruginosa
attgatccgagaggacctgacgtgaagaagattttcgtattcgccgcgcttgccggcagtgccgtgctcgcgggctgcgccagcccgcagcacggggcgatcccggtggtggattccggtactccggtgtccaaccaggaaagcggcggtttccgcatcacccgtacccaggtaccgcgtacccagcaaggcgccgccacccagggcattccccagggcggcgactccggtgtggtggtgatggtgccgcagggcgccaattccgcaccgatccagactttcccggcgcagtccggcgccgcgccgatcagcagcgctccgctcggcaccggcacccagtaccaggctccgcccagcagcgcctccacgccaccgctgggtggcagctacaacatgccgcccagcggcgccagtcgttccgcgcccaccggcattccggcctccggctcggccggcagcctggcggccgacgagcagttggacgggccggtcctggcgatgctcacaaccgcccagcaacagcagggcagcggcgacctgaacagcgccgccgccagcctcgagcgagcccagcgcatcgctccgcgcgagccgcaggtgctctatcgcctggcccaggtgcgcctggcccagggcgatgcggcccaggccgagcaggtcgcgcgccgtggcttgagctacgccaatggccggccggccttgcaggccgggctctgggaactgatcgcccaggctcgggagaagcagggagactccgccggcgctgcgctggcccggcagaaggccaaggtcagctcctga

SEQ ID NO: 7190 - DNA, 516 bp, Pseudomonas aeruginosa
tcctcgcggtcggcgcgcgtttcgacgaccgggtcatcaacggcgcggcgaagttctgcccgaacgccaagatcatccacatcgacatcgatccggcgtcgatttccaagaccatcaaggccgacatcccgatcgtcggcccggtggacagcgttctcaccgaaatggtcgcgatcgtcagggaaatcggcgagaccccgaaccaggatgcccaggctgcctggtggaagcagatcgacgagtggcgtggtaaccgtgggttgttcccgtacgacaagggcgacggcagcatcatcaagccgcagaccgtcatcgagacgctctacgaggttacccatggcgatgccttcatcacctccgatgtcggccagcaccagatgttcgcctcgcagtactacaagttcaacaagcccaatcgctggatcaactccggcggtctcggcaccatgggcttcggcttcccggcggcgatgggcatcaagctcaacttcccggacgacgatgtcgcctgcgtga

SEQ ID NO: 7191 - DNA, 2253 bp, Pseudomonas aeruginosa
cttcaatacgccagccctgcaacgcaagcgccgcatccgtgccctcaaggaccgcctgacccgctggtacgtgctggtcggcggcctggccgtgctggcggcgatcaccctgatcttcttctacctggcctacgtcgtgctccccctgttccgcggcgccgacctggagacccgcgaagcgctgactccggcctggatgcagcaggcgcaggtgcccctgctgctcagcatcgaggagcagaaccaggtggccatgcgcgtcggcggccagggcgagattctcttcttcaacgccaagaccggtgtcgaactgaagcgtgtcgctctgccgcttccggcgggcagcgagatccgctcgatcgcccaggaccagccgggcagcccgacggtcgccctgggcctgtccaacggacaggtgctggtgttccagcacacctacaaggtcacctacccggacaacaagaagaccatcaccccggagatcgccttcccctacggcgagaccccgatcggtctcgatccgcagggccgcccgctggagcatgtgagcatcaatgccggcgacgacagcctgctgctggctggctccgtcgacaagcaactgctgctgttgagcatgactcgggaagagaacatgctgaccggcgaaagcacgctggacgaggagcgcatcgaactcccgcagatcgccgaaccggtgaaagccatctacctcgacccgcgcaagcagtggctgtacgtgatcaacggacgtgccaccgccgatgtgttcgacctgcacagccgccagttgaacggtcgctacaagctgctggaagaccccaacgccgaggtcaccgcgagcacccaactgctgggcggcatctcgctgctggtgggcgactccaagggtggcatcgcccagtggttcatggctcgcgataccgacggcgaaccgcgcctgtcgcacgttcgcgacttcaatctggatggcgcgccgatcagcgccatcgctccggaacaacggcgcaagggcttcatcgccctggacgagaagggcaacctcggcgtcttccacagcaccgcgcaccgtaccctgctggtccagccggtcgccgactcttccggggtcatcaccctgtcgccgcgggccaaccgcctgctgctggagcagggtggcaagatccaccgcttcgccctgagcaacccgcacccggaaatctcctggagcgcgctctggggcaaggtctggtacgagagctacgacaagccggcctacgtctggcagtccaccgccgcgaccaccgacttcgaaccgaagctgagcctctcgccgctgaccttcggcacgctcaaggccgccttctacgcgatgatcctggcagctccgctggccatcgcggccgccgtctacaccgcctatttcatggctccggcgatgcgccgcaaggtcaagccggtgatcgagctgatggaggcgctgccgacggtgatcctcggcttcttcgccggcctgttcctggcgccctacgtcgaaggccacctgccgggtgtgttcagcctgctgttgctgacgccgctgggcatccttcttgccggcctgctctggagccgcctgcccgagcgtatccgtctgagcctgccggccggctgggaagccgcgctgctgatcccggtggtgcttgccgtcggcgccttcgccctgtggctgagcccgcacctggagaccaccttcttcggcggcgacatgcgcctctggctgagccacgacctgggcatcacctacgaccagcgcaatgccctgatcgtcgggctggcaatgggcttcgcggtgatcccgaatatcttctcgatcgccgaggacgccatcttcagcgtgccgcgcagcctcacctacggctccctggccctgggcgccacgccctggcagacgctgacccgcgtggtgatcctgaccgccagtccaggcatcttctcggcgctgatgatcggcatgggccgcgccgtcggcgagaccatgatcgtgctgatggcgaccggcaataccccggtgatggaagtgaatatcttcgaggggatgcgcaccctggcggccaacgtcgcggtggagatgcccgagtcggaggtcggcggcagccactaccgcgtgctgttcctctcggcgctggtactgctgacgttcaccttcgtgatgaacaccctggcagagctgatccgtcagcgtctgcgcaagaaatacgcgtcgttgtaagcggcggaggtatagctctgtga

SEQ ID NO: 7192 - DNA, 621 bp, Pseudomonas aeruginosa
acaacctcgccggcgtaccggcgatcgtctacggcgtgttcggcctgggtttcttcgtctacgtgctgggcggttccatcgaccggctgttcttccccgaggccctgccggcgccgaccttcggtacccccggggctgttctgggcctcgctgaccctggcgatcctcgccgtgccggtggtgatcgtcgccaccgaggaaggcctggcgcggattccgcgcgcggtccgcgaaggctccctggcgctcggcgcgaccaaggcggaaacgctgtggaagatcgtcctgccgatggccagcccggcgatgatgaccggcctgatcctcgccgtggcccgtgccgccggcgaagtggcgccgctgatgctggtcggcgtggtgaaactggcaccgtcgctgccggtcgacggtaactatccgtacgtgcatctcgaccagaagatcatgcacctcggtttccatatctacgacgtcggtttccagagccccaacgtcgaggccgcacggccgctggtatacgctacggcgttgctgctggtcgtggtgatcgccctgctgaacttctccgccatcgcgatccgcaatcgcctgcgcgagaagtacaaggccctggaaaactga

SEQ ID NO: 7193 - DNA, 849 bp, Pseudomonas aeruginosa
ttgagggagcttcccatgcaaaacgagaccgccagccacggcatcaacttcgatgcgctcggccgcgaccgccagagcctcgacctggcttccgaaagtgtcgaactggaagtgcccgggctgaacctgttctacggcgccaagcaggcccttttcgacgtccggatgaacattccgaagcagcgcgtgaccgccttcatcggcccgtccggctgcggcaagtcgaccttgctgcgctgcttcaaccggatgaacgacctggtggatggctgccgcgtcgaaggcgagattcgcctcgatggccacaacatcttcgccaagggcgtcgacgtcgccgagctgcgccgtcgcgtcggcatggtgttccagaagcccaacccgttccccaagagcatctacgagaacgtggtctacggcctgcgtatccagggcatcaacaagaagcgcgtacttgacgaggccgtcgagtgggcgctgaagggggctgcgctgtgggaggaggtgaaggatcgcctgcacgagtccgccctcggcctgtccggcggccagcagcagcgcctggtgatcgcccggaccatcgcggtggaaccggaagtgctgctgctcgacgagccgtgctcggcgctggacccgatctccacgctgaagatcgaagagctgatctacgagttgaagtcgaagttcaccatcgtcatcgttacccacaacatgcagcaggccgcgcgggtttccgactatacggcgttcatgtacatgggcaagctgatcgagttcggcgacaccgatacgctgttcaccaacccggcgaagaagcagaccgaagactacatcaccggccgctacggctag

SEQ ID NO: 7194 - DNA, 996 bp, Pseudomonas aeruginosa
cctggagccttgtttcttcgcgcgactgcagcaaggcttggcatcctgccagcaggggaggctatcctaggcggacctgtccaggagaagtcgatgagcaaagtcagcgcgctagtggtggatgacgcccccttcatccgagatctgatgaagaaagggttgcgcgacaacttccccggccttcatatcgaggaggccgtgaacggccgcaaggcccagcaactgctcagtcggcagaacgtcgacctgatcctctgcgattgggagatgccggagatgtccggcctcgaactgctgacctggtgccgtgcccaggaaaacctcaagactaccccgttcatcatggtcaccagtcgcggcgacaaggagaacgtggtccaggcgatccaggccggggtgtcggactacatcggcaagccattctccaatgaccaactggtggccaagatcaagaaggccctgagccgcagcggcaagctggaagccctggcggcccacgcgccgcgccgggagatcgccagcggcatggccaacgattcgctggccgccctgaccggtggtcgcgccgaggtgatcaagcctgccgccagtccggcaaaaccggcccccgcgccgaagccggcttcggctccccaggccagcgcgcgtcccgccggcagcggcaacccgctggggcaggcgcaattgcgcctgccgcagagcagcatgccctgcgtgatcaaggcggtcagtctgaaggaagcgcaactggtggtgaagcgcgccgacccgttgccgcaggtgctggaaagcgcggtgctggacctcgaggaaaacagcgacgtggcgcgcctgaacggctacctgcacgccatcgccgcgctggagccgaagccggatagcgattggctgctgttgaccctgcgtttcgtcgaccgcgacccgcagaagctcgactacctgtcgcgcctgatcgcccgcggaagtacccagaagcactacgttcccggcgcctga

SEQ ID NO: 7195 - DNA, 609 bp, Pseudomonas aeruginosa
ggggctgtgtcgtcgcttgcaagccttggccgtgccgacgccggcggcgcggcactgcgacgaggttcacttcggcgccttgcgctcggcctcggcgacctgcgccggggcgaaatggcaggtgaaggtgctgcccttgccgggcacgctgctgatttccaggcgcgcgcggtggcggatcagcacgtgcttgacgatggccaggccgaggccggtgccgccggtgttggaggcgcggctggagtccaccctgtagaagcgctcggtcaggcgcggcaggtgcttggggtcgacgccgataccggtgtcctgcaccgacaggtgcgcgccctgttcgtcggcccaccagcggatgcggatctcgccttcgtcgggggtgtacttcaccgcgttgaataccaggttggagaaggcgctgcgcagttccgcctcgctgcccttgagctgcacagcgggtgcggcgtccaggctgatgcggtggttgcgcccggcggacagggcctgggcgtcgttacggatgctggcgaggagagcgtccaccgccaccggcttgttgtcgccggggttactcggtggcctccagcttggccagcaggagcaggtcgttga

SEQ ID NO: 7196 - DNA, 219 bp, Pseudomonas aeruginosa
tcgggatgtcgacggtcagttcgtcacgcttcaggcgtcgcgccagttcgatgccggaagtgccggggagcatccagtcgagcaggatcaggtccggcttgcggtcgacgatcaccgcgtgcgcctgctgggtattttccgcctccaggcactcgtagccggccatctccagggccacggcgatcatctcgcgaatcggtgcttcgtcatcaacgatga

SEQ ID NO: 7197 - DNA, 483 bp, Pseudomonas aeruginosa
tttccgccgactgcccgcggcggggctatgctcaacaggttccggtgccgtccctgcgggcggcgaacgctccacctgaagacacaggagagagacgcgatgaacagaatccacctggcgctgggtctggcgctggccctgccggcgttcgccgcgctggcccaggaaacggtggcgccggccaccgagaaggacggcgtgctggtcgatggcaagggcatgacgctctatacctacgacaaggacagcgaagggcaatccgcctgttccgggcagtgcgcgaagaactggccgccgctggcagcggcccagggagcgcaggccagcggcgactggagcctggtcgctcgcgaggacggcacccagcagtgggcctactacggcaagcccctttataccttcatccaggacaagaagcctggcgacaagaacggtgacggcaagatgggcgcctggcacgtcgcccagccggacatggactag

SEQ ID NO: 7198 - DNA, 447 bp, Pseudomonas aeruginosa
cgccggcggccgcggccggctgctgcggcgcgctggatttccacctggatgcgcaggagcgcggccgccagcgcgcgcggcgcaatatcgacgcctggtggccgttgctgcgcgagggtgccgaggccatcgtgcagaccgccagcggctgcggcgccttcgtcaaggactacgcctacctgctgcgcgacgacccacggtacgcggacaaggcgcacgaggtcgccgccgctgcccgcgacctggtggaagtgcttcgcgacgagccgctggagtccctcggcctgcgctgcgaccagcgcctggcgttccactgcccatgcacactgcagcacgcgcaacgactgggcggggccgtggaggcggtgctgcggcgactgggcttccatctcaccgaggtggccgacggtcatctctgctgcgggtccgccggcacctactcgctga

SEQ ID NO: 7199 - DNA, 585 bp, Pseudomonas aeruginosa
cccagccggcgctgtcccggcgtctgcgcgacaaccgcctggacgccctggaaagcggcgcgccggatgtcatcgccacggccaacgtcggttgccaggcccatctcgacggggccggacggaccccggtacgccactggatcgagctgctcgaccaggccttgcccggaggagagtgaaaccatgcacagcaagccggtactcggccgcgaggaggtcgcccgcgtccttggcgcggcccgcgaggaggcacagcgccaaggctgggcggtgagcatcgcggtggtcgacgacggcggccacccgctggcgctggagcgcctcgacggctgcgcgccgatcggtgcctacatcgcgacggaaaaggcccgcagcgccgccctgggacgccgggaaacgaagcgctacgaggacatgatcaacggcggacgcagcgccttcctctcggtgccgctgctgcaggccaccctggagggcggtgtgccgatcctggtggacggacaggtggtcggcgcggtcggggtttccggcgtacgcgccgaagaggatgcccgggtggcgcggatcggagccgaggggttgtga

SEQ ID NO: 7200 - DNA, 1830 bp, Pseudomonas aeruginosa
agactggctgtgccccgactgcggcgtcggcaagctggacttcgagatgatcgaaatcggctgagccccgctcgccggcgaagaaggcggccctggccgccttttttcatgcctggccagcggccgtccaggagttatccttgggacttgggtccggtcattgactgtcctgccgggaacgcccggcagccttgccgttggccggccaccgacgctgagctaggttcgacgaacgaggagggtggctatgcgcaagtggcaatgcgtggtctgcggcttcatctacgacgaagccctgggcctgcccgaagaaggcattccggcgggaacccgttgggaagacatcccggcggactgggtctgcccggattgcggtgtcggcaagatcgatttcgagatgatcgagatcgcctgagcgaaatccacagaagcggcgcccggcgccggcaatcacagaggaacggaaatgagcgagcgtgcgcccctggtaatcatcggaaccggcctggcgggctacaacttggcccgcgagtggcgcaagctggacagcgagacgccgctgctgatgatcaccgccgacgacggccgttcctattccaagccgatgctctccaccggcttctcgaagaacaaggacgccgacggcctggccatggccgaaccgggcgccatggccgagcaactgaacgcacgcatcctgacccatacccgggtcaccggtatcgatcccggccatcagcggatctggatcggcgaggaagaggtgcgttatcgcgacctggtcctggcctggggcgcggagccgatccgggtgccggtcgagggcgatgcccaggacgcgctctacccgatcaacgacctggaagactacgcgcgcttccgccaggcggctgccggcaagcaccgggtactgctgctcggtgcggggctgatcggttgcgaattcgccaacgacctctccagcggcggctaccagctcgacgtggtggcgccttgcgagcaggtcatgccgggcctgctccacccggccgcggcgaaggccgtgcaggcaggcctggaaggcctcggcgtgcgcttccacctggggccggtgctggccagcctgaagaaggccggcgaggggctggaagcgcatctttcggatggcgaggtgattccctgcgacctggtggtctccgccgtcggcctgcgtccgcgcaccgaactggccttcgccgccgggctggcggtcaaccgcgggatcgtcgtcgaccgctcgctgcgcacctcccacgccaacatctacgcgctgggcgactgcgccgaagtggacggcctcaacctgctctatgtgatgccgctgatggcttgcgcacgcgcgctggcgcagaccctcgccggcaaccccagccaggtggcctacggtcccatgccggtgacggtgaagaccccggcctgcccgctggtggtgtcgccaccgccccgcggaatggatggccaatggctagtggaaggctctggaacggacctcaaggtcctgtgccgggataccgctggtcgagtgatcggttatgccctgaccggagcggcggtgaacgaaaaattggccctgaacaaagagttacccggcctcatggcttgaatgccattggttccggccgttatgccgtcgagacttgcggcaaaattgtcggacgatactggcgcagtcctcgggagcatgccatcctccatcgcgtctaccgcagtctagagcctatggttccggtggactgcggtgcctttgagcgctgctgggaagacagcacggacacaaaaacaacaaaccgtcaaagaggcaactatgcgtaa

SEQ ID NO: 7201 - DNA, 1035 bp, Pseudomonas aeruginosa
ctggtgcagttgggccaggccaaggcgctcggggttctcgatgatcatcaggctggcgttgggcacgtcgacgccgacctcgatcaccgtggtcgccaccagcagttgcaacatgccttccttgaaggcctccatcaccacggccttgtccgccggcttcatgcgcccgtggatcaggccgacacgcagttcgcccagcgccgaggaaagctcttcgtaggtggtctcggcggcctggcaggtaagctcctcggactcttcgatcagggtacacacccagtaggcctggcgcccttcgcggcaagccgcgcggactcgctcgatcacctcgatacggcggctgtcggccaccagcacggtattcaccggggtacgcccgggcggcagctcgtcgaggatcgaggtgtcgaggtcggcataggcgctcatcgccagggtccgcgggatcggcgtggcggtcatgatcaactggtgtgggcagagcctgccgtccacgcccttctggcgcagggccaggcgctgctgcacgccgaagcggtgctgttcgtcgatgatcgccagtgcaaggcgcttgaatttcacttcatcctggaacagcgcgtgggtgccgaccaccatcggcgcgccgtcgccgatgcgttccagtgccgccgcgcgggccttgcccttgagcttgccggccagccaggcgacttcgatgtccagcggctggagccacttgctgaagttgaggaaatgctgctcggcgaggatctcggtcggcgccatcagcgccacctggtagccggcctctatggcttgcagggcggcgagggcggcgaccacggtcttgccggcaccgacgtcgccttgcaccaggcgcagcatcggctcgtcctgggccaggtcgtaggcgatctccgcgccgacccggcgttgcgcgccggtcggctggaagccgaggttggcaaggaagcgtttcggcaagcggctggccgccggcaagcgcggcgctgcctgcgagcgcacggcttcgcgcaggcgctgcagggataa

SEQ ID NO: 7202 - DNA, 666 bp, Pseudomonas aeruginosa
ctggtgggtcagcagttcttcgaaggccaggcgcaactgcgcccagtgccggccttcggccagttcctcgatgtcggcatccggcggcggccggtgcaggtagcggatcgcctggtcgagcgggccaagttggtagtcgcgggccagttccgccggcagccagtcgggcaggctgctggggccgagcatggccagggcctgttggctcaactggcgcaggcgctgctgggtgaggccctcggtagtcgggtagatcggcgtcagggtctgctccaccggaatcggctcgtcgccgttcagcgcgcggtattccggatggtagatctccaggcccgaggcacccggccggacttcgccgtagcagcgcaggtgggtgccgcgcttgagaccgtccttctgcgcctggctgaaatggtagaagcgcaggctcagggtgccgctgccgtcctgcaggcgcaccagcaggctgcggcggcgccccatcaccacgtcggcgccggccaccacgccctcgaccaccgcgtcggcccctggccgcagggcgccgatggcggtgacgcgggtacggtcctggtagcgcaggggcaggtggaacaggatatcctgcagggtttccaggcctacccgagcgagcttctccgccagcgcggcgcctacgccctttag

SEQ ID NO: 7203 - DNA, 2397 bp, Pseudomonas aeruginosa
tcgccggctgcggcgatgtcggcgggcgcctcggcgaggcgctgctggccgatggctggcgggtccatggcctgcgtcgctcggtggacgccttgccgcaggggatcctgccggtggctggcgatctgcaggctccggagtgtcccgcgcagtggccgagcgagccgctcgactacctggtgtacagcgccgccgccagtcagcacgacgaggctggctaccgtgccgcctacgtcgacggcctgcgccatgtgctgggctggttgcaggcccgcggccagcggcccaggcgcctgctgttcgtctccagcaccggggtctacgcgcagaccgatggcggctggatcgacgaggagtcgccggcgctttcccaggtctattccggacggatcatgctcgacgccgagcaggtcgcgctggacagcgggataccggctacccgcgtgcgcctggccggcatctacggtccggggcgggagtggctgctcaaccaggtgcgtcaggggtaccgggtggtcagcgagccgcccctgtatgccaaccggatccacgccgacgatgcggccgggctgctggccttcctgttgcgcgccgatgccggcggccaggcgctggaggactgctacatcggtgtcgacgacgcgcccgtggcgatgcacgaggtggtcgactacctgcgccagcgcctgggcgtcagccaatgggccgacgaacattcggtacgccgcgccggcagcaagcgttgcagcaaccgccgcgcccgggcgctcggctgggtgccgcgctatcccagctaccgcgagggctacgcggcggtgctcggggacgcctgatggctgccaaccggttgttggcgcgtccctggctgcctggcgtggagctgttccatgcggacttctccggccaggcgttcggccgccacagccattcggccttcgccatcggctcgatcctccacggcgtcggcggctaccagtgccgcgggcggcgccatgcgctgccggccggcaccctgtcgctgatgaacccggaagagccacataccgggcacgccgaatccgagcggctggtctaccggatgctctatgtcgaggaaacgcgcctgctcggcctgctcggccgcaaacagttgccgcgcggcttcggcgaactgaacccggccgacgacggcagcgtggcggctggcctggcgtggctggccgaggatttccagcgcagcgacgcattggggttggaaagccgcctgctggccttgctcgaacaggtcttcgtgcgtcacggcggcttgcgcccggcggccgcggcgccccgcgacggcggaaccaccgcacgcctgcgcgattacctggaagcgcatgctaccgaggcgctcggtctggaccaactggcgcagttgctgcagcgccacccgcgccacctgatcgaggctttccggcgtgcctacggcgtgccgccgcatacctaccaactgcaatgccgggtgcgccaggccaagcgcctgttgctggaagaacggccgctggcggaactcgcccagcacctcggcttctacgaccaggcgcacttctccacgaccttccggcgtttcaccggggtcactccggggcagttccggcgcagcgccaagacctgagttttttccaatacggcgcccgccgtgctgcacagactggaggccttcgcgtttcgaggggccttcatgttcgccgcgttcgtccttgtcgccagtacccatttcgccgccctgctgtcgccggggccggacttcttcctgttggtgcgcgccgccctgctgcgcggccggcgccaggccgacggggtggccgccggcatcgccctggccaacctcctgagcatgctgctggtgctcggcctgttggccagcgtgccggactcggcgcacagcgccttgcgctggctgcaggcgctcggcggactgtacttcctctggctggcgggccaggcgctgcttgcgcagaggcgactggaaatgccggcgcagcgcgacgtcccgtcccgcggcggctatctgcgcgggctgcgcgacggcctgctggcgagcagcctgaatcccaagctgccgatcttctatgcggggctgttcggcgtgctggcgcgcttcagcctgccgggctgggcgctggccctgtgcctggcgtggatgagcctggcggtgctgtgctgggacatggcgctggtgcgcctgctggacaggccgcgctggcgcggctggttgcaacggcgggtaggtgcgctggaccggctgtgcggcgtcctgctgctggcgctgggcggctggctggtgctggccgccctctgagaggcctcagcgctccagcagccagacgcgcttgccgggcacgtagctgggcatctcgttggcgccggcggtattga

SEQ ID NO: 7204 - DNA, 846 bp, Pseudomonas aeruginosa
agtgttggcttcccggttgagttcctgcatcaggaagtccaggcgccgaccggcggcgccgccggccttgaggacccggcggacctcgccgacgtgggtggcgaggcggtccagctcctcggcgacatcgctcttctgcgccagcaggaccagttcctgctccaggcgctgcggatcgagttcggccttgagttcggcgaagcggtcgaggatcttctgccgctggttggccagcatggtcggcaccagttcgcgcaggttgccgacttccaccagcatcgcgtcgagccgatcgttgagcagcttcgccagctccaggccttcgcgcgagcggccggccttgagttgctccagggcctggccgaaggcttccagggcggcggcgttgagcgcctgcggatcggccgagtcggccaccagtacgccgggccaggccagcacggcgagcggatcgagcggcgccggctggcggatcagggcggctacgccttcggcggcggcgaccagttggcgggcgcgctcctggtcgacctgcaggctcttgccggcggtttcctcggcgaagcgcagggtgcattccaccttgccacgcgacaggccctggcgcagcgcctcgcgcaccgcgccctcgaggtcgcggaaggcgtcgggcaggcgcaggtggggctccaggtaacggtggttgaccgagcgcagctcccagctcagggtgccgtgggtaccagcctgctcgacgcgggcgaaggcggtcatgctgtgcaccatgggtctacctcgatagtcgtgtggggagtgcgttcggcgccggtcgcgcgcggctgccgtgattcgagccgggcattgtaa

SEQ ID NO: 7205 - DNA, 759 bp, Pseudomonas aeruginosa
tggcggccaattccgctttctcagtacaggatatccacgatgaatcgtcccagtggccgtgccgccgaccagctgcgcccgatccgtatcacccgccattacaccaagcacgcagaaggttcggtgctggtcgagttcggcgataccaaggtgatctgcaccgtcagcgcggagtccggggtgccgcgcttcctcaagggccagggccagggttggttgaccgccgagtacggcatgctgccgcgctccaccggcgagcgtaaccagcgcgaggccagccgcggcaagcagggcggtcgtaccctggagatccagcgcctgatcggccgctccctgcgagcggcgctggacctcagcaagctcggcgagaacaccctgtacatcgactgcgacgtgatccaggccgacggcggcacccgcaccgcctcgatcaccggcgccaccgtggcgctgatcgacgccctggcggtgctgaagaagcgtggcgcgctcaagggcaatccgctgaagcagatggtcgccgccgtttccgtgggcatctaccagggcgtgccggtcctcgacctggactacctggaggattccgccgcggaaaccgacctgaacgtagtgatgaccgatgccggcggcttcatcgaggtgcagggaaccgccgaaggcgcgccgttccgtcccgccgagctgaacgccatgctcgaactggcccagcagggcatgcaggagctgttcgaacttcagcgcgccgcgctggccgaatga

SEQ ID NO: 7206 - DNA, 522 bp, Pseudomonas aeruginosa
gttcaccctcaagtccgggcgcaccagcccctatttcttcaatgccggcctgttcgacagcggcctggcgctggcccgcctgggacgcttctacgccgaggcggtgatcgacagcggaatcgacttcgacgtcctgttcggcccggcctacaagggcattcccctggccgccaccaccgcggtggccctcgccgagcagcaccagcgcgacctgccctggtgcttcaaccgcaaggaagccaaggaccacggcgaaggcggcacgctggtcggcgcgccgctgagcggccgggtgctgatcatcgacgacgtgatcaccgccggcaccgcgatccgcgaagtgatgcagatcatcgacgcccagggcgccagggccgcgggcgtgctgatcgcgctgaaccgccaggagcgcggcaagggcgagctgtcggcgatccaggaggtcgagcgcgacttcggcatgccggtggtgagcatcgtttccctggagcaggtgctggaatatcttgccgaagatgctga

SEQ ID NO: 7207 - DNA, 693 bp, Pseudomonas aeruginosa
actgaagaagcatctgccggcggtagaggcctatcgcgcccaatacggtatctgaacctttcacaagggactggcatggtcggacaggatgtaatgcgttgcctgatggccctggggctggtgctccaggggatttccttcggcgcccaggcggcgccgggcggagcggtggagctgtaccgctacgtcaacgacaagggcgtggtggtgctcgaccgccagggtgtgccgccgcagtacatcggcaagggctaccaggtcctcaacgaccagggccgggttatccgcaccgtaccgccggcgccgaccgccgaggaactgcggcagcgcaaggcggcccaagcccaggccagctccgatgcgcagctgctgcgcctgtattccagcctcgaggacgtcgaccgcgctcgcgaacggcgcctggcggaactggacgggctgagcagcgtggcgcgcggcaacctgcagtcgctcaagctgcaacaggccaacctgcaaggccaggcggccaaccaggagcgtgccggacgtccggtggcgcaggcgctggtggaccagttggacgatctcaagcaggaggaaaagcgcctgcagggcgagatcgggcgtttccagaaggcccgcgaagacgcggaaagaacctatgccgccgaccgcgcgcggctctcccagctactcggcgtgagtccctga

SEQ ID NO: 7208 - DNA, 2748 bp, Pseudomonas aeruginosa
gcagcgaggtctcggtgggcaccgccatgctcaagccgagccactacgacctggcgtccctggccgagcatgtgccggccgtctacatcgccacgccggtactcaagagcaccggcgcggtgcagatcccggcgctggacggcaagtcgcggctgttttcctggtgggaccccaaccagcgcggcaccttcttcatctacggcggcaactggatggccgacttcgcctcgcccgagggactgcgcagcaacggcatctacgggcgcagctcgaaccaggaaatggtcaacggctcgccttcggtgggcctggaggtggacgaccaggtcttcctgcggccgacccagagcgagtcggtgctgctgcaattcggcgacctgctggcgctgcgcggcgggcggatcgtcgagcgctggccggtttacgcctaggacgcctggcgcttttcctagtcgatggcggcagcccgcggataccgggctgccgcttcgttccgatgcctcagagttcgaacggaatggtcagcttggcccagagcatgtcgccttcggggcggttctccacgtcgaattccttggcccagcggatctccgcgctggcgtacttgaggaaggtcaggtgcacggccgggccgatggcgaagacctggccgcgtacgccgtcgtcgacttcctcgccgaaaccgaacacccgtacggtctcgccgttctgtttgtcgtcggtggtctgcttgaggtagtagccgttcaggccgaggcgcaggttgtcggtcacccgatagctggcggaatagtcgaaatggaagatctgccccgagcgatagtcggtgtcgtggttttccatgttgaagctgtaggtggccttcagcgacagctcggtgcgttcggtgggcagccaggtgaaggagaacagcggcttgtaggtgtagaagttgttgctggtgttggccagccgctcggcatcgtacttgccggtgggcacggtgacctccacggcggcggccagggtcaggtccttgcccatgtcccagaggatgatcggcgcgaaggtggtgtcacccatgctttcccgttcgtcgctcaggccgaacgcggccacccgttggcggatatagggctgggcgatgtagccgcccaggcgcccgccgaagatccgcagcgggctcaggtagtccaggcgagggatgatcgcatccgagctgatcttcacgtcggacaccttgccgccgaaggagctgatgttcagcttcctggcttcgtagtggttgtagtagacgttgaaggcgaacatgtggtccgggaggttgtcgacgtccagtggcagggtgaagaaaccgtcggttcctggacctatgttgtccacgccgccttcgctggcatgggtgcagcagctgaaggcgagggtgacgcaggcggccaggcgcaggggcctgcgggggtgggtccgattcatgggcgggctcttattattgtttggcgtggctcggggtacggcataggaataagccctatcgacaggccgaggcagggcattgacggtcagcgagggggggatttgcggacaccgtgcaatgctttgttacatctgtgcggaacgctatatgatgggacgctcatcccatgtcgcgatccaccgccagaacaagaacgaagccgagaccggctcaggatttcgcccatgcacaacaatgccgccgatgcgcgctacgaactcgcccaggtatccaccttcctgctgcagacgctggccgaggtggtcgaaggccatggtgtcgatcccgcgcggctgtgccggggcctgggcttcaccgtcgaagacctgcaggaccctacccagcgcatctcctaccgccaggccgtgagcatgatccagcgtgccctccaggccctgccggagcggggactggggctgtgggtcggacaccagaacgtgctcggcacccttggcctgctgggccatgtgctgtcgctgtgccggaccctgcgcgacgcgttcgacatcggcgtgcgctaccagcacagctcgggcgggatcgtcacctccagcgtctaccagcagggcgaaaccttcttcgtcgaggtcgaatgccacctgcccagcagtgaggtgcaggtgttcgccatcgaggagttcttcgccagcctgctggtgtatgggcgtgccctggtcagcccggcgttcgaaccgctgggcatcgaactcatccatgccgctccgccctacgcgggcgagtacctgcgcctgctgggcccccaggtacgcttcggctgcctgcacaaccgcatggcgatcgccagccactggctggacatgcgcctgcccaaccacaacctgccggcgttgcgccaggcgctggccctgctggagcaggaaaacacccaggtgcaccggaaactcgacctggtccaggcggtggaacgggccatcgcccgcgacctcagcctgggcagccagatcgaaaggatttccgccgaactgaacatgagcagccgcaccctgcggcgccggctggccgaacacgggctgaccttcgaggcgttgctggagcaggtgcgacgagggcgggcgatgagcctgctgggcaaccctgggatgtccatcgaacgtatcaccgaggaagtgggataccgtgacatccgcagtttcaggcgcgctttcaagcgttggacgggagtgagcccggcgaccttccgcagcgagggtgcgagcccgctggagcaggccttcgcgctggccgcgcgacgctaa

SEQ ID NO: 7209 - DNA, 2541 bp, Pseudomonas aeruginosa
  unsure (2058): Identity of nucleotide at the above locations are unknown.
ggcagggcctcggaaaggaccttggcaacctgggcggcgtcatcgcgactcagggtcatggggagctccgacatgtcagaagggcacgggcagcgaggaatccactgccttcagttggttacggaagacggtcttgatgcgctccagctcttcctcggtgtccgcttcgaagcgcaggaccagcacgggagtggtgttggaggcgcgtaccaggccccagcctttggggtagtcgacccgcacgccgtcgagggtggtgatgttgccttcgccccattgggcgtcgcgttgcagcgcctcgatgatggcgaacttgctgtcctcggtgacggtgatgttgatttccggggtggaaatgtcgctcgggaaggccgagaacacgtgctcgctgtcacgctgatcctggctgaggatttccagcaggcgggcggcgctgtagatgccatcgtcgaagccgaaccagcgctccttgaagaacacgtggccgctcatctcgccagccagcagggcgccggtttccttcatcttcttcttgatcagcgagtggccggtcttccacatcaccggacggccgccgtagccgctgatcagggcgatcagacggcgggtgcacttgacgtcgaagatgatgtcggcccccgggttgcgcgagaccacgtccttggcgaacagcatcagcagacggtccggatagatgatggtaccggtattggtgaccacgccgacgcgatcgccgtcgccgtcgaaggccaggcccaggtcggcgttctcggccttgaccttggcgatcaggtccttcaggttctccggcttgcccgggtccggatggtggttcgggaagttgccgtcgacctcgcagtacagcgggatcacgctgcagcccagggcctcgatcaactgcggggcgatcaccccggccacgccgttgccgcagtcgaccaccaccttcatcggcttggccatggcgatgtcgtcgcggatctgcttgaagtagcgcggcaggatgtcgacctgctctacgctgccgacgccggatgccaggtcgtttttctcgatgcgctcgcgcagggcctggatctgctcgttggccagggtctcgccggcgaccacgatcttgaagccgttgtagtccggcgggttgtggctgccggtcagcatcaccccggacttgccctcgagcacgttggccgcgtagtacagcaccggggtaggcaccatgcccacgtcgctgacctggcaaccgcagtccaccaggccctggatcagctgcttgaccagctcgggaccggacaggcggccatcgcggccgacagcgacgcacggttcgccgcgggcgaggctttccgagccgatggcgcgaccgatccagtaggcggtctcggcggtgagggtatcgcctaccacgccacggatgtcgtaggcgcggaagatgctggcgggcagcgtcggtgcttttgcagtgctcatgatgggggtttgctccaatcccaggaggtcctggtcttcatcgagaatgtcgatatccagaatgtcggtgttctggaacaacggatctgccaatgccggctcctcgcgaggaggcgctttcgccaccgccaccggcgctgccttggcagggctgggcacgctggtcggctccggcttgcgccgcggctggcgggccaatgcctggatcagcggggcgaagcccggcaggctaggcacagggggtttggcagtgcgttgcccgccgagttcctgaagatactgaccgagggtcaggacatcctgatgcaggcggcgcaacagcgacgaacgggtgaggtaggtgccgaggatgccgccgagcagcgccagcagcgccgcgagtgccagcagcagcggcgaggcctgggtcgaagcgacgctgccgggcgtgtagttcagtttccagttcggattgccgctgtccagcgcttgcgcacccttgcccggcgccggcgtaccgcgttgcagcagcacctgggccggtgcgccggagaactgctggaccagttgtacctggccggcatcgcccggcaagggcggcagggcgcgcancagccgttgcaggtcgaccgccagcagcagcgtgccttgcaggctctggtcggcgccgcgcaccggcgcggcgctgtacagcagccagcgctggccgaccttgtaggcttcggcggcgacgttctggccactttccacccggtgcaggatatccagggcggcgaagctgaccgggccggggctgtcgttgtcctgggcggcctggccgggcgcgttcaggtgggcatcgaccacgccgtcccaggccagcaggatgcgctgggcggcctcgatgcgggtggcgtcgccgctttgcagggcttcgagggcgagggggctggccgcggcggcgcgggtgtcggcggcgagttgctgcaaggcctggcgcaaggcgccggcctggccttcggcccaggccgcgtccaactggcgctgctgcgcctcaccggcgccgccgaagacgccgaaccagagcagggcgccggcggccgccacgcccagtag

SEQ ID NO: 7210 - DNA, 1470 bp, Pseudomonas aeruginosa
atggacaggccggtgggaatcagcagggtctggcccgggccgaggacgctgtcttccttgagcatggcgcgcaggtccaggccggccgagcccggcgtggcgtactgcgggagcgggaagtcggagcccaggcgggggtcgaggatcttggcttggagagagtgcatcagtaactcattgctggttgaggcggtcggcgatgaaggcgatcagctggcgagcgatcttgcccttgctggtctgggcgaaggtgctcggatgcaggtcgcggtcgatcaccgtgatcgcgttctcgtcgctgttgaagccgatcgaggggttggccacgtcgttggcgacgatcaggtcgaggttcttgtccttcagcttgcgtgcagcatagtccagcaggttttcggtttctgcggcgaagcccacgctgaagggacgatcctcgcgctgtgcgagggtggcgagaatgtcgggattgcgcaccagctgcaagagcaagccctcgccgctggtagggtctttcttcagtttgtgcgcggcgaccacttccgggcggtagtcggcgaccgccgcggaggcgatcagcaggtcgcagggcatctccgcctcgcaggcggccagcatgtcgcgggcgctgaccacgtcgacgcgctgcacccggtcgggcgtgggcaggtgcaccgggccggtgaccagggtcacccgtgcgccggcttccaccgccgcctcggcgagggcgaagcccatctttccggaactgtggttggtgatgtagcgcaccgggtcgatgttttcctgggtcgggccggcggtgatcagcacatgcacgccggtcagcgcctggcgctggaagcagtcggcggcgcgctgcgccagttcctcggcttcgagcatgcgtccgaggccgacatcgccgcaggcctggctgcccgctgccggaccgaacaggtggaagccgcgctggcgcagcagctcggcgttggcctgggtcgcggtgtcgcgccacatggcctggttcatcgccggtgccagggcgatttgcgcgtcggtggccagcaccagggtggtcagcaggtcgttggccacgccctggaccaggcgcgccatgaggtcggcggtagccggtgcgatcagcaccagatcggcccagcgggccagttcgatgtggcccatcgcggcttccgccgccgggtccagcagatcggtatgcaccggatggccggacaacgcctggagggtcaggggcgtgatgaactcgcggccgccctgggtcatcaccactcggacttcagcgccctggtcgcgcaggcggcggaccagttcggcgctcttgtaggcggcaatgccgccgcccacgccgaggacgatgcgtttccgatagagccgctgcataggcttgccttaataaggaaatggatgacatgcgcttcggcaaacgcgcctccccaggtcgtctgccgcgcaaaaaggatgggctaa

SEQ ID NO: 7211 - DNA, 573 bp, Pseudomonas aeruginosa
gatagcacagcgtccgcacgggaacagcgggcgggctcgatggggaaagcgaatgagcatccgcgattggcccgaagccgaacggcctcgggagaagcttctggagcagggcgcggcggccctttccgatgccgagctgttggcgatcttcctgcgtacgggagtgaccggttgcagtgcggtcgagctgtcgcggcggctgttgagcgagttcggcgggctgcgtgccctgctcgaggcggacctcgcctcgttctgcggccatctcgggctcggcgtggccaagtatgcgcaattgcaggccgtgctggagatgggccggcgccacctggccgagcgcctgcgtcgcgattcgatactggagagcccgcaggcggtgcgcgactatctcaaggcgcgcctgcgccacgagcagcacgaggtgttcgcctgcctgttcctcgacacgaggcaccgggtcctggcgttcgaggtgctgttccagggcagcatcgatggcgccagcgtctacccgcgccaggtggtcaagcgcaccctggcgcacaacgcggcggcgctgatcctgacccataa

SEQ ID NO: 7212 - DNA, 1608 bp, Pseudomonas aeruginosa
agacggtcgagatccatcgctgggttctcccgggcgtggccttcagcgtttcacggcgacccgagagaaatcctggcgaccgaacggattgacctggtagccctgcacctcctggcgggtaagggcgaaggcggtcgggtgggccaggggcagccagagcgcctgttcgtggatcagtttctgcgcctggtggtacaggccggtgcgttgttcctggctgctggcggccttgccgtcggcaatcagcttgtccaggccggggtcgcaatagcgcgcgaagttgagccccgacttgacgctggcgcagctgaattgcggagtgaggaagttgtccggatcgccgttgtcgcctgcccaacccatgaacagcaggtcgtgttcgccgttcttggcacgacggatcaactcgccccattcgatgacgcggatgttggccttgatcccggcctccgccaggtcggcctggagcagttgggcgccgaggctcgggttggggttgagcaggctgccggacgggcgggtccagatgttcagctcgggaagctgcttgccggccagcagcttgcgcgcctgttcgggggcgtgcgggtaggcgggaatatccctggcatagctccaggtgttcggcggatagatgccggtggcggcactggcgctgccttcgaataccgcctgcaggtagctggtgcggtcgaaggccaggttgatcgcctggcgcaccttgggatcgtccagcggcggatgctgggtattgagggcgacgaaggcggtcatgaaggccggcgtctgctcgaccttcaggctggcgtccttgcgcgcgctctccacgtccagcggcttcggcgacagggcgatctggcattcgccgcggcgcaacttctgcaggcgcacgttggcgtccggggtgatggcgaagatcagcgcgtcgaccgccggcttgccggcgaagtactcggggttggcggcgtagcgcaccaccgcgtccttctggaagcgcttgaacacgaacgggccgctgccgatcggctcggcgttgagcttttccggggttccggccttcatcaactggtcggcgtattccgccgaatagatggaggcgaagcccatgctcagcatcggcaggaaggtcgcgtcggggtggtcgagaacgaacagcacctggtggtcgccgcttttctccacccgcttgatcagctccggcagttgcatcgactgggcgtgcgggaagccgttctgcgccaccttgtgccagggattggccggatcgagcatgcgctggaagctgaacaccacgtcgtcggcgtcgagcgtacggctcggcttgaagtaggcggtgctgtggaagtgcacaccctggcgcaggtcgaagcgatagctcaggccgtcgtcggacaccgaccagcgctcggccagcgagggcaccaccgtccccttgccggcgtcgaactcgaccaggcgattcatcagcacatcggccgaggcgttggtggtggtcatcgagttgtactggaccacgtcgaagccctcggggctggcttcggtgcacacgctcaaggcggcagcggcggcgggctgggcgagcagcaggggggcgaggaacagggataa

SEQ ID NO: 7213 - DNA, 240 bp, Pseudomonas aeruginosa
ggcatgtctagagtctgtcaagtaaccggtaagggtccggttaccgggaataacatttcccacgcacacaacaaaacccgccgccgtttcctgccgaacctgcagcaccaccgtttctgggtcgagtccgagaagcgcttcgtacgtctgcgcgtttccgccaagggcatgcgtatcatcgacaagcgtggcatcgaggccgtcctggctgacctgcgtgcccgcggcgaaaaattctaa

SEQ ID NO: 7214 - DNA, 1590 bp, Pseudomonas aeruginosa
ggtggcggacaccacgggccgcgcgcccgccttgcagaatctgacagcgcgcctgtctcccaggcgcccagaacaccaataagaggacacgttgtcatgaccaccctgacccgcgccgactgggaagcccgcgccaaagacctgaagatcgaaggccgtgccttcgtcaacggcgaatacagcaacgccgcctccggcgagaccttcgattgcctgagcccggtggatggccgcttcctggccaaggtcgccagttgcgacctggccgatgccgagcaggcggtcaaggtcgcccgcaatgccttcgattccggcgcctggtcgcgcctggcgccggccaagcgcaagcagacgatgatccgcttcgccgatctgctgctggagaacgccgaggagctggcactgctggaaaccctggacatgggcaagccgatcagcgactcgctgcacatcgacgtcgccagcgccgccaacagcctgcgctggagcgccgaggcgatcgacaagatctatgacgaagtcgccgccactccccatgccgagctgggcctggtgacccgcgagccggtcggcgtggtcgccgccatcgtgccgtggaacttcccgctgctgatgtcctgctggaaactcggtccggccctggccaccggcaactcggtgatcctcaagccctccgagaagtcgccgctgaccgccatccgcatcgcccagttggccgtcgaggccggcattccgaaaggcgtgttcaacgtgctgccgggctatggccacacggtaggcaaggcgctggcattgcacatggatgtcgacaccctggtgttcaccggttcgaccaagatcgccaagcaactgatggtctatgccggcgagtcgaacatgaagcgcgtctggctggaggccggcggcaagagcccgaacatcgtcttcgccgacgccccggacctgaaggccgccgccgaagccgctgccggcgccatcgccttcaaccagggcgaagtctgcaccgccggttcgcgcctgctggtggagcgctccatcaaggacaagttcctgcccctggtgattgaggccctcaagggctggaagccgggcaacccgctggatccggaaaccaacgtcggcgcgctggtggacacccagcagatgaacaccgtgctgtcctacatcgaggccggtcacaaagacggcgccaagttggtcgccggcggcaagcggaccctggaagaaaccggcggcacctacgtcgagccgaccatcttcgacggcgtgaccaatgcgatgaagatcgcccgcgaggaaatcttcggcccggtgctctcggtgatcgagttcgaggatgccgaggaagccgtgcgcatcgccaacgacacgccctatgggctggcggcggcggtctggaccagcaacctgtccaaggcgcacctgactgccaaggccctgcgcgccggcagcgtctgggtcaaccagtacgacggcggcgacatgaccgctccgttcggcggcttcaagcagtcgggcaacggtcgcgacaagtcgctgcacgccttcgacaagtacaccgagctgaaggcgacctggatcaagctctga

SEQ ID NO: 7215 - DNA, 1686 bp, Pseudomonas aeruginosa
tactggatgtcgaggctgcgctgggctgcgcgaatcagcgccgcgcgggcgacgaaggcatcctcgctggcgcccaggaggtggaagccggactggccggggtggtcgcgtccctggatttcggcctgcctggccagccaggtaccctcggcgggcagtgccgacgacggttgcggcggaggagtgctggcgcagccggagagggccaggagggccagcaggaggaatcggcgaagcaaggacatctcccgtggaaactcgaacgaccggctcatcccggtcgtgcgaattctaggagttttcctcggaagagcgatgccccgcctgattttttcagaatccgccgagcctcggatgggctcagctaccgagtttttccttcagccggtaccaggccatgcccagcgccagcagtggcgagcgcagcagcttgccgccggggaaggtgatgtgcggcaccttggcgaacaggtcgaagccgtcgctctgctggccgccgatggcttcggcgagcaactgcccggcgaggtgcgtggcgttcaccccgtgtccggaataggcctgggcgaagtacacgttgggttgccccggcaggcggccgatctgtggcaggcgattggcgccgatgccgatcatgccgccccattggtagtcgatgcggacgttcgccagttgcgggaatacctccagcatcttcggccgcatgtaggcggcgatgtcgctggggtcgcggccggaataatggcaggcgccaccgaacagcaggcggttgtcggcggagagccggtagtagtcgagggccacgcgctggtcgcacaccgccatgttctgcggcagcagttggcgggccagttgctcgtccagcggttcggtggcgatcacgtagctgccggccggcagtaccttgccgccgagcagcgggttgaggtcgttcatgtaggcgttgcagcccagcaccagggtcttcgcccgcaccttgccggtggcggtatgcacctggacttccgcgccgtagtcgatccgcgtcaccggcgagcgctcgaacaggcggacgcccagcgactgggcagcggcggcttcgccgaggaccaggttgagcggatgcaggtggccggagcccatgtccaccaggccgccgacgtagcgatcggagccgaccacgctgcgcatctccgcggccggcaccaggcgcatctcgtggcgatagccgagggcctggagttcctccatgtcctcgcggaagccctggtagtcgccgggcttgttcgccaggtcgcagtagccccagcgcagatcgcagtcgatggcgtactgctcgacccggcgacggacgatctccaccgcctccaggcccatcagcttgagtgccttcacgccgtcggcgccgatcaccgggaagaactgctcgacgtcatggccgacgccgcggatcaactggccgccattgcgcccactggcgccccagccgatccggtgcgcttccagcaggaccacggagaagccgcgctgggccagttccaacgccgtgttcactcccgagaagccgccgccgacgacgcacacgtcggcctgttcttcgccggccaggggagggcactcgatgcgtcggttgagcgtggcggcgtagtaggagggggcgtgttgggcggtatgcaccggctggtgaacgcgggcgttcatgtgtga

SEQ ID NO: 7216 - DNA, 2667 bp, Pseudomonas aeruginosa
cgtcgaaagcagggaaaaacactggccagggaaaacgccttgatcttgcacgagggccccgccacccttggccgggtcggcaacggacagaggtgggacatgcgtttgcgcagaaggacgacgttgctgctggtatttgcagtgctgttgctgctggcgttcggctacggctggcatgcctggcgcagcctgttgcgcgagcagggtgtcgagcgcctggagtggcaaggcctgggcctgtccgccgaaggcatcgggctgcgacggctggcgctggagcggcgcggcgcggatggcgccagcctgcgactggacgtggaacacgcgctgctgcgctggcccgggctgtcgggttggcgtccgcgtctacccggcctgcgcgtggagcaagtggcgctcgcctggcaaccggctgccgcgagttccgacgacgacgccgctgcgctggactggacgtccctgcgcgagaccctcgcctggctgccggaacagatccacctcgaacgcttccatctcgacctgccttgtcccgccggccgctgcgagcaggacggcggactggacatcggccgcccgtcgggagcgctgtttccgctggctgcgcaactgcgcctgcaacaggaggcgcagcaggcccagctcgacgcccagctcttcgaggagcctactggttggcgcctgcggacgcgcgcgcaactcgaccggcaggcgctgctgacgctggacagccagctcgcgccgtccgatggcgacggcctctggcaggggcgcctggaggcgcccggcctgccggacacccgtggcctggtggtctggctcaatcgctggttgccggaagcccagcgcctgcccgacgcaccgcaagccctgcatctgcaagcggactggacgatccgcctggcgcctggcagcgactggctggagccgcgccgggtgctcgacggcggtggctcggcggcgctgctggtgcaggctccgcaagcctggccgctgcccggtctgggtaatgtacagggcgaactgcaagtccaactggatggagacgagggcgcctggttgccacgccagctgcgcagcgacttgcgcctgagccagttgcacggcgagtggttgcaggcgctgccggccgagttgcggccgagcgcgctgggcttgcgcagcgagccgctggagcgcgatgccgatagcgtcaccgcgttgcgcctggcgttcaccagcgagggcgcgagtacgctgaagctggagacgcggctcgacctgctgggcatctcgccgtgggccgccaggctggtggagggtcgcttgcaggtggacgcgccgcgcctgcaatacctgggctggaaagccgagcgactggtcgcggagattcccctggagggccggctggacgggcagcgcgccaacctctccttcggcaggggcgcgcggttgcaggcggcgtccctggccgagccgtcgacgctgcaccttggccagccccgcctcgacctcgccggggccgctctcgaactggcctaccagccgctggcgctgcatttcgccgggccgctgcaggcgcaggtcggacaactccgccaggccaacctcaaaccgttggcctggaccttcgaggggccgctcgacaccaccctcgagcgcaccagcctgaagggacggctgagcaacggcgcggggttggcggcggacatccagctgcagcgcgacgcgaagacgcccctggcgctctccgccaggctggccgaggtgttcttccgtaccggcaatccgctggccgcgaccctcgccgactggccggggctgctcgaactgggcaatgggcgagcgaccgccgcggccggctggaagctcgatgcggcgggcgcctcgtccctcgacctggacctgaccctgaaaggcctcgacggtatctacgaccgcagcgagctgaaggggctgggcggcagcctggccttgcgcctgcgtggcggtcagttgagcctggacagccccggcctgagcctggccgaggccaatcccggcctgccgctggggccggtgagtttccgcgggcgctatgaggccccgctttccgcgccgggcagcggccgtttgagctggcagacgttgcagagcggcctgttcggcgggcaggcctcggtccccgcggggagcatccgcctgggtcaggccgagcagaagttcgccttgcgtatccagggcatacaactcggcgagattttccgggtctatccggcggagggcctggccggcgaaggcgccctggacggcgagctgccgctgatgctgaaccgctggaagcccagcgtctccggcggccaggtcaaggcccgcgagcccggctacctgcgcttccgctcggcgaagatcgaggcgctggggcgcagcaacccggggatgaagctggtcgccgatgccctcgacgatttccattacgacgtcctgcaaagcagcgtcgattatcatgagaacggcaagctgttgctcggcctgcgcttgcagggcagcaacccggacctggagaaggggcgcccggtcaacctcaacgtcaatctggaggaggatatcccggcactgctgaccagcctgcaactgagcgaccgggtcagtgaaaccattcgccaacgtgtgcaggagcgcatgcagaaacgcaaggcttcggcgccatga

SEQ ID NO: 7217 - DNA, 1152 bp, Pseudomonas aeruginosa
cggtcccgccctggaaaccagcttcgccaacgccggccaggtgtctcccggctacgcttcgccctgggcagccccgggcattcccctgaaggccatgaagtggctgctggaaaagcacgcgccgctggccatcaagctcacctccgatcccagccagtacgcctggatgctgcagatgctgcgcaactgcaccgccgagcgctacgccgtgaacaaggagcgcatggtccgcctgtccgagtacagccgcgattgcctcgacgaactgcgcgccgagaccggcatcgcctacgagggccgcaccctcggcaccacccaactgttccgcacccaggcgcagctggacgccgccggcaaggacatcgccgtgctcgagcgctccggcgtgccctacgaggttctcgaccgcgacggcatcgcccgcgtagagccggctttggccaaggtcgccgacaagctggtcggcgccttgcgcctgcccaacgaccagaccggcgactgccagctgttcaccacccgcctggcggaaatggccaagggcctgggcgtggagttccgcttcggccagaacatcgagcgcctggacttcgccggcgaccgcatcaacggcgtgctggtcaacggcgaattgctcaccgccgaccactacgtgctggccctgggcagctactcgccgcaactgctcaagccgctgggtatcaaggctccggtctatccgctgaagggttattcgctgaccgtgccgatcaccaacccggagatggcgccgacctcgaccatcctcgacgagacctacaaggtggcgatcacccgcttcgaccagcgcatccgcgtcggcggcatggcggaaatcgccggcttcgacctgtcgctgaacccgcgccgccgcgagaccctggaaatgatcaccaccgacctctatcccgagggcggcgacatcagccaggcgaccttctggaccggcctgcgcccggcgaccccggatggcaccccgatcgtcggcgccacccgctaccgcaacctgttcctcaataccggccacggcaccctgggttggaccatggcctgcgggtcgggtcgctacctggccgacctgatggcgaagaagcgcccgcagatcagtaccgaaggcctggatatttcccgctatag

SEQ ID NO: 7218 - DNA, 2415 bp, Pseudomonas aeruginosa
cgatgcgatcgccaagcgcctcgagccggtaggcaaggtctgcgtacaaggcaaggaatgcgaaggcgtcggcgccgtcgcggcagccgccggtggcggcggtgcgcgttccggcgaagacatcgtcggcaagacctgcaacacctgccacggcaccggcctgctgggcgcgccgaaggttggcgacaaggccgagtggggcaagcgcgccaaggagcagggcggcctcgatggcctgctggccaaggcgatttccggtatcaacgccatgccgccgaaaggcacctgcgccgattgctcggacgacgagctgaaagccgcgatcaagcatatgtccggtctgtaacaacgccgggacagtgtcgcgaaaagccgcctcctggcggctttttcgtatccgcggtgcgggtttttcccgctggcggatcgtcccgccggcaaacagggtccaaacttccggctacccattcgccggagggcatcgtcttgagccgaacctgttccatcgacgccgcagtcgatcacttgctgcagaccatcgagggcccgattcgcatgggcctgcccctcgggctgggcaagcccaaccgactggtcaatgcgttgtaccagcgcctgcggaccctgccggagcgccaactgacgctgtataccgcgctttccctggggcgtcccgccgctggcggcgacctgcaacggcgtttcctcgagcctttcgccgaacgggtcttcgccgactacccggagctggattacctgcacgccctacgccgcgacgaactgccggcgaacatccgcgtcgaggagttctacctgcagcccggcagcctgctggacagcgcgccggcgcagcagcactacatcagttgcaactacagccacgtcgcccgcgacatcaatgccaagggcgtcaacgcggtggcccagctggtggcgcggcatcccgagcggccgggcaagctgagcctggcctgcaacccggatatcaccctggacctcctgccgatgctggagaagcgtcgcgccgctggcgagaccatcgtcgccatcggcgtggtccacgatgacctgccctacctgccgggcgacgccgaggtcgaggagtcggtattcgacctgctgatcgacgcgccggcggaaagcagccggctgttctccacgccgaacatgccggtcaacctgcaggatcactgtatcggtctccacgccagcgcgctggtgcgcgacggcggcaccctgcagatcggcatcggctcgatgggcgacgcgctgaccgccgccctgctgctgcgccagcgcgacaacgccacctaccgggcgttgatcgacgagctgggtgtgcgtgcgcgctgggccgagacgatcgagcgcgacggtggcctggagccgttccgccgggggctttacggttgcagcgagatgttcgtgccgggtctgctggcgctggccgaggccggcgtgctgagccgccgggtctaccccgacgaagcgcggcagcgtgccgccgagcgcggtgaggcgccggtggagggcggggtgtggctgcacggcggctttttcctcggtccgttggcgttctaccggcgcctgcgcgagatgtcgctggaagagcgcgccgggatcggcatgaccggcatcggcttcgtcaacaacctgtaccgccaggaagagctgaagcgtctgcagcggcgcgacgcgcgcttcatcaacagcgccttcaccgtgaccctgctcggcgccggggtcgccgaccagttggaggacggccgggtgctcagtggcgtcggcgggcagtacaacttcgtcgcccaggctcacgagctggagggcgcacgttcgatcctgatgctgcgtagctggcgcgaatccggcggggaggtcagttcgaacatcgtctggcagtacgcccacaccaccattccccggcacttgcgtgacatggtggtgaccgagtacgggatcgccgacctgcgcggcaagaatgacgcggaagtgatcgccgcgctgctggccatcgccgactcgcgcttccagcaggcgctggccgagcaggcccagtcggccggcaagctgccgaaggatttcgtcctgcccgaacgctatcgcaacaataccccggagcgcctgcaggccttgcaccaggcccacgcagcggcgctgccggagtttcccctgggcagcgatttcgacgagatcgagcaggacctgctgcgggcgctgggttggctcaagcgcaagctgaagctgagcgagatcctcgaactgggcaaggcgaccctggatgcgccggagccagaagcctacccggcgcatctgcggcgcatggacctggacgatccgcaggggcttcgcgaggaactctaccagcgcttgctgctggccggcctgcgagccagccaggaagagcggggctga

SEQ ID NO: 7219 - DNA, 1692 bp, Pseudomonas aeruginosa
aactttggaggttgcttgtcagcgcccgcagaacccttgcgcctgctccttctggcggatacgccggactgggcgccactgctaggtgaacgcctgagagcgctggggcctgccttttcgctgagcatcgtcaccacctgggagggtgcggccaccctgttcgccgccgagccccgggggctgctcctggccacgccggcctgcctgccgctggggactccctgtccctggccggtgatcctgctgttgcagcaggagccggcgcaggcgccggttggggtggtcgactggctggccgccgaacagctttccgaggacagcctgcgccgctgcctgcgctacgcgcgcgagcgcctgggtttgcaggcgaccctgcaactgctcgccgagcaggatccgctgaccggcatcgccaaccgccagggcttccagaccctgctcgcggcgcgcctcagcgaattcgacgggcgtggcctggtgctcggccacctcgacctggacaacttccgtcacgtcaacgattccctcggccaccagggcggcgaccgcctgatcctgcaggtggtcaaccgcctgcgcggcttcatggagaacggcgacagcctggcgcgcctgggcagcgacgagttcgccctgctgctggacacccgtcgcgatccgcaacgcgccgagcgggtcgccgaacgcatcgtcgaatgcctcggcgagccctactggatcgatggcgagagcctgttgctgggttgcagcctgggactcgcccatgcccgtgccgacgaaggtgccgacccgctgatgtggcatgcgcacatcgccatgcagcaggccaagagccgccagggttgcaccttccatgtcttcgacgaacgcatcaaccgtggcgtgcgcagcctcgccgacctcgaagccgaactgcgccgggcgctgcgtcgcgacgagctggagctgcactaccagccgcgactgtgcctggacagcgggcgcatcgtcggcctggaggcgctggtgcgctggcgccacggcgagcggggcctgctcacgcccagcgagttcgtcccgctggccgaggagagcgggctgatcgtgccgctcggctactgggtcatcgcccgcgccctgcgcgacatgcagtggctcaacgggcgcggcctggagccgttgcacatggcggtgaacctgtcgttccgccagttccaggacagccagttgctgccgaccctgcaacggttgatcgaagagcacggcgtcgacgcgcgctggctcgagttcgaactgaccgagaccgccgtgatgcggcgcagcgaccaggtgctgcagaccatgcaggcgctcggccaactgggcgtgcgcttttcgctggacgacttcggcaccggtttctcgtccttcgtccacctcaatagcctgccgatcaccctgttgaagatcgaccgcagcttcgtcggcggcatggaccagcgggcggaaaacttccaactggtgcgggcgatgatcaacctggcgcacaacctcaacctggaagtggttgccgaaggcgtggagaccctgcgccagcaggagcagttgcgcgatttcggttgcgaccaggtgcagggctactggatcagtccgccgctgccgttggcggaactggcgcgtttcctgggcataggcgagcgctcggcgcaccgcggccagccgctcggcaattga

SEQ ID NO: 7220 - DNA, 597 bp, Pseudomonas aeruginosa
cggatgccgcgcttggtggcatccaggtgcagcgccttgaacaggccccagatcgacgccaggagcacgatggagaatggcagcgcgctggcgatggtcgcggtttgcagcgccttgaggccatcggcgaggagcagggcgatggccaccacgcccatcagcaccgaccagaatatccgctgccagagcggcgagtggtccttgccgctggaggctagcatgtccaccaccagcgcgccggagtcggccgaggtgacgaagaacaccaccaccatcagcaccgccaccagcgagatcacgctgcccagcgggaagtgctcgaggaaggcgaacagcgccaccgaactgtcctggttgaccacttcggccaactgggtgaagccctcctgcaggaccatgtggatggcggtatcgccgaacaccgtcatccacagcagggtgaagccggccgggacgaacagcacgccgcagacgaactcgcggatggtgcggccgcgcgagatacgggcgatgaacaggccgacgaagggcgaccaggacagccaccagccccagtacagcagggtccagccgccgatccaatcggtgggctcgtag

SEQ ID NO: 7221 - DNA, 1302 bp, Pseudomonas aeruginosa
tcgatagctttgctgaattattacgcttcacgtggaggtcattgcccgatactgcagggcttccgccaggtgccggcgttcgatggcatcgatgcgctccaggtcggccagcgtccgggccaccttgagtatgcgatgcaaggcgcgcaaggaaagttccaggcgctctccggcagcctccagccagcggcggtccgcttcggcgagtgcacaattgcggtgcatcgcctggagatcgagatgggcattggcgcagccctggcgggccagttgccgttgccgtgcggcgcccacccgttcgctgacctcggcggtagcggtttcgccgtgtcctggctgcaggctggtgctttcgcggagcacgctgacgtgcaggtcgatgcgatcgagcagcggtccggacagcttgccccggtagcgctggacctgttccggggtgcagcggcagcggccactgggatcgccgaggtagccacagggacagggattcatcgccgccaccagttggaagcgcgccgggaaacgtacccggccgttggcccgggcaatgacgatctcgccgctttccagcggctcgcgcaggacctccaggaccttgcgctcgaactccggcagttcgtcgaggaacagcacgccctggtgcgccagggtgatctcgcccggctgcgggcggctgccgccgccgaccagggccggcgcggaggcggagtggtgcggctggcggaacggtcgctgcggccagtgcctgagggggacgtggctggccaccgaatggatcgccgcgacctccagggcttcgtcctcgtcgagcgccggcagcaggccgggcaggcggctggccaggagggtcttgccggtgcccggcgggccgctgagcaacaggttgtgcgcgccggcggcggccaccagcagggcgcgcttggcggcggcctggccctggacctcggccaggtctggataagggaagggcgcgcggagcaggccgcgggcctggtagggcggcagcggggcctggccggagaggtgtccggcgatctccagcaggtggtccacggcgaacaccgtcagcccgctggccaggctggcctcttcggcattttccttcggtaccaccagaacgcgccttgcgtcgcgcgccgccagcgcggccggcaatacgcctcgcactggccggatcgccccggacagggccagttcgccgaggcactccaggccgtcgagggcggtgccgggcaactggccgctggcggcgaggatgccgagtgcgatggccaggtcgaagcgaccgccgtccttgggtag

SEQ ID NO: 7222 - DNA, 351 bp, Pseudomonas aeruginosa
ctaacctgcttttgcagcaccgagaggttgaccatgagcgaagaagaactggaacaggacgagctggacggcgctgacgaggacgacggcgaagagctggccgcggccgacgacggcgaagcggacagcggcgacggcgacgaggcccccgcccccgggaagaaggcgaaagccgccgtggtggaagaggagctgccctcggtcgaagccaagcagaaagagcgtgacgccctcgccaaggcgatggaggagttcctttcccgcggtggaaaggtgcaggagatcgaacccaacgtggtggccgatccgccgaagaagccggacagcaagtacggcagccgccccatctga

SEQ ID NO: 7223 - DNA, 993 bp, Pseudomonas aeruginosa
aaagattatccacccatcaagttcactccggttccggcggattttcccggacatgccggacacatcggttgtcatcccatggagttcaagacgttccgtcgaaccctgctgctcgcggcagtcctgttcgttcccgccggcaccagcatggctgccaatctgtacgctttcggcggccgcgatatcgccgtgccctcgatccttcccgagggaagtgtcatgtcgcgctacacgttcactcccatgcaactgtgcggcaagcccagctgcgatctcatcggcgtctctctgtacaacaagggaagtgtctgggacccgatcgatggtccggacctgaataccaacgtgccgggcctctcggtgcgcctgctgctggatggcataccggcgagcagccgtttcaagggcactttctcgcaaatcgcggagatccagttgttccgcaactcgacgccgctctccgacggccagttcgcgagcggagccttcaactcgtacttcctcattacctacaaggacgggcttattgcgtctggcacctcctccatcaggttgaccgggagcgtcaccacgatcaatgcgacctgccaggtcgccgaccagaccgtgaagctgcagtcgatcgctgccgcccggctgaacggcgtcggcacctacgcggccgttaccccgttcaatctcgtagtggccggctgtcctcgcgggtacaaccgcgtcggctacagccttcaagcggtggggggcgcggtggccgaaggctcgggtgtgctgccgcgcctggcgggcagcaccgcgaccggcgtatcgatccgggtcaccgacgaggccggcgtgccgctacggatgggactctcgttgccggtgaccgcgtacgacaagaacaccggcggggcgtactggatcccgatgaaagcgtcctatgtgcagaccgccgagaaaatcacgcccggctcggtcctggccgcgatggtgatcctgctcgactaccagtga

SEQ ID NO: 7224 - DNA, 786 bp, Pseudomonas aeruginosa
ggggctgaggctggtgccggtggggttgtggtacatgctgttggtgaaaaggaacttcggcttgtgcgcgcggaggatcgtctccagcgcggcggtgtccgggccgtggcgggtgcgcggcacgccgagcatcttcaccccgtggaacttcagcaggttgaacaggttgtagtagccggggttctccaccaccaccacgtcgcccggcttgagcagcgtgcgtaccaacaggtcgagggcatggctggcgccggtggtggtgaggatctgctccgggtcgacatggatatcgatcagccgcaggcgtttctggatgtgctggcgcagcgccggcaggcccagcggagtgctgtagtcgaacagcccggcgagttcgctgcgggcgacctggcggatcgcgtagctgagttcctcgacttcccgccaactgtccggaatccagccgcagccgagcttgagtttcgtcgagctgccgctgaactggccccatgcgttttccgcgccttcgtgccattcgctgtcgaggtcggtagtggcggcgggcgcctcggcgacgaagaaccccgagccgtgccgcgattccagcatccccagggcgaccaggcggtcgtaggcctcgatcacgctggactggctgagctggttttccctggccaactggcgtatcgacggaatccgcgtgccggcgcggacgcgattgccgcggatccagccgctgacccctgcgacgatctgctgcaccagcggctcgctggcattgcggtcgatccggaggtgcatgtctga

SEQ ID NO: 7225 - DNA, 1182 bp, Pseudomonas aeruginosa
acggagaaacgcatgagcaatacccgtcgccacgccgcatgcctggccttcggcctgtgcctgatcaccttggcggtgaacctccaggcgccgctgtacaccgcctacgcggagctttccggctacggcgcggcagctaccgccagcgctttctccggctatgtgctcggcgtactgccggtgctgctggtactcggcgggttgtccgatcggatcgggcgcaagccgccgatcgtcgtcgcgctgctgctgtcgatggtggccaccctggtgatggcgctctggccgcgcctggaggcgctcggcgtggcgcgcctgttgctcggcgtcggcacggccctggcatcggccaccgggacggcctacatgagcgaactgatcgcgggcggggattctcgcacctcggccaactgggtgaccgccagcacctcgctcggcttcggcctcggcgcggcactgaccagtctgttcctgctgttccgggagagcctggtgcccggcagcttctgggtccagctgggactggcctgcgtggccctggcggcggtggcgggcctgccggacgaggcgccgcgcgggcgcgatacgccgatgctgcggctgccgttctttcccgccggcagcctgccgtacggcctctcgatcctgctggcatgggccactgtgggtctggtcatcgcggtcctgccttcgctgctggcggcccacgggctggcgcgctggtcgggcttctcgaccttcaccgtgatcagctgcggcctgctgttccagccgctggcgcggcggatggcgccggcctcggcgacctgcctggggctggtgatcctgccgccgagctatgccctgctggcctggggcgcgatccacggctcactggctgcggtgctgttcggtgcgctgggcgcgagcagttcctgctacggcttcacctacctgggcgggctgtcggcggtgaatgtcctggccggtgcggaaaagccgcgggccagcgcgggctacttcctgttggcctacctcggcttcagcctgccggtgatcttcaccgggttgatcgcggatcgcttcggtgcgtcgacggcgttgctgcttttcggcgtgtcgctgacgttggctgccgttgcggtggcgttttccatcttgcgcggggtcgggcgcttaaaggccagcgcttcgcgtgcctag

SEQ ID NO: 7226 - DNA, 1563 bp, Pseudomonas aeruginosa
gccctggaaactcagggagaccaccgctgcggagccgatctcgtcgcggtcgctctcgccgaagaggaacgccagttcgtgcggacgcagcacgccgcagacggtcttgccgccggagagcaggccgccgatggcctggtgcgcctccgcgctgctcaccgagcggcccaccgagacgctactgtcgctgaacaggatcaggctcacgtagggcacctggaactcgtggcgcaggctgtcctcgacggtactgaccacgtcttccaggctggtggcgtcgagcaggtcgaggaccaggcggcgggtcttgtcgaacaggcggtcgttctcgcgggccacgtccatcagttgcgagagccggtggcgcatctcgatgttgcgctcgcgcagcaggcgtacctggcgctccaccagcgacactgcgtcgccgggctggtgtgggatgcgcaactcggggatcagctcgtcatgctcgacgaagaactccgggtgctggctcagataggcggccacctgctcggcgtccagcgctgctgtcggttcctggcttttctcggtcataagcgtctcggttctcgcgggcgacggcccttacaggcggacctggccttcatacacgcggacggcaggcccggtcatcataacgggctggccgggacctgcccactcgatgtgcaggcggccgccggggaggtcgatctgcaccggcgattgcagccagccctggcgaatcccggcaaccgccgcggcgcaggcgccggtgccgcaggcttgggtctcgccgacgccgcgctcccagacgcgcaggcgcgcatggtgcggatcgagcacctggaggaagccgatgttggccttcttcgggaagcgcggatggacttccagttgcggaccgaggctgtgtaccggtgcgctgtcgacgttctcgacgcgcagcacgccatggggattgcccatggataccgcggccagttcgacgcgctggccattcacctctatctcataggacaaggcttcgcgctcggcctggaacggtatctcggccggggccaggcgcggcggacccatgtccaccgtgacctggccgtccgggcggatattcagctcgatgatgccgcccttggtttctacgcggatgctcttcttcaccgtcaggcgcttgtcctgaacgaagcgggcgaagcagcgagcgccgttgccgcactgctcgacctcggagccgtcggcgttgaagatccggtagcggaagtcgacgtcggggctgctcggggcttcgacgatcagcaactggtcgaagccgattccggtgttgcggtcgccccagagcttgacgtgcttgggctgcacatgggcgtgctggctgaccaggtcgaggaccatgaagtcgttgcccaggccatgcatcttggtgaagcgcaaaagcatggtctgggcctcactgcggcagcaggctttcgccggcgtagagctcttggacggtctcgcggcgacggacctcgtgggtctgctcgccatccaccagcacctccgcggcgcggccgcgggtgttgtagttcgagctcatga

SEQ ID NO: 7227 - DNA, 426 bp, Pseudomonas aeruginosa
ggtactcgacacgggtcagcagcacgccggcgttggcgacgatggaccggcccggctcgaacaccagggtcaggtcgcggccgtgcaggcgctcgcggatggcgcggatgtagtcgccggccagcggcggctgttcgtcgcggtagcgcaccccgaggccaccaccgaggtccaggtggcgaatgccgatgcctttgccggccaggcggtcgaccagcccgagcaggcgctcgagggcgtcgaggaagggctccagctgggtcaactgcgagccgatgtggcagtcgacgccgatcacctccaggtggtcaagctcggcggcgcgggcgtagaccgcctcggcctcgtcgatggcgatgccgaacttgttctctttcaggccggtggagatataggggtgggtctgggcgtccacgtccgggttga

SEQ ID NO: 7228 - DNA, 354 bp, Pseudomonas aeruginosa
cgaatgccgaggcaatgcatgagtacgatgaatgaagcgcgtttccacgacctggtcgatgcgctccagcagcaggtggaagacgccttcgatgacagcgacctggacctcgacctggagaacgccggcggcgtgctcaccgtacgcttcgagaacggctcgcagctgatcctcagccgccaggcgccgttgcgccagctgtgggtggctgcgaagtcgggcggcttccacttcgattacgacgaggccagcggcctctggcgccacgatggcagccaggaaccgctgggcgcgctgctcaaccgggcgaccctggagcaggggggcgaggatgtcgagttccccggcctctga

SEQ ID NO: 7229 - DNA, 522 bp, Pseudomonas aeruginosa
cgagattccgccgggcgtcgtgaccatgaactccaccgtgcgctgccgcgaggaaagcagcggcaaggagtacaccctgaccctggtctatcccgaagacgtcgccggcgaaggcaaggtctcgatcctcgcgccggtgggcaccgcgctgctgggcctgaccatcggccagaccatcgactggccggcgccgagcggcaagacgctgaagctgaccctgctggaaatcgaataccagccggaagccgccggcgactacgcgcgctgatcggttttcgcccgtcgccattcggcgacgggcttcgcgaccctcagtcgcccccaccgcccccgcatcctccacccccgcaaccgctgccgccgtctccgccgctatcgccgccgctgccgtggcgcgaatcctgtccgtccgaaccgaaggtactgccgctatcgctggcgcagccgctgctgcaaccgatatggctggcgcaatacaccgctgcgccgccgtcttgccgctgcgcgcagttcagggcgtag

SEQ ID NO: 7230 - DNA, 1932 bp, Pseudomonas aeruginosa
ctcgtacagcgcgggcccggccagggcctccggcgcctcgcgaggctcgacatgcactctgccgtcgttggagagcaactcgtagtagcggatatccagcgcggccggcacctgttccgccagcgacagggcgttgcgccggtacagcagcgattgcaggaagcgctgcagcggtgcgagcaggctgcgttcgtcacgcaatgcctggcgctggcgccagagggcgttgcgttcgtcgagcaggctgatctcggcgctgtcgaagtcgcgccggtagaacacctggatgcagtccggccgccccatggacaggatcagcccgaggtcctcgccctccagggcgtgacgatccagcttcagggcgctgtagccatctcgctcgcggcccaggtgctggagcaggctcggcaggtcgggcaggctctcgtggctgaccgcttccggcgacatttccagcaggtggtactgctggcggatctgcagcaggtagcggcttggctggccgccaagcagttgcccgtaggtctcgcggaacagctcttcgacccgcacggcgatggcggcggcccggttgcgacagaagcagcgcaccatcagttcaggcggctgcggcgggcttccgggcttttcgcggacggcgtcgaggaactcggcaaggcactcgggcagcgcctgggggcctgcgtaatggcgcaccgtcagttcgttccagctgttgaggctgagctggtcgagggtcagcaccaggttgtcgcgcaccccggcataaccgagcacgtcggtacgcccggtagccatgtgcaggttcatctggctgtggtggcgcagcgggtcgacaccgacgttgaccagcagcaggacgctcttgagccgacgcggttgcagcaggtcggcgtcgtccacggtcgccagggggacaggcaggaactgccgcaggctgcccaggagattgtccagttcggcatcgccgaggtcgctctggccgggatgcagggacagccgggtggcgctgtcgatgacgccgttgcgatggcaccaggcgagcagctcgaccagcctgaggctgcgtttcagaggcgcgtagtcaggccactggtgagcgcccagggcaccggggaagatcgcccactgcgcctgctcgcggtcgtcgtcggcgggcagctggaccagggtcaggacgtcttcgccgagatccggggcgatccccgggttgatgttctccaccttgcctgccttgcgctcgaaggcggcatacaggcggcggccgagcaggcccaggtcacggctgtcgatgccgctgtcagcgccttgctggcgggcgatctggaacagcaggcggtagctgtaggtcagttcgttgaccaccgtgcgacgctcttccatcacctggcgcatcttccactggctgcggctgtcgagcagggccaagcggcgaggctcccattgccattccgcgacgagccgctccatcgacaggtgctgccagcccttctgcgcctggcgctggcgaccgccgagcttgcgcccgaccttgaggtacaggcagcgccgcacgagttccaggcgttccggcgcctgctgttcccgcaggtagcgttcgagatggcgatagaccaggacgtaggggtccagttcgtcgagatcgagctggccggcgaatacctgctccttgaagcgcagggcgacgcagcggacccgcgggtgctcgctggcgtaggcttcggtgagcagcagcttgagcagcgacttgtagggcgaatcgatggccttggacaactgccagaggccggcgccgatgaactcccgggcggggatgtgcgccaggtggccgaggtcgagcacctcttcggcgcggatgaagcgtttgccgagcagggtccggcagtattcgtcgtagcgccgttcatgggcctgcggcaccagccaccatag

SEQ ID NO: 7231 - DNA, 486 bp, Pseudomonas aeruginosa
aggggtgcgtccgccgagccagatcgcgctacggtagaactcgtcgagcagcaggaagtgctgggtattgccgtcgccgccggactctttccagtctttgcgttcgtcctggccgaaacgggcgacgtcgatcaggaaacagtgcacctcgctgccctggctgcgcgcccagtcctcgatcaacgcgcacttgcggcgcagctcctggcgcgcgccgggctccagttctggggcatggcagacccagaggtcgagatcgctctgttcctcctgggccaggctccccaggctgcccatcaggaacaggccgtggatcggctgctgtgcgggttcttgcctgcgtggcttgtagacaaacgagcgggccaggcgctgggcttcggcgagtacttcgtcgtccgcctcgaaaccgctcaggcccgctggcgtgctggccgacaggtagcccggcagcagcggatggttgatgtggaacagcagcggtag

SEQ ID NO: 7232 - DNA, 1191 bp, Pseudomonas aeruginosa
acacagcgcgcgccgccggcggattctcgctttcgatctggttctcgatggcctggatcagtttttcctcggcgaagccgtcttcctggttgtcgtcctgttcgctcatcgggcgttcctcgttctggcgcaaagtaccgcttgtgcggcggcgggaagttgtccaccctgcttggccaacggatggccgcgaaggtagcgatacccgacatgatcacctattacatcctttccggcgaccgcctggagcgacgccagcacgacgatgcccagcgggggttgccgccgggcaccctgtggatcgacctgcatcacccgacccccgaagaggagcgcctgctcgaatcccacctgcaggtgaacatcccgacccgcgaggagatggccgagatcgaggattcgtcgcgcttctacgaggacggcaacgtcctctacatgaccacttcggtggtcggcgggatcaccgagcaccggccgagcacagaggaagtgaccttcgttctcagcgagaaatggctgattaccgtgcgctacgccgacctgcgttcgttccgcgagttcgagaaccgttgcatccgccagctcgacgccaaccgcagcagcacccagttgttcgccctgatgatggacagcctggtggaccgcatcgccgacgtgttggaggccgtacaggggcaactgagcagcatgtcgcgggagatcttcgccgagtccaccgcccagacccgcaagccgaagaccgacctgcagcagatcatcaagcacctcgggcgcagcagctcgctgctgtccaagctcaacgacagcctgctcagcatcaatcggatgaacagctatttccgccagggttgcaacggctggctttccgagccggcgaaggtgctggcgaagaccgtggagcgcgacgtgcgctcgctggacgagtacctggcgaagatgtccaccgagatcaacttcctcctcgacgcgacccttggcctgatcaacatcgagcagaacagcatcatcaaggtgttctccatcgccgccgtactgttcctgccgccgaccctggtgggcaccgtctacggcatgaacttcaaggacatgcccgagctggactggtccatcggctatccgatggcgctggggatgatggtggtatcggcgatccttccgtacctctggttcaagttcaagaactggctctga

SEQ ID NO: 7233 - DNA, 1785 bp, Pseudomonas aeruginosa
cccgctaccgcatcaccctcgtcccgcaactggcctacctcgcccagcgcaccaaccagcgcatcttccagcacctcacggtgccgcagatcgtcggtcgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccgggcggcggtcaagccgcttcggcgtacgcctggaaacccgcaccagccgcgtcacccgccgcgactacgacttcgagaaaccgcgcctgacgctggaaagcgccgcccgcggcgaagcccggccggacctcgaggactacgactatcccggtcgcttcgtcgaccgcgagcgcggcaagcacctggccaggcgtgccctcgaacggcagcgcagcgactaccgcctggccgagggccgcagcgaccaatcgttgctgctcagcggccacttcctgccgctggccgcccatccccaggcgggctggaacgacctctggctgctcaccgaggtgattcacgaggggcggcagccgcaggtgctggaagaaagcatcgtctccgacgtctctgcgagcccggacgacttccggcagggttaccgcaaccgcttccaggccacgccctgggaggcgttctttcgtcccccgccgacgccgccgaagccgcgcatcctcggcacgcagagcgcggtggtgaccggaccgaagggcgaggaaatccattgcgaccgctacggtcgggtgaaggtgcaattccactgggatcgcgagggccaggccgacgacagcagcagttgctggttacgcgttgcctccggctgggcgggaaggaactacggtgccatcgccatcccgcgggtcggcatggaggtgctggtgaccttcctcgaaggcgatcccgaccagccgctggtcaccggctgcctgtttcacagggaacatccggtgccctacgaactgccggggcacaagacccgcagcgtcttcaagagcctcagcagccctggcggcggtggctacaacgagctgcgcatcgaggaccgcaagggccaggagcagatattcgtccatgcccagcgcgactgggacgaaaacatcgagcacgaccagaagatccgcgtcggtcaccaacgccacgacaccgtgcaggcgaacagctacagcgagttcaaggccgaggaacaccgcaccacccacgccgagcgcaaggtggagatccgcgccagcgaccacctcaccgtagccaacgaccagcacctgaagatcgccagcggccagttcgtcgaggccggccaggagatccacctgagcagcggcctgaaggtggtactggaggccggcgccgaactgaccctcaagggcggcggcagcttcctcaagctcgacgccagcggcgtgaccctctccggggccaacgtccgggtcaactccggcggcagcccgggcagcggcagcggcgcggcgccgctgttgccggggccgctgcggcaggccgacagcgacaaggccggcgccctcctcaccccggcccagatcaataccctgaagcgcaacgcgcccttctgcgaagagtgcgagaagtgcaaggacggtgcctgtgacctctga

SEQ ID NO: 7234 - DNA, 4881 bp, Pseudomonas aeruginosa
gatcggcggcctgttgttgaacaaggacctgaccccatgatctcgtcgttctacgccatgttcatgctgcgcggagtgaacgcgaagcagccggatgccagccagttgatcggcgaattcagctccggggtgctcaaccgctatgaggaatatgcgaacagttggctctggggctgggcactcgacgtccagcagaccatcgccctttccgatgggaacggcaacgagttgaccaggctgaaagccgacaaagacgccaacatcctcgaagacgtcgcctcatgtccggtcaacggtcaactgaaactgctgcatactttcgaatcgaccagtttcgtgcccatcggcaacacgccttacgaaatcactcggataggcagcaggacaccgcagttcaagggcgtactggatgcagatgggatggcgagcataagcggctgcgctcccaatacgctgtaccaggtcaagttctacccagaggtaagcatccaggagatcgacgcgctctaccgctcctacgacgacgtaatcgccaagctgaacgaatggcttctggagcaatggaacggcccgctttccgccgaatggaaaaggctcgcgccggttggcgaccgtaggcggatggagcagataaacgacgcctatctggacggcatgggcaaagcgctggtcaatctctgggatgatgtggtcgagctgttcagcatcctcgcgaacctcgacgagcacgcggcgaaactccttgagttcatcaacgaagcggatttcgaaaagctcaaggctcaggccaaggaactcctcggtaccgccttgctgatcgccagcgacgaaccgcttctgttcatctatgccagcgccatcgtgtgctggacccagttgctgccgcccacgactgccgcggaaatggtcgcggaactctccaccggcctgctcctcgatattctgctcggcatcatcctgaccggcggagccggtctcgccgttcgcctggccgtcaagggctcgaaagcgatcaaggcctccgaaggtgcgatgctgctgcgcaaagccatgcaggtgctgatcgataccagctgtcggcattccctccagttgcacgcggaaaagctgaaacctctggccgtccgcggtgaagtgatggccaacagctccaacaagatcaccgcacagatccagagcaccgcccaaggcatcgcccgcaccgagcccgacaccctgccgctgagccgaggaaagcgcgcgaacacctcgctctccagcagtcatgcgacgcccgatgcctccgcacccggtaggacgcccgccggcaaacccgccgaccaggccgcccagacctgcgtcaaggactgtcccgtttcgatggtcaccggcgaggagctgctgaccctgaccgactgcgagctagacggtccgctgcgtttcgcctggacgcgcctgtaccgcaccagcgcggcggaaatcgacaatggtctgggcttcggctggagccatgccctctcccatcgcctcgatcgcgacggcgacgagttggtatggaccgatcacgagaaccgccggacccgcttcccgatccctgacgcccagcgcccggcgatcaccaaccgactgtcgcgcgccgccatctacctcggcggcgacccatccgaactgatccttgcccaggccggcgaaaagccgcgcttctaccacttccgcaaagacccggacggcgcttacctgatcgccatcagcgacgcctacggcaaccgcctggaactgagtcgcgaccgcctcggccggccgcgccgcctcagccacaaggccgggcgcgcgctactgctgtgctaccagggcaggcacatcgagcgcgtcgagtaccaggtgtaccagcccgccgataacctggaggcctgctggcacaccacccaggtactcgcccgctaccgctgcaacgaacgtggccagttgatcgaagccggaaacgcactctacgaggccgaacgctatcgctacgacgcgcgcaatgtcatcctcgagcgccagttggccggcggcgcctcgttcttctgggaatgggaaggcgaaggcaagcaggcccgcgcggtccatcactgggccagcttcccgcagatggactcgcgctacgtctggaacgaagacggcagcgttaccgcgatcaacgccgacggcagcgaggaagtctatgtccacgacgacaacgcgcgcctggtacgccaggtcgatcccgacggaggcgaaaccctcaggcactacgacgagaagggccaactggtcgccgaacgcgatccgttgggaacgatcaccgagtaccgctacgaccaggccggacgcttggaggcactgctcccggccgaaggcgagccaacctgctatagctacttcgacggcttcgtgcgcagcgtgcgccgcggcgaggcgcagtggaagtacgagcgcaacgctcagggcgacatcacccgccagaccgatcccgaaggcaacgtcacccactacgcctacgaccaccgcggctgcctggtggaaatcacccatgccgacggcagcctgcaccagttgacctggaatccgctcggccagttgatagaagaacagcttccggacggtagcgtgcgccgctatcgctacgacacactgggtagacagatcacccgccaggacgaaagcggcgccatcacccggttccaatgggatgcagcaggccgcctgagccagatcaccctgcccggtggcgccagccgcatgtaccgctacaacgcttacggcaaggtcaccagcgagtgcgacgaacagggccggatgacccgctacgaatatcttgacgacctgcacctggtcagccggcggatcaacccggacggcagtcagctgcgctaccgctacgaaaacgcccggctactgctcagcgagatcgagaacgaacgcggcgaacgctatcgcctcgattaccacggcaacggcctgatcagccaggaaaccggcttcgacggccgccgcaccgcctatcgctacgacctcaaaggccagcttctggagaaaaccgagtacggcgacgacggcagcgaactgcgcaccacctaccagcgcgacagtaccgggcgcctgctggcgaagacactgcccgacggcaatcgggtcgactaccgctacgatacgctcggacgcctggtcgccgtcgacgacggcacctggccgctggcctacgaatacgacctacgggaccgcctggtccgcgagcaccagggctgggccacccttcactacgcctacgacgccctcggccagttgatccactgccgactgcccgacggcaaccgcgtcgactaccgctaccagaccggcggcaccctctcggcaatcgatctcaacggccagtccctgacccggcaccagttcggtagcggtcgcgaacgccagcgccagcagggcgaactgctcagccaataccactacgatgagcagggccgcctgctggcccaccaggtcagtcagcggcagcgccatctctaccagcgccagtaccgctatgacgctagcggcaacctggccgccatcgaggacagccgcaagggcattcgcagcttccactacgacccgctggaccgcctgctcggcgtacgcggtgaaaccccggaaagcttcgtgcacgacccggccggcaacctgctcgcccagggcgggcaattcgacgcgcgacagatggaggttcgcggaaatcgcctgctgacgcagggcgaccggcatttcgactacgacgcccacggcaatctcgttcgcgaacgccgcggcaccgggcagaagctggtcaccgaatacagctacgactgccaacaccgcctgatcggcgtcagcctgccggacgggcgccaggtcgtctaccgctacgacgccttcggccgacgcatcgccaagcaggtcgacgggcgcaataccgagttcctctggctcggcgaacgcctgctcgccgagagcggcgaccggcactaccgcacctatctctacgaacccgacagcttccgcccgctggccctgctcgacggcgaaggcccggaacaggtcgaaccctgctactaccaactcgaccacctcggtaccccgcaggaactgacccgcgccgatggccgcctctgctggtcggcgcgctaccgggcttacggcaatgtgctcaagctggacatcgccgaagtggataacccactgcgcttccagggccagtatttcgacgccgagaccgggctgcactacaaccgccatcgctactacaatccaagcacgggacgctacctgacccccgatccgatcaggctggcaggtgggttgaacagctaccggtacgtgccgaatccgacggggtgggtggacccgttggggctggcctcaaataaaactcgctgtcccgaagcattagacaataatccccgcaaagggattaactccacatccggcagcaaaaagccggcaggaccaatcgtagagctggatgcgcagggaaacgagatttactaccgaacactaagcgagcagcaccttgagatactgaggaacaactttgaagtacctccgacgagtgagaccttcatctccccgctacaatcctactcccaagagtatgatgggaaattagtaagacttacagccagtccaggcaccatgaatgagctgtctaaaattggagtaactgcaaattccggaaccggcctattgcttccagatctccctcccgcccgaaagggctggaaacagaacaatgcactattcaaactcgaagcactaaaaaagccaacgataaatgaaggaggcggcgttatcaacactggccttggggatggaaaagccctagagattttcaacaagaacctaatagacttcgaagtaatagactag

SEQ ID NO: 7235 - DNA, 444 bp, Pseudomonas aeruginosa
agaaacctcatgaaaaccatttacaacttcaaacagcgtatcaaagaagaccccgagtacattcgaaaagcccatgaactcactttgaatacaacgaagcctaaagctggccttaaagggacttatggactactgggctcaaaggaatggtgggacaatcttgaaaacggatcaattccacaaaaagaaatttccggaaccataaagaaagtatatttaacggggcaagacaacaccgaagatttcaacacgatagatatagaaacagaaaacaaaaccctctgcacggagggcacttacacaaacaagaataccgacagaaagcattacgaagcaggaaaaaaaatcaccataaaatatgctttcgacccactaaaaaagcccaagccaaatggagaaatcgactattcaaaaatagttgttgagatatcaatatccgaataa

SEQ ID NO: 7236 - DNA, 690 bp, Pseudomonas aeruginosa
accttgtacatcgtgtcgctcctcggatcggatggccggcgccctcggaggagcgccgatgagggttcaggccgcttcggcggcctgggcgtcgcggacgaccttggccaggcgccgcaggccttcgtgcaggcgctccggggcgacgtggctgaagttcagccgcagacgcccgaggttctgctccggctcggcgaagaaaggttcgccgggcatgaatgcgacatcggcggccagcgccggctggagcagggtgcgggtatccagcggctgcctgagggtcagccagaagaacagcccgccctccgggatattccattcggccagctcaccgaagtgctccagcagcgcctcctgcatggcgtcgcggcggacccggtagaactcgcgcagttcggccaggtgctggcggtaggcctcgctgccgaaccattgcagcgcctgccactgccctacccggttggtatgcaggtcggccgactgtttcagccgcagcaggtgggggaacaggtccggggtggcgatcaggaaaccgacgcgcaggcccggcagcagggtcttcgacaccgtgccggtatagatccagctggacttgcgcaggcggctgaccagcggggttgcgcggccctcgtcgaacaccagttcgcgatagggttcgtcttcgatcagggtcacgccgaattcgtctag

SEQ ID NO: 7237 - DNA, 525 bp, Pseudomonas aeruginosa
gtcaaactgcttgaccgaagctacgatgccgcgcccggaagcgtcaatatgcctgacctgaaaaaccacgccgtccagcagcaggccatgatggaagccttcttcttcgcgtaccaggccttcaccaccaagcctgacgagatgctcgcccgccgcggcctgggacgtgtgcaccaccgcgtgctgttcttcatcgcccgctatccgggcctcagcgtgaaggaactgctggccctgctcggcgtgaccaagcaggcgctgaacatcccgctgcgccagttgctggagatgaacttgatcggcagcgccaccgccgacgacgacaagcgcaaacgcctcctcggcctcaccgccgagggcgtgcggttggaaaaggcgctgcgtcgcgagcagtcgcggctgctccaacgctgcttcgaggaagccggcggcgaagcggtctccggctggctggcggtcaatcgcaccctggctcgggcgcatgcaggcagccgcggcgaagcggcgacggaggccgccgactga

SEQ ID NO: 7238 - DNA, 1341 bp, Pseudomonas aeruginosa
tcggcactccgcgcctcgcgcaacctgccccgtggctccgcccaccgccgtgcccggtcgtcccgcacactccatggaagtacccggcatgaccgaaaccacccagccccagcctcgtctgcgtccgttcgccgactcctctcccgccgccgtggtggccggcttcgtcgccatgctcaccggctacaccagctcgctggtactgatgttacaggccgggcagaacgccggtctcagcagcgcgcagatttcctggtggatctgggccctgtcgatcggcatgggcctggcgaccatcggcctgaccctgcgctaccgggtgccgatcgtgatcgcctggtccacccccggcgcggcgctgctgatcagcagcctgcccggagtgccgtacagcgaggcgatcggcgccttcatcgtctgcgccctcctgatcaccctgtgcggcgtcaccggcagcttcgaacgcctgatgcgccaggttccctcctcgctggcctcggcgctgctggccggggtgctgttccgcatcggcatcgagatctgcaacgccgccgagcaacagaccctgctggtgctggcgatgttcttcagctatctgctgtgcaaacgcttctcgccgcgctatgcggtgttcgctgcgctactggtgggggtgctgctggccgggatactgggccaactggacttcagcaggttccgcctggaactggcggtaccggagtggaccacgccgagcttctccctggccgccaccatcagcatcggcatcccgctgttcatcgtcgccatggcttcgcagaacatgcccggcatcgccgtgctgcacgccgacggctaccaggtgccagcctcgccgctgatctcgagtaccggcatcgcctcgatcctgctggcaccgttcggctcccacgggatcaacctggcggcgatcagcgcggcgatctgcaccggtccctcggcccacgaggacccgcacaagcgctataccgcggcgctctggtgcggcttcttcaactgcgtcgcaggaaccttcggcgccaccctggcagcgttgttcgcggcgttccccaaggcactggtactgtccatcgccgccatcgccctgctcggctcgatcatgaacggcctggccaactcgatggccgacgagcgccagcgcgaggccgcgctggtgaccttcatggtaaccgcctccggcttcaccctgctgtccatcggctcggcgttctggggcctggtggccggcctgctgactcagttcgtgctcaactggcggcgcggctgaccgacctcagtccggcgccgtcacgggcgccggcgtggcctggtggccacggctga

SEQ ID NO: 7239 - DNA, 942 bp, Pseudomonas aeruginosa
tcccccggcagtggcctggcgcgccaaaccgcgtgccgacctgtaacagaatgcgaatgccccgcgccggggcatcccggttgtatcgccgcccgctcagatcgccgtcgccccgccgtccaccggcaaggcgataccggtggtgaagcccgcgtggtcgctgcacaggtagagcaccgcggcggcgatttcctcgacccgcccgacccgacccagcggatgcatcgcggcggcgaactcggccttgcgcggatcggcctcgtaggcgcggcggaacatgtcggtgtcgatcaccgccggacacacggcgttgacgcggatgcccttcttcgcgtactcgatcgccgccgatttggtcaggccgatcaccgcgtgcttggaagcagcgtagatgctcatcttcggcgccgcgccgagcccggcgaccgaggcggtgttgacgatcgcgccaccgccctgggccagcatcagcgggatctggtgcttcatgcacaaccagacgcccttcacgttgacagccatgatggcgtcgaactcggcttcgttgccgtcggccagcttgccctgctcgatctcgataccggcgttgttgaaggcgtagtcgagacggccgtaggccgccgcgcaaccctctaccagcgccttgacctcggcgtcgcgggtgacgtcgcagcgaatgaagagggcttcgccacctgcctggcggatcgcttcgaccgtgccctcgccgccggcgctgtccaggtcggcgaccaccaccttgaccccggcggcggcgaaggccagcgcggtagcgcggccgatgcccgccgcaccgccagtgaccagtgcgacctggccggaaagaagtttgctcatctgctgctcctcggaaaatcgccttccgccaaccgcgacggaaccgggccgcgccagtctagccagggccggcgcaaggcatag

SEQ ID NO: 7240 - DNA, 378 bp, Pseudomonas aeruginosa
tctccggcgccgccggtgcggtgggcagcgttgccgggcagatcgccaggctcaagggctgccgggtggtgggcatcgccggcggcgccgagaaatgtcgcttcctggtcgaagaactgggcttcgacggcgccatcgactacaagaacgaagacctcgccgccggactcaagcgcgaatgcccgaagggtatcgatgtgttcttcgacaacgtcggcggcgaaatcctcgacacagtgctcacccgcatcgccttcaaggcacgcatcgtcctctgcggggcgatcagccagtacaacaacaaggaagcggtgcgcggcccggccaactacctgtcgctgctggtcaatcgggcgcgcatggaaggcatggtggtga

SEQ ID NO: 7241 - DNA, 1791 bp, Pseudomonas aeruginosa
ttcccggcaatcctgcagcctgtccttcgggctaagctgcggcatccgcgcctgcaaggaatcagccgcatgccactcgcccgctgggtacccggactcgatagcctgctccactaccgccgcgcctggttccgtccggatgtccaggccgggctgtcggtagcggcaatccagatccccaccgccatcgcttacgcccagatcgccggcttcccgccccaggtaggcctctatgcgtgcatcctgccgatgctgatctacgccctgatcggcagctcgcggcagttgatggtaggccccgacgcggcgaccgcggcgatggtcgccgccgccatcaccccgctggcggcgggcgatccgcagcgcctggtggacctgtcgatgatcgtcgcgatcatggtcgggctgttctccatcgtcgccggcctggcccgcgccgggttcatcgccagcttcctctcgcgaccgatcctggtcggctacctcaacggcatcggcctgagcctgctggtcgggcaactgggcaagctgttcggctacgaggcggcgaccagcggcttcgtcgccggcatcctcgcgctgctggagaacctgctgcacatccattggccgacgctgatcctcggcagcctctcgctcttgctgatggtgctgctgccgcggcgcttcccgcagttgcccggggcgctctgcggcgtcttcctggccagcctcgccgcggcgctgctgggcctggatcgctacggcgtggaactgcttggcgaggtaccggccgggctgccgcaactgagctggccgcagaccagcctggaggaactgaaaagcctgctgcgcgacgccaccggcatcacggtggtcagcttctgcagcgccatgctcaccgcgcgcagcttcgccgcccgtcacggctacagcatcaaccccaaccacgaattcgtcgccctcggcctggccaacatcggcgccggggtctcccagggcttcgccatcagcggcgccgactcacgcaccgcggtgaacgacatggtcggcggcaagacccaactggtcggcgtggtcgccgcgctggtgatcgccgccaccctgttgctgctgaacaagcccctgggctgggtgccgatgccggcgctcggtgcggtcctgttgctggccggctggggcctgatcgacgtgcaggcgctgaagggcttctggaagctcagccgcttcgagttcagcctctgcctgctgaccaccgtcggcgtgctcagcgtcggcgtgctgccgggaatcttcgtcgccgtcagcatcgccgtactgcgcctgctctactacacctatcgcccgagcgacgcggtgctcggctggatgcacggcatcgacggccaggtcgagctggccaagtacccgcaggccaccactcttcccggcctggtgatctaccgcttcgacgcccccctgctgttcttcaacgccgagtacttcaagcagcgggtgcttgccgtggtggacggcagcgagcggccgaatgcggtgctgctcaacgccgaagccatgaccaacctcgacatcagcggcctggccaccctccacgaggtgcaacagatcctcaaggcccagggcgtgcacctgtcgctggcgcgggtgaccgggcagacgctggacctgctgcaacgctcgagcatgctcggcgagatcaagccgccgctggtgttcagctcggtgcgctccggggtcagtgcctatcgctactggctgcgccagcaggaaagactcgccgcccaggccgcggctacaagcggaaatgcctga

SEQ ID NO: 7242 - DNA, 1665 bp, Pseudomonas aeruginosa
acttgccctaccctcacccaggagccctgccatgaactatcgaggaagctgccactgcggaaccatcgcctacgaagtcgaaggcgacctcgaccaggtgatccagtgcaactgttcactgtgcagccggcgcggctggctgctgtggttcgtcccgcgcgaccgtctggcgctgaagacgccggccagcgcgatgcacacctacaccttcaacacccatcgcctgcagcatcacttctgccccacctgcggctgcgcgccgttcagcgaaggcataggcccggacggccaggcgatggccgcggtcaacgcgcgctgcctggaggacatcgacgccagcgcgctcccggtacagcactacgatggccgcaacgcctgacgctggcgcaggtagccgatcacctcggcctggttgccgcggaactccacgcggtcttccttgctctgccgctggaaggcgtacatcgggtcgtagtactccttgagcagcccctcgatccagccacgatgggtatccaccgagccgtcgcggccctgctcttccagcgcctgcacgaggatcgccgccagccgctggtagcgctcgccgccgaggcgcttgacgatgccggcgaggctcttctgcaggtaggcggagaaggcggcgaagccctcctccacgcacaccacgcgctcgaactcgctgcgcaggtcgatcacgtagtccctgaggatacgctcgacacgctgctcgaaggcatcctccagccagaccagcgggtagccctgcatgccctggtacagctccagcggcaaggagcagctgccgacgatccgcccctcgtcctcgaggacgaactggccgacgccacgatgacgcttcttcaggatgtcgatggccaggcggttctcgaagtcgatctgcgccggctgcggcgtggctcgccggccaaagctggagccgcgatggttggcgtggccttcgagatcgaggctgttgtccagcgccgcgatcacctcggtcttgccgcaaccggtgaggccgccgaccagcacgaaatcgcactcgtcgaccgccgcgcgggtggtttcgaaaaggaagttgcgcaacgccttgtagccgccgatcacccgtgggtagtcgatgccggcgtcctgcttcagccactgctggacgatctgcgagcgcaggccgccgcggaagcaatacaggtagccgttcgggttggcttcggcgaaggctttccaggccgccagccgttcggccttgagcgccccgcagaccagttcgtggccaagggcgatggcggcctgctggccgtgctgcttgtagctggtgccgaccttctgccgctcgatgtcgttcatcagcggccggttgacagtgttgggaaaggcgcccttgtggtactccaccggggcgcgcacatccatcagggggatatcgtcgagaaacagttcgcggtagtgctgggtgttgtcgcgcattacagcacctgtaccgcgagactctgtcgctcgaccagctcgccgatcggcgccagttgcaggccgagttccgccgccacggcgaggaactccgcctcgccttccggagccaccgccaccagcaggccgccgctggtctgcggatcgcaaagcaacagcttctgcacttccggcagtggcgcgatgcgctcgccatag

SEQ ID NO: 7243 - DNA, 513 bp, Pseudomonas aeruginosa
tattcggcactggccaggcgcggtaccgcggcgtactccacgcgtgcggtgagcttgctgccgtcggccatttccaccaggtggccgagcaggccgaaaccggtgacgtcggtcatcgccttgacccccgccaaccggccgaagcgcgcgccgggcctgttcagggtgcacatccagtcacgcgccacgccgacgtcctcggcgcgcagcctggccttcttctcggcagtggtgaggatgccgatgcccagcggcttggtcaggtacagcctgcagccggcctcggcggtgtcgttgcgtttcatgaagcgcttctccaccacgccggtcacggccaggccgaagatcggctcgggggcgtcgatggagtgtccgccggccagcgggatgccggcttcctcgcaaaccttgcggccgccggcgatcacctcgcgggcgacttccgcggccagcacgttgaccggccagccgaggatggcgatggccatcagcgggtcgccgcccatggcgtag

SEQ ID NO: 7244 - DNA, 1137 bp, Pseudomonas aeruginosa
ggcaggcgaagacacgggaaacgggaatcgggcgggacatggcgaccatcctggcgagtggaccggcgcatccggcgccggcaagcggtagccgcagaacatagcgcagcggcgccgggaattcgagcgccaccacgacgggcggcggtttcagaagatcgaccagccgatccgctcgctgagtttctccagcgcggcgatacccgccagcgaattgcccgcggcgttcagctccggcgaccagacgcagaccgtgaagcgccccggcaccaccgcgatgatgccgccgccgacgccgctcttgcccggcaggccgacccggtaggcaaagttgccggcctcgtcgtagagcccgctggtggccatgatcgcgttgacctgcttggtctgccgctcgttgagcacctgctcgccgctgtgcttgcagaagcccttgtcggcgaggaagcagaacgcccgcgccaggtcgacgcagctcatgcgcaacgcgcaatgatggaaatagctgagcagcaccgcctcgacgtcgttgtggaagttgccgaacgatttcatcaggtaggccgccgccgcgttgcgcgagcggtgctggtactccgagcgcgccaccaccgagtccgacaccacttccgggttgccgcacaggcgccggacgaaatcgcgcatcgattgcgccggcgcggcgaaacgcgactggttgatgtcgcagatcaccagggcgccggcattgatgaacggattgcgcggcttgccgcgctcgaactccagctgcaccagggagttgaaaggctggccggagggctcgtggccgaggcgttgccagatgtcctcgccggaatgctggatcgcctggaccaggctgaacaccttggaaatgctctggatggaaaacggccgcagggcgtcgccggcatggaacagctcgccgtcgcggctgtacacggcgatccccagttggttcggctcgacgccggcgagcgcgggaatgtagtcggcgaccttgccgcgcccgatcagcgggcggacttcatcgagaatctcgttcaacagttgctgcatgatgaccttcgtcgtgacaccggggcaccgacccggcgcatccgggccagcgcgaatgcgcggcatcataggcgatga

SEQ ID NO: 7245 - DNA, 756 bp, Pseudomonas aeruginosa
acgcgcgggaggcatgcccctcgcgcagaattgcgctgcgcgtcagctgtcgcgcaggcgatagccgacgcccgcctcggtcaccaggaagcgcgggctggccggatcgtcgccgagtttctgccgcaggtggccgaccacgacccgcaggtaatgggtgtcttcgacgtgggtcgggccccagatatccttgagcagttgctgctgggtcactacccgtccgagatggcgtgccagcgcggcgagcaccgcgtactccttacgtgtcagcgccacttccgcaccctccagggtgactcggcgataggcgaagtccacctgcaacgggccgaccgccaccgacgcctccgggctttcgccctgcgccgcctggcgcagcaggacgcgcacgcgggcgaggaactcctggatgccgaacggcttggtcacgtagtcgttggcgccgccgtccagggccagtaccttctcgccctcgctggcgcgcaccgacagcaccagcaccggcacctgcgaccattcgcgcaggtcgcgaaggatgtcctggccgtcgcggtccggcaggccgaggtcgagcaccaccaggtccggtcggttcagcgcggcctgggccagcccctcttcgccggtgccggcctcgagcacccggtagccctgggcattgaggctgatacggaggaacttgcggatctgcggttcgtcgtcgatcagcaggatgctgttctgcaattgggtcatggcactcggcacggcaggtga

SEQ ID NO: 7246 - DNA, 495 bp, Pseudomonas aeruginosa
cggtccagtcgctcggcctcgtcgcgggtgctttccagcagttcgcgacgatccgccggcgggatcgcctcgcccagcgccagcaggctgtcgatggaaccgcgcatggccgtcagcggcgtgcgcaggtcgtgggacaccgaggcgagcaaggcgctgcgcagttgctcggtctcgccgtgcaggcgcgcggcctccaggtcctcggccaggcgcgcacgggccagggcctgggccaggggctggccgagggcagcgagcaggcgccggcgctgcgggctcagcggctggccgtccagcggcgcgacgccgagcagtgccagcggtccctcttccgccgacagcggccaccaccaccagcgtcctccgggcagcgtgccagtaccgaggccggccggctggtcgtgggcccaggcccagtccgcggcgacccgttcctggtcggcgagttgccgctgcacgccggcctcggtcttccactcgccattgacctga

SEQ ID NO: 7247 - DNA, 417 bp, Pseudomonas aeruginosa
acgtcgattcccgccgccagcaactcctggatgtcctgccagcgcttggcgtggcggctgccgggaacgttgctatgggccagttcgtcgaccagggccagcgccggcgggtcggcgaggagaccgtcgaggtccatttcctgcagtttcatccctcgatactcgaggctgcgcagcggctgctgcggcacgcctgcgaggagggactcggtttccgcccgcgagtgggtctcgaccaccccggcgcgcagtttcacgccctggcgcaactgggcctgggcggcctgcagcatggcgaaggtcttgcccacccccggcgccgcgccgagaaagactttcaggcggccgcgcccgtcagcgggcaggtcggccagcagcgcgtcggcgcgtgcggtgtcggtcatggatcggtcgtaa

SEQ ID NO: 7248 - DNA, 1020 bp, Pseudomonas aeruginosa
gtacatctacgggtacccgggtggtgccctcctgcatatctacgacgcgctcttcaaggagcacgacgtgacccacatcctggtgcgccacgaacaggcggctacccatatggccgacggctacgcccgcgccaccggcaagcccggtgtcgtgctggtgacttccggcccgggcgcgaccaacgccatcaccggtatcgccaccgcatacatggactccatcccgatggtgatcctgtcgggccaggtgccgagcaacatggtcggtaccgacgcgttccaggaaaccgacatggtcgggatctcccggccgatcgtgaagcacagcttcatcatcaagcatccctcggaaattcccgaggtgatcaagaaggccttttacctggcgcagtccggtcgtccggggccggtggtcgtggatattccgaaggacatgggcgacccgacgcagaagttcgaatattcctatccgaagaaggtcaagttgcgttcgtacagcccggccgttcgcggtcactcgggacagatccgcaaggccgccgagatgctcctggccgccaagcgcccggtggtctattccggcggcggcgtgatcatgggcaatgccgcggcgccgctgaccgagctggcgcagatgctcaacctgccggtgaccaacaccctgatgggcctcggcgggtatcccggcgcggaccgccagttccttggcatgctcgggatgcacggcagcttcaccgccaacctggcgatgcatcacagcgacgtgatcctcgcggtcggcgcgcgtttcgacgaccgggtcatcaacggcgcggcgaagttctgcccgaacgccaagatcatccacatcgacatcgatccggcgtcgatttccaagaccatcaaggccgacatcccgatcgtcggcccggtggacagcgttctcaccgaaatggtcgcgatcgtcagggaaatcggcgagaccccgaaccaggatgcccaggctgcctggtggaagcagatcgacgagtggcgtggtaa

SEQ ID NO: 7249 - DNA, 540 bp, Pseudomonas aeruginosa
cggcgcgatgcgcgacatgtggctgagcaagacggagcgtacctgatcatgcgacacatcatttccctgctgctggaaaacgagccaggcgcattgtcccgcgtggtcggcctgttctcccaacgcaactacaacatcgaaagcctgaccgtggcgccgaccgaggacccgaccctgtcgcgtctgacgctgaccaccgtggggcacgatgaggtgatcgagcagatcaccaagaacctcaacaagctgatcgaagtggtcaagctggtggatctgtcggaaagcgcccatatcgagcgcgagctgatgctggtgaaggtcaaggccacgggcgcccagcgcgccgaggtcaagcgcaccaccgatatcttccgtgggcagatcgtcgacgtcaccagtagcgtctataccgtgcaactggcgggtaccagcgacaaactggacagcttcatccaggccatcggcactgcgtcgatcctggaagtggtccgcagtggcgtcactggcatcgcccgtggcgacaagactctgagcatctga

SEQ ID NO: 7250 - DNA, 1029 bp, Pseudomonas aeruginosa
aggggaattcccatgcgcgttttctacgataaagactgtgacctctcgatcatccagggcaagaaagttgccatcatcggctacggctcccagggccacgcccatgcctgcaacctgaaggactccggcgtcgacgtcaccgtgggcctgcgtagcggctccgccaccgtggccaaggccgaagcgcacggtctgaaggttgccgacgtgaagaccgccgtcgccgcagccgacgtggtcatgatcctcaccccggacgagttccagggccgcctgtacaaggaagagatcgagccgaacctgaagaagggcgccaccctggccttcgctcacggcttctccatccactacaaccaggtcgtcccgcgcgccgacctcgacgtgatcatgatcgcgccgaaggccccgggtcacaccgtgcgttctgagttcgtcaagggcggtggcatccctgacctgatcgccatctaccaggacgcttccggcaacgccaagaacgtcgccctgtcctacgcctgcggcgtcggcggcggtcgtaccggtatcatcgaaaccaccttcaaggacgagaccgaaaccgacctgttcggtgagcaagccgttctctgcggtggttgcgtcgagctggtcaaggccggtttcgaaaccctggtcgaagccggttacgcgccggaaatggcctacttcgagtgcctgcacgagctgaagctgatcgtcgacctgatgtacgaaggcggcatcgccaacatgaactactccatctccaacaacgccgaatacggtgagtacgtaaccggtccggaggtgatcaacgccgagtcccgtgctgccatgcgcaacgccctgaagcgcatccaggacggcgaatacgcgaagatgttcattaccgaaggtgcggccaactacccgtcgatgactgcctaccgccgcaacaacgccgctcacccgatcgagcagatcggcgagaagctgcgcgcgatgatgccgtggatcgcagccaacaagatcgtcgacaagagcaagaactaa

SEQ ID NO: 7251 - DNA, 636 bp, Pseudomonas aeruginosa
cggcatggatctgaggaagtactactgatgcgctactggtatctgcgccttgcggtattcctgggggcgctggcagtgccggcctggtggatgtaccaagcctggatctttgccctcggacctgacccgggcaagaccctggtcgatcgactggggctgggcgccttggtattgctgctactcaccctggcgatgaccccactgcagaagctgagcggctggccgggctggatcgccgtgcgtcgccagttggggttgtggtgcttcacctatgtgctgctgcacctgagcgcttactgcgtgttcatcctggggttggactgggggcagttgggcatcgagttgagcaagcgtccctacatcatcgtgggaatgcttggattcatctgcctgttcctgttggcgatcacttccaaccgcttcgccatgcgcaagctcggtagtcgctggaagaagctgcatcgcctggtctacctgatccttgggctcggcttgttgcacatgctctgggtggtgcgggcagacctggaggagtggaccctgtacgctgtggttggtgcgtcgctcatgctgctgcggctaccctcgatcgctcgccgcctgcccaggcttcgaactcgtcacggtgtttcgtaa

SEQ ID NO: 7252 - DNA, 189 bp, Pseudomonas aeruginosa
agcgcacccctgataagggtgaggtcggcagttcgaatctgcccagacccaccaattgttggtgtgctgcgtgatccgatacggggccatagctcagctgggagagcgcctgctttgcacgcaggaggtcaggagttcgatcctccttggctccaccatctaaaacaatcgtcgaaagctcagaaatga

SEQ ID NO: 7253 - DNA, 2409 bp, Pseudomonas aeruginosa
aggctctgccggcgggcgctaggatccgccggcctttcccgccagcgaggctctgctggcgggctttgttgcgtcatgttgctgtcatctgtctgtcatacagagcctttagggtgtcaccccatgaacgacatggccaactccccgatgaactcctcccttgctcccgagcggattgacttcaatacgccagccctgcaacgcaagcgccgcatccgtgccctcaaggaccgcctgacccgctggtacgtgctggtcggcggcctggccgtgctggcggcgatcaccctgatcttcttctacctggcctacgtcgtgctccccctgttccgcggcgccgacctggagacccgcgaagcgctgactccggcctggatgcagcaggcgcaggtgcccctgctgctcagcatcgaggagcagaaccaggtggccatgcgcgtcggcggccagggcgagattctcttcttcaacgccaagaccggtgtcgaactgaagcgtgtcgctctgccgcttccggcgggcagcgagatccgctcgatcgcccaggaccagccgggcagcccgacggtcgccctgggcctgtccaacggacaggtgctggtgttccagcacacctacaaggtcacctacccggacaacaagaagaccatcaccccggagatcgccttcccctacggcgagaccccgatcggtctcgatccgcagggccgcccgctggagcatgtgagcatcaatgccggcgacgacagcctgctgctggctggctccgtcgacaagcaactgctgctgttgagcatgactcgggaagagaacatgctgaccggcgaaagcacgctggacgaggagcgcatcgaactcccgcagatcgccgaaccggtgaaagccatctacctcgacccgcgcaagcagtggctgtacgtgatcaacggacgtgccaccgccgatgtgttcgacctgcacagccgccagttgaacggtcgctacaagctgctggaagaccccaacgccgaggtcaccgcgagcacccaactgctgggcggcatctcgctgctggtgggcgactccaagggtggcatcgcccagtggttcatggctcgcgataccgacggcgaaccgcgcctgtcgcacgttcgcgacttcaatctggatggcgcgccgatcagcgccatcgctccggaacaacggcgcaagggcttcatcgccctggacgagaagggcaacctcggcgtcttccacagcaccgcgcaccgtaccctgctggtccagccggtcgccgactcttccggggtcatcaccctgtcgccgcgggccaaccgcctgctgctggagcagggtggcaagatccaccgcttcgccctgagcaacccgcacccggaaatctcctggagcgcgctctggggcaaggtctggtacgagagctacgacaagccggcctacgtctggcagtccaccgccgcgaccaccgacttcgaaccgaagctgagcctctcgccgctgaccttcggcacgctcaaggccgccttctacgcgatgatcctggcagctccgctggccatcgcggccgccgtctacaccgcctatttcatggctccggcgatgcgccgcaaggtcaagccggtgatcgagctgatggaggcgctgccgacggtgatcctcggcttcttcgccggcctgttcctggcgccctacgtcgaaggccacctgccgggtgtgttcagcctgctgttgctgacgccgctgggcatccttcttgccggcctgctctggagccgcctgcccgagcgtatccgtctgagcctgccggccggctgggaagccgcgctgctgatcccggtggtgcttgccgtcggcgccttcgccctgtggctgagcccgcacctggagaccaccttcttcggcggcgacatgcgcctctggctgagccacgacctgggcatcacctacgaccagcgcaatgccctgatcgtcgggctggcaatgggcttcgcggtgatcccgaatatcttctcgatcgccgaggacgccatcttcagcgtgccgcgcagcctcacctacggctccctggccctgggcgccacgccctggcagacgctgacccgcgtggtgatcctgaccgccagtccaggcatcttctcggcgctgatgatcggcatgggccgcgccgtcggcgagaccatgatcgtgctgatggcgaccggcaataccccggtgatggaagtgaatatcttcgaggggatgcgcaccctggcggccaacgtcgcggtggagatgcccgagtcggaggtcggcggcagccactaccgcgtgctgttcctctcggcgctggtactgctgacgttcaccttcgtgatgaacaccctggcagagctgatccgtcagcgtctgcgcaagaaatacgcgtcgttgtaa

SEQ ID NO: 7254 - DNA, 1059 bp, Pseudomonas aeruginosa
tcgcccgcggaagtacccagaagcactacgttcccggcgcctgagcggttttttcccgacgatccgttcacagcccgctcgctgtcgtctcgccctggcaataaagcgctgctagtcttgccgattcgggataaccagaacgacacgatccgtgcagtcatgctagggcgccttctccttctctgtggcctgttcgccgcggcagctccggctgcggccctgaccatctacaagtacaccgacgccaatggcgtggtgacctactccgaccgcgccgtggccggggcgcaggtgttcgtcttccgcgaccggatggtcgagcacctggaacgggaagtgaagctggagacgaagaagcacgcgggtggcgagaccctgcaggtgcgcaacgacctctacgcgccggtcgaggtcgagttgcggatccgcaacccgcgcaatgccgttggggtgcccgacgggccgattcgctgggtggtcccggcgcgcagccaggtgcgcctggcgaccctggcgccgcgcaaggccggcaagccgatgagctacgccccgaagctgcgttacgcgctcggcgacccgcgccagcagccgctgctctatcgctatccgctgccctggcgcggcgggccgttccgcctgtcccagggcgccaatggcaagtacagccacttcacccccaagggccgctacgcgatggacatcgccatgcccgagggcacgccgatcatcgctgcccgcggcggcaccgtggtgaagatcgagaacaaccagagcgggcgcggcaacaatccctcgggcaacttcgtccgcatcctgcacgacgacggcaccatgggcgtctacctgcacctgatgcgccattcggtactggtcgccgagggccagcgggtccaggtcggcacgccgctggcgcgctccggcaacaccggcaacagcagcgggccgcacctgcacttcgtgatccagcgcaacgtcggcctggcgctggagtcgattccctacgacttcgcccagccggtcgacagcctgccgaacttcgccatcgtccgcgagccttga

SEQ ID NO: 7255 - DNA, 987 bp, Pseudomonas aeruginosa
aagcgctcggtcaggcgcggcaggtgcttggggtcgacgccgataccggtgtcctgcaccgacaggtgcgcgccctgttcgtcggcccaccagcggatgcggatctcgccttcgtcgggggtgtacttcaccgcgttgaataccaggttggagaaggcgctgcgcagttccgcctcgctgcccttgagctgcacagcgggtgcggcgtccaggctgatgcggtggttgcgcccggcggacagggcctgggcgtcgttacggatgctggcgaggagagcgtccaccgccaccggcttgttgtcgccggggttactcggtggcctccagcttggccagcaggagcaggtcgttgagcaggttctgcatgcgtccggcctgctgctgcatctgctgcagggcgcgcagccagcgcgggttcacatcctcgacgttgtcgaggagggtctccaggtagccggcgatcaccgtcagcggcgtacgcagctcgtgggagacgttggccacgaagtccttgcgcatctgctccagctggtggacgcgggtgacgtcgcggaccagcatcaggtgctcgcggttgccgtagagggtgatgtggaattgcaggcgcaggcgctcgttgatcggcgaggggatttccagcggctcgcggtaatcctcctggtcgaagtattccttgaagcgcggatggcggatcaggttgctcaccggctggccaccgtcctgcggggtcttcaggccgagcaggttttccgcggcgaggttccaccattccaggttgccgtcgctgtcgagcatgatcaccgcgtcacgcagggccgcggtggactcctggatccggtcgatcaccgcctgcaggcggccacgggcgcgctggttgcggcgttgcaggtggtagatattgtcgaagacttcgccccagaggccgtagctgtccggcggtggctcgtctggctggtggttgcgcagccactggtgcaggcgcagtag

SEQ ID NO: 7256 - DNA, 960 bp, Pseudomonas aeruginosa
ctgccagagggtccagccgaggtagagagccaggccgagggccagggcccagccgtaatggccgctgaccacgccgagcacgaggctggcggccagcacgagaagcaggtggcggatcagcgctccacgccagtcttggttcacgacggattgcatcctgtccagtggcggtccgtcacggaccgtccaggggaaacgactccggccgctgggcggccgggagcggggtcagctcttggtggagaaacgatagccggtcccgcggacagtctgaaccagattttcgtagacctcgccgagcgccttgcgcaggcggcggatatgcacgtcgacggtgcgctcctcgacatagacgttgccgccccagacctggtccagcagttggccgcgggtataggcgcgttcctggtgagtcatgaagaactgcagcaggcggtactcggtggggcccatctcggccggcttgccgtcgatggtcacgcggtggctgatcgggtccagcagcaggccgccgacctcgatcggcgcctcgctgtcgccaggcccggtgcggcgcagcacggccttcaggcgggcgaccagctcgcggggcgagaacggcttggtgatgtagtcgtcggcgccgacctccaggccctggatcttgttgtcctcctcgcccttggcggtgagcatgatgatcgggatgtcgacggtcagttcgtcacgcttcaggcgtcgcgccagttcgatgccggaagtgccggggagcatccagtcgagcaggatcaggtccggcttgcggtcgacgatcaccgcgtgcgcctgctgggtattttccgcctccaggcactcgtagccggccatctccagggccacggcgatcatctcgcgaatcggtgcttcgtcatcaacgatgaggattgtcttgccaaccatggtcttgcctcgggtcgatctgtcttgcgccgcattagataa

SEQ ID NO: 7257 - DNA, 516 bp, Pseudomonas aeruginosa
cgctctatacctacgacaaggacagcgaagggcaatccgcctgttccgggcagtgcgcgaagaactggccgccgctggcagcggcccagggagcgcaggccagcggcgactggagcctggtcgctcgcgaggacggcacccagcagtgggcctactacggcaagcccctttataccttcatccaggacaagaagcctggcgacaagaacggtgacggcaagatgggcgcctggcacgtcgcccagccggacatggactagacggtcgccggcctgcgcgccgctcaacgcagcgcgtagtcggcgaccgtgccgaggaagatcgccaggccagcccagtggttgtgcaggaaggcgcggaagcaggcctgcgggtcgcggtcgcgggtcgaccaggcttcccagacgaagcaggccgccgccaccgccaggccgaggtagaagcacaggcccagttcgaagcggttgccggccagcgccagcaggagcagggtcaggccctgcaggctgccgatga

SEQ ID NO: 7258 - DNA, 921 bp, Pseudomonas aeruginosa
gaccagttagacgcctgctggaccccggcgtccgcgcggtacaggctgtggacgcttgctgatcccgccgacaaccacaacaaggacagccgccatgaacatcctctacgacgagcgtctggacggtccgctgccgcaggtggacaaggatggcctgctggccgagttgcgcctccgcctgcccgacctcgaactgctgcacgccgcggaagacctgcgtccctacgagtgcgacggactctcggcgtatcgctgcacgccgttgctggtggcattgccggaacgcatcgaacaggttcagggcctgctcgccctctgccatcggctgaaggtgccggtcgtggcgcgcggtgccggcaccggcctgtccggcggcgcgctgccgctggagaacggcgtgctgctggtgatggcgcgtttccggcggatcctcgagatcgatccgctgggtcgtttcgcccgggtccagcctggcgtgcgcaacctggcgatctcccaggccgctgcccctcatggtctgtactacgcaccggacccgtcctcgcagatcgcctgctccatcggcggcaacgtcgcggagaacgccggcggcgtgcattgcctgaagtacggcctgaccgtgcacaacctgttgcaggtggacatcgtgaccctggaaggcgagcgcctgagcctggggtccagcgccctggacagcgccggcttcgacctgctggcgctgttcaccggctccgaagggctgctcggcgtggtggtggaggtcaccgtcaggctgttgccgcgcccgccggtggcgaaggtcctgctggccagcttcgacgatgtggaaagcgccgggcgggcggtggccgacctgatcggtgccggcatcgtcccggccgggctggaaatgatggacaacctgtcgatccgcgccgctga

SEQ ID NO: 7259 - DNA, 1794 bp, Pseudomonas aeruginosa
agcgctgggcggcaggatcctcgagttgtgcgtggcggtaggcggcagcatcaccggcgaacatggcgtcggccgcgagaagatcaaccagatgtgcgctcagttcaatgccgacgagctgaccctgttccacgccgtgaaggcggcgttcgacccggccgggctgctcaatcccggcaagaacgtgcccaccctgcatcgctgcgccgagttcggcgccatgcacgtccaccacggtcgactgccgttccccgaactggagcgtttctgatgagccagccgtatttcgatccggacgctggcgccgaccatgccggcgcgctgctcgagcgggtccgcgacgccctggcgcggcgcgcgccgctgcgcatcgtcggcggcgatagcaaggcgttcctcggcaggccggttgcgggcgaaccgctggcgctcgccgaacaccgtgggatcgtcgcctacgatccctgcgaactggtgatcaccgcccgtgccggtacgccgctggacgagctacaggccgtgctggcgcgcggcgggcagatgcttgcctgcgaggcgccgggtttcggcggccgggcgacggtcggcggggtgctcgccagcggcctgtccggaccgcgccggccctgggcgggagcggtacgcgatttcgtcctcggcacgcggctgatcagtggcctgggcacccacctgcgcttcggcggcgaggtgatgaagaacgtcgccggctacgacctgtcgcggttgctggcgggcagcttcggttgcctcggggtggtcaccgaagtgtccttcaaggtgctgcccatgccgcgctgccaggccggcctgagcctggacctgccggtggcgacggcgttgcgcaagctggccgagtggggaggccagccattgccgatcagtgcggcctgccacgacggcgaagccctgcgcctgcgcctggagggcggcgagggctcggtacgctcggcgcgcgaccgcctcggtggcgaagcgctcgaggacggcttctgggccgacctgcgcgagcagcgcctgccgttcttcgatcgacccgcgaccgctctggcgcctgtcgctgccggcgctggcgccggagacgccgttgcccggtcgtcagttgctggactggggcggggcgctgcgctggctgaagagcgacgcgccggccgcggacatccgtgcgtggaccgccgcccatggcggccacgccacctgctaccgcgccggccatctcgatgcgccgttccagccgctaccgcctggactgctcggcctgcaccgggcactcaaacgccagctcgacccgcagggcatcttcaatcccgggcggatgtacgccgaactctgaggaggcgcgatgcaaaccaacctctgcgattccgcccggcaacgcgccgaggccgccgaagccgagcgcatcctgcgcagctgcgtgcactgcggtttctgcaacgccacctgcccgacctaccaggagctgggcgacgaactcgacggcccgcgcggacggatctacctgatcaagcagttcctcgagcgcgacgaggccagcgagcgcacccgcctgcacctcgatcgctgcctgagctgccgcaactgcgaaaccacctgcccgtccggagtcgagtaccacaagctgctggatatcggccgcgacctcctcgccgaacgcctgccgcgcggcttccggcaacgcctgctgcgcgacgggctgcgcctgctggccccgcgcccggggttgttcggcgcgctggccggcactgccgggcggctgaggcctctgctgcctga

SEQ ID NO: 7260 - DNA, 888 bp, Pseudomonas aeruginosa
ggcgatgcagggcaagctgccacgtcgggtcgcggcgccgggcaggcggccgcagccccggcatgcacggcgcgtgctgctgctcgaaggttgcgtgcagccggcgctgtcgccgaacaccaacgccgccgccgcgcgggttctggaccgcctgggaatcagcgtgacgccggcggccgcggccggctgctgcggcgcgctggatttccacctggatgcgcaggagcgcggccgccagcgcgcgcggcgcaatatcgacgcctggtggccgttgctgcgcgagggtgccgaggccatcgtgcagaccgccagcggctgcggcgccttcgtcaaggactacgcctacctgctgcgcgacgacccacggtacgcggacaaggcgcacgaggtcgccgccgctgcccgcgacctggtggaagtgcttcgcgacgagccgctggagtccctcggcctgcgctgcgaccagcgcctggcgttccactgcccatgcacactgcagcacgcgcaacgactgggcggggccgtggaggcggtgctgcggcgactgggcttccatctcaccgaggtggccgacggtcatctctgctgcgggtccgccggcacctactcgctgacccagccggcgctgtcccggcgtctgcgcgacaaccgcctggacgccctggaaagcggcgcgccggatgtcatcgccacggccaacgtcggttgccaggcccatctcgacggggccggacggaccccggtacgccactggatcgagctgctcgaccaggccttgcccggaggagagtgaaaccatgcacagcaagccggtactcggccgcgaggaggtcgcccgcgtccttggcgcggcccgcgaggaggcacagcgccaaggctgggcggtga

SEQ ID NO: 7261 - DNA, 192 bp, Pseudomonas aeruginosa
gttcgacgaacgaggagggtggctatgcgcaagtggcaatgcgtggtctgcggcttcatctacgacgaagccctgggcctgcccgaagaaggcattccggcgggaacccgttgggaagacatcccggcggactgggtctgcccggattgcggtgtcggcaagatcgatttcgagatgatcgagatcgcctga

SEQ ID NO: 7262 - DNA, 1206 bp, Pseudomonas aeruginosa
gcgaaatccacagaagcggcgcccggcgccggcaatcacagaggaacggaaatgagcgagcgtgcgcccctggtaatcatcggaaccggcctggcgggctacaacttggcccgcgagtggcgcaagctggacagcgagacgccgctgctgatgatcaccgccgacgacggccgttcctattccaagccgatgctctccaccggcttctcgaagaacaaggacgccgacggcctggccatggccgaaccgggcgccatggccgagcaactgaacgcacgcatcctgacccatacccgggtcaccggtatcgatcccggccatcagcggatctggatcggcgaggaagaggtgcgttatcgcgacctggtcctggcctggggcgcggagccgatccgggtgccggtcgagggcgatgcccaggacgcgctctacccgatcaacgacctggaagactacgcgcgcttccgccaggcggctgccggcaagcaccgggtactgctgctcggtgcggggctgatcggttgcgaattcgccaacgacctctccagcggcggctaccagctcgacgtggtggcgccttgcgagcaggtcatgccgggcctgctccacccggccgcggcgaaggccgtgcaggcaggcctggaaggcctcggcgtgcgcttccacctggggccggtgctggccagcctgaagaaggccggcgaggggctggaagcgcatctttcggatggcgaggtgattccctgcgacctggtggtctccgccgtcggcctgcgtccgcgcaccgaactggccttcgccgccgggctggcggtcaaccgcgggatcgtcgtcgaccgctcgctgcgcacctcccacgccaacatctacgcgctgggcgactgcgccgaagtggacggcctcaacctgctctatgtgatgccgctgatggcttgcgcacgcgcgctggcgcagaccctcgccggcaaccccagccaggtggcctacggtcccatgccggtgacggtgaagaccccggcctgcccgctggtggtgtcgccaccgccccgcggaatggatggccaatggctagtggaaggctctggaacggacctcaaggtcctgtgccgggataccgctggtcgagtgatcggttatgccctgaccggagcggcggtgaacgaaaaattggccctgaacaaagagttacccggcctcatggcttga

SEQ ID NO: 7263 - DNA, 363 bp, Pseudomonas aeruginosa
agcctatggttccggtggactgcggtgcctttgagcgctgctgggaagacagcacggacacaaaaacaacaaaccgtcaaagaggcaactatgcgtaaaccagaactagccgccgctatcgccgaaaaggccgatctcaccaaggaacaggccaatcgcgttctcaacgccctgttggatgaaatcaccggcgcgctgaaccgcaaggacagcgtgaccctggtcggtttcggcaccttcctgcaacgccatcgcggagcccgcacgaggaagaacccgcagaccggccagccggtgaagatcaaggccagcaacaccgtcgccttcaagccgggcaaggccctgcgcgacgcggtcaactga

SEQ ID NO: 7264 - DNA, 528 bp, Pseudomonas aeruginosa
ccgccgagagcccggagtcagagcggctccgggcttcgtcgaagacgcttccgcgctcatcgaaaggacagctgtagtcctcctcgcgaacagctacaatgcgccgctcatctccccggatatcgaggcgcgtgcatgaaatttcgtcttctcctgtggatgcttggtcgcctgatggccaaggccagccgcgacaatcccgctttccagaagcagctcgagggcaaggacctggtgttccagttgcataccctcgacggcaaggtggcgcgccactacctggtcagggacctgcgcgtcagcagcaagcgcggtacccatccgcaaccgtctttttccctggggttcaaggacggagcctacggtttcgccgcgatgacttcgaagaacccgcagttggccttcatgcagggcatccagaacaaggacatccagatacagggcaatccggcgctggtgatctggttccagggtctggtgaagtacctcaagccgaagaagaaggctccggagaagaaagccgcctga

SEQ ID NO: 7265 - DNA, 1719 bp, Pseudomonas aeruginosa
tcgggcgtgcattgcagacgattcgacgcctacactgcccgccttgttgtaggaaggagacggcttcatgtcgcaaacagtgatgatcgccggctgcggcgatgtcggcgggcgcctcggcgaggcgctgctggccgatggctggcgggtccatggcctgcgtcgctcggtggacgccttgccgcaggggatcctgccggtggctggcgatctgcaggctccggagtgtcccgcgcagtggccgagcgagccgctcgactacctggtgtacagcgccgccgccagtcagcacgacgaggctggctaccgtgccgcctacgtcgacggcctgcgccatgtgctgggctggttgcaggcccgcggccagcggcccaggcgcctgctgttcgtctccagcaccggggtctacgcgcagaccgatggcggctggatcgacgaggagtcgccggcgctttcccaggtctattccggacggatcatgctcgacgccgagcaggtcgcgctggacagcgggataccggctacccgcgtgcgcctggccggcatctacggtccggggcgggagtggctgctcaaccaggtgcgtcaggggtaccgggtggtcagcgagccgcccctgtatgccaaccggatccacgccgacgatgcggccgggctgctggccttcctgttgcgcgccgatgccggcggccaggcgctggaggactgctacatcggtgtcgacgacgcgcccgtggcgatgcacgaggtggtcgactacctgcgccagcgcctgggcgtcagccaatgggccgacgaacattcggtacgccgcgccggcagcaagcgttgcagcaaccgccgcgcccgggcgctcggctgggtgccgcgctatcccagctaccgcgagggctacgcggcggtgctcggggacgcctgatggctgccaaccggttgttggcgcgtccctggctgcctggcgtggagctgttccatgcggacttctccggccaggcgttcggccgccacagccattcggccttcgccatcggctcgatcctccacggcgtcggcggctaccagtgccgcgggcggcgccatgcgctgccggccggcaccctgtcgctgatgaacccggaagagccacataccgggcacgccgaatccgagcggctggtctaccggatgctctatgtcgaggaaacgcgcctgctcggcctgctcggccgcaaacagttgccgcgcggcttcggcgaactgaacccggccgacgacggcagcgtggcggctggcctggcgtggctggccgaggatttccagcgcagcgacgcattggggttggaaagccgcctgctggccttgctcgaacaggtcttcgtgcgtcacggcggcttgcgcccggcggccgcggcgccccgcgacggcggaaccaccgcacgcctgcgcgattacctggaagcgcatgctaccgaggcgctcggtctggaccaactggcgcagttgctgcagcgccacccgcgccacctgatcgaggctttccggcgtgcctacggcgtgccgccgcatacctaccaactgcaatgccgggtgcgccaggccaagcgcctgttgctggaagaacggccgctggcggaactcgcccagcacctcggcttctacgaccaggcgcacttctccacgaccttccggcgtttcaccggggtcactccggggcagttccggcgcagcgccaagacctga

SEQ ID NO: 7266 - DNA, 687 bp, Pseudomonas aeruginosa
gttttttccaatacggcgcccgccgtgctgcacagactggaggccttcgcgtttcgaggggccttcatgttcgccgcgttcgtccttgtcgccagtacccatttcgccgccctgctgtcgccggggccggacttcttcctgttggtgcgcgccgccctgctgcgcggccggcgccaggccgacggggtggccgccggcatcgccctggccaacctcctgagcatgctgctggtgctcggcctgttggccagcgtgccggactcggcgcacagcgccttgcgctggctgcaggcgctcggcggactgtacttcctctggctggcgggccaggcgctgcttgcgcagaggcgactggaaatgccggcgcagcgcgacgtcccgtcccgcggcggctatctgcgcgggctgcgcgacggcctgctggcgagcagcctgaatcccaagctgccgatcttctatgcggggctgttcggcgtgctggcgcgcttcagcctgccgggctgggcgctggccctgtgcctggcgtggatgagcctggcggtgctgtgctgggacatggcgctggtgcgcctgctggacaggccgcgctggcgcggctggttgcaacggcgggtaggtgcgctggaccggctgtgcggcgtcctgctgctggcgctgggcggctggctggtgctggccgccctctga

SEQ ID NO: 7267 - DNA, 1218 bp, Pseudomonas aeruginosa
gaggcctcagcgctccagcagccagacgcgcttgccgggcacgtagctgggcatctcgttggcgccggcggtattgaccgcttcgaacagttgcagctcgtcgtcgtcgaggctgaacagcaattcgcggccgcggttgccttgttgcagccagatgctgtcgttgtcgccgctcatcgctgcgcaatcgccggccaggcacagcgcgtagcgttcggcgccgggcagaccgctgaccaggccattggcctggaactcgaccttgccgccctggccctggccttcgcggatcttccagctgcccttcagatagctgccatacaaggcccgctcgaaaccgctgccggcagggctgttggccgcgggttgcgggtcgagacggcggaaacgctgttccgggccgttggcgctggcctgctggatcagctccttgccgtccagttcgagactctcctggttgtcgtcgccatagaaggcaaccttccagtgctcgtcatcgctcttgctcagggtcccttcgcccagttcgaagccgttgctgaaggtggcttcgcctgccttgctgtcgagcttccattccaggttcgggccataggcgagcagggcctcgcgcagcttgccgtccttgctcgcggcgtcgatcgcggcctggttgatccaggtgccggacggatcggccgtgccggcgcagccggccagcagggtggcggctgcggcgaggaaaatcacgcggcgcatcgtgctactccatgcagagcgacggggccttgggccccgtcgcgaacatccggcttattcgaggacgacgatggcgtccatttccacctgtgcgcccttcggcagggcggctacgccgatagcggcgcgcgccgggtagggctgggtgaagtagcggcccatgatctcgttgaccttggcgaagtgcgacaggtcggtgaggaagatgttcagcttggcgacgtcgtgcaggtagccgccggaagcctcgatcaccgccttgaggttctcgaacacctggacggtctgctcctcgaagccttccaccagttccatggtcttcgggtccagcgggatctgcccggacacgtagacggtattgccggccttgatggcctgggagtaggtgccgatggcggccggggcgttgtcggtgtggataacggtcttggtcatgggaactccttgctgaaatcgagtgggcgcgggggcgccggatga

SEQ ID NO: 7268 - DNA, 831 bp, Pseudomonas aeruginosa
ggtgttcctggtgcttcgtacgggttggaaagagatcgggcggaggcgcccgcgggtcattcgatgttctggacctgctcgcgcatctgctcgatcaggaccttgaggttgaccgccgcctgggtcgagcgcgggtcgaacgccttggagcctagagtgttggcttcccggttgagttcctgcatcaggaagtccaggcgccgaccggcggcgccgccggccttgaggacccggcggacctcgccgacgtgggtggcgaggcggtccagctcctcggcgacatcgctcttctgcgccagcaggaccagttcctgctccaggcgctgcggatcgagttcggccttgagttcggcgaagcggtcgaggatcttctgccgctggttggccagcatggtcggcaccagttcgcgcaggttgccgacttccaccagcatcgcgtcgagccgatcgttgagcagcttcgccagctccaggccttcgcgcgagcggccggccttgagttgctccagggcctggccgaaggcttccagggcggcggcgttgagcgcctgcggatcggccgagtcggccaccagtacgccgggccaggccagcacggcgagcggatcgagcggcgccggctggcggatcagggcggctacgccttcggcggcggcgaccagttggcgggcgcgctcctggtcgacctgcaggctcttgccggcggtttcctcggcgaagcgcagggtgcattccaccttgccacgcgacaggccctggcgcagcgcctcgcgcaccgcgccctcgaggtcgcggaaggcgtcgggcaggcgcaggtggggctccaggtaa

SEQ ID NO: 7269 - DNA, 492 bp, Pseudomonas aeruginosa
acgccatgctcgaactggcccagcagggcatgcaggagctgttcgaacttcagcgcgccgcgctggccgaatgagcagacgcccggcactgcctgccgggccccggagaaggagcgctacatgaacgatgtatccgaagaggtcgccgcgacccccggccaggaagcccggcaatgggcgatgttctgccatttcgcggcgttcatcggcttggtgtttcccttcggcagcctgctcgggccgctgatcgtctggcaactcaagcgcgagagcgatccgttcgtcgacgcccagggcaaggaagcgctgaacttccagatcaccgtggcgctggcgatgttcgtcagcttcctgctgatgctggtggtgatcggcttcttcctgctcggcctggtctgcctggcggcgctggtgttgaccatcatcgccggcatcaaggccaacgaaggcaaggcctatcgctatccgttctgcctgcggctgatcaagtag

SEQ ID NO: 7270 - DNA, 669 bp, Pseudomonas aeruginosa
ctaaattcatgcggcttggtgtcattcatgcaggcgtatcagcgcgatttcattcgttttgccatcgagcgcggggttctgcgcttcggtgagttcaccctcaagtccgggcgcaccagcccctatttcttcaatgccggcctgttcgacagcggcctggcgctggcccgcctgggacgcttctacgccgaggcggtgatcgacagcggaatcgacttcgacgtcctgttcggcccggcctacaagggcattcccctggccgccaccaccgcggtggccctcgccgagcagcaccagcgcgacctgccctggtgcttcaaccgcaaggaagccaaggaccacggcgaaggcggcacgctggtcggcgcgccgctgagcggccgggtgctgatcatcgacgacgtgatcaccgccggcaccgcgatccgcgaagtgatgcagatcatcgacgcccagggcgccagggccgcgggcgtgctgatcgcgctgaaccgccaggagcgcggcaagggcgagctgtcggcgatccaggaggtcgagcgcgacttcggcatgccggtggtgagcatcgtttccctggagcaggtgctggaatatcttgccgaagatgctgaactgaagaagcatctgccggcggtagaggcctatcgcgcccaatacggtatctga

SEQ ID NO: 7271 - DNA, 1932 bp, Pseudomonas aeruginosa
accgccatcgcgcggtgcgaaagggctggccgcagaaccccccgtcgctggcccgcattgccctcatcctcggggcgtcgcggccttagtgttgttcgacgagaacgcacgccgtgcgcaacgagagaggaacaccatgtcgtccacgctccgccccggaccgggcaactcgcgcctttgccgcccggggttgctgcttgccctgggcctgatgctggtggcctgcggagaatccacggagccgccggcgcgggccgccgattcccagcgtgtccctgcggaccctgcgttggcgcaggtgtattccgccagttgcaagctctgtcacgccaatcccgcctccggcgcgccgctgaccggcgatgccgctgcctgggcgccacgcctggcgcagggcatcgacaccctgctggaccacagcatcaacggctacaagggcatgccacccatgggcatgtgcatgcagtgctcggaaaaacagttccgggctttgatcgatttcatgtccgcagcgcaggaccgataggggataccggcatgccaagtcatctgtcgcgacgccagctcctgcaacgggcgggagcgctcggtgcgttcgccgccatggtgggaaaccccgcgctggcggagttgctccgcgcaccgcgcctgattccctggcgcaactggtccggcgcgcaaagctgcctgcccctggcgcgggaggcaccgaaagacctcgacgaactggtccggatcatccgccaggcgtccggcaggatccgcccggtgggctccgggcattcgttcagcgcgttggtcccgaccgacggcaccctgctctcgctcgcctacttcagcggcttgctcagccacgacagcgcgaccctccaggccgagttcggcggcggtacgccgatgtcgcagatgggcgctccgctcaaggagatcggccaggcgctggtgaacatggccgatatcgattaccagaccctggccggcgccatcgctacttccacccatggcaccggggtcggcttcggttcctattccgcccaggttcgcggtctgcaactggtcaccgcgagcggcgaggtgctcgagtgcgacgccaagcgcaacgtggaggtgttcgatgccgcgcgggtctcgctgggggcgctgggcgtcgtgacccgggtgcgcctgcagaaccgcgcggcctaccgcctgcgtgaacggcagtggatcgcccggaccgaagaattgctggaagacgtggagaagaatacgcgcgagaaccagcactgggagatgctggtggtgacccattccgactacgccctgtcgatcgccctcaacgagaccgacgagccgaagaccccgcccctggacccggcgaaggaaggcggcaacgagttcgtcggcctgatcgaaggtctcgacaagtacctcagcgacttcccggagacccgccgcaccctgctcaacagcctgcgccatttcgcccgcttcgacgagcgggtcgacgattcctatgcggtctacgccaacgtgcgcaacgtgcgtttcaacgagatggagtattcggtccccgccgagcatggtcccgcctgcctgcgggagatcctcgcgctgatccgcgacaaggacctgcgcacctggtttcccatcgagtaccgctacgtgaaggccgacgacattcccctgagcatgttcgagggccgcgacagttgttccatttccgtgcatcagcactacagcatggaccaccacaacttcttcgccgcggtggaaccgatcttctggaaatacgccgggcgtccgcactggggcaagctgcatggcctcaacgcgcaccagttacaggggctctatccgcgctggaaggcgttcgccgaggtgcgccaggcgctggatccccgcgggcggttcctcaatgcgcacctctcctccatcctgggcgtgacctga

SEQ ID NO: 7272 - DNA, 612 bp, Pseudomonas aeruginosa
tccagcgtgccctccaggccctgccggagcggggactggggctgtgggtcggacaccagaacgtgctcggcacccttggcctgctgggccatgtgctgtcgctgtgccggaccctgcgcgacgcgttcgacatcggcgtgcgctaccagcacagctcgggcgggatcgtcacctccagcgtctaccagcagggcgaaaccttcttcgtcgaggtcgaatgccacctgcccagcagtgaggtgcaggtgttcgccatcgaggagttcttcgccagcctgctggtgtatgggcgtgccctggtcagcccggcgttcgaaccgctgggcatcgaactcatccatgccgctccgccctacgcgggcgagtacctgcgcctgctgggcccccaggtacgcttcggctgcctgcacaaccgcatggcgatcgccagccactggctggacatgcgcctgcccaaccacaacctgccggcgttgcgccaggcgctggccctgctggagcaggaaaacacccaggtgcaccggaaactcgacctggtccaggcggtggaacgggccatcgcccgcgacctcagcctgggcagccagatcgaaaggatttccgccgaactga

SEQ ID NO: 7273 - DNA, 681 bp, Pseudomonas aeruginosa
gcttcggcggcgacgttctggccactttccacccggtgcaggatatccagggcggcgaagctgaccgggccggggctgtcgttgtcctgggcggcctggccgggcgcgttcaggtgggcatcgaccacgccgtcccaggccagcaggatgcgctgggcggcctcgatgcgggtggcgtcgccgctttgcagggcttcgagggcgagggggctggccgcggcggcgcgggtgtcggcggcgagttgctgcaaggcctggcgcaaggcgccggcctggccttcggcccaggccgcgtccaactggcgctgctgcgcctcaccggcgccgccgaagacgccgaaccagagcagggcgccggcggccgccacgcccagtaggctggcgcatatgccgggcaacaggtccttgccgtcagcgcgttcggacgctgccttggcgcggcttcttttccggttcgagcacgtcgcccaactcgttcccatccttgggcggtgcgctggaaaagcttcatgccgcgtctcctcggcgtctcgtcctgtgttcggggtcagtggctgccggaatggccgaagccgccggcgccgcgctggctttcgtcgaacgcttcgaccagctcgaaatgcgcctgcaccaccggcaccagtaccaactgcgcgatgcgctcgccgacggcgatggtga

SEQ ID NO: 7274 - DNA, 216 bp, Pseudomonas aeruginosa
tcggcgaccgccgcggaggcgatcagcaggtcgcagggcatctccgcctcgcaggcggccagcatgtcgcgggcgctgaccacgtcgacgcgctgcacccggtcgggcgtgggcaggtgcaccgggccggtgaccagggtcacccgtgcgccggcttccaccgccgcctcggcgagggcgaagcccatctttccggaactgtggttggtgatgtag

SEQ ID NO: 7275 - DNA, 561 bp, Pseudomonas aeruginosa
cgcaccgggtcgatgttttcctgggtcgggccggcggtgatcagcacatgcacgccggtcagcgcctggcgctggaagcagtcggcggcgcgctgcgccagttcctcggcttcgagcatgcgtccgaggccgacatcgccgcaggcctggctgcccgctgccggaccgaacaggtggaagccgcgctggcgcagcagctcggcgttggcctgggtcgcggtgtcgcgccacatggcctggttcatcgccggtgccagggcgatttgcgcgtcggtggccagcaccagggtggtcagcaggtcgttggccacgccctggaccaggcgcgccatgaggtcggcggtagccggtgcgatcagcaccagatcggcccagcgggccagttcgatgtggcccatcgcggcttccgccgccgggtccagcagatcggtatgcaccggatggccggacaacgcctggagggtcaggggcgtgatgaactcgcggccgccctgggtcatcaccactcggacttcagcgccctggtcgcgcaggcggcggaccagttcggcgctcttgtag

SEQ ID NO: 7276 - DNA, 792 bp, Pseudomonas aeruginosa
catgcgcttcggcaaacgcgcctccccaggtcgtctgccgcgcaaaaaggatgggctaagatagcacagcgtccgcacgggaacagcgggcgggctcgatggggaaagcgaatgagcatccgcgattggcccgaagccgaacggcctcgggagaagcttctggagcagggcgcggcggccctttccgatgccgagctgttggcgatcttcctgcgtacgggagtgaccggttgcagtgcggtcgagctgtcgcggcggctgttgagcgagttcggcgggctgcgtgccctgctcgaggcggacctcgcctcgttctgcggccatctcgggctcggcgtggccaagtatgcgcaattgcaggccgtgctggagatgggccggcgccacctggccgagcgcctgcgtcgcgattcgatactggagagcccgcaggcggtgcgcgactatctcaaggcgcgcctgcgccacgagcagcacgaggtgttcgcctgcctgttcctcgacacgaggcaccgggtcctggcgttcgaggtgctgttccagggcagcatcgatggcgccagcgtctacccgcgccaggtggtcaagcgcaccctggcgcacaacgcggcggcgctgatcctgacccataaccacccttccggggaacgcccgtccgagtctcgccgaccgccagctcactgcgcgcctcaagggaacccttggcgctcatcgacgtgcgggtgctcgaccactttcctcatcgggcgacgggggagcccgctgtcgctggccgaatacggttggctgtga

SEQ ID NO: 7277 - DNA, 1500 bp, Pseudomonas aeruginosa
aggcgacctggatcaagctctgatcgcctaggtcggcccttccgggccggctctctcgagccacacccgcggccgggtttccttctggaagcccggccgctgtgcttcgtgcgccggatatatccgctcgccccggcaaggctttcggggtgccaacgggagaatcgcaatgcgttggggaagctatttcgccgtctgttccgcagtcatcagcatcggtctcgcccttggcctgaccatgccgctggtctcgttgcgcctggagagctggggctacggcagtttcgccatcggcgtgatggccagcacgccggcagtgggcgtgctgctcggcgcgatgatcgccgggcgcctcgccgcgcgcgtcggcacgccgcggctgatgcagttgtgcctgctcaccggggcagcctccgtcggcctgctggcgctgctgcagagctacccggtatggctgttgctgcgcctgctgatcggcgtgcagctcaccgtggtgttcatcctcggggaaagctggatcaaccagttggcggtggagaagtggcgtggccggctggtcgcgctgtacggcaccggctacgccctcagccaactgtccgggccggtactgctgaccttcatcggtaccgccgacgaccgtggcttctggttcggcgtctgcctgctgattgctggctcgttgctgctgctgggccgcagcggtgcgcccagggtcgatccgcacagtgcctccgggcgcggtttgtgggccttctgccggggtctgccggcgatcgcctgggcggtggtgttgttcgctgccttcgaggcgatgatcctcaccctgctgccggtatacgggttgcgccagggctttccgcaagcggtggcgctggccatggtcagtaccgtggtggtgggcgatgcattgttgcagctgccgatcggctggctcgccgaccgggtctcgcgcagcggcctgttcggcggctgcggcctggtgctgctgctgagcagcctggcgattcccctgctgctgcagacgccgttgatctggccgctgctggtgctgttcggggccagcgccggcgggttgttcaccctggcgctgatcctgatcggcgagcgctaccgagacgatgccctggtccgggccaatgcccatgtcgcgcagctatggggcatcggctgcctgctcggcccgctggccaccggcgccgccagccagtggatcagcggtcacgccctgccgttgatgatggcgctcggcgcggcgggcttcgtggtgctggtgcggctgcgcggggcgattccggcggacgacgaggcgacaggcctggaagcctccgagtgaccctcagagcatcttttccagtccgatcattcccgcgacccaggcgttcaggcgtcgccacaggctgcccggctcgtggcgcaggacctggggccggccgtcgcgttcgtcgatccagaccagcttcggccggctaccgctgcggtcgatgcgcacctggtagctga

SEQ ID NO: 7278 - DNA, 675 bp, Pseudomonas aeruginosa
tcttgcacgagggccccgccacccttggccgggtcggcaacggacagaggtgggacatgcgtttgcgcagaaggacgacgttgctgctggtatttgcagtgctgttgctgctggcgttcggctacggctggcatgcctggcgcagcctgttgcgcgagcagggtgtcgagcgcctggagtggcaaggcctgggcctgtccgccgaaggcatcgggctgcgacggctggcgctggagcggcgcggcgcggatggcgccagcctgcgactggacgtggaacacgcgctgctgcgctggcccgggctgtcgggttggcgtccgcgtctacccggcctgcgcgtggagcaagtggcgctcgcctggcaaccggctgccgcgagttccgacgacgacgccgctgcgctggactggacgtccctgcgcgagaccctcgcctggctgccggaacagatccacctcgaacgcttccatctcgacctgccttgtcccgccggccgctgcgagcaggacggcggactggacatcggccgcccgtcgggagcgctgtttccgctggctgcgcaactgcgcctgcaacaggaggcgcagcaggcccagctcgacgcccagctcttcgaggagcctactggttggcgcctgcggacgcgcgcgcaactcgaccggcaggcgctgctga

SEQ ID NO: 7279 - DNA, 1389 bp, Pseudomonas aeruginosa
ttatttctgcctccctcttcctatactgcgcgcatctacacgctcaaaataacaaacgtccgcggttcctccgcgacgtgggaggcgacaatgcgagttctggtccttggcagcggtgtcatcggtaccgccagtgcgtattacctggcccgtgccgggttcgaggtggtggtggtcgaccgtcatgacggtcccgccctggaaaccagcttcgccaacgccggccaggtgtctcccggctacgcttcgccctgggcagccccgggcattcccctgaaggccatgaagtggctgctggaaaagcacgcgccgctggccatcaagctcacctccgatcccagccagtacgcctggatgctgcagatgctgcgcaactgcaccgccgagcgctacgccgtgaacaaggagcgcatggtccgcctgtccgagtacagccgcgattgcctcgacgaactgcgcgccgagaccggcatcgcctacgagggccgcaccctcggcaccacccaactgttccgcacccaggcgcagctggacgccgccggcaaggacatcgccgtgctcgagcgctccggcgtgccctacgaggttctcgaccgcgacggcatcgcccgcgtagagccggctttggccaaggtcgccgacaagctggtcggcgccttgcgcctgcccaacgaccagaccggcgactgccagctgttcaccacccgcctggcggaaatggccaagggcctgggcgtggagttccgcttcggccagaacatcgagcgcctggacttcgccggcgaccgcatcaacggcgtgctggtcaacggcgaattgctcaccgccgaccactacgtgctggccctgggcagctactcgccgcaactgctcaagccgctgggtatcaaggctccggtctatccgctgaagggttattcgctgaccgtgccgatcaccaacccggagatggcgccgacctcgaccatcctcgacgagacctacaaggtggcgatcacccgcttcgaccagcgcatccgcgtcggcggcatggcggaaatcgccggcttcgacctgtcgctgaacccgcgccgccgcgagaccctggaaatgatcaccaccgacctctatcccgagggcggcgacatcagccaggcgaccttctggaccggcctgcgcccggcgaccccggatggcaccccgatcgtcggcgccacccgctaccgcaacctgttcctcaataccggccacggcaccctgggttggaccatggcctgcgggtcgggtcgctacctggccgacctgatggcgaagaagcgcccgcagatcagtaccgaaggcctggatatttcccgctatagcaattccccggagaacgccaagaatgcccatccagcgccagcacactaa

SEQ ID NO: 7280 - DNA, 474 bp, Pseudomonas aeruginosa
tcggtatcgtgcccgggtgtgataagccacgatgagggtgtaagggtgaacctgattaaaaaaatgctggcggcccaagctgccgtgttggccctgtgggctgtaagcgctcaggctacgaccactgacgatgcgatcgccaagcgcctcgagccggtaggcaaggtctgcgtacaaggcaaggaatgcgaaggcgtcggcgccgtcgcggcagccgccggtggcggcggtgcgcgttccggcgaagacatcgtcggcaagacctgcaacacctgccacggcaccggcctgctgggcgcgccgaaggttggcgacaaggccgagtggggcaagcgcgccaaggagcagggcggcctcgatggcctgctggccaaggcgatttccggtatcaacgccatgccgccgaaaggcacctgcgccgattgctcggacgacgagctgaaagccgcgatcaagcatatgtccggtctgtaa

SEQ ID NO: 7281 - DNA, 1113 bp, Pseudomonas aeruginosa
ccaggtgctgcggatggatcagctcgcccttgccggcttgctcctctttttccagcgtccgcagcgagcgctcgcggtgctccaggcattcgtcgaggaagctgcgctcctcgcgggcttcgagcaacggcaagagctggggatcacgtcgccgaccacgccgagatcgatggggtggcggcggcccaggtgactgccatcgcggtcgacctggatcagggtggccttctgcggatagaactgcgcccaggcgaagtcggcgccgagcagcaggagggtgtcgcactcggtcatcatgtggaagccggactcgatcccgagcataccggtcatgcccatgttgaaggggttgtcgtactcgacgaagtccttggcccgcgacgtgtgcgcgatgggcgccttgaggcggtcggcgagggccaccagcaggtcgtgggcgccctggcagccggagccggcgtagatgccgatcttcttgccgtgggccagcaggcgggcgacgtcctgcagttcggcgtcgctggggcgcagcaccggttgcgggaaatgcaccgagaacggcaggtcgtccttcaccgtggcctggctgatgtcggccggcaggatcaccaccgccacgccgcgccggttgagcgccgcctggcaggccagggccaccacccggcgcgcctgttccgggctgtgcacctgctcgcagaacaccgagcagctggcgtagaccgccttgaagtcgacctcctggggaaactccatgcccagttgcggggtaacgatctggctggcgatcagcaccatcggcgcgcggttgcgctgggcctcgtagacgccgttgatgaagtgcaggctgcccggtccgcaggagccggcgcaggcggtcaggcgtccgctgatgtaggactcggcgcccgcggcgaaggccgccgcttcttcgtggcgcacgtggacccactggatctggctgcgatggatggcgtcggtgacatggttgagggtgtcgccgacgatgccatagcaatggcggacgccggcggcttccagggtttccacgacgatctcggcgactttcttgctcgacatgaagctgtcctcgaatggaattcgttagctagctaa

SEQ ID NO: 7282 - DNA, 402 bp, Pseudomonas aeruginosa
attattacgcttcacgtggaggtcattgcccgatactgcagggcttccgccaggtgccggcgttcgatggcatcgatgcgctccaggtcggccagcgtccgggccaccttgagtatgcgatgcaaggcgcgcaaggaaagttccaggcgctctccggcagcctccagccagcggcggtccgcttcggcgagtgcacaattgcggtgcatcgcctggagatcgagatgggcattggcgcagccctggcgggccagttgccgttgccgtgcggcgcccacccgttcgctgacctcggcggtagcggtttcgccgtgtcctggctgcaggctggtgctttcgcggagcacgctgacgtgcaggtcgatgcgatcgagcagcggtccggacagcttgccccggtag

SEQ ID NO: 7283 - DNA, 861 bp, Pseudomonas aeruginosa
ggcggcagcggggcctggccggagaggtgtccggcgatctccagcaggtggtccacggcgaacaccgtcagcccgctggccaggctggcctcttcggcattttccttcggtaccaccagaacgcgccttgcgtcgcgcgccgccagcgcggccggcaatacgcctcgcactggccggatcgccccggacagggccagttcgccgaggcactccaggccgtcgagggcggtgccgggcaactggccgctggcggcgaggatgccgagtgcgatggccaggtcgaagcgaccgccgtccttgggtaggtcggcgggggcgaggttgagggtgatgcgccgcgcggggaagtcgaaaccggcattgagcagggcgctgcgcacgcggtccttgctctcgcgcaccgcggtttccggcaggccgaccagggtcagcgaaggcaggccgttggccaggtgcgcctcgacgctgacgcagggggcttcgacgccgacctgggctcggctgtggacaatcgccagggacatggatcgctccttgatctcacgccgctcgcaggggggaggatcagtcggcgggcggcgtcagcttgctttcgagttccgctaccttggcctccagggcttccagccgtgcgcgagtgcgggcgaggaccagcatctggctgtcgaactcctcgcggctgaccaggtcgagcttgctgaaggcgctctgcatcagggcgcggaactgcgactccagctcggccttgggcaacggcgattcgccggcgaacaggcggctggcttgttggctgagggcttcgaagacggctttgggcggcagcatggcgagggttccggtaacgagtgggcggcagtctag

SEQ ID NO: 7284 - DNA, 546 bp, Pseudomonas aeruginosa
gatcgcagggctaggagccctattgtccctcgctttgccgggcgtcgccctggccgccgaggagcccgtcctgaacagcggcgacaccgcctggatgctgatctccactgcgctcgtcctgctcatgaccatccccggcctggcgctgttctacggcggcatggtgcgagcgaagaacgtgctgtcgatcatgatgcagtgcttcgccatcaccggcctgatcaccattctctgggtggtctatggctacagcctggcgttcgataccaccgggatggagaagggcgtcctcaacttcaattccttcgtcggcggactggacaaggccttcctcagcggtctcaccgccgacggcctgacttccgccaccgcgctgttcccggaaagcgtgttcatcaccttccagatgaccttcgcgatcatcactccggcgctgatcgtcggcgccttcgccgagcgcatgaagttctcggcgatgctgatcttcatggcggtctggttcaccgtggtctacgcgccgatcgcgcacatggtctggagcggtga

SEQ ID NO: 7285 - DNA, 987 bp, Pseudomonas aeruginosa
cggcgccctgatgtgggactggggcgtgctggacttcgccggcggcaccgtggtgcacatcaacgccggtatcgccggtctggtcgcctgcctggtgctgggcaagcgcaagggctacccgaccacgccgatggcgccgcacaacctcggctacaccttggtcggggcggccatgctgtggatcggctggttcggtttcaacgccggttccgccgccgccgccaacggcaccgccgggatggccatgctggtgacccagatcgccaccgccgccgcggccctggcctggatgttcgccgagtggatcacccacggcaagccgagcgccctgggcatcgcgtccggcgtggtcgccggtctggtggccatcaccccggccgccggcaccgccggtccgatgggcgcgctggtgatcggcctggcctccggggtgatctgtttcttcgccgccaccagtctcaagcgcgcgctgaaatacgacgattccctcgacgccttcggcgtacatgcggtcggcggtatcgtcggcgcgctgctcaccgggatcttcgcggcgccgtcgctgggcggcttcggcagcgtggaggacatcggcgcgcagttcttcgtgcagttcaagggcgtggccttcaccgtggtctacaccgccgtggtgaccttcgtgatcctcaaggtgctggacctggtcatgggcctgcgggtcaccgaggaagaggaagcggtcggcctcgacctggcgctgcacaacgagcgcggctacaacctgtaatacctgccgacgcccggctttccgccgggcgtcggtttgcctcccgcgctcgccttcgccgaacgccatgcccttgtgcgtcgaaagtcctgggcgcttcccgcgactgccaccacctttccgcaaccggtctttcagtgactgccagcggactgcgccaccatcagctttcacaggtctgcctcttacgctctttgctttttcaaatgccgcgctag

SEQ ID NO: 7286 - DNA, 468 bp, Pseudomonas aeruginosa
aatgcgcggcgcgacggatcggagccgatttggaacagcagcatgtggcagcagaccctgatcaccttgcgcccgcgtccgcggggctttcacctcgtcaccgaggagatactcgacgccttgccggagcttcggcagtgccgggtcggcctgctgcacctgcttttgcaacatacgtcggcttcactgaccctgaatgaaaatgccgatcctgccgtacgccgggatttcgagcgttttttcgagcggctggcgccacgcggcgaagtcggctatgaacacaacgacgaaggtccggacgaccttccggcgcatttcaaggccagcctgctgggctgccaactgaccctgccgatacagtcgggagggttggcactgggcacctggcaggggatctatctcggtgaacaccgggacaggggcggggcacggcgcgtgctcgccacctggcagggcgagtcagtatga

SEQ ID NO: 7287 - DNA, 492 bp, Pseudomonas aeruginosa
gacggtggcgcagcatcggctcgcgatccagcaggcgggtgcggatcgcccacaagtgctcgatgggtaccggacccaggcgcgccgcgttgctcgccagccattcgcggagcagggccctcggcgttgttcatcaccggggcgacgtcccacagggtgtcgtcgaggtcgaaggtgatcagtcgcaggctgctcatgggtcgttgcctccatcggcgttgcccttgcgcttggcgcggggatgggcgcggtcgtagaccgaggccaggtgctggaagtccaggtgggtatagatctgggtcgtggcgatgtcggcgtggccgagcagttcctgcacggcgcgcaggtcgccggacgactccagcagatggctggcgaaggagtgccgcagcatgtgcgggtgcaggtgctggcccagctcgcggacgccggcctggcgcacccgcagctggatcgcccgcggcgtcaggcgcttgccgccgcgaccgatga

SEQ ID NO: 7288 - DNA, 468 bp, Pseudomonas aeruginosa
agtcatcctccacggcaccgtcgagcaattgcagggcgcggtcggcgtcgagggtcctgggcagcttgcgcggactcttcggcgcgctcaggccgttggcagggtcgtgccggcagcgcccttcgcgtagcaggtactggtagaggccgcgcgtcgccgagagcagccgtgccaggctgcggctggactggccctgctggtgcaggcgggcgacgaaggtgcgcaggctgcgggtgtcgagggcgttccagtcggagagcccggccttttcggcgagggcgaggatcttcagcaggtcgcggcggtagccgtcgagggtgtgcgcggagacctggcgctcgctgcgcagatgttcgaggaaggcatccaggtcggcgcgcatctcggaccgcccgccgcgctcagcggaccgagcgcagcggcgaggagaaacgcggcagcacgcgggccaggacctcggcgacgtag

SEQ ID NO: 7289 - DNA, 498 bp, Pseudomonas aeruginosa
gcggccacctgctcggcgtccagcgctgctgtcggttcctggcttttctcggtcataagcgtctcggttctcgcgggcgacggcccttacaggcggacctggccttcatacacgcggacggcaggcccggtcatcataacgggctggccgggacctgcccactcgatgtgcaggcggccgccggggaggtcgatctgcaccggcgattgcagccagccctggcgaatcccggcaaccgccgcggcgcaggcgccggtgccgcaggcttgggtctcgccgacgccgcgctcccagacgcgcaggcgcgcatggtgcggatcgagcacctggaggaagccgatgttggccttcttcgggaagcgcggatggacttccagttgcggaccgaggctgtgtaccggtgcgctgtcgacgttctcgacgcgcagcacgccatggggattgcccatggataccgcggccagttcgacgcgctggccattcacctctatctcatag

SEQ ID NO: 7290 - DNA, 1593 bp, Pseudomonas aeruginosa
cggaagtcgacgtcggggctgctcggggcttcgacgatcagcaactggtcgaagccgattccggtgttgcggtcgccccagagcttgacgtgcttgggctgcacatgggcgtgctggctgaccaggtcgaggaccatgaagtcgttgcccaggccatgcatcttggtgaagcgcaaaagcatggtctgggcctcactgcggcagcaggctttcgccggcgtagagctcttggacggtctcgcggcgacggacctcgtgggtctgctcgccatccaccagcacctccgcggcgcggccgcgggtgttgtagttcgagctcatgacgaagccgtaggcgccggccgagcgcaccgccaggaggtcgccttcggcgagcgccaggtcgcgatccttggcgaggaagtcaccggtctcgcagatcggcccgaccaggtcgtagcggcgcggcgcggcgtcgcgcgggcgtaccgcctgcacgtccatccaggcctggtagagagccgggcggatcaggtcgttcatcgccgcgtcgacgatggcgaaatccttgtgctcggtgtgcttgaggtactcgacacgggtcagcagcacgccggcgttggcgacgatggaccggcccggctcgaacaccagggtcaggtcgcggccgtgcaggcgctcgcggatggcgcggatgtagtcgccggccagcggcggctgttcgtcgcggtagcgcaccccgaggccaccaccgaggtccaggtggcgaatgccgatgcctttgccggccaggcggtcgaccagcccgagcaggcgctcgagggcgtcgaggaagggctccagctgggtcaactgcgagccgatgtggcagtcgacgccgatcacctccaggtggtcaagctcggcggcgcgggcgtagaccgcctcggcctcgtcgatggcgatgccgaacttgttctctttcaggccggtggagatataggggtgggtctgggcgtccacgtccgggttgacccgcagcgataccggcgctttcacgccgagttccgcagctacccgttgcaggcgctccagctcttcgccggactcgacgttgaagcagtgcacgccgacttccagggcgcggcgcatgtcgtcgcgggtcttgccgacgccggagaacaccaccttggccggatcgccgccggcggccaggacacgctccagctcaccgcgggaaacgatgtcgaaaccggcgccgaggcgcgccagcacattcagcaccccgaggttggagttggccttgaccgcgaagcagaccagatgcggcatgccggcgagggcatcggcataggcgcggtactgggcctcgatgtgtgcgcgggaatagacgtaggtgggcgtgccgaaacgctcggcgatgcgggaaagcgccaccccttccgcgaacagctcaccgtcgcggtaactgaatgtgtccatgggcgctctctcagaaaccgtagcggtctttgctgtgttctttcttggctttttcgtcgtccggcaggtacagcgggcctttctggccgcaggcggcgatggagccggcgaggagggcgagcgcgacgaaggacaggaacagccgcttcatga

SEQ ID NO: 7291 - DNA, 504 bp, Pseudomonas aeruginosa
tgtccgggaaaaccccgccttcgggcggggtttttgcttttttgcgattcctgcttttcatcgatcaaccgaaccggaccaaggagcacgcctgcgatcatgagcacgccgccgatcaccatcactcgtctggacctgcagcgcctggagcgcctgctggatggcctggacgaattcggacccgccgccgaggcgctggaggccgaactgtcgcgcgcccaggtggtggggcatgacgagattccgccgggcgtcgtgaccatgaactccaccgtgcgctgccgcgaggaaagcagcggcaaggagtacaccctgaccctggtctatcccgaagacgtcgccggcgaaggcaaggtctcgatcctcgcgccggtgggcaccgcgctgctgggcctgaccatcggccagaccatcgactggccggcgccgagcggcaagacgctgaagctgaccctgctggaaatcgaataccagccggaagccgccggcgactacgcgcgctga

SEQ ID NO: 7292 - DNA, 1287 bp, Pseudomonas aeruginosa
gcaccggtgagtgtagttggactagggcgtagcgtcggcggcctggctccagccgtcgaggatcttctgatactcgccgctggcgaggatgcgctgcatgccgaggtcgaagcgttcgagcagatgctcggcctgcgggtggcggcgcgagaacgacaggtacagctccgggcggtggaccgtggccaccggctggaactggccttccagttcgggatgttcgctgaacaactggcgagccgtattgcggtaggccagggcgtagtcgacgcggccgcgctggagcatgaggaaaccgtagtagtccttgcgtaccgggatgcgcaccaggtcgtggcggcgatcgaagccgtcgccgtattcatagccgagggtcaccgcgactttccggccgctcagcgcctgctccgcatccaccggccgcgcttcgtcgcgtcgcgcccagagctggatctccgcgcggaacaacggatgccggggcagacggtagtcggcgaggatgtgcgggttcggcgaggtgttgaagcagccggcgatcaagcctttcagggccagcttcatgcagcgggagtaggggtagggattgagctggaccggcgtgtccgcagccctgaaggcggcccgcacgatgtccgcgctcatgccctggatgcggccgtccttgtaggcggtatagggataccagtcgtcttcggcgccgagcaccaggggttctgtcgggacggccgctgccgggccggaaagggccagcagcaggcagatgggcaggaagtggaaccaggatcgcatccggtatcgctccgcgaaagcaggtggcacggagagtgggcgccacctttctaccagagcggcaggcgtttggcgaaacaaaaccgtatggatacgaggggcattcgccggcaccagtcggcccggctccgctcattcgtcgtccggcaacgtcggcagggcacgcagcgcatgctcgtagccggcgctgtcgaaagcgcggtcggcggcgagcatggcgttgatctcgtgggccagcacgtaggccatcatgcccagcgcctcgtcgcgctcgtagccgaccagggtcagcttgttgaacacagcgcgcgccgccggcggattctcgctttcgatctggttctcgatggcctggatcagtttttcctcggcgaagccgtcttcctggttgtcgtcctgttcgctcatcgggcgttcctcgttctggcgcaaagtaccgcttgtgcggcggcgggaagttgtccaccctgcttggccaacggatggccgcgaaggtag

SEQ ID NO: 7293 - DNA, 570 bp, Pseudomonas aeruginosa
ctgccgcaccaggacatgtcgtcccggctaccactgacaaggaatgcatccatggcaacccccgcctatatgtccatcaccggcaccaagcagggcctgatcaccgccggcgccttcaccgaggattcggtcggcaacacctaccaggaaggccacgaggaccaggtgatggtccagggcttcaaccacgaagtgatcatcccgcgcgacccgcagtccggccagccgaccggccagcgcgtgcacaagccggtggtcatcaccaaggtcttcgacaaggcctcgccgctgctgctggccgccctgacctccggcgagcgcctgaccaaggtcgagatccagtggtaccgcacctccgccgccggcacccaggagcactactacaccaccgtcctggaagacgcgatcatcgtcgacatcaaggactacatgcacaactgccaggacccgggcaacgcccacttcacccacctggaagacgtgcacttcacctaccgcaagatcacctggacccacgaagtctccggcacctccggctccgacgactggcgctccccggtcgccggctga

SEQ ID NO: 7294 - DNA, 717 bp, Pseudomonas aeruginosa
gggacaacggatgttcgcagcagccaaccagacccatttcagcctcgccatcgacggcctcgccctcgacctgcaggtgctctccttcagcggccgcgaagccatcagtcagccgttcgccttcgacctggagctggtcggcgaacgccccgtgccggacctcgaaagcctgctgcacaaacccgccttccttaccctcgggcccgccggcaacggtatccacggcctggtgcgcagcgccggacagggcgactcgggcaagcgcctgacccgctaccgcatcaccctcgtcccgcaactggcctacctcgcccagcgcaccaaccagcgcatcttccagcacctcacggtgccgcagatcgtcggtcgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccgggcggcggtcaagccgcttcggcgtacgcctggaaacccgcaccagccgcgtcacccgccgcgactacgacttcgagaaaccgcgcctga

SEQ ID NO: 7295 - DNA, 783 bp, Pseudomonas aeruginosa
agcgcaacgcgcccttctgcgaagagtgcgagaagtgcaaggacggtgcctgtgacctctgacgccctctccccgcgaacctggctggcccgacatccgcttcaggcaggcgaatgcttgtacgcgatcttcggcagcgccagcgatgccgcgcccctgcaagcctactaccgggaagacagcccacccctaccgctccctctctggaacggtacgccatatgccgactggcaaccggtgatgccctacctcgcgaagctgtcccccagcagcgtattcctcgattgggctgccagcgaaaagtctcgcgactggggttggctggcagtttccacctggtcgacagacgcaatcctagagcacctacgcagcctcacccaggtacgcatgccggatggcagcgaagtgttcttccgtttctgggacggccgtcacctgctaccgatactcgcccacctcggcgagaaagcgcacgaagtactgccgatgttcggccgttacctgatcaatggcaaagcactcgaaaccggccagggccatctccatgccgcccgtccctacccctggtgggaggttccgcgggcactggtcgacacgctgcatgccgacgacccgactaccgctatcgacaacctgctgcagtggctgcgcgagaaccacgcagatctgtacttcgcctatcccgagcgaagcctgcaattgcgcgccagacgcctcatcgcgaaagccgtcgccatggatgagatcggcggcctgttgttgaacaaggacctgaccccatga

SEQ ID NO: 7296 - DNA, 609 bp, Pseudomonas aeruginosa
tcgaagccggaaacgcactctacgaggccgaacgctatcgctacgacgcgcgcaatgtcatcctcgagcgccagttggccggcggcgcctcgttcttctgggaatgggaaggcgaaggcaagcaggcccgcgcggtccatcactgggccagcttcccgcagatggactcgcgctacgtctggaacgaagacggcagcgttaccgcgatcaacgccgacggcagcgaggaagtctatgtccacgacgacaacgcgcgcctggtacgccaggtcgatcccgacggaggcgaaaccctcaggcactacgacgagaagggccaactggtcgccgaacgcgatccgttgggaacgatcaccgagtaccgctacgaccaggccggacgcttggaggcactgctcccggccgaaggcgagccaacctgctatagctacttcgacggcttcgtgcgcagcgtgcgccgcggcgaggcgcagtggaagtacgagcgcaacgctcagggcgacatcacccgccagaccgatcccgaaggcaacgtcacccactacgcctacgaccaccgcggctgcctggtggaaatcacccatgccgacggcagcctgcaccagttga

SEQ ID NO: 7297 - DNA, 267 bp, Pseudomonas aeruginosa
tcggcgtcagcctgccggacgggcgccaggtcgtctaccgctacgacgccttcggccgacgcatcgccaagcaggtcgacgggcgcaataccgagttcctctggctcggcgaacgcctgctcgccgagagcggcgaccggcactaccgcacctatctctacgaacccgacagcttccgcccgctggccctgctcgacggcgaaggcccggaacaggtcgaaccctgctactaccaactcgaccacctcggtaccccgcaggaactga

SEQ ID NO: 7298 - DNA, 420 bp, Pseudomonas aeruginosa
tcggcagcgccaccgccgacgacgacaagcgcaaacgcctcctcggcctcaccgccgagggcgtgcggttggaaaaggcgctgcgtcgcgagcagtcgcggctgctccaacgctgcttcgaggaagccggcggcgaagcggtctccggctggctggcggtcaatcgcaccctggctcgggcgcatgcaggcagccgcggcgaagcggcgacggaggccgccgactgacgccccatgggcctggcgcatggacgctcgacaagccgaccggctgcccgctagctccgctccaactcccgcgccgcgcgccagcaggccagcgccatggccacggtggctgccagcagcggcagtaccgccagcaccagcaacagcaccgaagccagcatcgcgccgccggcgatgtccagccaggccatga

SEQ ID NO: 7299 - DNA, 1578 bp, Pseudomonas aeruginosa
gcaccatcagcaccacgccgccggctatcgaggccaggcagagccaggcgaggatgcgcagttgcgcgggcgtccagcgccggcggaaagcatccggtatgccctgctcgaccaattcgacacgcggcgtggcgtaggggtttgcatccatggcgaagctcctcggcaaatgccgggaagttaccagctccgccagcttccggcagctgcgactgtatggccaactatgtccgcggctgtaccgggacagcccctggccggctgtttaggctgcgcaaaacagaaaaagatgatcggcactccgcgcctcgcgcaacctgccccgtggctccgcccaccgccgtgcccggtcgtcccgcacactccatggaagtacccggcatgaccgaaaccacccagccccagcctcgtctgcgtccgttcgccgactcctctcccgccgccgtggtggccggcttcgtcgccatgctcaccggctacaccagctcgctggtactgatgttacaggccgggcagaacgccggtctcagcagcgcgcagatttcctggtggatctgggccctgtcgatcggcatgggcctggcgaccatcggcctgaccctgcgctaccgggtgccgatcgtgatcgcctggtccacccccggcgcggcgctgctgatcagcagcctgcccggagtgccgtacagcgaggcgatcggcgccttcatcgtctgcgccctcctgatcaccctgtgcggcgtcaccggcagcttcgaacgcctgatgcgccaggttccctcctcgctggcctcggcgctgctggccggggtgctgttccgcatcggcatcgagatctgcaacgccgccgagcaacagaccctgctggtgctggcgatgttcttcagctatctgctgtgcaaacgcttctcgccgcgctatgcggtgttcgctgcgctactggtgggggtgctgctggccgggatactgggccaactggacttcagcaggttccgcctggaactggcggtaccggagtggaccacgccgagcttctccctggccgccaccatcagcatcggcatcccgctgttcatcgtcgccatggcttcgcagaacatgcccggcatcgccgtgctgcacgccgacggctaccaggtgccagcctcgccgctgatctcgagtaccggcatcgcctcgatcctgctggcaccgttcggctcccacgggatcaacctggcggcgatcagcgcggcgatctgcaccggtccctcggcccacgaggacccgcacaagcgctataccgcggcgctctggtgcggcttcttcaactgcgtcgcaggaaccttcggcgccaccctggcagcgttgttcgcggcgttccccaaggcactggtactgtccatcgccgccatcgccctgctcggctcgatcatgaacggcctggccaactcgatggccgacgagcgccagcgcgaggccgcgctggtgaccttcatggtaaccgcctccggcttcaccctgctgtccatcggctcggcgttctggggcctggtggccggcctgctgactcagttcgtgctcaactggcggcgcggctga

SEQ ID NO: 7300 - DNA, 1008 bp, Pseudomonas aeruginosa
ccgacctcagtccggcgccgtcacgggcgccggcgtggcctggtggccacggctgacccaccagccgaaggccgccgcggtgaagaacatcagcactccgtagatcgccggcggaatcgccatggtgctgttgttcagcaggctcggactcagcgccagggcgatcgccagggtgccgttgtggatgccgatctccatgccgatggccaccgcctgggccttcggcaggcgcagcaggcgcggcacccagtagcccaccgccaggctcagcaggttgaaggccagcgcggccagcccgaccaccggcgcgtaggtgacgaaggtctgccagtccttggccagcgccagcaggatgatcaccagcaacagcagcgcggaaaggatcttcaccggcttctgcaggcgatccgccacggccggcaggcggttgcgcaccagcatgccgatggccaccgggccgaggacgatgacgaagacctgcacgaccttgccgaactgcaggggaatcgcctgcccgtcgcccatgaagtattgcagcgacagattgacgatcagcggcatggtgaggatggcgatcaccgagttcaccgcggtcagggtgatgttcagtgccacgtcgccatgcgccaggtggctgtagaggttggcggtggtgccgccgggcgaggccgccagcaacatcatgccgaccgccagggccgcctccagggcgaagccctggacgatcaggaaacaggccaggggcagcaggacgatctggcacaccaggccgaccagcaccggcttcgggtagcgcaccacgcggaggaagtcggccggggtcagggacagtccgagaccgagcatgatgatgcccagtgcgatggggaggaacagggtcaggatgggatcggcggtcattattgttattgctccgatgcgatggagacgggctcaggccccggattctcgacccaggttagtcccccggcagtggcctggcgcgccaaaccgcgtgccgacctgtaa

SEQ ID NO: 7301 - DNA, 402 bp, Pseudomonas aeruginosa
gccgccgcgcaaccctctaccagcgccttgacctcggcgtcgcgggtgacgtcgcagcgaatgaagagggcttcgccacctgcctggcggatcgcttcgaccgtgccctcgccgccggcgctgtccaggtcggcgaccaccaccttgaccccggcggcggcgaaggccagcgcggtagcgcggccgatgcccgccgcaccgccagtgaccagtgcgacctggccggaaagaagtttgctcatctgctgctcctcggaaaatcgccttccgccaaccgcgacggaaccgggccgcgccagtctagccagggccggcgcaaggcatagcactatcaggggactggaggatgggccatccagcccgctgataagactgatggcggcgaatcatcggcatagatga

SEQ ID NO: 7302 - DNA, 531 bp, Pseudomonas aeruginosa
ccggtcatttccgcactcgccttcgcttgccgccggcgccggcgccggctatccctaggggcctgtttcccgacattcgagtgccctgccatgacctcccagatcaatcggcaataccagttggcccagcgtcccagcgggctgcccggccgcgacaccttcagtttcgtcgagaccccgctcggcgagccggccgagggccagatcctggtgaagaacgagtacctgtcgctggacccggcgatgcgcggctggatgaacgacgcccgctcctacatcccgccggtggggatcggcgaggtgatgcgcgcgctcggcgtcggcaaggtgctggtttcgaagcaccccggcttccaggccggcgactacgtcaacggcgccctcggcgtgcaagactatttcgtccgggaacccaatggtttctacaaggtcgaaccgtccccgcgcgccgctgccacgctatctctcggcgctgggcatgaccggcatgaccgcctacttcgcgttgctcgacgtcggccagccaaataa

SEQ ID NO: 7303 - DNA, 627 bp, Pseudomonas aeruginosa
cagggagaccgtggtgatctccggcgccgccggtgcggtgggcagcgttgccgggcagatcgccaggctcaagggctgccgggtggtgggcatcgccggcggcgccgagaaatgtcgcttcctggtcgaagaactgggcttcgacggcgccatcgactacaagaacgaagacctcgccgccggactcaagcgcgaatgcccgaagggtatcgatgtgttcttcgacaacgtcggcggcgaaatcctcgacacagtgctcacccgcatcgccttcaaggcacgcatcgtcctctgcggggcgatcagccagtacaacaacaaggaagcggtgcgcggcccggccaactacctgtcgctgctggtcaatcgggcgcgcatggaaggcatggtggtgatggactatgcccagcgcttcccagaaggcctgaaggagatggccacctggctggcggaaggcaagctgcaatcgcgcgaggacatcgtcgaaggcctggagacctttcccgaaacgctgctcaagctgttcagcggggaaaacttcggcaagttggtgttgaaggtctgaggtccgccgccggcgcgaagaagcggcggatagcgcctcgcctcgaagagcgtgtgcactga

SEQ ID NO: 7304 - DNA, 1572 bp, Pseudomonas aeruginosa
ttcgcggcccagctccgccagttgttcgctggacgaagccgtcgactgcatggcttgggccgactgatcggccacctcgcggatcgccgtgacgctgcggttgatctcctcggcgaccgcgctctgctgctcggaggccgcggcgatctgctggttcatctgctggatcagcgccaccgccgtggcgatgttgcccagcgccgcctcggtctgcaacgcgtcgtcgacgctctggtccaccaactggtggctgcgctgcatacgctgcaccgcctgctgcgtgccattctgcaaggcaccgatcagggtctcgatctcggccgtggactgttgggtgcgccgcgccagcgcccgcacctcgtcggcgaccacggcgaagcctcgaccctggtcgccggcccgcgccgcctcgatggcggcgttcagcgccagcaggttggtctgctcggccacgctcttgatcacgtccagcacgctgccgatgcgctggctgtcggcgctcagcgcctcgacgctggcggtggccgcgcgcaccgcctcggccagtcgctcgatccgctccagggtctggcgtaccacctcctggccgacgctgaccttgccgtcggcgctttccgccgcccccgcggcttcctcggcgttgtgcgccacttcatggacggtggcggccatctggttcatcgccgtggccacctgttcggtttccgcccgctggctgtcgattcccaggcgggtgcgcgtggtaacgccggacagcgcctcggaagcgccggcaatccgcccgacgccgtcctgcaactggctgacgataccgcgcaggctgccggtcatggcgcgcatcgcggccatcagttggccaacctcgtcgcgccgctcgctgtcgacccgtaccgcaaggtcgccttcggcgatccggtgcgccacacccatcgcctggcgcagcggacggacgatcagcaggctgatgccgaaggccgcgcccaggcccaccagcagcgccagcacggcggcgccgacgatcagcagggagtttgtccgcaggctgtggagcatggcctgctgctgcgcctcccagctacggtcaacacgcgccatcacctgcccggcgcgctcgcccatggcggcgtacatctgccgctcctggagctgactggcgcggtactcggcgagcttgtcggcgaaaccgcggatattggtcagcacgtccttgaccaccgacacgtaggcatcgtcggtgatcgcctgctccagccgggctgccagctccagcgcctcgcgcagcgatttcggcggcccctcctgcgcatccgcggcgcgcgcttcgagacgcgagcgggcctcgtccagcccctgaaggaccaggcgattgacctgggcgacctgggccgcctgctgcaacagcggctcgccgtcgtgcccctggctctccttcagcgcataggcgccatcctcggccaggctggactggaggatatcgaggctgttggcggcgccgttcagcgaccaactggcgctttcccaagccaattggcgtccctggatggactgctcgaagcggccgaacgcttctag

SEQ ID NO: 7305 - DNA, 519 bp, Pseudomonas aeruginosa
tggcacgataatggccaggagagatatgcgcaggtcgtttccaggatatccgggctgacgtcggtcgagcgcggagccatactgggcgccccatggaaaaaggagcttgccatgcgtcccgtatttccgctgttgctgtcgctgagtctgtgcgcccccgccctggccgactggagcggcccgatcgagcagccgctctggtcgttgccggcggcgccgggcctgtcgcgctggctgatcgtgcacaacctgtcgagcgcggcggccgacggcctgtaccacgtcgaggtcctggagcgccgtcagggccagcagccctggcagttccagcgcctggccgcgcacctggcgctgaccgaacaggcgctgcgcgcgagtatcgtggcgccgctgaaacgcggcggggtgtatccggaaagctaccagttcgcctatcgccagtggcaggaacgccaggccgcgggccaggcgccggtgtgccggcgcacggtcgacgagtgcctgcgggcgccggactga

SEQ ID NO: 7306 - DNA, 498 bp, Pseudomonas aeruginosa
agtccagttgcatggcggtctcgcggaaatcgacggaggggacgccgattatgccgcagccccgcagctctcgcgaccgtctgcgccgcggccctgcgccacctggaggcagcggctagacttgccctaccctcacccaggagccctgccatgaactatcgaggaagctgccactgcggaaccatcgcctacgaagtcgaaggcgacctcgaccaggtgatccagtgcaactgttcactgtgcagccggcgcggctggctgctgtggttcgtcccgcgcgaccgtctggcgctgaagacgccggccagcgcgatgcacacctacaccttcaacacccatcgcctgcagcatcacttctgccccacctgcggctgcgcgccgttcagcgaaggcataggcccggacggccaggcgatggccgcggtcaacgcgcgctgcctggaggacatcgacgccagcgcgctcccggtacagcactacgatggccgcaacgcctga

SEQ ID NO: 7307 - DNA, 1719 bp, Pseudomonas aeruginosa
agaaatcggtggtggagaccaccccgcgctcctcgtcgagggcgtagacagccgcgtcgtcgcgcgaggcgttgccgacccagagcttcggatcgaggttctgcgcgccgctgccggcgaggatcacctccagtaccttgggcgaaatcttgcagccgcagccggcgccgtggctgtactgggtcaggcggatcgcctcgctcatcggtgtactcccgtggatgtcggaaaagtgcccattctagcaaagccggcgccgccgccagaggaccgatcgccgcgcccggctcagcgcccggcgcgcgactcacggatatagaagcgcgccttctcggccttgctggtgcagccctcgtaggcctcgaactgctgctgggtcttggccccggtgagcagggtcagggccttcgagtagctgacggtgccggcgaaaccttcggccttggccaggtcgagttccttccaggccgcgtccaactggtcggcgcagttctcccggtaggcggtcttgccggcgcagccggccagggtcagggcaaggacgggcagaacgatccaggttttcatcgaacgatctccggacagggaaagggccgcgcatcgccgcgacgcacttggcggcggccgggcgacacgcgtatcgttttcgcttcgtcacgcagtattggcaaggggttgcagatgagcaaacaggtcgccctggtattgggctccggcggtgcgcgcggctacgcgcacatcggcgtgatcgaggaactcgaggcacgcggctatgagatcacctgcatcgccggttgttccatgggctcggtgatcggcggcatctacgccgccggcaagctgcgcgagtaccgcgagtgggtggaaagcctggattacctcgacgtgctgcgcctgctcgacgtcagcttccgcctcggcgcgatccgcggcgagcgggtgttcggcaagatccacgagatcctcggcgaggtaaacatcgaggacctgtcgattccctacacggcggttgccaccgacctcaccaaccagcaggaaatctggttccaggaaggctgcctgcaccaggccatgcgcgcctcggcggcaatccccagcctgttcacaccggtcatgcagggcagccgcatgctggtcgacggcggcctgctcaacccgttgccgatcgtgccggtggtgtcggcccacagcgacctgatcatcgcggtcaatctcaacgccaccaaccagaagcagtaccacctgccggtgatcgagcgtccggccgcgctcaaggggcgcttcgacagcatgatcgagagcctcggccacaaactctcgttcttccgccgccacggcgacgacaataccccgccggagctgagcgccgacgccctgctccatccggttccggcggaatccgaggagcccgccgagccgcaactgcaacagccggccgcggcgccgcaaggcaaggactcgccgaagtcggccagcggcaccacggtggtggaaagcagcggtccggcatcactgctggaactggtcaaccagagcttcgaggtgatgcagacctcgctggcgcagtacaagatcgccggctacccgccggacatcctgatcaacgtgccgaagcgggtctgccgcttcttcgagttctacaaggcgccggagttgatcgccctcggccggcagatcgccagcgacaccctggaccgctacgaggaagacaacgcctga

SEQ ID NO: 7308 - DNA, 693 bp, Pseudomonas aeruginosa
tcagcgcctgttcgatcagcgccgcatgcacgtagagcaacggcaggtcgttggccacgatcgcctgcacccggtacggcgccagcaccgcgcgcaggcggttcagcgcgctgccgacgatgtcgcccggcgccacccagtcgcgcgccagcttcaggccaccgtggccgagacgggtcatgtcgagcaggttctggatatagcggtccagtcgctcggcctcgtcgcgggtgctttccagcagttcgcgacgatccgccggcgggatcgcctcgcccagcgccagcaggctgtcgatggaaccgcgcatggccgtcagcggcgtgcgcaggtcgtgggacaccgaggcgagcaaggcgctgcgcagttgctcggtctcgccgtgcaggcgcgcggcctccaggtcctcggccaggcgcgcacgggccagggcctgggccaggggctggccgagggcagcgagcaggcgccggcgctgcgggctcagcggctggccgtccagcggcgcgacgccgagcagtgccagcggtccctcttccgccgacagcggccaccaccaccagcgtcctccgggcagcgtgccagtaccgaggccggccggctggtcgtgggcccaggcccagtccgcggcgacccgttcctggtcggcgagttgccgctgcacgccggcctcggtcttccactcgccattga

SEQ ID NO: 7309 - DNA, 402 bp, Pseudomonas aeruginosa
tctccaggccctggccgtcgcgcagcagacgcccggcgagaccaccgccgaaggcccggcggtaccagcggcgccgcgactggccaaccaggaccaggctggcgcggcgctcgcgggcatgttgcaggagggtccgcgccacctcgccggcgcgcagcacgacgatctcgccgccgagccgctcggccagttgctgcgcaccctgcaggcgcatccgcgcgtgctcgccgcgcaagccgccggtatcgacgtgtaccacgctccagggcaggtgccgacgttcggcgacccggcaggcgtggcgcaccaggcgttcggcctgttcgtcaccgtcgatgcccaccagcagccgcccgcgcaacgccggcgcttcctcgccgcgctggcggtagcggtggttga

SEQ ID NO: 7310 - DNA, 483 bp, Pseudomonas aeruginosa
ccgttgtgtagacgtcgattcccgccgccagcaactcctggatgtcctgccagcgcttggcgtggcggctgccgggaacgttgctatgggccagttcgtcgaccagggccagcgccggcgggtcggcgaggagaccgtcgaggtccatttcctgcagtttcatccctcgatactcgaggctgcgcagcggctgctgcggcacgcctgcgaggagggactcggtttccgcccgcgagtgggtctcgaccaccccggcgcgcagtttcacgccctggcgcaactgggcctgggcggcctgcagcatggcgaaggtcttgcccacccccggcgccgcgccgagaaagactttcaggcggccgcgcccgtcagcgggcaggtcggccagcagcgcgtcggcgcgtgcggtgtcggtcatggatcggtcgtaatccgttgctctgcgccccgcacggcggacgatcacaagtgatcaggacggggtag

SEQ ID NO: 7311 - DNA, 2817 bp, Pseudomonas aeruginosa
tcacttgtgatcgtccgccgtgcggggcgcagagcaacggattacgaccgatccatgaccgacaccgcacgcgccgacgcgctgctggccgacctgcccgctgacgggcgcggccgcctgaaagtctttctcggcgcggcgccgggggtgggcaagaccttcgccatgctgcaggccgcccaggcccagttgcgccagggcgtgaaactgcgcgccggggtggtcgagacccactcgcgggcggaaaccgagtccctcctcgcaggcgtgccgcagcagccgctgcgcagcctcgagtatcgagggatgaaactgcaggaaatggacctcgacggtctcctcgccgacccgccggcgctggccctggtcgacgaactggcccatagcaacgttcccggcagccgccacgccaagcgctggcaggacatccaggagttgctggcggcgggaatcgacgtctacacaacggtcaacgtccagcacctggagagcctcaacgaccaggtccgcgacatcaccggcgtgcaggtccgcgagacggtgccggactgggtgttgcaggaggcctacgagatcgtcctcatcgacctgccgccgcgcgagctgctggagcgcctgcgcgagggcaaggtctacgtgccggaacaggcgcgggcggcgatcgatgcgttcttctcgcagaccaacctcaccgcgctgcgtgaactggcgatgcagaccgccgccgcgcgggtcgacgccgacctcaaccaccgctaccgccagcgcggcgaggaagcgccggcgttgcgcgggcggctgctggtgggcatcgacggtgacgaacaggccgaacgcctggtgcgccacgcctgccgggtcgccgaacgtcggcacctgccctggagcgtggtacacgtcgataccggcggcttgcgcggcgagcacgcgcggatgcgcctgcagggtgcgcagcaactggccgagcggctcggcggcgagatcgtcgtgctgcgcgccggcgaggtggcgcggaccctcctgcaacatgcccgcgagcgccgcgccagcctggtcctggttggccagtcgcggcgccgctggtaccgccgggccttcggcggtggtctcgccgggcgtctgctgcgcgacggccagggcctggagatcagtgccctggacagcgaggccgacctgcgcccggcggaaccgcggccacgctatccggtggtgtggaacgactatctgctggcgctgctggcgaccgccctggccagcggcctggcctggatcgtggcgcacctgctggagctgccgaacatctccctggtgttcctgatggcggtgctgctggtggcagtgcgcaccagcctgatgccggcactgctgtgcgcggtggcgtcgttcctggcctatgacttcctgttcatcccgccgcatttttccttcgccatccatcgccacgaagacctgctgagcctggcgttcttcctgttcatggccggcctcaccggcaacctggcggcacgccagcggcgccagctggaggcgctgcgcgatacccaggaggaaaccagcctgctgctggagctgtcgcgcaagctcaccgccgccaccgaccgccaggcggtgctggccgccgccgcccagcagttcgacgactggaaggacgtcgaggtctgcctgctcggtcaggtcaatggcgagtggaagaccgaggccggcgtgcagcggcaactcgccgaccaggaacgggtcgccgcggactgggcctgggcccacgaccagccggccggcctcggtactggcacgctgcccggaggacgctggtggtggtggccgctgtcggcggaagagggaccgctggcactgctcggcgtcgcgccgctggacggccagccgctgagcccgcagcgccggcgcctgctcgctgccctcggccagcccctggcccaggccctggcccgtgcgcgcctggccgaggacctggaggccgcgcgcctgcacggcgagaccgagcaactgcgcagcgccttgctcgcctcggtgtcccacgacctgcgcacgccgctgacggccatgcgcggttccatcgacagcctgctggcgctgggcgaggcgatcccgccggcggatcgtcgcgaactgctggaaagcacccgcgacgaggccgagcgactggaccgctatatccagaacctgctcgacatgacccgtctcggccacggtggcctgaagctggcgcgcgactgggtggcgccgggcgacatcgtcggcagcgcgctgaaccgcctgcgcgcggtgctggcgccgtaccgggtgcaggcgatcgtggccaacgacctgccgttgctctacgtgcatgcggcgctgatcgaacaggcgctgatcaacgtgctggaaaatgccgcgcgcttctcgccgagccacggccggttgcgcatcgaggtcagccaggatgccgccgagctgcgtttcgcggtgagcgacgaggggccggggattcccgaggcccgagcgggagaagatcttcgacatgttgtacaccgctgcccgtggcgaccgcggtggccagggcaccggcctgggcctggcgatctgccagggcatgatcggcgcccacggcgggcgtatcagcgtcggcgaaggcctcgacggtcgcggcaccacgctggtcctgcacctgccgctgcatccgcagccggacctcgggcaactggagggcgacgaatgagcccggcgcacttgcctggcgcctgcgctcgcgctattcctgccgtttccgcgacgccgccgctggcctgtcgccgtgttcacctgccgtgccgagtgccatga

SEQ ID NO: 7312 - DNA, 1071 bp, Pseudomonas aeruginosa
aatgggcacttttccgacatccacgggagtacaccgatgagcgaggcgatccgcctgacccagtacagccacggcgccggctgcggctgcaagatttcgcccaaggtactggaggtgatcctcgccggcagcggcgcgcagaacctcgatccgaagctctgggtcggcaacgcctcgcgcgacgacgcggctgtctacgccctcgacgaggagcgcggggtggtctccaccaccgatttcttcatgccgatcgtcgacgaccccttcgatttcggccgtatcgccgcgaccaacgccatcagcgatatctacgccatgggcggcgacccgctgatggccatcgccatcctcggctggccggtcaacgtgctggccgcggaagtcgcccgcgaggtgatcgccggcggccgcaaggtttgcgaggaagccggcatcccgctggccggcggacactccatcgacgcccccgagccgatcttcggcctggccgtgaccggcgtggtggagaagcgcttcatgaaacgcaacgacaccgccgaggccggctgcaggctgtacctgaccaagccgctgggcatcggcatcctcaccactgccgagaagaaggccaggctgcgcgccgaggacgtcggcgtggcgcgtgactggatgtgcaccctgaacaggcccggcgcgcgcttcggccggttggcgggggtcaaggcgatgaccgacgtcaccggtttcggcctgctcggccacctggtggaaatggccgacggcagcaagctcaccgcacgcgtggagtacgccgcggtaccgcgcctggccagtgccgaatattacctggagcagggctgcgtgcctggcggcacactgcgcaacttcgacagctatggcgagcgcatcgcgccactgccggaagtgcagaagctgttgctttgcgatccgcagaccagcggcggcctgctggtggcggtggctccggaaggcgaggcggagttcctcgccgtggcggcggaactcggcctgcaactggcgccgatcggcgagctggtcgagcgacagagtctcgcggtacaggtgctgtaa

SEQ ID NO: 7313 - DNA, 594 bp, Pseudomonas aeruginosa
ccgctgcctccaggtggcgcagggccgcggcgcagacggtcgcgagagctgcggggctgcggcataatcggcgtcccctccgtcgatttccgcgagaccgccatgcaactggacttcaccaccatcgctcccgccgaggcctatcgctggttggcttccaccgtcaccccgcgaccgattgcctggggtctcgaccctgtccgccgagggcgccagcaacctggccccgttcagcttcttccaggtgatcagcgacgagccgccgaccctgatggtcaacgtcagcctgcgcgacgacggcagcctcaaggacaccctgcgcaacgtccaggccaccgggcagttggtgatccacctggtcggcgccgcccaggcagagaccatgaacgccacctccgcctggctgccccatggcgtgagcgagatcgagacggtcggcatccctaccgtgtccagcgtacgcgtggcgccgccgcggatcgccgcggcggcggtggccttcgagtgcgaggtggcggagatcaagccgtatccggcggagaaccccaattgccacctgatcttcgcccgcgtgctgctggcccatgtcgatga

SEQ ID NO: 7314 - DNA, 972 bp, Pseudomonas aeruginosa
cgacaggctcgacctggtcggtcgcctgggcggcagccactacagctatacccgcgacacgttcagcatgatccggcccaggtagccgggctcagtccggcgcccgcaggcactcgtcgaccgtgcgccggcacaccggcgcctggcccgcggcctggcgttcctgccactggcgataggcgaactggtagctttccggatacaccccgccgcgtttcagcggcgccacgatactcgcgcgcagcgcctgttcggtcagcgccaggtgcgcggccaggcgctggaactgccagggctgctggccctgacggcgctccaggacctcgacgtggtacaggccgtcggccgccgcgctcgacaggttgtgcacgatcagccagcgcgacaggcccggcgccgccggcaacgaccagagcggctgctcgatcgggccgctccagtcggccagggcgggggcgcacagactcagcgacagcaacagcggaaatacgggacgcatggcaagctcctttttccatggggcgcccagtatggctccgcgctcgaccgacgtcagcccggatatcctggaaacgacctgcgcatatctctcctggccattatcgtgccactaccttgcccggccgctcaggttcggcgaaaaacgcgcgacacagcgggaaatgcgcacgcagacggcgcgtcacgggggaggggagtcatgctggggttgctgcgcaggcgtatggccgatctcggcacggcgaagaaattggccatcggttttaccctggtcctgctattgaccgcgctggtggccgcgctcgcggtgctctcgctgcatgcgctggggcagcgcttcgcgcgcctgcaggagatgagcgcgatcaatcgcgacgtgctggaggttcgccaggccgagaaggaatttgccctgcacggggaaaagagcgacgccgagcgcttgcgccagcgcctggccgcgacccttga

SEQ ID NO: 7315 - DNA, 573 bp, Pseudomonas aeruginosa
acgggtgggccggctcaaggccgacggcgacgccgatcaggcgcttggcatggccgaggtggagcaggtgctggcggcatacctagaagcgttcggccgcttcgagcagtccatccagggacgccaattggcttgggaaagcgccagttggtcgctgaacggcgccgccaacagcctcgatatcctccagtccagcctggccgaggatggcgcctatgcgctgaaggagagccaggggcacgacggcgagccgctgttgcagcaggcggcccaggtcgcccaggtcaatcgcctggtccttcaggggctggacgaggcccgctcgcgtctcgaagcgcgcgccgcggatgcgcaggaggggccgccgaaatcgctgcgcgaggcgctggagctggcagcccggctggagcaggcgatcaccgacgatgcctacgtgtcggtggtcaaggacgtgctgaccaatatccgcggtttcgccgacaagctcgccgagtaccgcgccagtcagctccaggagcggcagatgtacgccgccatgggcgagcgcgccgggcaggtgatggcgcgtgttga

SEQ ID NO: 7316 - DNA, 729 bp, Pseudomonas aeruginosa
agtggcgcacaacgccgaggaagccgcgggggcggcggaaagcgccgacggcaaggtcagcgtcggccaggaggtggtacgccagaccctggagcggatcgagcgactggccgaggcggtgcgcgcggccaccgccagcgtcgaggcgctgagcgccgacagccagcgcatcggcagcgtgctggacgtgatcaagagcgtggccgagcagaccaacctgctggcgctgaacgccgccatcgaggcggcgcgggccggcgaccagggtcgaggcttcgccgtggtcgccgacgaggtgcgggcgctggcgcggcgcacccaacagtccacggccgagatcgagaccctgatcggtgccttgcagaatggcacgcagcaggcggtgcagcgtatgcagcgcagccaccagttggtggaccagagcgtcgacgacgcgttgcagaccgaggcggcgctgggcaacatcgccacggcggtggcgctgatccagcagatgaaccagcagatcgccgcggcctccgagcagcagagcgcggtcgccgaggagatcaaccgcagcgtcacggcgatccgcgaggtggccgatcagtcggcccaagccatgcagtcgacggcttcgtccagcgaacaactggcggagctgggccgcgaactacagggcatggtcaggcatttccgcttgtagccgcggcctgggcggcgagtctttcctgctggcgcagccagtag

SEQ ID NO: 7317 - DNA, 912 bp, Pseudomonas aeruginosa
tggagcaggctatcgagtccgggtacccagcgggcgagtggcatgcggctgattccttgcaggcgcggatgccgcagcttagcccgaaggacaggctgcaggattgccgggaatcattatttcttcagtgcacacgctcttcgaggcgaggcgctatccgccgcttcttcgcgccggcggcggacctcagaccttcaacaccaacttgccgaagttttccccgctgaacagcttgagcagcgtttcgggaaaggtctccaggccttcgacgatgtcctcgcgcgattgcagcttgccttccgccagccaggtggccatctccttcaggccttctgggaagcgctgggcatagtccatcaccaccatgccttccatgcgcgcccgattgaccagcagcgacaggtagttggccgggccgcgcaccgcttccttgttgttgtactggctgatcgccccgcagaggacgatgcgtgccttgaaggcgatgcgggtgagcactgtgtcgaggatttcgccgccgacgttgtcgaagaacacatcgatacccttcgggcattcgcgcttgagtccggcggcgaggtcttcgttcttgtagtcgatggcgccgtcgaagcccagttcttcgaccaggaagcgacatttctcggcgccgccggcgatgcccaccacccggcagcccttgagcctggcgatctgcccggcaacgctgcccaccgcaccggcggcgccggagatcaccacggtctccctgttatttggctggccgacgtcgagcaacgcgaagtaggcggtcatgccggtcatgcccagcgccgagagatagcgtggcagcggcgcgcggggacggttcgaccttgtagaaaccattgggttcccggacgaaatagtcttgcacgccgagggcgccgttga

SEQ ID NO: 7318 - DNA, 294 bp, Pseudomonas aeruginosa
tcgacaccgacatgttccgccgcgcctacgaggccgatccgcgcaaggccgagttcgccgccgcgatgcatccgctgggtcgggtcgggcgggtcgaggaaatcgccgccgcggtgctctacctgtgcagcgaccacgcgggcttcaccaccggtatcgccttgccggtggacggcggggcgacggcgatctgagcgggcggcgatacaaccgggatgccccggcgcggggcattcgcattctgttacaggtcggcacgcggtttggcgcgccaggccactgccgggggactaa

SEQ ID NO: 7319 - DNA, 978 bp, Pseudomonas aeruginosa
cctgggtcgagaatccggggcctgagcccgtctccatcgcatcggagcaataacaataatgaccgccgatcccatcctgaccctgttcctccccatcgcactgggcatcatcatgctcggtctcggactgtccctgaccccggccgacttcctccgcgtggtgcgctacccgaagccggtgctggtcggcctggtgtgccagatcgtcctgctgcccctggcctgtttcctgatcgtccagggcttcgccctggaggcggccctggcggtcggcatgatgttgctggcggcctcgcccggcggcaccaccgccaacctctacagccacctggcgcatggcgacgtggcactgaacatcaccctgaccgcggtgaactcggtgatcgccatcctcaccatgccgctgatcgtcaatctgtcgctgcaatacttcatgggcgacgggcaggcgattcccctgcagttcggcaaggtcgtgcaggtcttcgtcatcgtcctcggcccggtggccatcggcatgctggtgcgcaaccgcctgccggccgtggcggatcgcctgcagaagccggtgaagatcctttccgcgctgctgttgctggtgatcatcctgctggcgctggccaaggactggcagaccttcgtcacctacgcgccggtggtcgggctggccgcgctggccttcaacctgctgagcctggcggtgggctactgggtgccgcgcctgctgcgcctgccgaaggcccaggcggtggccatcggcatggagatcggcatccacaacggcaccctggcgatcgccctggcgctgagtccgagcctgctgaacaacagcaccatggcgattccgccggcgatctacggagtgctgatgttcttcaccgcggcggccttcggctggtgggtcagccgtggccaccaggccacgccggcgcccgtgacggcgccggactgaggtcggtcagccgcgccgccagttga

SEQ ID NO: 7320 - DNA, 750 bp, Pseudomonas aeruginosa
acagccggccaggggctgtcccggtacagccgcggacatagttggccatacagtcgcagctgccggaagctggcggagctggtaacttcccggcatttgccgaggagcttcgccatggatgcaaacccctacgccacgccgcgtgtcgaattggtcgagcagggcataccggatgctttccgccggcgctggacgcccgcgcaactgcgcatcctcgcctggctctgcctggcctcgatagccggcggcgtggtgctgatggtgctcagcctgctggaggcattcggcgacggcgccgcgttcagggtctacgccgactggctgggcctgctcctcagcctgctcggcgcctacctgctgctgcggctcaagcacctggtcgagtcgcgctttcgcggcccctcgctggcctggccggtatggttgtcgattctcctgaccctgctgggcgagggctggagcctgctggcggttaccgacgatgcgctgcagggctggaactggcaggcgctggtgtacttcgcgctgcttgcgctgatcggcgctaccaccctctggctgggcctgcgtctgctcaagcaggaaaacctctatccgtcgctgcggatcatggcctggctggacatcgccggcggcgcgatgctggcttcggtgctgttgctggtgctggcggtactgccgctgctggcagccaccgtggccatggcgctggcctgctggcgcgcggcgcgggagttggagcggagctag

SEQ ID NO: 7321 - DNA, 750 bp, Pseudomonas aeruginosa
acttcagccacgtcgccccggagcgcctgcacgaaggcctgcggcgcctggccaaggtcgtccgcgacgcccaggccgccgaagcggcctgaaccctcatcggcgctcctccgagggcgccggccatccgatccgaggagcgacacgatgtacaaggtctacggtgattaccgttcgggcaactgctacaagatcaagctggccatgtcgctgctcggcatcgactaccagtgggtaccggtggacattctcaagggcgagacccagaccccggagttcctggcgaagaaccccaacggcaagataccggtgctggagctggaggacggcagttgcctgtgggagtccaacgccatcctcaacttcctcgccgacggcagcgccctgttgcccagcgaaccgcgcctgcgcacccaggtgctgcaatggcaattcttcgagcaatacagccatgagccctatgtggccgtggcgcgcttcatcaagctctacctcggcctcccggaagcccgccgcgccgagttcgaagagaagaagatcggcggctacaaggccatcgacgtcatggagaaacagctgtcgcgcacgccattcctggtcggcgaacagttctccatcgccgatatcaccctctacgcctacacccatgtcgcccatgaaggcggcttcgacctgacggcctacccggcgatccgcgcgtggatcaagcgagtgggggaggtgccggggtatgtggggatgctggattga

SEQ ID NO: 7322 - DNA, 681 bp, Pseudomonas aeruginosa
tcgacgtcgcccgtttcggccaggacgaacgcaaagactggaaagagtccggcggcgacggcaatacccagcacttcctgctgctcgacgagttctaccgtagcgcgatctggctcggcggacgcacccctctatggtggctggtgccgcaggcccatgaacggcgctacgacgaatactgccggaccctgctcggcaaacgcttcatccgcgccgaagaggtgctcgacctcggccacctggcgcacatccccgcccgggagttcatcggcgccggcctctggcagttgtccaaggccatcgattcgccctacaagtcgctgctcaagctgctgctcaccgaagcctacgccagcgagcacccgcgggtccgctgcgtcgccctgcgcttcaaggagcaggtattcgccggccagctcgatctcgacgaactggacccctacgtcctggtctatcgccatctcgaacgctacctgcgggaacagcaggcgccggaacgcctggaactcgtgcggcgctgcctgtacctcaaggtcgggcgcaagctcggcggtcgccagcgccaggcgcagaagggctggcagcacctgtcgatggagcggctcgtcgcggaatggcaatgggagcctcgccgcttggccctgctcgacagccgcagccagtggaagatgcgccaggtga

SEQ ID NO: 7323 - DNA, 777 bp, Pseudomonas aeruginosa
accaggcgctgctggaacaatgacccagcgccgcaccgcgcggggctcgacaaggacgtacggatggcactcctcggtattaccctgctcgctggcgccgcattcgtgggcggctatctctaccgccgcggcctggatcgccggcgctaccgcttcatccagcaattccgcctgccgccgcgggtcgcccaggcggtccgcgagcgctatccgcagctcagcgaggaacaggtccaacgggtgctcggcggcctacgcgaatacctgctgctatgccgcgccgccggcaagcggatggtcgcgatgccgtcccaggtggtggatgtcgcctggcacgaactgatcctgcatacccggctctaccagcacgtctgccgcaagggactcgggcgcttcctccaccatacgccggcccaggcgatgcgcagcccccgacaggcccaggagggcatccagcgcgcctggaagctggcctgccgccgcgagggcatcgacccactgaatcccacgcgcctaccgctgctgttcgccctcgacacggaactggcgatcgccgacggcttccgctacgccctgaactgcgcgcagcggcaagacggcggcgcagcggtgtattgcgccagccatatcggttgcagcagcggctgcgccagcgatagcggcagtaccttcggttcggacggacaggattcgcgccacggcagcggcggcgatagcggcggagacggcggcagcggttgcgggggtggaggatgcgggggcggtgggggcgactga

SEQ ID NO: 7324 - DNA, 426 bp, Pseudomonas aeruginosa
gggtcgcgaagcccgtcgccgaatggcgacgggcgaaaaccgatcagcgcgcgtagtcgccggcggcttccggctggtattcgatttccagcagggtcagcttcagcgtcttgccgctcggcgccggccagtcgatggtctggccgatggtcaggcccagcagcgcggtgcccaccggcgcgaggatcgagaccttgccttcgccggcgacgtcttcgggatagaccagggtcagggtgtactccttgccgctgctttcctcgcggcagcgcacggtggagttcatggtcacgacgcccggcggaatctcgtcatgccccaccacctgggcgcgcgacagttcggcctccagcgcctcggcggcgggtccgaattcgtccaggccatccagcaggcgctccaggcgctgcaggtccagacgagtga

SEQ ID NO: 7325 - DNA, 216 bp, Pseudomonas aeruginosa
tccggctcgcataggcaaggcgccggggggtcggtatactccggaacaattcacgttttatacaaggattccgtcatgaagcggctgttcctgtccttcgtcgcgctcgccctcctcgccggctccatcgccgcctgcggccagaaaggcccgctgtacctgccggacgacgaaaaagccaagaaagaacacagcaaagaccgctacggtttctga

SEQ ID NO: 7326 - DNA, 471 bp, Pseudomonas aeruginosa
ccacctggaggtgatcggcgtcgactgccacatcggctcgcagttgacccagctggagcccttcctcgacgccctcgagcgcctgctcgggctggtcgaccgcctggccggcaaaggcatcggcattcgccacctggacctcggtggtggcctcggggtgcgctaccgcgacgaacagccgccgctggccggcgactacatccgcgccatccgcgagcgcctgcacggccgcgacctgaccctggtgttcgagccgggccggtccatcgtcgccaacgccggcgtgctgctgacccgtgtcgagtacctcaagcacaccgagcacaaggatttcgccatcgtcgacgcggcgatgaacgacctgatccgcccggctctctaccaggcctggatggacgtgcaggcggtacgcccgcgcgacgccgcgccgcgccgctacgacctggtcgggccgatctgcgagaccggtga

SEQ ID NO: 7327 - DNA, 1083 bp, Pseudomonas aeruginosa
gtttccagggcctacacggcgtgctcgccatcggcagtcccgatccgcagcattacaagagttccctcggcaccctgttcctcggctacgtcgccgaggtcctggcccgcgtgctgccgcgtttctcctcgccgctgcgctcggtccgctgagcgcggcgggcggtccgagatgcgcgccgacctggatgccttcctcgaacatctgcgcagcgagcgccaggtctccgcgcacaccctcgacggctaccgccgcgacctgctgaagatcctcgccctcgccgaaaaggccgggctctccgactggaacgccctcgacacccgcagcctgcgcaccttcgtcgcccgcctgcaccagcagggccagtccagccgcagcctggcacggctgctctcggcgacgcgcggcctctaccagtacctgctacgcgaagggcgctgccggcacgaccctgccaacggcctgagcgcgccgaagagtccgcgcaagctgcccaggaccctcgacgccgaccgcgccctgcaattgctcgacggtgccgtggaggatgacttcatcgcccgccgcgaccaggccctgctggagctgttctattcctccgggctgcgcctctcggaactggtcggcctcgatctcgaatggctggacctcaaggaaggcctggtgcgagtgcgcggcaagggcaacaaggtccgcgagctgccggtcggcaaggccgcgcgccaggcgctcgaagcctggctgccgctgcgcgcccaggccgctccggaagacggtgcggtgttcatcggtcgcggcggcaagcgcctgacgccgcgggcgatccagctgcgggtgcgccaggccggcgtccgcgagctgggccagcacctgcacccgcacatgctgcggcactccttcgccagccatctgctggagtcgtccggcgacctgcgcgccgtgcaggaactgctcggccacgccgacatcgccacgacccagatctatacccacctggacttccagcacctggcctcggtctacgaccgcgcccatccccgcgccaagcgcaagggcaacgccgatggaggcaacgacccatga

SEQ ID NO: 7328 - DNA, 633 bp, Pseudomonas aeruginosa
acaacgccgagggccctgctccgcgaatggctggcgagcaacgcggcgcgcctgggtccggtacccatcgagcacttgtgggcgatccgcacccgcctgctggatcgcgagccgatgctgcgccaccgtctcagcgagctgcgccggcgcatcctgttccatgccctgctcgacgccggttatccacaggcggaggcggaaagcctggccgaggccggtttccaggtattcctcgaagcgcgccaccgggtcaccctgtttcccgaggtccacccgaccctggagatcctcgccgaccgcttcaccctcggcgtgctcaccaacggcaacgccgacgtgcgccgcctgggcctggccgactacttccggttcgccctctgcgccgaggaactgggcgtcggcaagcccgacccgacgccattccgcgaagccctgaagcgcgccggcgtcgaggcctcggcagcggtacacatcggcgaccaccccagcgacgacatcgccggagcgcgccgcgccggcatgcgtgccatctggttcaacccaagcggcaagccctgggccggggaggaagagccgagcgcggagatccgcagcctcgccgagctgccggccctgctcgcccgcctgcaatga

SEQ ID NO: 7329 - DNA, 597 bp, Pseudomonas aeruginosa
cacaaggcccgccatcccttgcgggaggcgggccttgggatggcgcgaaatcagatggggcggctgccgtacttgctgtccggcttcttcggcggatcggccaccacgttgggttcgatctcctgcacctttccaccgcgggaaaggaactcctccatcgccttggcgagggcgtcacgctctttctgcttggcttcgaccgagggcagctcctcttccaccacggcggctttcgccttcttcccgggggcgggggcctcgtcgccgtcgccgctgtccgcttcgccgtcgtcggccgcggccagctcttcgccgtcgtcctcgtcagcgccgtccagctcgtcctgttccagttcttcttcgctcatggtcaacctctcggtgctgcaaaagcaggttagttatagcccagccgcgcgttttgatgagcgccgccggaaaaaattcatactgactcgccctgccaggtggcgagcacgcgccgtgccccgcccctgtcccggtgttcaccgagatagatcccctgccaggtgcccagtgccaaccctcccgactgtatcggcagggtcagttggcagcccagcaggctggccttga

SEQ ID NO: 7330 - DNA, 1575 bp, Pseudomonas aeruginosa
tcagggtctgctgccacatgctgctgttccaaatcggctccgatccgtcgcgccgcgcattctagcgcggcatttgaaaaagcaaagagcgtaagaggcagacctgtgaaagctgatggtggcgcagtccgctggcagtcactgaaagaccggttgcggaaaggtggtggcagtcgcgggaagcgcccaggactttcgacgcacaagggcatggcgttcggcgaaggcgagcgcgggaggcaaaccgacgcccggcggaaagccgggcgtcggcaggtattacaggttgtagccgcgctcgttgtgcagcgccaggtcgaggccgaccgcttcctcttcctcggtgacccgcaggcccatgaccaggtccagcaccttgaggatcacgaaggtcaccacggcggtgtagaccacggtgaaggccacgcccttgaactgcacgaagaactgcgcgccgatgtcctccacgctgccgaagccgcccagcgacggcgccgcgaagatcccggtgagcagcgcgccgacgataccgccgaccgcatgtacgccgaaggcgtcgagggaatcgtcgtatttcagcgcgcgcttgagactggtggcggcgaagaaacagatcaccccggaggccaggccgatcaccagcgcgcccatcggaccggcggtgccggcggccggggtgatggccaccagaccggcgaccacgccggacgcgatgcccagggcgctcggcttgccgtgggtgatccactcggcgaacatccaggccagggccgcggcggcggtggcgatctgggtcaccagcatggccatcccggcggtgccgttggcggcggcggcggaaccggcgttgaaaccgaaccagccgatccacagcatggccgccccgaccaaggtgtagccgaggttgtgcggcgccatcggcgtggtcgggtagcccttgcgcttgcccagcaccaggcaggcgaccagaccggcgataccggcgttgatgtgcaccacggtgccgccggcgaagtccagcacgccccagtcccacatcagggcgccgtcaccgctccagaccatgtgcgcgatcggcgcgtagaccacggtgaaccagaccgccatgaagatcagcatcgccgagaacttcatgcgctcggcgaaggcgccgacgatcagcgccggagtgatgatcgcgaaggtcatctggaaggtgatgaacacgctttccgggaacagcgcggtggcggaagtcaggccgtcggcggtgagaccgctgaggaaggccttgtccagtccgccgacgaaggaattgaagttgaggacgcccttctccatcccggtggtatcgaacgccaggctgtagccatagaccacccagagaatggtgatcaggccggtgatggcgaagcactgcatcatgatcgacagcacgttcttcgctcgcaccatgccgccgtagaacagcgccaggccggggatggtcatgagcaggacgagcgcagtggagatcagcatccaggcggtgtcgccgctgttcaggacgggctcctcggcggccagggcgacgcccggcaaagcgagggacaatag

SEQ ID NO: 7331 - DNA, 576 bp, Pseudomonas aeruginosa
cggtgttcgccgtggaccacctgctggagatcgccggacacctctccggccaggccccgctgccgccctaccaggcccgcggcctgctccgcgcgcccttcccttatccagacctggccgaggtccagggccaggccgccgccaagcgcgccctgctggtggccgccgccggcgcgcacaacctgttgctcagcggcccgccgggcaccggcaagaccctcctggccagccgcctgcccggcctgctgccggcgctcgacgaggacgaagccctggaggtcgcggcgatccattcggtggccagccacgtccccctcaggcactggccgcagcgaccgttccgccagccgcaccactccgcctccgcgccggccctggtcggcggcggcagccgcccgcagccgggcgagatcaccctggcgcaccagggcgtgctgttcctcgacgaactgccggagttcgagcgcaaggtcctggaggtcctgcgcgagccgctggaaagcggcgagatcgtcattgcccgggccaacggccgggtacgtttcccggcgcgcttccaactggtggcggcgatga

SEQ ID NO: 7332 - DNA, 2079 bp, Pseudomonas aeruginosa
ggcttttcgaatcaaattagctatcacgatgtgttaggctgtttcgtcttccgccttcggcgggcaatccgatcacaaggagagctagcttacatggagacacccactaccccccggagcaccctgaatcctccggtcttctatacctccgccgccctgatcctggccctggtgctgttcaccgtgctcctccaggaagaagcgcaatcgctgttcaaccacgtccagcaatggatcatcaccaacgccagctggttctatgtactggccgtggcgctgatcctgatcagcgtggtgttcctcgccgtcagccgctacggcgacatcaagctcggccccgaccacagtcgtcccgactaccgcaacaccacctggttcgccatgctgttctccgccggcatgggcatcggcctgatgttcttcggcgttgccgaaccggtgatgcacttcaccaccccgccggtgggcgagccgaacaccgtgcaggcggcgaaggaagcgatgaagctgaccttcttccactggggcctgcatgcctgggcgatctacgccatcgtcgcgctgatcctggccttcttcagctatcgccacggcctgccgctgaccctgcgctcggcgctgtatccgctgatcggcgaacgtatctacggccccatcggccacgcggtggatatcttcgcgatcatcggcaccgtgttcggcgtggcgacttcgctcggctacggcgtgctgcagatcaacagcggcctgcaccacctgttcggctggccggtgaaccagaccgtgcagatcgccctgatcgccgccacctgcggcctcgccacgctctcggtggccagcggactggaccgcggcatccgcatcctgtccgaactgaacctgagcctggcggtgatcctgctgctcttcgtgctggtcctcgggccgaccgtgtttctcctgcagacctacgtgcagaacaccggggcctacctgtccgacatcgtcaacaagaccttcaacctgtacgcctacgagcccaccgattggatcggcggctggaccctgctgtactggggctggtggctgtcctggtcgcccttcgtcggcctgttcatcgcccgtatctcgcgcggccgcaccatccgcgagttcgtctgcggcgtgctgttcgtcccggccggcttcaccctgctgtggatgacggtgttcggcgataccgccatccacatggtcctgcaggagggcttcacccagttggccgaagtggtcaaccaggacagttcggtggcgctgttcgccttcctcgagcacttcccgctgggcagcgtgatctcgctggtggcggtgctgatggtggtggtgttcttcgtcacctcggccgactccggcgcgctggtggtggacatgctagcctccagcggcaaggaccactcgccgctctggcagcggatattctggtcggtgctgatgggcgtggtggccatcgccctgctcctcgccgatggcctcaaggcgctgcaaaccgcgaccatcgccagcgcgctgccattctccatcgtgctcctggcgtcgatctggggcctgttcaaggcgctgcacctggatgccaccaagcgcggcatccgctaccaggcgctgaccttctcccgccccaccacgcgcagcggcgcaagcgagggcgacggttggcagcgccgcctgcgcaacatcgccatgttcccaaggcgcagccacgtcaaccgcttcatcaccgatgtggcgcgaccggcctgcgaggacgtcgccgccgaactgcgcaagcagggctacgaagtccaggtgcaggacggcgaggacggccgggttcggctggaagtcagccacggcggcgaggtcgatttcatctacgaggtgcgtccgcgcgccttcaccacgccgagcttcgtgatgcgcgacaccgaggacagcagcgagtcgcgcaagtatttccgcgccgaggtccatctccaggaaggcggccaggactacgacatcatgggctggagccgcgacggcgtgatcggcgacatcctcgaccagtacgagcggcacatgcacttcctgcacgtggtgcgctga

SEQ ID NO: 7333 - DNA, 1488 bp, Pseudomonas aeruginosa
gccttactcatccatgtcctcgccatccctcgtcgaactcaaagccatcctgcgcctggcgggcccgttgatcgccgcccagctggcctatgtcgccatggtcttcaccgacaccgtgatgatgggcaagctcggccccgacgcgctggccgccggcggcctgggcgcggtcagctacgccttcgtctcgacgttctgtgtcggcgtggtggcagcggtcggcaacctggtggcgatccgtcacggctgcgacgacgccgctggcgccgccgcggccgctcgctccggactctgggtcggcgccgcgctggccctggccgccggcctgctgctatggaacctgcggccgctgctcctggtcttcggccaggcgccgcagacggtggacggcgccatgcagttcctccacagcctgacattcgccctgcccggctacatggccttcatggtcctgcgcggcttcaccagcgccatcgaccgcgccggcccggtgatggcgatcagcgtgctcggcgcgctggccaacctggctctcaactattccttcatagaaggcctgttcggcctgccgcgcctgggcctggccggtatcggcctggtcaccgccctcgtcatgaactgcatgccgctgctgctggccctgtatatccgcctgcagccggcctatgccgagtactcgctgctgcgcggactgggacggccgcagcgggcgatggtcgaggagatactgcgcctggggctgcccatcggtggcacctacgcggtggagtcggggatgttcacggtcgccaccctgtgcatgggcatcatcggcgatcacgccctggccgcgcaccagatcgccatccaggcggtatacgtggcgttcatggtgccggtggggttgtcgtacgccaccacctaccgcatcggccagcatttcggcgccggccgcctgctcgaagcacgccgcgccgggcgtgtcggcatcggcttcggcgcgctgtgcatgctgctcttcgccgggctcttctggtggatgccggaggccatcatcggcctgttcctcgaccgcgacgccccggccaaccgggaggtggccgcgatggccgtctcgctgctggcgatcgccgcctggttcgagctgttcgacggcacccagaacgtcgccatgggcgcgatccgcggtctcaaggacgcccgcaccaccttcctggtcggcctggcctgctactggctggtcggcgtgccgctggcctgcctgctggcgttcgcggccggctggggcgccgcgggcgtctggtgggggctggccggcggcctggcctgcgcggccattggcctgaccctggccttcgagtggaagaccgcgcggttgctgccgaaagccacggccagcgaggcgtcggcgctcaattgccgagcggctggccgcggtgcgccgagcgctcgcctatgcccaggaaacgcgccagttccgccaacggcagcggcggactgatccagtag

SEQ ID NO: 7334 - DNA, 2112 bp, Pseudomonas aeruginosa
acgatctcgggatcggtcacagcttgcacgctaattctcgcggatgccagccagcctgttagaatacgcccccgcttcaaccctctcttccggcctgttcctatgtcccgactcaatccccggcagcaagaagccgtgaactacgtcggcggtcccctgctggtcctggctggcgccggctccggcaagaccagcgtgatcacccgcaagatcgcctatctcgtccagcagtgcggtatccgcgcccagtacatcgtcgccgtgaccttcaccaacaaggccgcgcgggagatgaaggagcgcgtcggcaccctgctgcgcggcggcgagggcaagggcctgaccgtctcgaccttccacaacctcggcctgaacatcatccgcaaggaacacgaacggctcggctacaagcccggtttctcgatcttcgacgagtcggacatcaaggcgctgctgaccgacatcatgcagaaggagtattccggggacgacggcgtcgacgagatcaagaactacatcggcgcctggaagaacgacctgatccttccggaggaggcgctggaaaaggcccgcaaccccaaggagcagaccgccgcgatcgtctacctgcattaccagcgcaccctgcgcgcctacaacgcggtggacttcgacgacctgatcctgcaaccggtgaagctgttccaggaacatccggacgtcctccagaagtggcagaacaaggtgcgctacatgctggtggacgagtaccaggacaccaacgccagccagtacctgctggtcaagctgctggtgaaggaccgcgcccagttcaccgtggtcggcgacgacgatcagtcgatctacgcctggcgcggcgcgcgtccggaaaacctgatgcagctgaaggaagacttcccttcgctgaaggtggtgatgctggagcagaactaccgctccaccagccgcatcctcaagtgcgcgaacgtcctcatcgccaacaacccgcacgtattcgagaagcagttgtggagcgagatgggccacggcgatccgatccgggtgatccgctgccgcaacgaggacgccgaggccgagcgcatcgccatggaaatcctcaccctgcacctgcgcaccgagcggccgtacagcgagttcgccatcctctaccgtggcaaccaccaggccaagctgatggagctgaagctccagcaccaccagattccctatcggctctctggcggcaccagcttcttcgggcgccaggaagtgaaggacctgatgtcctacttccgcctgctggtgaaccccgacgacgacaacgccttcctcagggtgatcaacgtgccgcgccgggaaatcggttcggcgaccctggagaagctcggcaactacgccacccagcgcaagatctcgatgtacgccgcctgcgacgagatgggcctggccgagcacctcgacagccgtttccacgaacgcctgcaacgcttcaagcgctggatggacgatatccgccgacagtgcgcggagaacgagccgatcgccgtgctgcgcagcatggtgatggacatcgactacgagaactggctgcggcagaacgcctccagcgacaaggtcgccgaattccgcatgagcaacgtctggttcctcatcgaggcactgaagaacaccctcgagcgcgacgaggaaggcgacatgaccatcgagcaggccatcgccaagctggtcctgcgcgacatgctggagcgccagcaggaagaagaggaaggcgccgaaggcgtgcagatgatgaccctgcacgcgtcgaaggggctggagttcccctacgtgttcatcatgggcatggaggaagagatcctgccccaccgttccagcatcgaggccgacacggtggaagaggagcgccgcctggcctacgtcggcatcacccgcgcgcggcagaacctggcgatgaccttcgccgccaagcgcaagcaatacggcgagatcatcgactgctcgccgagccgcttcctcgacgaactgccccccgaagacctcgaatgggaaggcatggaagacgccccgcaagaggtcaaggcggccaagggcaacgccgccctcgccgacatccgcgccatgctcaagcgctga

SEQ ID NO: 7335 - DNA, 1737 bp, Pseudomonas aeruginosa
ctaacgaattccattcgaggacagcttcatgtcgagcaagaaagtcgccgagatcgtcgtggaaaccctggaagccgccggcgtccgccattgctatggcatcgtcggcgacaccctcaaccatgtcaccgacgccatccatcgcagccagatccagtgggtccacgtgcgccacgaagaagcggcggccttcgccgcgggcgccgagtcctacatcagcggacgcctgaccgcctgcgccggctcctgcggaccgggcagcctgcacttcatcaacggcgtctacgaggcccagcgcaaccgcgcgccgatggtgctgatcgccagccagatcgttaccccgcaactgggcatggagtttccccaggaggtcgacttcaaggcggtctacgccagctgctcggtgttctgcgagcaggtgcacagcccggaacaggcgcgccgggtggtggccctggcctgccaggcggcgctcaaccggcgcggcgtggcggtggtgatcctgccggccgacatcagccaggccacggtgaaggacgacctgccgttctcggtgcatttcccgcaaccggtgctgcgccccagcgacgccgaactgcaggacgtcgcccgcctgctggcccacggcaagaagatcggcatctacgccggctccggctgccagggcgcccacgacctgctggtggccctcgccgaccgcctcaaggcgcccatcgcgcacacgtcgcgggccaaggacttcgtcgagtacgacaaccccttcaacatgggcatgaccggtatgctcgggatcgagtccggcttccacatgatgaccgagtgcgacaccctcctgctgctcggcgccgacttcgcctgggcgcagttctatccgcagaaggccaccctgatccaggtcgaccgcgatggcagtcacctgggccgccgccaccccatcgatctcggcgtggtcggcgacgtgatccccagctcttgccgttgctcgaagcccgcgaggagcgcagcttcctcgacgaatgcctggagcaccgcgagcgctcgctgcggacgctggaaaaagaggagcaagccggcaagggcgagctgatccatccgcagcacctggtcagcctgctcgaccagcacgccagcgaggacgccctgttcaccgccgacggcggctcggcgatggtctggctgttgcgtcacatccacagcaacggcaagcgccgcaccctcaccagcctggtccacggcaccatggccaacgccatgccccaggcgctggggctgaagaaggcctaccccgagcgccaggtgatctcgatctccggcgacggcggcctggccatgctgctcggcgacctgctgacggccatccaggaaaaactgccgatcaaggtagtggtgctgaacaatgcctcgctgaacttcgtcgagctggaacagaaggtcgagggcctgctggacagctacaccgacctgctcaacccggacttcgcccgtctcgccgaagtgatcggcttccacggacgcaaggtgacgcgctccgaggagctcgagacggcggtgcaggagttcctcgcccagcccggtccggcgctgctggacgtgcataccaaccctgcggagctggtgatgccgccgaagatcgagttcggccaggtcgccgacaccgcgctctacgccgccaaggccgtgctcagcgggcgcttcaaggacgtcgagacgctactggtgaacaacctgctgaaatga

SEQ ID NO: 7336 - DNA, 1464 bp, Pseudomonas aeruginosa
ttcgacccggctgcccagcccggcctggggatggtcggtaaggtcgacggtgagcatgtccatcgatacccggccaaccaggcgccccggcttgccgtcgatgaacacaagggtgccgtcggcggcgtggcgcggatagccatcggcgtagcccatggcgaccacgccgatgcgctggctacgctcggtgctgtagcgcgcgccgtagccgaccggttcgccggccggcaggtcgcggacgctgatcaccttcgattccagggtcatcaccgggcgcaagcggtcggccagcggatgtgcgcgctcgaacggcgtggctccgtagagcaggatgcccggacgtacccaatcgctgggcaccttcggccagccgagcacggctggcgaattgcgcaggctaatctcgccttccaggccctggctagcggccgcgaaggcggcgagctgttcctcggtgcgcgggcaatccagttcgtcggcgcgggagaagtgactcatcatcacgatcttcgccaccttgccgctggcccgcaggcgctcgtgggcggcgcggaagtcctcggggaagaagccgacgcggtgcatgcccgaatccatcttcagccagacgttcagcgggcgggccaggctggcgcgttcgatcgcctccaattgccaggcgcaatgcaccacgcaccagaagtcgtgggcgacgatcagctccagctcggacgcctcgaagaagccctccagcagcaggatcggctggcggataccggcctcgcgcagctccaggccctcctcgatgcaggccacggcgaagccatcggcctcggccaccagcgcttcggcacagcgcaccgcgccgtggccgtatgcgtccgccttgatcaccgcgagcgcacgggcgccggtggcctcgcgggccagccgatagttgtgacgaagggcttgcaggtcgatcagggcacgggcggggcgcatggcgacgggtctctcttcagcgaggtgcggcatcgcgcacctttcatcaggcgaaaaaaagcccggctctccggccgggccagacaaaactcagggcagcgcagcgaccaccgacatctctaccaggatctccggctcgcagagcttggcttcgacggtggcgcgcgccggcgcgacgccgcgcggcagccactggtcccagacgcggttcatgccttcgaagtcggcgtcgatgtccttcaggtagatggtcaccgagaggatccgagtcttgtcggtgccggcctcttccagcagacgctcgatggccgccagggtctcgcgggtctgctgctcgacgcccgcggacatgtcctcgcccacctggcccgccaggtagacggtgccgttgtggacgacgatctggctcatacgctcgttagtgtgctggcgctggatgggcattcttggcgttctccggggaattgctatagcgggaaatatccaggccttcggtactga

SEQ ID NO: 7337 - DNA, 1350 bp, Pseudomonas aeruginosa
gccagttcgagagcggccccggcgaggtcgaggcggggctggccaaggtgcagcgtcgacggctcggccagggacgccgcctgcaaccgcgcgcccctgccgaaggagaggttggcgcgctgcccgtccagccggccctccaggggaatctccgcgaccagtcgctcggctttccagcccaggtattgcaggcgcggcgcgtccacctgcaagcgaccctccaccagcctggcggcccacggcgagatgcccagcaggtcgagccgcgtctccagcttcagcgtactcgcgccctcgctggtgaacgccaggcgcaacgcggtgacgctatcggcatcgcgctccagcggctcgctgcgcaagcccagcgcgctcggccgcaactcggccggcagcgcctgcaaccactcgccgtgcaactggctcaggcgcaagtcgctgcgcagctggcgtggcaaccaggcgccctcgtctccatccagttggacttgcagttcgccctgtacattacccagaccgggcagcggccaggcttgcggagcctgcaccagcagcgccgccgagccaccgccgtcgagcacccggcgcggctccagccagtcgctgccaggcgccaggcggatcgtccagtccgcttgcagatgcagggcttgcggtgcgtcgggcaggcgctgggcttccggcaaccagcgattgagccagaccaccaggccacgggtgtccggcaggccgggcgcctccaggcgcccctgccagaggccgtcgccatcggacggcgcgagctggctgtccagcgtcagcagcgcctgccggtcgagttgcgcgcgcgtccgcaggcgccaaccagtaggctcctcgaagagctgggcgtcgagctgggcctgctgcgcctcctgttgcaggcgcagttgcgcagccagcggaaacagcgctcccgacgggcggccgatgtccagtccgccgtcctgctcgcagcggccggcgggacaaggcaggtcgagatggaagcgttcgaggtggatctgttccggcagccaggcgagggtctcgcgcagggacgtccagtccagcgcagcggcgtcgtcgtcggaactcgcggcagccggttgccaggcgagcgccacttgctccacgcgcaggccgggtagacgcggacgccaacccgacagcccgggccagcgcagcagcgcgtgttccacgtccagtcgcaggctggcgccatccgcgccgcgccgctccagcgccagccgtcgcagcccgatgccttcggcggacaggcccaggccttgccactccaggcgctcgacaccctgctcgcgcaacaggctgcgccaggcatgccagccgtag

SEQ ID NO: 7338 - DNA, 1695 bp, Pseudomonas aeruginosa
aggaaaaactcggtagctgagcccatccgaggctcggcggattctgaaaaaatcaggcggggcatcgctcttccgaggaaaactcctagaattcgcacgaccgggatgagccggtcgttcgagtttccacgggagatgtccttgcttcgccgattcctcctgctggccctcctggccctctccggctgcgccagcactcctccgccgcaaccgtcgtcggcactgcccgccgagggtacctggctggccaggcaggccgaaatccagggacgcgaccaccccggccagtccggcttccacctcctgggcgccagcgaggatgccttcgtcgcccgcgcggcgctgattcgcgcagcccagcgcagcctcgacatccagtactacatcgtccacgacggactgaccacgcgcgccctcgcctacgagttgctcaaggcagccgaccgtggcgtgcgggtacgcatcctcatcgacgacaccgccagcgatggctgggactacgagatcggtgtgctctccgcccatccgaacatccaggtgcgcctgttcaacccgttgcacctgggccgcgccaccggcatcacgcgaggcgtcggccgcctgttcaacctgtcccagcaacaccggcgcatgcacaacaagctgtggctggccgacggcacggcggccatcgtcggcggacgcaacctcggcgacgagtatttcaacgccaagccggagatgaacttcaccgacctcgacctgctcggcgtcggccccatcgccaaccagctctcgcacagcttcgaccagtactggaacagcgccatcagccggccgatcgaggatttcctctggcgcgcgccctatcccggcgaactggagtcggcccgacgcaagttgcagcgctacctgcgcaaggagtcggtgaaggagtccggctacatccgccacctgttcgaccgcggcgaccagccacgcctgggcaactggctggagaatctcacctgggcccgcgccgaggcgatctgggatgcgccgctgaaggtattgagccgcggcgagcccgacccgcacctattgctcagtccgcacctggcgggcctgttcaagggcgtgcagaaggaactgatcctggtctcggcgtatttcgttccggccaaggacggtctcaactacctcaccggcaaggccgacagcggcgtccgcgtgcgcctgctgaccaactccctggaagccaccgacgtgcccgccgtgcatgccggctacgcgccctatcggatggcgctgcttgagcatggcgttaagctctacgagctgcgcgccaatcccgaccagccgctgagcggcgcgccctggcgcctgcacggatcgagcagcgccagcctgcacagcaaggcgatggtcttcgaccggcgcaaggtattcatcggttcgttcaacttcgatccgcgctcgatcctgtggaacaccgaagtcggggtcatcgtcgacagtccgctgctggccgagcaggtccgccaactggcgctggagggcatggcgccgagcgtcagctaccaggtgcgcatcgaccgcagcggtagccggccgaagctggtctggatcgacgaacgcgacggccggccccaggtcctgcgccacgagccgggcagcctgtggcgacgcctgaacgcctgggtcgcgggaatgatcggactggaaaagatgctctga

SEQ ID NO: 7339 - DNA, 1347 bp, Pseudomonas aeruginosa
ctgcgcgacatgggcattggcccggaccagggcatcgtctcggtagcgctcgccgatcaggatcagcgccagggtgaacaacccgccggcgctggccccgaacagcaccagcagcggccagatcaacggcgtctgcagcagcaggggaatcgccaggctgctcagcagcagcaccaggccgcagccgccgaacaggccgctgcgcgagacccggtcggcgagccagccgatcggcagctgcaacaatgcatcgcccaccaccacggtactgaccatggccagcgccaccgcttgcggaaagccctggcgcaacccgtataccggcagcagggtgaggatcatcgcctcgaaggcagcgaacaacaccaccgcccaggcgatcgccggcagaccccggcagaaggcccacaaaccgcgcccggaggcactgtgcggatcgaccctgggcgcaccgctgcggcccagcagcagcaacgagccagcaatcagcaggcagacgccgaaccagaagccacggtcgtcggcggtaccgatgaaggtcagcagtaccggcccggacagttggctgagggcgtagccggtgccgtacagcgcgaccagccggccacgccacttctccaccgccaactggttgatccagctttccccgaggatgaacaccacggtgagctgcacgccgatcagcaggcgcagcaacagccataccgggtagctctgcagcagcgccagcaggccgacggaggctgccccggtgagcaggcacaactgcatcagccgcggcgtgccgacgcgcgcggcgaggcgcccggcgatcatcgcgccgagcagcacgcccactgccggcgtgctggccatcacgccgatggcgaaactgccgtagccccagctctccaggcgcaacgagaccagcggcatggtcaggccaagggcgagaccgatgctgatgactgcggaacagacggcgaaatagcttccccaacgcattgcgattctcccgttggcaccccgaaagccttgccggggcgagcggatatatccggcgcacgaagcacagcggccgggcttccagaaggaaacccggccgcgggtgtggctcgagagagccggcccggaagggccgacctaggcgatcagagcttgatccaggtcgccttcagctcggtgtacttgtcgaaggcgtgcagcgacttgtcgcgaccgttgcccgactgcttgaagccgccgaacggagcggtcatgtcgccgccgtcgtactggttgacccagacgctgccggcgcgcagggccttggcagtcaggtgcgccttggacaggttgctggtccagaccgccgccgccagcccatag

SEQ ID NO: 7340 - DNA, 513 bp, Pseudomonas aeruginosa
atcttgtcgatcgcctcggcgctccagcgcaggctgttggcggcgctggcgacgtcgatgtgcagcgagtcgctgatcggcttgcccatgtccagggtttccagcagtgccagctcctcggcgttctccagcagcagatcggcgaagcggatcatcgtctgcttgcgcttggccggcgccaggcgcgaccaggcgccggaatcgaaggcattgcgggcgaccttgaccgcctgctcggcatcggccaggtcgcaactggcgaccttggccaggaagcggccatccaccgggctcaggcaatcgaaggtctcgccggaggcggcgttgctgtattcgccgttgacgaaggcacggccttcgatcttcaggtctttggcgcgggcttcccagtcggcgcgggtcagggtggtcatgacaacgtgtcctcttattggtgttctgggcgcctgggagacaggcgcgctgtcagattctgcaaggcgggcgcgcggcccgtggtgtccgccaccctaa

SEQ ID NO: 7341 - DNA, 1464 bp, Pseudomonas aeruginosa
accagagcagcgcctgttttcaatatatttgacaggaacccctctaactcccttgtcacgttcattattttaaacatagactcgcccggactagcgtcttcatccctcgcgtgcaacctgggtggccctatgacaatgaataacgagccgcagtcgagcagcctcgacaacttctggatgcccttcaccgccaaccgccagttcaaggtgcggccgcgcctgctggaaagcgccgaaggcatccactatatcgcccagggcgggcgccgcatcctcgacggcaccgccggcctctggtgctgcaatgccggccacggccggcgcgagatcagcgaagcggtggcccggcagatcgccaccctcgactacgccccgccgttccagatgggtcacccgctgccgttcgaactcgccgcgcggctggcggaaatcgccccgccgggcctgaacaaagtattcttcaccaactccggctcggaatcggcggacaccgcgctgaagatcgcccttgcctaccagcgcgccatcggccggggcacccgcacccgcctgatcggccgcgaactgggctaccacggggtcggcttcggcggcctgtcggtaggcggtatggtcaacaaccgcaaggccttctccgccaacctgctgccgggggtcgaccacctgccgcacaccctggacgtcgcccgcaacgccttcaccgtcggcctgcccgagcatggcgtggaaaaggccgaggagctggaacgcctggtgaccctgcacggcgccgagaatatcgccgcggtgatcgtcgagccgatgtccggctcggccggcgtggtgctgccgcccaagggctaccttcagcggctgcgcgagataacccgcaagcatggcatcctgctgatcttcgacgaagtgatcaccggtttcggccgcgtcggcgaagccttcgccgcgcagcgctggggcgtcgtcccggacctgctgacctgcgccaaggggctgaccaacggcagcatcccgatgggcgccgtattcgtcgacgagaagatccatgctgccttcatgcaaggcccgcagggcgccatcgagttcttccacggctatacctattccggccatccggtagcctgcgccgccgccctggcgaccctggacatctaccgtcgcgacgacctgttccagcgggccgtcgaactggaaggctactggcaggacgcgctgttcagcctgcgcgacctgcccaacgtggtcgacatccgcgccgtaggcctggtcggcggcgtgcaactggcgccgcacgcggacggccccggcaagcgcggctacgacgtcttcgagcgctgcttctgggagcacgacctgatggtccgggtgaccggcgacatcatcgccatgtcgccgccgctgatcatcgacaagccccacatcgaccagatcgtcgagcgcctggcccaggccatccgcgccagcgtctga

SEQ ID NO: 7342 - DNA, 582 bp, Pseudomonas aeruginosa
aacgctgaaggccacgcccgggagaacccagcgatggatctcgaccgtctctacctgccgcattggcagttcagcgaacaccaccagcggctgatcgacgcgccggccgcagcggtactcgacgcggtggaagacctgctgcgcttcgacgacccgctggtgcgcgccttcctcgtcctgcgcgaagcgccgggaaggctggccggcctgctgggccggcgcaacgacctggccggccgcccacgcttcggcctgcatgagttcacccgcctggagcgccgcgccgaccaggccatcgcctacggcctggtcggccgcttctggcgcgccgacttcgccctggaacgcatcgcggacggcgagcatttccgctgctacgaccagcccggagtggccaagctcgtgctgtgtttccgttgcacgcccagcgccagcggtaccctgctgcacacggaaacccgggtgttctgccccgatcgcgccagccgcctgcgcttcaccccctactggttggcgatccgcccggtcagcgggctgatccgccggcgcctgctggcgggcatcgagcggcgcctgggctga

SEQ ID NO: 7343 - DNA, 498 bp, Pseudomonas aeruginosa
tcgccttcatcgccgaccgcctcaaccagcaatgagttactgatgcactctctccaagccaagatcctcgacccccgcctgggctccgacttcccgctcccgcagtacgccacgccgggctcggccggcctggacctgcgcgccatgctcaaggaagacagcgtcctcggcccgggccagaccctgctgattcccaccggcctgtccatctacatcgccgatcccggcctcgccgccctggtcctgccgcgctccggcctggggcacaagcacggcatcgtgctgggcaacctggtcggcctgatcgactcggactaccagggcgagctgatggtgtcgtgctggaaccgcggcgagtcgccgttcaccatcgccgtcggcgagcgcatcgcgcagttggtactggtgccggtggtgcaggcgcatttcgagctggtcgaagcgttcgacgaaagccagcgcggcgccggcggcttcggccattccggcagccactga

SEQ ID NO: 7344 - DNA, 438 bp, Pseudomonas aeruginosa
ccccgaacacaggacgagacgccgaggagacgcggcatgaagcttttccagcgcaccgcccaaggatgggaacgagttgggcgacgtgctcgaaccggaaaagaagccgcgccaaggcagcgtccgaacgcgctgacggcaaggacctgttgcccggcatatgcgccagcctactgggcgtggcggccgccggcgccctgctctggttcggcgtcttcggcggcgccggtgaggcgcagcagcgccagttggacgcggcctgggccgaaggccaggccggcgccttgcgccaggccttgcagcaactcgccgccgacacccgcgccgccgcggccagccccctcgccctcgaagccctgcaaagcggcgacgccacccgcatcgaggccgcccagcgcatcctgctggcctgggacggcgtggtcgatgcccacctga

SEQ ID NO: 7345 - DNA, 378 bp, Pseudomonas aeruginosa
gcggccacgtgttcttcaaggagcgctggttcggcttcgacgatggcatctacagcgccgcccgcctgctggaaatcctcagccaggatcagcgtgacagcgagcacgtgttctcggccttcccgagcgacatttccaccccggaaatcaacatcaccgtcaccgaggacagcaagttcgccatcatcgaggcgctgcaacgcgacgcccaatggggcgaaggcaacatcaccaccctcgacggcgtgcgggtcgactaccccaaaggctggggcctggtacgcgcctccaacaccactcccgtgctggtcctgcgcttcgaagcggacaccgaggaagagctggagcgcatcaagaccgtcttccgtaaccaactga

SEQ ID NO: 7346 - DNA, 957 bp, Pseudomonas aeruginosa
aggcagtggattcctcgctgcccgtgcccttctgacatgtcggagctccccatgaccctgagtcgcgatgacgccgcccaggttgccaaggtcctttccgaggccctgccctacatccgccgcttcgtcggcaagacgctggtgatcaagtacggcggcaacgccatggagagcgaggagctgaaggccggcttcgcccgcgacgtggtgctgatgaaagcggtcggcatcaacccggtggtggtgcatggcggcggcccgcagatcggcgacctgctcaagcgcctgtcgatcgagagccacttcatcgacggcatgcgcgtcaccgacgcggcgaccatggacgtggtggagatggtcctcggcggccaggtgaacaaggacatcgtcaacctgatcaaccgccacggcggcagcgccatcggcctgaccggcaaggacgccgagctgatccgcgcgaagaagctcaccgtgacccgccagaccccggagatgaccaagccggagatcatcgacatcggccacgtgggcgaagtcaccggggtcaacgtcgggctgctgaacatgctggtcaagggcgacttcattccggtgatcgcgccgatcggcgtgggcagcaacggcgagtcctacaacatcaacgccgacctggtggccggcaaggtggcggaagcgctgaaggccgagaaactgatgctgctgaccaacatcgccggcctgatggacaagcagggccaggtgctgaccgggctgtccaccgaacaggtcaacgagctgatcgccgacggcaccatctacggcggcatgctgccgaagatccgctgcgccctggaagcggtacagggcggcgtgaccagcgcgcacatcatcgatggccgggtgccgaatgccgtgctgctggaaatcttcaccgacagcggcgtcggcaccctgatcagcaaccgcaagcgtcactga

SEQ ID NO: 7347 - DNA, 1419 bp, Pseudomonas aeruginosa
ccattccgttcgaactctgaggcatcggaacgaagcggcagcccggtatccgcgggctgccgccatcgactaggaaaagcgccaggcgtcctaggcgtaaaccggccagcgctcgacgatccgcccgccgcgcagcgccagcaggtcgccgaattgcagcagcaccgactcgctctgggtcggccgcaggaagacctggtcgtccacctccaggcccaccgaaggcgagccgttgaccatttcctggttcgagctgcgcccgtagatgccgttgctgcgcagtccctcgggcgaggcgaagtcggccatccagttgccgccgtagatgaagaaggtgccgcgctggttggggtcccaccaggaaaacagccgcgacttgccgtccagcgccgggatctgcaccgcgccggtgctcttgagtaccggcgtggcgatgtagacggccggcacatgctcggccagggacgccaggtcgtagtggctcggcttgagcatggcggtgcccaccgagacctcgctgctcagcgtttccttctcgtgcatgcgatagctggggctgccggcggtattcagggtcagctgtggtgtccacagcgcggcgaagcgctggcgggcgaagtcgacatgtccctggtagagcgccatgaccttggcgaacagttcctcgggcgaaccgaggatgcccggcacacccattccgacgaaggggtcgtagcccatgaagccggcgaactccaggtgctgcggatgcgccgcgatcagcgccagcaattcacccagcgcggcctggtcggccaccccgccgcgatgcaggccgacgtccagttcgatgttgacgcgcatccgggtccccagcccctgggccagcgccaggtactgacgcaagcgctgcggcgtatcgatcagccattgcaactgccgcgccgggtcgaacgcgcccttgtgctcgcggtagaacagttccgccgaacgcaccggcaacggcttgccgaggaggatgtcggcatccgcaaaagcgactgcgtcgtggttgaggaacggttggtggaaggacatcagccgccgggtgccggcgcgcctggcgatgtacgccagcaggccgggcgagggcagcgacttctccaccagccgcagatgcttgccgccgcggcggaccgaacgcatcaccacatcgatgttgtggtccaggcgatcgaggtcgatgagcagcaccgggcacatcgggccattggccttgagttcgcggttcagcgcgcggaaatagtcgtcgtacggcccgccacggtcggcgggacgcatccaggcggcagctcccgccagcagcgcgccggccccgaggccggcgaacatgaacttgcgtcgattcacggcgtcgctcctttcaggtcacgcccaggatggaggagaggtgcgcattga

SEQ ID NO: 7348 - DNA, 795 bp, Pseudomonas aeruginosa
ttttgggggccatttatgcggatcatcagtgtgaacgtgaatggtattcaggctgcggccgagcgcggtttgctcagttggctgcaagcacagaatgccgacgtgatctgcttgcaggacacccgagcctccgccttcgatctggatgacccgtccttccaactggacggctacttcctttatgcctgcgatgccgagctacccgaacagggcggtgtcgcactctacagccgtttgcagcccaaagctgtgatcagcggcttaggtttcgaaacggccgatcgttacgggcgctacctgcaagccgacttcgacaaggtgagtatcgccaccctgctgctgccttccgggcagagcggagacgagagcttgaaccagaaattcaagttcatggacgacttcacccattacttgagcaagcagcgtcgcaagcgccgcgaatacatctactgcggctcgctgtacgtcgcccatcagaagatggatgtgaagaactggcgcgaatgtcagcagatgccgggcttcctcgcgcccgaacgggcctggctggacgaagtgttcggcaacctcggctatgccgacgccctgcgcgaagtcagccgcgaaggcgaccagttcagctggtggccggacagcgaacaggccgagatgctcaacctcggctggcgcttcgactaccaggtgctgacccccggcctgcgccgcttcgtgcgcaacgccaagctgccgcgccagccgcgcttctcccagcatgcgccgctgatcgtcgactacgactggcagttgagcatctga

SEQ ID NO: 7349 - DNA, 441 bp, Pseudomonas aeruginosa
atgcccacggaaacggcggcgaccatctgcttcagcggattgcccttgagcgcgccacgcttcttcagcaccgccagggcgtcgatcagcgccacggtggcgccggtgatcgaggcggtgcgggtgccgccgtcggcctggatcacgtcgcagtcgatgtacagggtgttctcgccgagcttgctgaggtccagcgccgctcgcagggagcggccgatcaggcgctggatctccagggtacgaccgccctgcttgccgcggctggcctcgcgctggttacgctcgccggtggagcgcggcagcatgccgtactcggcggtcaaccaaccctggccctggcccttgaggaagcgcggcaccccggactccgcgctgacggtgcagatcaccttggtatcgccgaactcgaccagcaccgaaccttctgcgtgcttggtgtaa

SEQ ID NO: 7350 - DNA, 708 bp, Pseudomonas aeruginosa
tcgagcagatgcgcgagcaggtccagaacatcgaatgacccgcgggcgcctccgcccgatctctttccaacccgtacgaagcaccaggaacacctcatgtccggcaccctgtacatcgtttccgctccctccggcgccggcaagaccagcctggtgaaggccctgctcgacgccgcccccgaggtccgcgtgtccgtctcccataccacccgcggcatgcgtccgggcgaggtggacggggtcaactaccacttcaccagccgcgaggaattcctcgccatgctcgagcgcaacgagttcctcgagcatgccgaagtcttcggcaacctctacggcacctcgcagcgctgggtcgagaaaaccctcgccgaaggcctcgacctgatcctcgagatcgactggcagggcgcccagcaggtgcgccggctgatgcccgaggcccaatcgatcttcatcctcccgccgagccaggaagccctgcgccagcgcctgaccaaccgcggccaggacagcgacgaggtgatcgagcggcgcatgcgcgaagccgtcagcgaaatgagccactacgtggagtacgatcacctggtgatcaacgacgatttcgcccacgccctggacgacctcaaggcgatcttccgcgcccgccagttgcgccaggacgcccagcagcaacgccacgccgaactgctcggtcgtctgctcgcctaa

SEQ ID NO: 7351 - DNA, 2022 bp, Pseudomonas aeruginosa
tacgccgagcaggcccacgacgggcaacgccgccgcagcggcgaaccgtacgtgacccacccgctggcggtctccaacatcctcgccgacatgcacatggaccatcagagcctgatggccgcgatgctgcacgacgtgatcgaggacaccggcatcgccaaggaagcgctcaccgcgcagttcggcgagacggtttcggaactggtcgacggggtcagcaagctgacccagatgaacttcgagaccaaggccgaggcccaggccgagaacttccagaagatggccatggccatggcccgcgacatccgcgtgatcctggtcaagctggccgaccgcctgcacaacatgcgcaccctcgaggtgctgtccggcgaaaagcgccggcgcatcgccaaggaaaccctggaaatctacgcgcccatcgctaaccgcctgggcatgcacaccatgcgcgtggagttcgaggacctaggtttcaaggccatgcacccgatgcgcgccgagcgcatccgccaggcggtgaagaaggcccgcggcaaccgccgcgagatcgtcggcaagatccaggagtcgctggtcaactgcctcgcccgcgaaggcatggaaggccaggtgatcggccgcgagaagcacctctacagcatctaccagaagatgcgcggcaagcgtaaggcgttcaacgagatcatggacgtctacgccttccgcatcatcgtcgacaaggtcgatacctgctatcgcgtgctgggcgccgtgcacagcctgtacaagccgttccccggacgcttcaaggactacatcgcgattcccaaggccaacggctaccagtcgctgcataccaccctgttcggcatgcacggggtgcccatcgagatccagatccgtacccgcgagatggaagagatggccaaccacgggatcgccgcgcactggctgtacaagtccaacgacgagacgcccaagggcacccatgcccgcgcccggcaatgggtgaagggcgtgctggaactgcagcagcgcgccggcaactcgctggaattcatcgagaacgtgaagatcgacctgttcccggacgaggtctacgtgttcacgcccaagggccgcatcatggaactgcccaagggttccaccgcggtcgacttcgcctacgcggtgcacaccgacgtcggcaacagttgcatcgcctgccgcatcaaccgtcgcctggcgccgctctccgagccgttgcagagcggccagacggtggaaatcgtcaccgccccgggcgcccggccgaacccggcctggctgagcttcgtggtcaccggcaaggcgcgcacccatatccgccatgcgctcaagctgcaacgccgctccgagtcgatcaacctcggcgagcgcctgctgaacaagacccttaccggcttcgacagccacctcgagaagattcctcaggaacgcatccaggccgtgctcgccgagtaccgcatggaagtcttcgaggacctgctggaagagatcggcctgggcaaccgcatggcctacgtggtcgcccgccgcctgctgtccagcgagggcgaggaagcgccaagcgccgagggtccgctggcgatccgcggcaccgaaggcctggtcctgagctacgccaagtgctgcacgccgattcccggcgacccgatcgtcggccacctgtccgccggcaagggcatggtggtgcacctggaaagctgcaagaacatcagcgaagtacgccacaacccggaaaaatgcatccagctcagctgggccaaggatgtcaccggcgaattcaatgtcgaactgcgcgtcgaactggagcaccagcgtggcctgatcgccctgctcgccaccagcgtcaacgcggccgacggcaacatcgagaagatcagcatggacgagcgcgacggtcgcatcagcgtggtccagctggtcgtcagcgtgcacgatcgcgtccacctggcccgcgtcatcaagaagctgcgcgccctcaagggagtgatccggatcacccgcctgcgtagctga

SEQ ID NO: 7352 - DNA, 693 bp, Pseudomonas aeruginosa
cgagcactggaaggttgccttctatggcgacgacaaccaggagagtctcgaactggacggcaaggagctgatccagcaggccagcgccaacggcccggaacagcgtttccgccgtctcgacccgcaacccgcggccaacagccctgccggcagcggtttcgagcgggccttgtatggcagctatctgaagggcagctggaagatccgcgaaggccagggccagggcggcaaggtcgagttccaggccaatggcctggtcagcggtctgcccggcgccgaacgctacgcgctgtgcctggccggcgattgcgcagcgatgagcggcgacaacgacagcatctggctgcaacaaggcaaccgcggccgcgaattgctgttcagcctcgacgacgacgagctgcaactgttcgaagcggtcaataccgccggcgccaacgagatgcccagctacgtgcccggcaagcgcgtctggctgctggagcgctgaggcctctcagagggcggccagcaccagccagccgcccagcgccagcagcaggacgccgcacagccggtccagcgcacctacccgccgttgcaaccagccgcgccagcgcggcctgtccagcaggcgcaccagcgccatgtcccagcacagcaccgccaggctcatccacgccaggcacagggccagcgcccagcccggcaggctga

SEQ ID NO: 7353 - DNA, 423 bp, Pseudomonas aeruginosa
agcgcgccagcacgccgaacagccccgcatagaagatcggcagcttgggattcaggctgctcgccagcaggccgtcgcgcagcccgcgcagatagccgccgcgggacgggacgtcgcgctgcgccggcatttccagtcgcctctgcgcaagcagcgcctggcccgccagccagaggaagtacagtccgccgagcgcctgcagccagcgcaaggcgctgtgcgccgagtccggcacgctggccaacaggccgagcaccagcagcatgctcaggaggttggccagggcgatgccggcggccaccccgtcggcctggcgccggccgcgcagcagggcggcgcgcaccaacaggaagaagtccggccccggcgacagcagggcggcgaaatgggtactggcgacaaggacgaacgcggcgaacatga

SEQ ID NO: 7354 - DNA, 1518 bp, Pseudomonas aeruginosa
catgcgcttccaggtaatcgcgcaggcgtgcggtggttccgccgtcgcggggcgccgcggccgccgggcgcaagccgccgtgacgcacgaagacctgttcgagcaaggccagcaggcggctttccaaccccaatgcgtcgctgcgctggaaatcctcggccagccacgccaggccagccgccacgctgccgtcgtcggccgggttcagttcgccgaagccgcgcggcaactgtttgcggccgagcaggccgagcaggcgcgtttcctcgacatagagcatccggtagaccagccgctcggattcggcgtgcccggtatgtggctcttccgggttcatcagcgacagggtgccggccggcagcgcatggcgccgcccgcggcactggtagccgccgacgccgtggaggatcgagccgatggcgaaggccgaatggctgtggcggccgaacgcctggccggagaagtccgcatggaacagctccacgccaggcagccagggacgcgccaacaaccggttggcagccatcaggcgtccccgagcaccgccgcgtagccctcgcggtagctgggatagcgcggcacccagccgagcgcccgggcgcggcggttgctgcaacgcttgctgccggcgcggcgtaccgaatgttcgtcggcccattggctgacgcccaggcgctggcgcaggtagtcgaccacctcgtgcatcgccacgggcgcgtcgtcgacaccgatgtagcagtcctccagcgcctggccgccggcatcggcgcgcaacaggaaggccagcagcccggccgcatcgtcggcgtggatccggttggcatacaggggcggctcgctgaccacccggtacccctgacgcacctggttgagcagccactcccgccccggaccgtagatgccggccaggcgcacgcgggtagccggtatcccgctgtccagcgcgacctgctcggcgtcgagcatgatccgtccggaatagacctgggaaagcgccggcgactcctcgtcgatccagccgccatcggtctgcgcgtagaccccggtgctggagacgaacagcaggcgcctgggccgctggccgcgggcctgcaaccagcccagcacatggcgcaggccgtcgacgtaggcggcacggtagccagcctcgtcgtgctgactggcggcggcgctgtacaccaggtagtcgagcggctcgctcggccactgcgcgggacactccggagcctgcagatcgccagccaccggcaggatcccctgcggcaaggcgtccaccgagcgacgcaggccatggacccgccagccatcggccagcagcgcctcgccgaggcgcccgccgacatcgccgcagccggcgatcatcactgtttgcgacatgaagccgtctccttcctacaacaaggcgggcagtgtaggcgtcgaatcgtctgcaatgcacgcccgatcatgcccccggaggttggttcgcggcggtgcagccgctatgcttggccgatcttaacggatgagcagccatga

SEQ ID NO: 7355 - DNA, 429 bp, Pseudomonas aeruginosa
tgccggccgaccatccctggaccgccaaggccagcatcgattccgagctgctcaacgacaagagcctgctcctgctcggcgaaggccactgcttccgcgaccaggtgctggaagcctggcccgaccgtgcgcaagggcgacgagaacaagcacaccacggtggagtcctcgtcgctggagaccatccgccacatggttgcctccggactgggcgtctcggtgctgccgttctccgcggtggacagccaccactacgcgccgggcgtcatcgaagtgcgcccgttcagcgcgccggtgccgttccgtaccgttgccatcgcctggcgcgccagcttcccgcgtccacgcgccatcgaagtgctggccgactcgatccgcctgtgctcggtggcccgtccgcaaacccaggaacaaccgcaaatcgcatga

SEQ ID NO: 7356 - DNA, 258 bp, Pseudomonas aeruginosa
tcatcgagaaccccgagcgccttggcctggcccaactgcaccagctacgcggccgggttggccggggcagcgccgccagccactgcgtgctgctctaccacccaccgctgtcgcagatcggccgcgagcggctgggcatcatgcgcgaaaccagcgacggcttcgtcatcgccgagaaggacctggaattgcgcggccccggcgaaatgctcggcacccgccagaccggcctgctgcaattcaaggtcgccgacctga

SEQ ID NO: 7357 - DNA, 519 bp, Pseudomonas aeruginosa
gggaaaatccagctcgcatggtctcgtcatgacagaagccgccctggcctccgccgatgctccgcacgccccccaggtcatcctccagctgctcgccaagctaggcatcgcctgccgcgaggtcagcgacagcgcggagctgcctgccgcccgccgggtccaggcggtgctgctggacgacgccgtcggcaccctgctggtgctgttcccgcagagccagttgctggacctcgcccggctcaccgaactgaccggccgcaagctgctggcgatcaagcccgagcgcctggaacgaatgctcggcaagcacgagttgcaccgcctgccggcgttgccgcccctgaccagttcgccctgcctgtacgacgagcgcctgttgcaggaaccgcgcctgctgatcgagtccggccagcccggcatcctcctggagatcgccagcaacgacttccgcggcctgctgggcaaggccagcgccgcgcgcttcggcgaaccgctggaaaacatcaacctgaaccttga

SEQ ID NO: 7358 - DNA, 1500 bp, Pseudomonas aeruginosa
gcaccgatcggcgcgcagccgtcgaggcgctccagcgccagcgggtggccgccgtcgtcgaccaccgcgatgctcaccgcccagccttggcgctgtgcctcctcgcgggccgcgccaaggacgcgggcgacctcctcgcggccgagtaccggcttgctgtgcatggtttcactctcctccgggcaaggcctggtcgagcagctcgatccagtggcgtaccggggtccgtccggccccgtcgagatgggcctggcaaccgacgttggccgtggcgatgacatccggcgcgccgctttccagggcgtccaggcggttgtcgcgcagacgccgggacagcgccggctgggtcagcgagtaggtgccggcggacccgcagcagagatgaccgtcggccacctcggtgagatggaagcccagtcgccgcagcaccgcctccacggccccgcccagtcgttgcgcgtgctgcagtgtgcatgggcagtggaacgccaggcgctggtcgcagcgcaggccgagggactccagcggctcgtcgcgaagcacttccaccaggtcgcgggcagcggcggcgacctcgtgcgccttgtccgcgtaccgtgggtcgtcgcgcagcaggtaggcgtagtccttgacgaaggcgccgcagccgctggcggtctgcacgatggcctcggcaccctcgcgcagcaacggccaccaggcgtcgatattgcgccgcgcgcgctggcggccgcgctcctgcgcatccaggtggaaatccagcgcgccgcagcagccggccgcggccgccggcgtcacgctgattcccaggcggtccagaacccgcgcggcggcggcgttggtgttcggcgacagcgccggctgcacgcaaccttcgagcagcagcacgcgccgtgcatgccggggctgcggccgcctgcccggcgccgcgacccgacgtggcagcttgccctgcatcgcctcaggcagcagaggcctcagccgcccggcagtgccggccagcgcgccgaacaaccccgggcgcggggccagcaggcgcagcccgtcgcgcagcaggcgttgccggaagccgcgcggcaggcgttcggcgaggaggtcgcggccgatatccagcagcttgtggtactcgactccggacgggcaggtggtttcgcagttgcggcagctcaggcagcgatcgaggtgcaggcgggtgcgctcgctggcctcgtcgcgctcgaggaactgcttgatcaggtagatccgtccgcgcgggccgtcgagttcgtcgcccagctcctggtaggtcgggcaggtggcgttgcagaaaccgcagtgcacgcagctgcgcaggatgcgctcggcttcggcggcctcggcgcgttgccgggcggaatcgcagaggttggtttgcatcgcgcctcctcagagttcggcgtacatccgcccgggattgaagatgccctgcgggtcgagctggcgtttgagtgcccggtgcaggccgagcagtccaggcggtag

SEQ ID NO: 7359 - DNA, 1872 bp, Pseudomonas aeruginosa
tcaccagttcgcagggatcgtaggcgacgatcccacggtgttcggcgagcgccagcggttcgcccgcaaccggcctgccgaggaacgccttgctatcgccgccgacgatgcgcagcggcgcgcgccgcgccagggcgtcgcggacccgctcgagcagcgcgccggcatggtcggcgccagcgtccggatcgaaatacggctggctcatcagaaacgctccagttcggggaacggcagtcgaccgtggtggacgtgcatggcgccgaactcggcgcagcgatgcagggtgggcacgttcttgccgggattgagcagcccggccgggtcgaacgccgccttcacggcgtggaacagggtcagctcgtcggcattgaactgagcgcacatctggttgatcttctcgcggccgacgccatgttcgccggtgatgctgccgcctaccgccacgcacaactcgaggatcctgccgcccagcgcttcagcgcgctccagctcgcccgccaggttggcgtcgaagaggatcagcgggtgcatgttgccgtcgccggcgtggaatacgttggccacccgcaggccgtattcgcgcgaaagctcggcgatgccatgcagcacccgcggcagctcgcggcgcgggatgctgccgtccatgcagtagtaatcgggggaaatccgcccgaccgccggaaacgcattcttgcgcccggcccagaagcgctggcgctcggcctcgtcttgggcctgtcgcaccgaggtggcgccagccgcctcgaacagctcgcggacccgctcgcaatcctcgtgcacgtcggcttccacgccatccagttcgcagagcaggatcgccgccgcgtcgaccgggtaaccggcgtggatgaaatcctcagcggcgcggatcgacaggttgtccatcatttccagcccggccgggacgatgccggcaccgatcaggtcggccaccgcccgcccggcgctttccacatcgtcgaagctggccagcaggaccttcgccaccggcgggcgcggcaacagcctgacggtgacctccaccaccacgccgagcagcccttcggagccggtgaacagcgccagcaggtcgaagccggcgctgtccagggcgctggaccccaggctcaggcgctcgccttccagggtcacgatgtccacctgcaacaggttgtgcacggtcaggccgtacttcaggcaatgcacgccgccggcgttctccgcgacgttgccgccgatggagcaggcgatctgcgaggacgggtccggtgcgtagtacagaccatgaggggcagcggcctgggagatcgccaggttgcgcacgccaggctggacccgggcgaaacgacccagcggatcgatctcgaggatccgccggaaacgcgccatcaccagcagcacgccgttctccagcggcagcgcgccgccggacaggccggtgccggcaccgcgcgccacgaccggcaccttcagccgatggcagagggcgagcaggccctgaacctgttcgatgcgttccggcaatgccaccagcaacggcgtgcagcgatacgccgagagtccgtcgcactcgtagggacgcaggtcttccgcggcgtgcagcagttcgaggtcgggcaggcggaggcgcaactcggccagcaggccatccttgtccacctgcggcagcggaccgtccagacgctcgtcgtagaggatgttcatggcggctgtccttgttgtggttgtcggcgggatcagcaagcgtccacagcctgtaccgcgcggacgccggggtccagcaggcgtctaactggtcctaccagtatcaccaggagccatgggcatgaggcgcatgctagaaagtccctgagcttctatagtgagtaa

SEQ ID NO: 7360 - DNA, 795 bp, Pseudomonas aeruginosa
cgacagccaactggtcctaccagtgcaacgggagcttccatgcagaaacagcgggtggccgaccaggtcgcagagcgtatcgagcggctgatcgtcgacggcgtgctcaaggtcggccaggctctgccgtccgagcggcgcctggtggccaagctcggctgctcgcgctcggccctgcgcgagggcctgcgggcgctgcgcgggcgcggcatcatcgacaccgagcatggccgtgggtcgttcgtcgccgacctcgaccgcaacgccgacgtcagcccgctgatgcacctgttcggctcccagccgcgcaccctctacgacctgctcgaagtccgcgccctgctggagggcgaggcggcccgcctggcagcgctacgcggcaccgaggcagacttcgtcctgctcgcccgacgctacgaagagatgctcgccagccacgaggaagcccagccgatcgatccccgcgagcacgcccgccgcgaccacgcgttccaccgggcgatcagcgaggcatcgcacaatccggtgctggtgcataccctgcaatcgctcaacgaactgctgctgagcacggtgttcgcctcagtgaacaacctctatcaccggccgccgcagaaacgccagatcgaccgccagcacgcgcgcctctacgcggccctccgcgagcgccagccggaccaggcgcaacgggcggcgcgcgaacatatccacagcatccgcgacaacctgcgggagatcgagcaggaagaacagcgcctggtccgcgccaccctgcgcctgaacggctggggctga

SEQ ID NO: 7361 - DNA, 1248 bp, Pseudomonas aeruginosa
cggctgggtccgcgaggtctacctgcatggccacgaccgtccctgggtgttcgcccgcagcgtggcggcgcgcagcgccctggaaggctcgggcttcgacctggcgctgctcggcacccgctcgctgggcgagttgctgttcagcgacagcgccttcgagcgcgggcccatcgaagtctgccgctatccggcggccggtctgcccgccgaggtccgcgccgagggtctctggggccgtcgctcacggttttcccgcggcgcgctcggggtgctggtggcggaggtgtacctaccgcgcctgtgggaccaggcgggaatcgccgacgtataatcccccggtcgactccggaggtccccatgttcgtcaccctgatcaagccgctggcccgcctgcacccccgcgcctgggacttcgtccaactggtgcggctggaccggccgatcggcatctacctgctgctctggccgaccctctggtcgctgtggatcgccgcggacggcgtgccggaactgaagaacctgctgatcttcgtcctcggcgtcatcctgatgcgcgccgccggctgcgtgatcaacgatttcgccgaccgcaatttcgacggccacgtcgcacgcaccaaggcgcgcccgctggccaccggcaagatcagcgtgcgcgaggcctggatcaccttcgccgtcctggtcgcgctgagcttcggcctggtcctgctgaccaacgcaacgaccgtctggctgtcgttcggcgcggtagccgtggcctcgctctaccccttcatgaagcgctacacctactatccgcaggtggtgctgggcgccgcctattcctggggcatcctgatggccttcaccgccgagcgcggtgaactgccggccagcgcctggctgctgttcctggccaacgtgctgtggacggtcgcctacgactcctactacgcgatgaccgaccgcgaggacgacctgaagatcggcatcaagtccaccgcaatcctcttcggcgatgccgaccgcctgatcatcggcagcctgcagggcctgaccctgctcctgctggcgctggccggcaaccgcttcgaactgggcctgtgcttctacctcggcctggcggtggcggcggcctgcttcgtctgggaagcctggtcgacccgcgaccgcgacccgcaggcctgcttccgcgccttcctgcacaaccactgggctggcctggcgatcttcctcggcacggtcgccgactacgcgctgcgttga

SEQ ID NO: 7362 - DNA, 678 bp, Pseudomonas aeruginosa
cgcggtgatcatgctcgacagcgacggcaacctggaatggtggaacctcgccgcggaaaacctgctcggcctgaagaccccgcaggacggtggccagccggtgagcaacctgatccgccatccgcgcttcaaggaatacttcgaccaggaggattaccgcgagccgctggaaatcccctcgccgatcaacgagcgcctgcgcctgcaattccacatcaccctctacggcaaccgcgagcacctgatgctggtccgcgacgtcacccgcgtccaccagctggagcagatgcgcaaggacttcgtggccaacgtctcccacgagctgcgtacgccgctgacggtgatcgccggctacctggagaccctcctcgacaacgtcgaggatgtgaacccgcgctggctgcgcgccctgcagcagatgcagcagcaggccggacgcatgcagaacctgctcaacgacctgctcctgctggccaagctggaggccaccgagtaaccccggcgacaacaagccggtggcggtggacgctctcctcgccagcatccgtaacgacgcccaggccctgtccgccgggcgcaaccaccgcatcagcctggacgccgcacccgctgtgcagctcaagggcagcgaggcggaactgcgcagcgccttctccaacctggtattcaacgcggtga

SEQ ID NO: 7363 - DNA, 1287 bp, Pseudomonas aeruginosa
tcctcttcgcgcttttcctcgtcctgctcaatggcttcttcgtccgccgccgagttcgccatggtcaagctccgcgccacccgcgtggaaaccatcgccaagcagcacggctggcgcggcgccatcctgcgcaaggttcacaaccagctggacgcctacctgtccgcctgccagctgggcatcaccctggcctccctgggcctgggctgggtcggcgagccggccttcgccgaactcctggaaccgctgctggcgatgatcggcgtgcattccgacgaactgatccgcggtatctccttcttcaccgcgttcttcatcatttcctacctgcacatcgtggtcggcgagctggcgcccaagtcctgggcgatccgcaagccggaactgctgtcgctgtggacggcggtgccgctgtacctcttctactggctgatgtacccggcgatctggctgctcaacgccagcgccaacgccatcctcaagatcgccggccagggcgagcccggcccgcaccacgagcatcactacagccgcgacgaactgaagctgatcctccactccagccgcgcccaggaccccagcgaccagggcatgcgcgtgctggcctcggcggtggagctgggcgaactggaggtggtcgactgggccaactcccgcgaagacctggtctacctcgagcacgacgcgccgctggcggacatcctcgcggtgatccgccgccataagtacagccgctacccggtctgggacagccacaagggcgagttcatcggcctgctgcacatcaaggacctgctgctggcgctgtccgccctggacagcctgccggagaccttcgacctcgacgaactggtgcgcccgctggagatcgtcaccaagcacaccccactgtcgcgcctgctggagcagttccgcaagggcggcgcgcacttcgccgtggtggaagaggccgatcacaaggtggtcggcttcctgaccatggaggacgtgctggaagtgctggtcggcgacatccaggacgaacaccgcaagaccgagcgcggcatcctcgcctaccagccgggcaagctgctggtgcgcggcgacacaccgctgttcaagctcgagcgcctgctcggcatcgacctcgatcatgtcgaggcggacactctcgccgggctggtctacgacaccctgaagcgggtgccggaggaagaggaagtcctcgacaccgagggcctgcggatcatcgtgaagaagatgcgcggtccgaagatcgtcctggccaaggtggtcaagctcgactga

SEQ ID NO: 7364 - DNA, 513 bp, Pseudomonas aeruginosa
agtggctgtacttgccattggcgccctgggacaggcggaacggcccgccgcgccagggcagcggatagcgatagagcagcggctgctggcgcgggtcgccgagcgcgtaacgcagcttcggggcgtagctcatcggcttgccggccttgcgcggcgccagggtcgccaggcgcacctggctgcgcgccgggaccacccagcgaatcggcccgtcgggcaccccaacggcattgcgcgggttgcggatccgcaactcgacctcgaccggcgcgtagaggtcgttgcgcacctgcagggtctcgccacccgcgtgcttcttcgtctccagcttcacttcccgttccaggtgctcgaccatccggtcgcggaagacgaacacctgcgccccggccacggcgcggtcggagtaggtcaccacgccattggcgtcggtgtacttgtagatggtcagggccgcagccggagctgccgcggcgaacaggccacagagaaggagaaggcgccctagcatga

SEQ ID NO: 7365 - DNA, 1035 bp, Pseudomonas aeruginosa
aggccggggaagttgtcgcgcaaccctttcttcatcagatctcggatgaagggggcgtcatccaccactagcgcgctgactttgctcatcgacttctcctggacaggtccgcctaggatagcctcccctgctggcaggatgccaagccttgctgcagtcgcgcgaagaaacaaggctccaggtcaagggagccttgcctgcggaagatcactcgccgcggttgttctcgacctcttccttcatgcgggtcaggccgatgtggcgaacgtcggtgccgcgaaccaggtagatcaccagctcggcgatgttgcgcgcatggtcgccgatgcgctccagcgagcgcagggcccagatgatgttgagcacgcgggatatcgcccgcgggtcttccatcatgtaggtgaccagctcgcgcagggcggtcttgtactcgcgatcgacggtcttgtcgtactgcgccacggacagcgccaggtcggcatcgaagcgggcgaaggcgtccagtgcctcctgcaccatcttctgtacctggctgccgatgtgccgaacctcgacgtagccgcgcggcgactcgccttcctcgcacagctggatggcgcggcgggcgaccttggaggcctcgtcgccgatccgctcgaggtcgatcaccgacttcgagatgctgatgatcaggcgcaggtcggaggccgccggctgacgccgggcgaggatacgcacgcactcctcgtcgatgttgcgctccatctggttgatctggtcgtcgatctcgcggacctgctgggcgaggccggagtcggcgtcgatcagcgcgttgaccgcgtcgttgacctgcttttccaccagcccgcccatggccaggaggtggctgcgcacatcctccagctcggcgttgaactgctgggagatgtgatgggtgagactgtctttgttgatcatgtggggaatccttctggagccgctgcgaccggtgacatcaacgagctacggagagcgccggaggcagcggtatcgccgcgcctccggacgcgccgctag

SEQ ID NO: 7366 - DNA, 264 bp, Pseudomonas aeruginosa
atgctcttggggaacgggttgggcttctggaacaccatgccgacgcgacggcgcagctcggcgacgtcgacgcccttggcgaagatgttgtggccatcgaggcgaatctcgccttcgacgcggcagccatccaccaggtcgttcatccggttgaagcagcgcagcaaggtcgacttgccgcagccggacgggccgatgaaggcggtcacgcgctgcttcggaatgttcatccggacgtcgaaaagggcctgcttggcgccgtag

SEQ ID NO: 7367 - DNA, 1560 bp, Pseudomonas aeruginosa
ttaccgtcgaccggcagcgacggtgccagtttcaccacgccgaccagcatcagcggcgccacttcgccggcggcacgggccacggcgaggatcaggccggtcatcatcgccgggctggccatcggcaggacgatcttccacagcgtttccgccttggtcgcgccgagcgccagggagccttcgcggaccgcgcgcggaatccgcgccaggccttcctcggtggcgacgatcaccaccggcacggcgaggatcgccagggtcagcgaggcccagaacagccccgggggtaccgaaggtcggcgccggcagggcctcggggaagaacagccggtcgatggaaccgcccagcacgtagacgaagaaacccaggccgaacacgccgtagacgatcgccggtacgccggcgaggttgttcacggcgatgcggatcacccgggtcagcggcccctgcttggcgtactcgcgcaggtagaccgcagcgatcacgccgaacggggtgacgatcagcgccatcaccagggtcatcatcacggtgccgaagatcgccgggaagataccgccctcggtattggcctcgcgcggatcgtcgctgaggaactcccagagcttcttgaagtacaccgtcatcttggtgcccaggcccatggcgttgggctggtaggcatgcaccagcttgccaagggtgatttcgctctcgcggccgctggcgtcgcgcattaccacgctgtcgcggttgaactcctggtgcaggccgttgagctgctcttccaggaccttgtagcgcgcctgcaactcgctgcgctcggcggccaggtcggcctgggcggcggcgtccagcttgccgtccaactgcaacttgcgctctttcaggcgcaggcgctcgagaccgtggttgatcccgccgatgtcgcccttctccagcttgtagagcttggcgtagaggtcatccacccgctgcatgcgcttctgcagctcgcctaccgcggcgtcgccttcagcgaccacctggccgttctccttgacgctcagcaggtagccgtagaagttgccccactcgcggcgttcgagaaccatcagcgcttcggggcgcttgatgtcctgcagccactcgccgacgacccaggagaaatcgctgccgtaaagctcgcggttgcccagcttgagcagctcgcgggtcatgaattcggggccggcctccgggaccggcatgccggcgctgcgcaggcgcgcgcgcggcacttcctcggcctggaccacctcgccgatcacggtcttggcggcttcgccagggatctggtaagacgcctcgatgacgttcgccggccagaagtggccgaggccgcgtaccgcgatcaccgccagcaggccgatggtcatgatcaccgcgatcgacaccgcgccggcgttcatccacacccagggcgagccgctgccgaaccaggctttgacggtttcctgtttctgtttcacagagctatacctccgccgcttacaacgacgcgtatttcttgcgcagacgctgacggatcagctctgccagggtgttcatcacgaaggtga

SEQ ID NO: 7368 - DNA, 315 bp, Pseudomonas aeruginosa
gccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactgcccaccatacactgtcctcgatccggatcacggaccagagttag

SEQ ID NO: 7369 - DNA, 276 bp, Pseudomonas aeruginosa
caagtaggctcccactgcttgtacgcatacggtttcaggttctatttcactcccctctccggggttcttttcgcctttccctcacggtactggttcactatcggtcagtcagtagtatttagccttggaggatggtccccccatgttcagacaaagtttctcgtgctccgtcctactcgatttcacttcaaagatcctttcgcgtacggggctatcacccactatggccgcactttccagagcgttccgctaaaatcaatgaagcttaagggctaa

SEQ ID NO: 7370 - DNA, 306 bp, Pseudomonas aeruginosa
agaacagttctggtgcaaagaccagaaatcaatgttcattcacgaacattcatttctgagctttcgacgattgttttagatggtggagccaaggaggatcgaactcctgacctcctgcgtgcaaagcaggcgctctcccagctgagctatggccccgtatcggatcacgcagcacaccaacaattggtgggtctgggcagattcgaactgccgacctcacccttatcaggggtgcgctctaaccaactgagctacagacccaatcgtctaaccagtgaatcaagcaattcgtgtgggagcttatga

SEQ ID NO: 7371 - DNA, 963 bp, Pseudomonas aeruginosa
gtagcagcaataccaaggcgcccagccccagtcgatcgaccagggtcttgcccgggtcaggtccgagggcaaagatccaggcttggtacatccaccaggccggcactgccagcgcccccaggaataccgcaaggcgcagataccagtagcgcatcagtagtacttcctcagatccatgccgctataaagggaagcgacctcgctcccgtagccattgaacatctgcgtatcccgtacattggggctgaacaacccactgggcaggcgccgctcgcgagcctgggaccatcgcgggtggtcgacctgcggattgacgttggcatagaacccgtactcgttggcggcaatgctttcccaggtggtcttcggctgctcgcggaccagactgatacgcacgatggacttgatgctcttgaagccatacttccacggcaccaccaggcgcaacggcgcgccattctggttgggcaacagccgcccgtacatgcccaccgccagaattgccaggggatgcatcgcctcgtccatgcgcaagccttccatataaggccagtcgatcaccgagaaaccggagcgttggccgaccatctgttccggacgctgcagggtttcgaaacggacgaacttcgcctgcccattgggttcgacccgcttgagcaggtccgccaggggaaagcccagccaagggatcaccatcgaccaggcttccacgcagcgcagccgatagatgcgctcttccagttggtagggtttgacgaaatcctcgagggcataggtacccggcttgccgacctcgccgtcgatcaccaccgaccagggctcggtcttcagggccgaggcgttttccgccgggtcgcccttgttcggcccgaattcgtagaaattgttgtagtgggtggcgtccttgaatggcgtgatcgcctccctctggacatccaccgcctgccagcgggtctgcggtag

SEQ ID NO: 7372 - DNA, 1716 bp, Pseudomonas aeruginosa
tcaggtacgctccgtcttgctcagccacatgtcgcgcatcgcgccgtcacggatctgcatcggatagacgtgttcgctggcgtccacctggatgtcgaggaagaccaggcgattcttcatggcgaacgcctcctccatcttcggcttcagatccttcaggtcggtgatgcgcatgccgacatgcccgtaggcttcggcaagcttgacgaagtccggcagggattccatgtaggaatgcgaataacggctgttgtactgcatgtcctgccactggcggaccatgcccagggcaccattgttcaggttgacgatcttcaccggcaggtcgtactgcaggcaggtagacagttcctggatattcatctggatactgccctcgccggtcacgcaggcgacatcgtcgtccgggaagttgagcttgatgcccatcgccgccgggaagccgaagcccatggtgccgagaccgccggagttgatccagcgattgggcttgttgaacttgtagtactgcgaggcgaacatctggtgctggccgacatcggaggtgatgaaggcatcgccatgggtaacctcgtagagcgtctcgatgacggtctgcggcttgatgatgctgccgtcgcccttgtcgtacgggaacaacccacggttaccacgccactcgtcgatctgcttccaccaggcagcctgggcatcctggttcggggtctcgccgatttccctgacgatcgcgaccatttcggtgagaacgctgtccaccgggccgacgatcgggatgtcggccttgatggtcttggaaatcgacgccggatcgatgtcgatgtggatgatcttggcgttcgggcagaacttcgccgcgccgttgatgacccggtcgtcgaaacgcgcgccgaccgcgaggatcacgtcgctgtgatgcatcgccaggttggcggtgaagctgccgtgcatcccgagcatgccaaggaactggcggtccgcgccgggatacccgccgaggcccatcagggtgttggtcaccggcaggttgagcatctgcgccagctcggtcagcggcgccgcggcattgcccatgatcacgccgccgccggaatagaccaccgggcgcttggcggccaggagcatctcggcggccttgcggatctgtcccgagtgaccgcgaacggccgggctgtacgaacgcaacttgaccttcttcggataggaatattcgaacttctgcgtcgggtcgcccatgtccttcggaatatccacgaccaccggccccggacgaccggactgcgccaggtaaaaggccttcttgatcacctcgggaatttccgagggatgcttgatgatgaagctgtgcttcacgatcggccgggagatcccgaccatgtcggtttcctggaacgcgtcggtaccgaccatgttgctcggcacctggcccgacaggatcaccatcgggatggagtccatgtatgcggtggcgataccggtgatggcgttggtcgcgcccgggccggaagtcaccagcacgacaccgggcttgccggtggcgcgggcgtagccgtcggccatatgggtagccgcctgttcgtggcgcaccaggatgtgggtcacgtcgtgctccttgaagagcgcgtcgtagatatgcaggagggcaccacccgggtacccgtagatgtacttaacgccttcgtcgcgcaacgagcggacgaccatttcagcgccagataa

SEQ ID NO: 7373 - DNA, 2922 bp, Pseudomonas aeruginosa
ctgccacccagcggtggcgtggaggcgctgctgggcggagcctggtactgggtgccggtgccgagcggagcgctgctgatcggcgcggcgccggactgcgccgggaaagtctggatcggtgcggaattggcgccctgcggcaccatcaccaccacaccggagtcgccgccctggggaatgccctgggtggcggcgccttgctgggtacgcggtacctgggtacgggtgatgcggaaaccgccgctttcctggttggacaccggagtaccggaatccaccaccgggatcgccccgtgctgcgggctggcgcagcccgcgagcacggcactgccggcaagcgcggcgaatacgaaaatcttcttcacgtcaggtcctctcggatcaattcagccagccacgtacccagtccatcacctcgccggcggggttctggctcccgcagcctgggccctgggcgggctcgctgccacgaatatagggcatctgtacggcattcgggcaatccgccgccgagccctgcccggtctgcgcgtccacccaggccatcaccacgttctccggcatcggcatttccagcgattgcggatgcgccttgcgcatgaagctggcccacacctgcaaggcaccggtggcgccggtaagcggcgtcttgccgttgtcgtcgcgaccgagccagaccacagcctggaggtcgccgccgaaaccggagaaccagctatcgcgcgagtcgttgctggtgccggtcttgccggcgagggtcagcgacgacggcaattgactgtacaccgaacgcccggtgccttcgcgcatgacccgctgcatggcgttctgcaccaggtagacggcgcccgagtcgaagcgctgttcgacctggaacggatagcgcttgagcggctggccgtcggcagtgaggacgctgcggatcccccgcaacggcgtgttgaagccgccgctggcgatggtctggtacatggtggcgacctccatcggactgagcgaaccggcgcccagcagcatcgacggataggccggccagtcacggttgatacccagccgggcgacggtctgcagcacgttgggcacaccgacgtcgaggccgagcttggcggtggacaggttgtaggagtttgccaggccctggtacaggaagatcgtgccatgcgagcgccggtcgtagttctgcggtcgccagacctggccgtcctggcctttcaccgcgaagggctcgtcctgcacccaggtggtcagggtgtacttgctcggccgctcgagagcggtcaggtaaaccgccggcttgatcagcgaaccgatcggccgcaccgcgtccagggcccggttgaagccggcgaagcgcgggtcgcgactgccgatcagggcctggatctcgccggtttccggattggtcacgaccatcgccgcctcgacctggtcgactcccttgcgcccactgaggcgcttgagcgtttcgttgacggaggtctcggccttctcctgcaggatcggatcgaagctggtgaagatgcgcagcccttcctcggtcaggtcctcgtcgcggtagtcctggcgcaactggcgcttgaccaggtcgaggaaggccggataggagctgtcggccatgctgccctgccgggtaacgccgagcgggcgctgcttggcggcgtcgacttcctgctgggtcgccacgccctgctcggcgagcacgtcgagcaccaggttgcgccgcgccagcgcacgatccgggtaacgccgcgggttgaagtaggacggtcccttgaccatgccgaccagcagcgccacctggtcgagcttgagctcggccagcggctggctgaagaaatactggctggccaggccgaagccatggatcgctcgttgcccatcctggccgaggaacacctcgttgagataggactcgaggatgtcgcgcttgtcgtagtgcagttccagcagcaccgccatcatcgcttcgttgatcttgcggctcaggctgcgctcattgctcaggaagaagttcttcaccaactgctgggtcagggtgctgccgccctggcgcagctggccggccgtggtgttgacccacaccgcccgggccacggatttcagcgacacgccatggtggttccagaagtcgcgatcctcgaccgcgaccagggtgtcgatcaggtaggtcggcacctggtcgagcttgaccaggatgcgatcctcatggtgcgccggatacaagccgccgatcagcagcggctcaaggcgcgccaccgccagttccttgccgttggcctggctcagcccgctgacatagttgccgttgaagcgcacgcgcacgcgctgggccggttccgcgccttcgtagaactggaagccacgggtattgagttcgaccgcgctggccgccaccgatacggttccagggccgctcacgctgggctcgcgacggtagccgagggcgtcgagttcgcgcaggaagtcttccctgctcagcttcaggccgttgaacagctccagcgggcgggcatagaccttcgccgggatggtccagcgccggccggagaatttctcctgcaccacggcatcgagatagatggcgaagccggcgaggagcaccaggccgacgaggccgagcttgagggcccagccgagccatttgttcaggccgggtgccgggcgtgctttgctgttacgggaacggggggatcggggacgcgtcatggcggcgcattatacgtactttatccacagcggacagacaccgcatcggcggcatccacggtctgcgcggccccggtggataggcgcggcggcagcgcggcgcattcgaccggcgatccggcaaatggttgctatccgccagcgaggtttgcactgtcaccccttcccgccataatgcgggttttcgcatatttcagaggcaaggatatcccgtga

SEQ ID NO: 7374 - DNA, 507 bp, Pseudomonas aeruginosa
acacccacgacgcggccagcctcgacgggctggtcgacggcattcgccagcgcctgcccggtctctgaacgaactgccatgccgcccgcccctccagggcgggcgccgtgccgctgctcttctatactcacggcgagccttctgcacaggacgccgcccatgaactcgccccgtcagctcgactcgccgctctaccaactgctccacgccgaagacatcgaaggcttcaaccgacagaagccggccgacggctggatcgacctggccggcggcgacttccgcggcctcgacctgcgtctgctggatgccgcccgcgtcgacttcagcgatgcctatttccgcggcgccgacctgcgcggcgtggatctgcgcgaggcgcgcctggagggcgccagcctggcccatgcgcagatatccggtacgtatttcccgttgcgcctggcgccggacgagatccgcatgtcggtgaacttcggcacccgcctgcgctacctgccggagccctga

SEQ ID NO: 7375 - DNA, 294 bp, Pseudomonas aeruginosa
gcggcatcgcaaggaccgacgatgaacgacgaactgctgaacctgaaaaacctcgggaaaacctcgacccaatggttgcatgccgtgggtatccacagcgccaccgatctgcgtcggctcggctcggtgggagcctatcgcgcggtccgcgcgcgcggcttccgagcctcgaaagtcttgctctatgccatcgaaggcgcactcctcgacgttcactggaacgagctgtccccagaccacaaggccgcactgctcggcgagctggagactttccccgtgcgaaacaagagctag

SEQ ID NO: 7376 - DNA, 903 bp, Pseudomonas aeruginosa
ctcacacctgccacgggaagatatttactcccccccgggcgcccacctatcgtctcgtggacgttcgtacctcctctcccgaccaggcagctcaaggaaatggccatgtatctactcggcgagcaaccggcgtatgccgaccaattgatcaatcgcctgcagggaatccctcaccgcttgctcgaaggcctggcacccagcggccccgccctggaactggaacgtagcgacgacctggaacgcgagctgcccgccgaccaggtattcctggtggaaagcggcctgctgcatgcgctggtcgacgaacgcccactgttctacctccaggaaggcgacctcctcggccttcgacgcggactcgagctccccgcctgccggcatgccaacgaagaaccgatccgcctgctgccctattcgcgcgatgcgctgctccggcacatccatgctgaccaggaacgtcaggaactgctattgcagtacctgatcggacagactgccctgctcggcgatgcgctggcgcacctgaagcagccggaagtccgcccggccaccggcttccgccacttcgccgcgggcgaggcgctgatccgccagggcgacgatgcggatcatgtgttcatcatcatcgaggggcatgccgaagcgctggtggacggccagaaagtcggcgatgtgcagaaggacgagatcttcggcgccatggccgtgttcactcgcgagaaacgcagcgccacggtggtcgccagcgaaccctgcacggtgatggtgattcccaaggagcagttcctcggccttatgcagaacaacccgcgaatcgcccatagcctgatcgaaggcatggcccggcggatagacctgcttaaccgggaagtgacccagctgcgcctgcgccgcagcgcctga

SEQ ID NO: 7377 - DNA, 1008 bp, Pseudomonas aeruginosa
aactgcaggaaatggacctcgacggtctcctcgccgacccgccggcgctggccctggtcgacgaactggcccatagcaacgttcccggcagccgccacgccaagcgctggcaggacatccaggagttgctggcggcgggaatcgacgtctacacaacggtcaacgtccagcacctggagagcctcaacgaccaggtccgcgacatcaccggcgtgcaggtccgcgagacggtgccggactgggtgttgcaggaggcctacgagatcgtcctcatcgacctgccgccgcgcgagctgctggagcgcctgcgcgagggcaaggtctacgtgccggaacaggcgcgggcggcgatcgatgcgttcttctcgcagaccaacctcaccgcgctgcgtgaactggcgatgcagaccgccgccgcgcgggtcgacgccgacctcaaccaccgctaccgccagcgcggcgaggaagcgccggcgttgcgcgggcggctgctggtgggcatcgacggtgacgaacaggccgaacgcctggtgcgccacgcctgccgggtcgccgaacgtcggcacctgccctggagcgtggtacacgtcgataccggcggcttgcgcggcgagcacgcgcggatgcgcctgcagggtgcgcagcaactggccgagcggctcggcggcgagatcgtcgtgctgcgcgccggcgaggtggcgcggaccctcctgcaacatgcccgcgagcgccgcgccagcctggtcctggttggccagtcgcggcgccgctggtaccgccgggccttcggcggtggtctcgccgggcgtctgctgcgcgacggccagggcctggagatcagtgccctggacagcgaggccgacctgcgcccggcggaaccgcggccacgctatccggtggtgtggaacgactatctgctggcgctgctggcgaccgccctggccagcggcctggcctggatcgtggcgcacctgctggagctgccgaacatctccctggtgttcctga

SEQ ID NO: 7378 - DNA, 429 bp, Pseudomonas aeruginosa
gcctggcgttcttcctgttcatggccggcctcaccggcaacctggcggcacgccagcggcgccagctggaggcgctgcgcgatacccaggaggaaaccagcctgctgctggagctgtcgcgcaagctcaccgccgccaccgaccgccaggcggtgctggccgccgccgcccagcagttcgacgactggaaggacgtcgaggtctgcctgctcggtcaggtcaatggcgagtggaagaccgaggccggcgtgcagcggcaactcgccgaccaggaacgggtcgccgcggactgggcctgggcccacgaccagccggccggcctcggtactggcacgctgcccggaggacgctggtggtggtggccgctgtcggcggaagagggaccgctggcactgctcggcgtcgcgccgctggacggccagccgctga

SEQ ID NO: 7379 - DNA, 249 bp, Pseudomonas aeruginosa
gcgacgaggggccggggattcccgaggcccgagcgggagaagatcttcgacatgttgtacaccgctgcccgtggcgaccgcggtggccagggcaccggcctgggcctggcgatctgccagggcatgatcggcgcccacggcgggcgtatcagcgtcggcgaaggcctcgacggtcgcggcaccacgctggtcctgcacctgccgctgcatccgcagccggacctcgggcaactggagggcgacgaatga

SEQ ID NO: 7380 - DNA, 576 bp, Pseudomonas aeruginosa
gcccggcgcacttgcctggcgcctgcgctcgcgctattcctgccgtttccgcgacgccgccgctggcctgtcgccgtgttcacctgccgtgccgagtgccatgacccaattgcagaacagcatcctgctgatcgacgacgaaccgcagatccgcaagttcctccgtatcagcctcaatgcccagggctaccgggtgctcgaggccggcaccggcgaagaggggctggcccaggccgcgctgaaccgaccggacctggtggtgctcgacctcggcctgccggaccgcgacggccaggacatccttcgcgacctgcgcgaatggtcgcaggtgccggtgctggtgctgtcggtgcgcgccagcgagggcgagaaggtactggccctggacggcggcgccaacgactacgtgaccaagccgttcggcatccaggagttcctcgcccgcgtgcgcgtcctgctgcgccaggcggcgcagggcgaaagcccggaggcgtcggtggcggtcggcccgttgcaggtggacttcgcctatcgccgagtcaccctggagggtgcggaagtggcgctgacacgtaa

SEQ ID NO: 7381 - DNA, 1593 bp, Pseudomonas aeruginosa
agtccgcccgctgatcgggcgcggcaaggtcgccgactacattcccgcgctcgccggcgtcgagccgaaccaactggggatcgccgtgtacagccgcgacggcgagctgttccatgccggcgacgccctgcggccgttttccatccagagcatttccaaggtgttcagcctggtccaggcgatccagcattccggcgaggacatctggcaacgcctcggccacgagccctccggccagcctttcaactccctggtgcagctggagttcgagcgcggcaagccgcgcaatccgttcatcaatgccggcgccctggtgatctgcgacatcaaccagtcgcgtttcgccgcgccggcgcaatcgatgcgcgatttcgtccggcgcctgtgcggcaacccggaagtggtgtcggactcggtggtggcgcgctcggagtaccagcaccgctcgcgcaacgcggcggcggcctacctgatgaaatcgttcggcaacttccacaacgacgtcgaggcggtgctgctcagctatttccatcattgcgcgttgcgcatgagctgcgtcgacctggcgcgggcgttctgcttcctcgccgacaagggcttctgcaagcacagcggcgagcaggtgctcaacgagcggcagaccaagcaggtcaacgcgatcatggccaccagcgggctctacgacgaggccggcaactttgcctaccgggtcggcctgccgggcaagagcggcgtcggcggcggcatcatcgcggtggtgccggggcgcttcacggtctgcgtctggtcgccggagctgaacgccgcgggcaattcgctggcgggtatcgccgcgctggagaaactcagcgagcggatcggctggtcgatcttctgaaaccgccgcccgtcgtggtggcgctcgaattcccggcgccgctgcgctatgttctgcggctaccgcttgccggcgccggatgcgccggtccactcgccaggatggtcgccatgtcccgcccgattcccgtttcccgtgtcttcgcctgcctcaccgttctcgccgcctgcgcgcacgccggcgccgccgagccggactggcgtggctataccagcgaccagcagcagcgcagcgtgctggccgtcgagcaggacgccgaggccatcaacaagcgctactacgacagtgccttcgaggaattcctgccggaactggagcaactggaactcagcctggcgcagcccgtcgtcgccgtcgacgagaaaggcctgctgggcgactggaagtgccgctcgacccaggccgaccagtacggcatctatcgctatccgaacttccagtgccgcatccggcgtaccgaccgcggcctgttcctggagaagaccagcggttcgcagcgggtcagcggctacctgttccgcgaaggcacgcagcgctacgtgttcctcggcggcgccacggtcaacgacgagccccaggtggccttcagtggcctggcccacggcgcgccggctgagtccgacgtggttgcgctgctgcgcccgcacgccggcggcttcatcctgctgttcccggaacggcgcggcggctacgaggtcctcgagttcagccgctga

SEQ ID NO: 7382 - DNA, 366 bp, Pseudomonas aeruginosa
cgaagcgaaaacgatacgcgtgtcgcccggccgccgccaagtgcgtcgcggcgatgcgcggccctttccctgtccggagatcgttcgatgaaaacctggatcgttctgcccgtccttgccctgaccctggccggctgcgccggcaagaccgcctaccgggagaactgcgccgaccagttggacgcggcctggaaggaactcgacctggccaaggccgaaggtttcgccggcaccgtcagctactcgaaggccctgaccctgctcaccggggccaagacccagcagcagttcgaggcctacgagggctgcaccagcaaggccgagaaggcgcgcttctatatccgtgagtcgcgcgccgggcgctga

SEQ ID NO: 7383 - DNA, 1713 bp, Pseudomonas aeruginosa
ccgacgtcaccggtttcggcctgctcggccacctggtggaaatggccgacggcagcaagctcaccgcacgcgtggagtacgccgcggtaccgcgcctggccagtgccgaatattacctggagcagggctgcgtgcctggcggcacactgcgcaacttcgacagctatggcgagcgcatcgcgccactgccggaagtgcagaagctgttgctttgcgatccgcagaccagcggcggcctgctggtggcggtggctccggaaggcgaggcggagttcctcgccgtggcggcggaactcggcctgcaactggcgccgatcggcgagctggtcgagcgacagagtctcgcggtacaggtgctgtaatgcgcgacaacacccagcactaccgcgaactgtttctcgacgatatccccctgatggatgtgcgcgccccggtggagtaccacaagggcgcctttcccaacactgtcaaccggccgctgatgaacgacatcgagcggcagaaggtcggcaccagctacaagcagcacggccagcaggccgccatcgcccttggccacgaactggtctgcggggcgctcaaggccgaacggctggcggcctggaaagccttcgccgaagccaacccgaacggctacctgtattgcttccgcggcggcctgcgctcgcagatcgtccagcagtggctgaagcaggacgccggcatcgactacccacgggtgatcggcggctacaaggcgttgcgcaacttccttttcgaaaccacccgcgcggcggtcgacgagtgcgatttcgtgctggtcggcggcctcaccggttgcggcaagaccgaggtgatcgcggcgctggacaacagcctcgatctcgaaggccacgccaaccatcgcggctccagctttggccggcgagccacgccgcagccggcgcagatcgacttcgagaaccgcctggccatcgacatcctgaagaagcgtcatcgtggcgtcggccagttcgtcctcgaggacgaggggcggatcgtcggcagctgctccttgccgctggagctgtaccagggcatgcagggctacccgctggtctggctggaggatgccttcgagcagcgtgtcgagcgtatcctcagggactacgtgatcgacctgcgcagcgagttcgagcgcgtggtgtgcgtggaggagggcttcgccgccttctccgcctacctgcagaagagcctcgccggcatcgtcaagcgcctcggcggcgagcgctaccagcggctggcggcgatcctcgtgcaggcgctggaagagcagggccgcgacggctcggtggatacccatcgtggctggatcgaggggctgctcaaggagtactacgacccgatgtacgccttccagcggcagagcaaggaagaccgcgtggagttccgcggcaaccaggccgaggtgatcggctacctgcgccagcgtcaggcgttgcggccatcgtagtgctgtaccgggagcgcgctggcgtcgatgtcctccaggcagcgcgcgttgaccgcggccatcgcctggccgtccgggcctatgccttcgctgaacggcgcgcagccgcaggtggggcagaagtgatgctgcaggcgatgggtgttgaaggtgtaggtgtgcatcgcgctggccggcgtcttcagcgccagacggtcgcgcgggacgaaccacagcagccagccgcgccggctgcacagtga

SEQ ID NO: 7384 - DNA, 645 bp, Pseudomonas aeruginosa
tcggcgtcccctccgtcgatttccgcgagaccgccatgcaactggacttcaccaccatcgctcccgccgaggcctatcgctggttggcttccaccgtcaccccgcgaccgattgcctggggtctcgaccctgtccgccgagggcgccagcaacctggccccgttcagcttcttccaggtgatcagcgacgagccgccgaccctgatggtcaacgtcagcctgcgcgacgacggcagcctcaaggacaccctgcgcaacgtccaggccaccgggcagttggtgatccacctggtcggcgccgcccaggcagagaccatgaacgccacctccgcctggctgccccatggcgtgagcgagatcgagacggtcggcatccctaccgtgtccagcgtacgcgtggcgccgccgcggatcgccgcggcggcggtggccttcgagtgcgaggtggcggagatcaagccgtatccggcggagaaccccaattgccacctgatcttcgcccgcgtgctgctggcccatgtcgatgatgccgtgctggccgacgagcgccatgtggatagcgacaggctcgacctggtcggtcgcctgggcggcagccactacagctatacccgcgacacgttcagcatgatccggcccaggtag

SEQ ID NO: 7385 - DNA, 2574 bp, Pseudomonas aeruginosa
ccgggctcagtccggcgcccgcaggcactcgtcgaccgtgcgccggcacaccggcgcctggcccgcggcctggcgttcctgccactggcgataggcgaactggtagctttccggatacaccccgccgcgtttcagcggcgccacgatactcgcgcgcagcgcctgttcggtcagcgccaggtgcgcggccaggcgctggaactgccagggctgctggccctgacggcgctccaggacctcgacgtggtacaggccgtcggccgccgcgctcgacaggttgtgcacgatcagccagcgcgacaggcccggcgccgccggcaacgaccagagcggctgctcgatcgggccgctccagtcggccagggcgggggcgcacagactcagcgacagcaacagcggaaatacgggacgcatggcaagctcctttttccatggggcgcccagtatggctccgcgctcgaccgacgtcagcccggatatcctggaaacgacctgcgcatatctctcctggccattatcgtgccactaccttgcccggccgctcaggttcggcgaaaaacgcgcgacacagcgggaaatgcgcacgcagacggcgcgtcacgggggaggggagtcatgctggggttgctgcgcaggcgtatggccgatctcggcacggcgaagaaattggccatcggttttaccctggtcctgctattgaccgcgctggtggccgcgctcgcggtgctctcgctgcatgcgctggggcagcgcttcgcgcgcctgcaggagatgagcgcgatcaatcgcgacgtgctggaggttcgccaggccgagaaggaatttgccctgcacggggaaaagagcgacgccgagcgcttgcgccagcgcctggccgcgacccttgaacgggtgggccggctcaaggccgacggcgacgccgatcaggcgcttggcatggccgaggtggagcaggtgctggcggcatacctagaagcgttcggccgcttcgagcagtccatccagggacgccaattggcttgggaaagcgccagttggtcgctgaacggcgccgccaacagcctcgatatcctccagtccagcctggccgaggatggcgcctatgcgctgaaggagagccaggggcacgacggcgagccgctgttgcagcaggcggcccaggtcgcccaggtcaatcgcctggtccttcaggggctggacgaggcccgctcgcgtctcgaagcgcgcgccgcggatgcgcaggaggggccgccgaaatcgctgcgcgaggcgctggagctggcagcccggctggagcaggcgatcaccgacgatgcctacgtgtcggtggtcaaggacgtgctgaccaatatccgcggtttcgccgacaagctcgccgagtaccgcgccagtcagctccaggagcggcagatgtacgccgccatgggcgagcgcgccgggcaggtgatggcgcgtgttgaccgtagctgggaggcgcagcagcaggccatgctccacagcctgcggacaaactccctgctgatcgtcggcgccgccgtgctggcgctgctggtgggcctgggcgcggccttcggcatcagcctgctgatcgtccgtccgctgcgccaggcgatgggtgtggcgcaccggatcgccgaaggcgaccttgcggtacgggtcgacagcgagcggcgcgacgaggttggccaactgatggccgcgatgcgcgccatgaccggcagcctgcgcggtatcgtcagccagttgcaggacggcgtcgggcggattgccggcgcttccgaggcgctgtccggcgttaccacgcgcacccgcctgggaatcgacagccagcgggcggaaaccgaacaggtggccacggcgatgaaccagatggccgccaccgtccatgaagtggcgcacaacgccgaggaagccgcgggggcggcggaaagcgccgacggcaaggtcagcgtcggccaggaggtggtacgccagaccctggagcggatcgagcgactggccgaggcggtgcgcgcggccaccgccagcgtcgaggcgctgagcgccgacagccagcgcatcggcagcgtgctggacgtgatcaagagcgtggccgagcagaccaacctgctggcgctgaacgccgccatcgaggcggcgcgggccggcgaccagggtcgaggcttcgccgtggtcgccgacgaggtgcgggcgctggcgcggcgcacccaacagtccacggccgagatcgagaccctgatcggtgccttgcagaatggcacgcagcaggcggtgcagcgtatgcagcgcagccaccagttggtggaccagagcgtcgacgacgcgttgcagaccgaggcggcgctgggcaacatcgccacggcggtggcgctgatccagcagatgaaccagcagatcgccgcggcctccgagcagcagagcgcggtcgccgaggagatcaaccgcagcgtcacggcgatccgcgaggtggccgatcagtcggcccaagccatgcagtcgacggcttcgtccagcgaacaactggcggagctgggccgcgaactacagggcatggtcaggcatttccgcttgtag

SEQ ID NO: 7386 - DNA, 945 bp, Pseudomonas aeruginosa
actggcgcggcccggttccgtcgcggttggcggaaggcgattttccgaggagcagcagatgagcaaacttctttccggccaggtcgcactggtcactggcggtgcggcgggcatcggccgcgctaccgcgctggccttcgccgccgccggggtcaaggtggtggtcgccgacctggacagcgccggcggcgagggcacggtcgaagcgatccgccaggcaggtggcgaagccctcttcattcgctgcgacgtcacccgcgacgccgaggtcaaggcgctggtagagggttgcgcggcggcctacggccgtctcgactacgccttcaacaacgccggtatcgagatcgagcagggcaagctggccgacggcaacgaagccgagttcgacgccatcatggctgtcaacgtgaagggcgtctggttgtgcatgaagcaccagatcccgctgatgctggcccagggcggtggcgcgatcgtcaacaccgcctcggtcgccgggctcggcgcggcgccgaagatgagcatctacgctgcttccaagcacgcggtgatcggcctgaccaaatcggcggcgatcgagtacgcgaagaagggcatccgcgtcaacgccgtgtgtccggcggtgatcgacaccgacatgttccgccgcgcctacgaggccgatccgcgcaaggccgagttcgccgccgcgatgcatccgctgggtcgggtcgggcgggtcgaggaaatcgccgccgcggtgctctacctgtgcagcgaccacgcgggcttcaccaccggtatcgccttgccggtggacggcggggcgacggcgatctgagcgggcggcgatacaaccgggatgccccggcgcggggcattcgcattctgttacaggtcggcacgcggtttggcgcgccaggccactgccgggggactaacctgggtcgagaatccggggcctga

SEQ ID NO: 7387 - DNA, 927 bp, Pseudomonas aeruginosa
gcccgtctccatcgcatcggagcaataacaataatgaccgccgatcccatcctgaccctgttcctccccatcgcactgggcatcatcatgctcggtctcggactgtccctgaccccggccgacttcctccgcgtggtgcgctacccgaagccggtgctggtcggcctggtgtgccagatcgtcctgctgcccctggcctgtttcctgatcgtccagggcttcgccctggaggcggccctggcggtcggcatgatgttgctggcggcctcgcccggcggcaccaccgccaacctctacagccacctggcgcatggcgacgtggcactgaacatcaccctgaccgcggtgaactcggtgatcgccatcctcaccatgccgctgatcgtcaatctgtcgctgcaatacttcatgggcgacgggcaggcgattcccctgcagttcggcaaggtcgtgcaggtcttcgtcatcgtcctcggcccggtggccatcggcatgctggtgcgcaaccgcctgccggccgtggcggatcgcctgcagaagccggtgaagatcctttccgcgctgctgttgctggtgatcatcctgctggcgctggccaaggactggcagaccttcgtcacctacgcgccggtggtcgggctggccgcgctggccttcaacctgctgagcctggcggtgggctactgggtgccgcgcctgctgcgcctgccgaaggcccaggcggtggccatcggcatggagatcggcatccacaacggcaccctggcgatcgccctggcgctgagtccgagcctgctgaacaacagcaccatggcgattccgccggcgatctacggagtgctgatgttcttcaccgcggcggccttcggctggtgggtcagccgtggccaccaggccacgccggcgcccgtgacggcgccggactga

SEQ ID NO: 7388 - DNA, 651 bp, Pseudomonas aeruginosa
ggtcggtcagccgcgccgccagttgagcacgaactgagtcagcaggccggccaccaggccccagaacgccgagccgatggacagcagggtgaagccggaggcggttaccatgaaggtcaccagcgcggcctcgcgctggcgctcgtcggccatcgagttggccaggccgttcatgatcgagccgagcagggcgatggcggcgatggacagtaccagtgccttggggaacgccgcgaacaacgctgccagggtggcgccgaaggttcctgcgacgcagttgaagaagccgcaccagagcgccgcggtatagcgcttgtgcgggtcctcgtgggccgagggaccggtgcagatcgccgcgctgatcgccgccaggttgatcccgtgggagccgaacggtgccagcaggatcgaggcgatgccggtactcgagatcagcggcgaggctggcacctggtagccgtcggcgtgcagcacggcgatgccgggcatgttctgcgaagccatggcgacgatgaacagcgggatgccgatgctgatggtggcggccagggagaagctcggcgtggtccactccggtaccgccagttccaggcggaacctgctgaagtccagttggcccagtatcccggccagcagcacccccaccagtag

SEQ ID NO: 7389 - DNA, 432 bp, Pseudomonas aeruginosa
cgcagcgaacaccgcatagcgcggcgagaagcgtttgcacagcagatagctgaagaacatcgccagcaccagcagggtctgttgctcggcggcgttgcagatctcgatgccgatgcggaacagcaccccggccagcagcgccgaggccagcgaggagggaacctggcgcatcaggcgttcgaagctgccggtgacgccgcacagggtgatcaggagggcgcagacgatgaaggcgccgatcgcctcgctgtacggcactccgggcaggctgctgatcagcagcgccgcgccgggggtggaccaggcgatcacgatcggcacccggtagcgcagggtcaggccgatggtcgccaggcccatgccgatcgacagggcccagatccaccaggaaatctgcgcgctgctgagaccggcgttctgcccggcctgtaa

SEQ ID NO: 7390 - DNA, 891 bp, Pseudomonas aeruginosa
acgcatctcccgcctgaaaagctccttgatccgcgaaatccttgccgcggcgcagcgtccggaggtgatgtcgttcgccggcgggctgccggccgagccgatgctgccgaaggtgcagtgggagcagatgccggcctccatgggccagtacggcatgagcgaaggcgagcctgccctgcgcgaagccatcgccgccgaagcgcgtgccctcggcgtcccctgcgaggcgagccaggtgctgatcgtcagcggttcgcagcagaccctcgacctggccagcaagctgttcatcgatccgggcaccgaggtgctgctcgaggcgccgacctacctcgccgcgctacaggccttccaattgttcggcgccgattgcgtgaccgtgccgctgggtgccgagggccccgacctggttgccctgcggcagcgcctggagcgacacaagccggccttcgcctacctgatcccgactttccagaatccgtccggcgtgcgctacagcgaggaacgccgcgacgcggtggcggcgctgctagacgaattcggcgtgaccctgatcgaagacgaaccctatcgcgaactggtgttcgacgagggccgcgcaaccccgctggtcagccgcctgcgcaagtccagctggatctataccggcacggtgtcgaagaccctgctgccgggcctgcgcgtcggtttcctgatcgccaccccggacctgttcccccacctgctgcggctgaaacagtcggccgacctgcataccaaccgggtagggcagtggcaggcgctgcaatggttcggcagcgaggcctaccgccagcacctggccgaactgcgcgagttctaccgggtccgccgcgacgccatgcaggaggcgctgctggagcacttcggtga

SEQ ID NO: 7391 - DNA, 846 bp, Pseudomonas aeruginosa
gctggccgaatggaatatcccggagggcgggctgttcttctggctgaccctcaggcagccgctggatacccgcaccctgctccagccggcgctggccgccgatgtcgcattcatgcccggcgaacctttcttcgccgagccggagcagaacctcgggcgtctgcggctgaacttcagccacgtcgccccggagcgcctgcacgaaggcctgcggcgcctggccaaggtcgtccgcgacgcccaggccgccgaagcggcctgaaccctcatcggcgctcctccgagggcgccggccatccgatccgaggagcgacacgatgtacaaggtctacggtgattaccgttcgggcaactgctacaagatcaagctggccatgtcgctgctcggcatcgactaccagtgggtaccggtggacattctcaagggcgagacccagaccccggagttcctggcgaagaaccccaacggcaagataccggtgctggagctggaggacggcagttgcctgtgggagtccaacgccatcctcaacttcctcgccgacggcagcgccctgttgcccagcgaaccgcgcctgcgcacccaggtgctgcaatggcaattcttcgagcaatacagccatgagccctatgtggccgtggcgcgcttcatcaagctctacctcggcctcccggaagcccgccgcgccgagttcgaagagaagaagatcggcggctacaaggccatcgacgtcatggagaaacagctgtcgcgcacgccattcctggtcggcgaacagttctccatcgccgatatcaccctctacgcctacacccatgtcgcccatgaaggcggcttcgacctga

SEQ ID NO: 7392 - DNA, 411 bp, Pseudomonas aeruginosa
ccagcggctggtcgggatcgccttcgaggaaggtcaccagcacctccatgccgacccgcgggatggcgatggcaccgtagttccttcccgcccagccggaggcaacgcgtaaccagcaactgctgctgtcgtcggcctggccctcgcgatcccagtggaattgcaccttcacccgaccgtagcggtcgcaatggatttcctcgcccttcggtccggtcaccaccgcgctctgcgtgccgaggatgcgcggcttcggcggcgtcggcgggggacgaaagaacgcctcccagggcgtggcctggaagcggttgcggtaaccctgccggaagtcgtccgggctcgcagagacgtcggagacgatgctttcttccagcacctgcggctgccgcccctcgtgaatcacctcggtga

SEQ ID NO: 7393 - DNA, 840 bp, Pseudomonas aeruginosa
ctgatggcttcgcggccgctgaaggagagcacctgcaggtcgagggcgaggccgtcgatggcgaggctgaaatgggtctggttggctgctgcgaacatccgttgtccctcactggcgcaggcgaccgattcgattgtcctgcctggcgcgggcgagacaagggcgcgcaggctcgatcggaagctgcctacaacaaacaaagcggcatcgacccggcgcgggctttcctggccacggcgctatgggtcatcgagggcacgacggccagcgaggctggccgcgtgcggcggtcgcggctcagccggcgaccggggagcgccagtcgtcggagccggaggtgccggagacttcgtgggtccaggtgatcttgcggtaggtgaagtgcacgtcttccaggtgggtgaagtgggcgttgcccgggtcctggcagttgtgcatgtagtccttgatgtcgacgatgatcgcgtcttccaggacggtggtgtagtagtgctcctgggtgccggcggcggaggtgcggtaccactggatctcgaccttggtcaggcgctcgccggaggtcagggcggccagcagcagcggcgaggccttgtcgaagaccttggtgatgaccaccggcttgtgcacgcgctggccggtcggctggccggactgcgggtcgcgcgggatgatcacttcgtggttgaagccctggaccatcacctggtcctcgtggccttcctggtaggtgttgccgaccgaatcctcggtgaaggcgccggcggtgatcaggccctgcttggtgccggtgatggacatataggcgggggttgccatggatgcattccttgtcagtggtag

SEQ ID NO: 7394 - DNA, 381 bp, Pseudomonas aeruginosa
tcatgtcgggtatcgctaccttcgcggccatccgttggccaagcagggtggacaacttcccgccgccgcacaagcggtactttgcgccagaacgaggaacgcccgatgagcgaacaggacgacaaccaggaagacggcttcgccgaggaaaaactgatccaggccatcgagaaccagatcgaaagcgagaatccgccggcggcgcgcgctgtgttcaacaagctgaccctggtcggctacgagcgcgacgaggcgctgggcatgatggcctacgtgctggcccacgagatcaacgccatgctcgccgccgaccgcgctttcgacagcgccggctacgagcatgcgctgcgtgccctgccgacgttgccggacgacgaatga

SEQ ID NO: 7395 - DNA, 900 bp, Pseudomonas aeruginosa
gcggagccgggccgactggtgccggcgaatgcccctcgtatccatacggttttgtttcgccaaacgcctgccgctctggtagaaaggtggcgcccactctccgtgccacctgctttcgcggagcgataccggatgcgatcctggttccacttcctgcccatctgcctgctgctggccctttccggcccggcagcggccgtcccgacagaacccctggtgctcggcgccgaagacgactggtatccctataccgcctacaaggacggccgcatccagggcatgagcgcggacatcgtgcgggccgccttcagggctgcggacacgccggtccagctcaatccctacccctactcccgctgcatgaagctggccctgaaaggcttgatcgccggctgcttcaacacctcgccgaacccgcacatcctcgccgactaccgtctgccccggcatccgttgttccgcgcggagatccagctctgggcgcgacgcgacgaagcgcggccggtggatgcggagcaggcgctgagcggccggaaagtcgcggtgaccctcggctatgaatacggcgacggcttcgatcgccgccacgacctggtgcgcatcccggtacgcaaggactactacggtttcctcatgctccagcgcggccgcgtcgactacgccctggcctaccgcaatacggctcgccagttgttcagcgaacatcccgaactggaaggccagttccagccggtggccacggtccaccgcccggagctgtacctgtcgttctcgcgccgccacccgcaggccgagcatctgctcgaacgcttcgacctcggcatgcagcgcatcctcgccagcggcgagtatcagaagatcctcgacggctggagccaggccgccgacgctacgccctag

SEQ ID NO: 7396 - DNA, 276 bp, Pseudomonas aeruginosa
tccaactacactcaccggtgctcaacaccgcaaggagccgacatggccttcactcccgagctgatcgacgaactggaactgctggcgctcttcaacctgaacaacacccaggaaggactcaaggtccatcacaccgccgacggcaaggccgtcgccgccgcccgacgcctgcacgacaaggggctgatcgaccagcccgacggcggctacctgaccagtctggggctggacgccgcggagcaggcacagggcctgctgaccatcctcaagggttga

SEQ ID NO: 7397 - DNA, 762 bp, Pseudomonas aeruginosa
cggaagcggccatcgcgacctgctcccgacaggccgcgacggttaccccggttcgcggtgcggtgctcaagccgccgcgcttccgggcgatacaatggcatgaccggagccaggcacggcgcctggccttgcctgtgcccggacgcccatgaaccgacatcccgcactcagcctcgatctcgacgatggcatcgaccgcaaggtcctcggccagttgcgccaacgcttcctggcggtcaatgccggtcgcctgcaacgcgcccggcaggcgttgtccagccgccaggagcgggtcctgcgcctgctaccgctgctgttccacatcaaccatccgctgctgccgggctacctgtcggccagcacgccagcgggcctgagcggtttcgaggcggacgacgaagtactcgccgaagcccagcgcctggcccgctcgtttgtctacaagccacgcaggcaagaacccgcacagcagccgatccacggcctgttcctgatgggcagcctggggagcctggcccaggaggaacagagcgatctcgacctctgggtctgccatgccccagaactggagcccggcgcgcgccaggagctgcgccgcaagtgcgcgttgatcgaggactgggcgcgcagccagggcagcgaggtgcactgtttcctgatcgacgtcgcccgtttcggccaggacgaacgcaaagactggaaagagtccggcggcgacggcaatacccagcacttcctgctgctcgacgagttctaccgtag

SEQ ID NO: 7398 - DNA, 486 bp, Pseudomonas aeruginosa
ctacgcgcctctgaaacgcagcctcaggctggtcgagctgctcgcctggtgccatcgcaacggcgtcatcgacagcgccacccggctgtccctgcatcccggccagagcgacctcggcgatgccgaactggacaatctcctgggcagcctgcggcagttcctgcctgtccccctggcgaccgtggacgacgccgacctgctgcaaccgcgtcggctcaagagcgtcctgctgctggtcaacgtcggtgtcgacccgctgcgccaccacagccagatgaacctgcacatggctaccgggcgtaccgacgtgctcggttatgccggggtgcgcgacaacctggtgctgaccctcgaccagctcagcctcaacagctggaacgaactgacggtgcgccattacgcaggcccccaggcgctgcccgagtgccttgccgagttcctcgacgccgtccgcgaaaagcccggaagcccgccgcagccgcctga

SEQ ID NO: 7399 - DNA, 405 bp, Pseudomonas aeruginosa
actgatggtgcgctgcttctgtcgcaaccgggccgccgccatcgccgtgcgggtcgaagagctgttccgcgagacctacgggcaactgcttggcggccagccaagccgctacctgctgcagatccgccagcagtaccacctgctggaaatgtcgccggaagcggtcagccacgagagcctgcccgacctgccgagcctgctccagcacctgggccgcgagcgagatggctacagcgccctgaagctggatcgtcacgccctggagggcgaggacctcgggctgatcctgtccatggggcggccggactgcatccaggtgttctaccggcgcgacttcgacagcgccgagatcagcctgctcgacgaacgcaacgccctctggcgccagcgccaggcattgcgtga

SEQ ID NO: 7400 - DNA, 690 bp, Pseudomonas aeruginosa
actgcgcgcagcggcaagacggcggcgcagcggtgtattgcgccagccatatcggttgcagcagcggctgcgccagcgatagcggcagtaccttcggttcggacggacaggattcgcgccacggcagcggcggcgatagcggcggagacggcggcagcggttgcgggggtggaggatgcgggggcggtgggggcgactgagggtcgcgaagcccgtcgccgaatggcgacgggcgaaaaccgatcagcgcgcgtagtcgccggcggcttccggctggtattcgatttccagcagggtcagcttcagcgtcttgccgctcggcgccggccagtcgatggtctggccgatggtcaggcccagcagcgcggtgcccaccggcgcgaggatcgagaccttgccttcgccggcgacgtcttcgggatagaccagggtcagggtgtactccttgccgctgctttcctcgcggcagcgcacggtggagttcatggtcacgacgcccggcggaatctcgtcatgccccaccacctgggcgcgcgacagttcggcctccagcgcctcggcggcgggtccgaattcgtccaggccatccagcaggcgctccaggcgctgcaggtccagacgagtgatggtgatcggcggcgtgctcatgatcgcaggcgtgctccttggtccggttcggttgatcgatga

SEQ ID NO: 7401 - DNA, 1395 bp, Pseudomonas aeruginosa
agcggctgttcctgtccttcgtcgcgctcgccctcctcgccggctccatcgccgcctgcggccagaaaggcccgctgtacctgccggacgacgaaaaagccaagaaagaacacagcaaagaccgctacggtttctgagagagcgcccatggacacattcagttaccgcgacggtgagctgttcgcggaaggggtggcgctttcccgcatcgccgagcgtttcggcacgcccacctacgtctattcccgcgcacacatcgaggcccagtaccgcgcctatgccgatgccctcgccggcatgccgcatctggtctgcttcgcggtcaaggccaactccaacctcggggtgctgaatgtgctggcgcgcctcggcgccggtttcgacatcgtttcccgcggtgagctggagcgtgtcctggccgccggcggcgatccggccaaggtggtgttctccggcgtcggcaagacccgcgacgacatgcgccgcgccctggaagtcggcgtgcactgcttcaacgtcgagtccggcgaagagctggagcgcctgcaacgggtagctgcggaactcggcgtgaaagcgccggtatcgctgcgggtcaacccggacgtggacgcccagacccacccctatatctccaccggcctgaaagagaacaagttcggcatcgccatcgacgaggccgaggcggtctacgcccgcgccgccgagcttgaccacctggaggtgatcggcgtcgactgccacatcggctcgcagttgacccagctggagcccttcctcgacgccctcgagcgcctgctcgggctggtcgaccgcctggccggcaaaggcatcggcattcgccacctggacctcggtggtggcctcggggtgcgctaccgcgacgaacagccgccgctggccggcgactacatccgcgccatccgcgagcgcctgcacggccgcgacctgaccctggtgttcgagccgggccggtccatcgtcgccaacgccggcgtgctgctgacccgtgtcgagtacctcaagcacaccgagcacaaggatttcgccatcgtcgacgcggcgatgaacgacctgatccgcccggctctctaccaggcctggatggacgtgcaggcggtacgcccgcgcgacgccgcgccgcgccgctacgacctggtcgggccgatctgcgagaccggtgacttcctcgccaaggatcgcgacctggcgctcgccgaaggcgacctcctggcggtgcgctcggccggcgcctacggcttcgtcatgagctcgaactacaacacccgcggccgcgccgcggaggtgctggtggatggcgagcagacccacgaggtccgtcgccgcgagaccgtccaagagctctacgccggcgaaagcctgctgccgcagtga

SEQ ID NO: 7402 - DNA, 432 bp, Pseudomonas aeruginosa
cgtctcggtgggccgctcggtgagcagcgcggaggcgcaccaggccatcggcggcctgctctccggcggcaagaccgtctgcggcgtgctgcgtccgcacgaactggcgttcctcttcggcgagagcgaccgcgacgagatcggctccgcagcggtggtctccctgagtttccagggcctacacggcgtgctcgccatcggcagtcccgatccgcagcattacaagagttccctcggcaccctgttcctcggctacgtcgccgaggtcctggcccgcgtgctgccgcgtttctcctcgccgctgcgctcggtccgctgagcgcggcgggcggtccgagatgcgcgccgacctggatgccttcctcgaacatctgcgcagcgagcgccaggtctccgcgcacaccctcgacggctaccgccgcgacctgctga

SEQ ID NO: 7403 - DNA, 771 bp, Pseudomonas aeruginosa
cgccgcgggcgatccagctgcgggtgcgccaggccggcgtccgcgagctgggccagcacctgcacccgcacatgctgcggcactccttcgccagccatctgctggagtcgtccggcgacctgcgcgccgtgcaggaactgctcggccacgccgacatcgccacgacccagatctatacccacctggacttccagcacctggcctcggtctacgaccgcgcccatccccgcgccaagcgcaagggcaacgccgatggaggcaacgacccatgagcagcctgcgactgatcaccttcgacctcgacgacaccctgtgggacgtcgccccggtgatgaacaacgccgagggccctgctccgcgaatggctggcgagcaacgcggcgcgcctgggtccggtacccatcgagcacttgtgggcgatccgcacccgcctgctggatcgcgagccgatgctgcgccaccgtctcagcgagctgcgccggcgcatcctgttccatgccctgctcgacgccggttatccacaggcggaggcggaaagcctggccgaggccggtttccaggtattcctcgaagcgcgccaccgggtcaccctgtttcccgaggtccacccgaccctggagatcctcgccgaccgcttcaccctcggcgtgctcaccaacggcaacgccgacgtgcgccgcctgggcctggccgactacttccggttcgccctctgcgccgaggaactgggcgtcggcaagcccgacccgacgccattccgcgaagccctga

SEQ ID NO: 7404 - DNA, 537 bp, Pseudomonas aeruginosa
ccagacccacagtggcccatgccagcaggatcgagaggccgtacggcaggctgccggcgggaaagaacggcagccgcagcatcggcgtatcgcgcccgcgcggcgcctcgtccggcaggcccgccaccgccgccagggccacgcaggccagtcccagctggacccagaagctgccgggcaccaggctctcccggaacagcaggaacagactggtcagtgccgcgccgaggccgaagccgagcgaggtgctggcggtcacccagttggccgaggtgcgagaatccccgcccgcgatcagttcgctcatgtaggccgtcccggtggccgatgccagggccgtgccgacgccgagcaacaggcgcgccacgccgagcgcctccaggcgcggccagagcgccatcaccagggtggccaccatcgacagcagcagcgcgacgacgatcggcggcttgcgcccgatccgatcggacaacccgccgagtaccagcagcaccggcagtacgccgagcacatagccggagaaagcgctggcggtag

SEQ ID NO: 7405 - DNA, 828 bp, Pseudomonas aeruginosa
gtcagacatgcacctccggatcgaccgcaatgccagcgagccgctggtgcagcagatcgtcgcaggggtcagcggctggatccgcggcaatcgcgtccgcgccggcacgcggattccgtcgatacgccagttggccagggaaaaccagctcagccagtccagcgtgatcgaggcctacgaccgcctggtcgccctggggatgctggaatcgcggcacggctcggggttcttcgtcgccgaggcgcccgccgccactaccgacctcgacagcgaatggcacgaaggcgcggaaaacgcatggggccagttcagcggcagctcgacgaaactcaagctcggctgcggctggattccggacagttggcgggaagtcgaggaactcagctacgcgatccgccaggtcgcccgcagcgaactcgccgggctgttcgactacagcactccgctgggcctgccggcgctgcgccagcacatccagaaacgcctgcggctgatcgatatccatgtcgacccggagcagatcctcaccaccaccggcgccagccatgccctcgacctgttggtacgcacgctgctcaagccgggcgacgtggtggtggtggagaaccccggctactacaacctgttcaacctgctgaagttccacggggtgaagatgctcggcgtgccgcgcacccgccacggcccggacaccgccgcgctggagacgatcctccgcgcgcacaagccgaagttccttttcaccaacagcatgtaccacaaccccaccggcaccagcctcagcccctcagtggcccaccgcgtgctgcaactggccgagcagcatga

SEQ ID NO: 7406 - DNA, 567 bp, Pseudomonas aeruginosa
cgctgccaccggaaaggaaaaggccttggcccgtcgccagccgtgcctgaacaggcgaaagatcggctcgccaaccgggatgcggcggcctgtcaaagtgaccggcgccatagcacaaggcccgccatcccttgcgggaggcgggccttgggatggcgcgaaatcagatggggcggctgccgtacttgctgtccggcttcttcggcggatcggccaccacgttgggttcgatctcctgcacctttccaccgcgggaaaggaactcctccatcgccttggcgagggcgtcacgctctttctgcttggcttcgaccgagggcagctcctcttccaccacggcggctttcgccttcttcccgggggcgggggcctcgtcgccgtcgccgctgtccgcttcgccgtcgtcggccgcggccagctcttcgccgtcgtcctcgtcagcgccgtccagctcgtcctgttccagttcttcttcgctcatggtcaacctctcggtgctgcaaaagcaggttagttatagcccagccgcgcgttttgatgagcgccgccggaaaaaattcatactga

SEQ ID NO: 7407 - DNA, 216 bp, Pseudomonas aeruginosa
agccgacgtatgttgcaaaagcaggtgcagcaggccgacccggcactgccgaagctccggcaaggcgtcgagtatctcctcggtgacgaggtgaaagccccgcggacgcgggcgcaaggtgatcagggtctgctgccacatgctgctgttccaaatcggctccgatccgtcgcgccgcgcattctagcgcggcatttgaaaaagcaaagagcgtaa

SEQ ID NO: 7408 - DNA, 489 bp, Pseudomonas aeruginosa
accacggtgaaggccacgcccttgaactgcacgaagaactgcgcgccgatgtcctccacgctgccgaagccgcccagcgacggcgccgcgaagatcccggtgagcagcgcgccgacgataccgccgaccgcatgtacgccgaaggcgtcgagggaatcgtcgtatttcagcgcgcgcttgagactggtggcggcgaagaaacagatcaccccggaggccaggccgatcaccagcgcgcccatcggaccggcggtgccggcggccggggtgatggccaccagaccggcgaccacgccggacgcgatgcccagggcgctcggcttgccgtgggtgatccactcggcgaacatccaggccagggccgcggcggcggtggcgatctgggtcaccagcatggccatcccggcggtgccgttggcggcggcggcggaaccggcgttgaaaccgaaccagccgatccacagcatggccgccccgaccaaggtgtag

SEQ ID NO: 7409 - DNA, 1035 bp, Pseudomonas aeruginosa
atcgcgtcggtatcggtttcgccggtacggatgcggatggcctgttccaggttcaccacgaagatcttgccgtcaccgatcttgccggtattggccgccttggtgatcgcctcgatgacgcggtccagctggtcgtcggcgatcgccacgtcgatcttcaccttgggcaggaagtcgacgacgtactcggcgccgcgatacagctcggtgtggcccttttgccggccgaaacccttgacctcggtcaccgtgatgccctgcacaccgatctcggacaacgactcgcggacgtcgtccaacttgaacggcttgatgatggcagtgactagcttcatgaaactctctcccgtgtttggtggactcgccccaggaaaacgaacccgaggacagtctaagcgcagtgtctggctttgtaacgcgccggtccctctgggaagcatgatcgggaccctccgccccgacctggccctgctgcggccgttcgatgccgcaacctgccggcctcccgcaaccgcctcatctgccgcaccggtactgcttcagtgcacgcctcaccccggccaaagcagaaagcttgccagctccggcaaatccgccggatttcaagttcttagccgccaacccggggatagtgcggaacgccgggctccgggcggcgcaccaaataggcgcagacgcgctccgacagttgcgcaaaaagtgtgcaatggccctcccgcgagcgccgccgacatcgtgctagactgccgcccactcgttaccggaaccctcgccatgctgccgcccaaagccgtcttcgaagccctcagccaacaagccagccgcctgttcgccggcgaatcgccgttgcccaaggccgagctggagtcgcagttccgcgccctgatgcagagcgccttcagcaagctcgacctggtcagccgcgaggagttcgacagccagatgctggtcctcgcccgcactcgcgcacggctggaagccctggaggccaaggtagcggaactcgaaagcaagctgacgccgcccgccgactga

SEQ ID NO: 7410 - DNA, 1578 bp, Pseudomonas aeruginosa
gatcaaggagcgatccatgtccctggcgattgtccacagccgagcccaggtcggcgtcgaagccccctgcgtcagcgtcgaggcgcacctggccaacggcctgccttcgctgaccctggtcggcctgccggaaaccgcggtgcgcgagagcaaggaccgcgtgcgcagcgccctgctcaatgccggtttcgacttccccgcgcggcgcatcaccctcaacctcgcccccgccgacctacccaaggacggcggtcgcttcgacctggccatcgcactcggcatcctcgccgccagcggccagttgcccggcaccgccctcgacggcctggagtgcctcggcgaactggccctgtccggggcgatccggccagtgcgaggcgtattgccggccgcgctggcggcgcgcgacgcaaggcgcgttctggtggtaccgaaggaaaatgccgaagaggccagcctggccagcgggctgacggtgttcgccgtggaccacctgctggagatcgccggacacctctccggccaggccccgctgccgccctaccaggcccgcggcctgctccgcgcgcccttcccttatccagacctggccgaggtccagggccaggccgccgccaagcgcgccctgctggtggccgccgccggcgcgcacaacctgttgctcagcggcccgccgggcaccggcaagaccctcctggccagccgcctgcccggcctgctgccggcgctcgacgaggacgaagccctggaggtcgcggcgatccattcggtggccagccacgtccccctcaggcactggccgcagcgaccgttccgccagccgcaccactccgcctccgcgccggccctggtcggcggcggcagccgcccgcagccgggcgagatcaccctggcgcaccagggcgtgctgttcctcgacgaactgccggagttcgagcgcaaggtcctggaggtcctgcgcgagccgctggaaagcggcgagatcgtcattgcccgggccaacggccgggtacgtttcccggcgcgcttccaactggtggcggcgatgaatccctgtccctgtggctacctcggcgatcccagtggccgctgccgctgcaccccggaacaggtccagcgctaccggggcaagctgtccggaccgctgctcgatcgcatcgacctgcacgtcagcgtgctccgcgaaagcaccagcctgcagccaggacacggcgaaaccgctaccgccgaggtcagcgaacgggtgggcgccgcacggcaacggcaactggcccgccagggctgcgccaatgcccatctcgatctccaggcgatgcaccgcaattgtgcactcgccgaagcggaccgccgctggctggaggctgccggagagcgcctggaactttccttgcgcgccttgcatcgcatactcaaggtggcccggacgctggccgacctggagcgcatcgatgccatcgaacgccggcacctggcggaagccctgcagtatcgggcaatgacctccacgtgaagcgtaataattcagcaaagctatcgattaaggcttttcgaatcaaattagctatcacgatgtgttag

SEQ ID NO: 7411 - DNA, 723 bp, Pseudomonas aeruginosa
cctcgcgcggcggcgacgatgcccagttccagcgtgtcgaacacctggccgcccttgagcgacacctcctcccccagcccggtccgttgcagccagcgtcgccagtcgcgacgatccggcgtagggtgcagcaactcgctgtcacgcaggcgttggagggtccagggctccacggcctcgtcgggatcgcagaccggcaccagccattcggcgaacagcgctgccgtttcccattccgggctgaactggccgctgcccagcaacaccgcgcagtcgaaaggctcgcgctggaagtccaccgagtccacatccatccaggcactggtgagctgcacctcgatatccgggttcaggtggcggaagcggctcaggcgcggtagcagccagcgcagggtaagggtggaaggcgccttcaggcgcagggtggcgtcgtccacacgcagggcggtgcaggcccgttccagcgcatcgaagccgtcgcgcagcccgggcagcagcaggcgtgccggctcggtcagctgcaactggcggccatggcgctcgaacagacgacaaccgaagtgctcctccagggtacggatgtgccggctcaccgcgctctgggttatcgccagttcctcgccggcgcgggtgaaagaggcgtgccgggcggcagcctcgaaggcgcgcagggcatacagcgggggcaggcgacgggtcattggggaattacctctttcatga

SEQ ID NO: 7412 - DNA, 1593 bp, Pseudomonas aeruginosa
cttttactcatgcctggcatcttgtttttccttttgtggagccatgccagtcgcaccgagaatagccgcattctcaacgccgacaggccatcgcggcaaccatctcctcctgagccttactcatccatgtcctcgccatccctcgtcgaactcaaagccatcctgcgcctggcgggcccgttgatcgccgcccagctggcctatgtcgccatggtcttcaccgacaccgtgatgatgggcaagctcggccccgacgcgctggccgccggcggcctgggcgcggtcagctacgccttcgtctcgacgttctgtgtcggcgtggtggcagcggtcggcaacctggtggcgatccgtcacggctgcgacgacgccgctggcgccgccgcggccgctcgctccggactctgggtcggcgccgcgctggccctggccgccggcctgctgctatggaacctgcggccgctgctcctggtcttcggccaggcgccgcagacggtggacggcgccatgcagttcctccacagcctgacattcgccctgcccggctacatggccttcatggtcctgcgcggcttcaccagcgccatcgaccgcgccggcccggtgatggcgatcagcgtgctcggcgcgctggccaacctggctctcaactattccttcatagaaggcctgttcggcctgccgcgcctgggcctggccggtatcggcctggtcaccgccctcgtcatgaactgcatgccgctgctgctggccctgtatatccgcctgcagccggcctatgccgagtactcgctgctgcgcggactgggacggccgcagcgggcgatggtcgaggagatactgcgcctggggctgcccatcggtggcacctacgcggtggagtcggggatgttcacggtcgccaccctgtgcatgggcatcatcggcgatcacgccctggccgcgcaccagatcgccatccaggcggtatacgtggcgttcatggtgccggtggggttgtcgtacgccaccacctaccgcatcggccagcatttcggcgccggccgcctgctcgaagcacgccgcgccgggcgtgtcggcatcggcttcggcgcgctgtgcatgctgctcttcgccgggctcttctggtggatgccggaggccatcatcggcctgttcctcgaccgcgacgccccggccaaccgggaggtggccgcgatggccgtctcgctgctggcgatcgccgcctggttcgagctgttcgacggcacccagaacgtcgccatgggcgcgatccgcggtctcaaggacgcccgcaccaccttcctggtcggcctggcctgctactggctggtcggcgtgccgctggcctgcctgctggcgttcgcggccggctggggcgccgcgggcgtctggtgggggctggccggcggcctggcctgcgcggccattggcctgaccctggccttcgagtggaagaccgcgcggttgctgccgaaagccacggccagcgaggcgtcggcgctcaattgccgagcggctggccgcggtgcgccgagcgctcgcctatgcccaggaaacgcgccagttccgccaacggcagcggcggactga

SEQ ID NO: 7413 - DNA, 1083 bp, Pseudomonas aeruginosa
cgaattccattcgaggacagcttcatgtcgagcaagaaagtcgccgagatcgtcgtggaaaccctggaagccgccggcgtccgccattgctatggcatcgtcggcgacaccctcaaccatgtcaccgacgccatccatcgcagccagatccagtgggtccacgtgcgccacgaagaagcggcggccttcgccgcgggcgccgagtcctacatcagcggacgcctgaccgcctgcgccggctcctgcggaccgggcagcctgcacttcatcaacggcgtctacgaggcccagcgcaaccgcgcgccgatggtgctgatcgccagccagatcgttaccccgcaactgggcatggagtttccccaggaggtcgacttcaaggcggtctacgccagctgctcggtgttctgcgagcaggtgcacagcccggaacaggcgcgccgggtggtggccctggcctgccaggcggcgctcaaccggcgcggcgtggcggtggtgatcctgccggccgacatcagccaggccacggtgaaggacgacctgccgttctcggtgcatttcccgcaaccggtgctgcgccccagcgacgccgaactgcaggacgtcgcccgcctgctggcccacggcaagaagatcggcatctacgccggctccggctgccagggcgcccacgacctgctggtggccctcgccgaccgcctcaaggcgcccatcgcgcacacgtcgcgggccaaggacttcgtcgagtacgacaaccccttcaacatgggcatgaccggtatgctcgggatcgagtccggcttccacatgatgaccgagtgcgacaccctcctgctgctcggcgccgacttcgcctgggcgcagttctatccgcagaaggccaccctgatccaggtcgaccgcgatggcagtcacctgggccgccgccaccccatcgatctcggcgtggtcggcgacgtgatccccagctcttgccgttgctcgaagcccgcgaggagcgcagcttcctcgacgaatgcctggagcaccgcgagcgctcgctgcggacgctggaaaaagaggagcaagccggcaagggcgagctga

SEQ ID NO: 7414 - DNA, 741 bp, Pseudomonas aeruginosa
aatgagccggcagcggcgcggcccgcctgccacggggccgcgccgggcaggcgcggattcctgaccgctcgatcatgttcgctcgtccgagagaacgtcgcgcgcggcgccggctggcggtacaatgccgcgcttcatcagcgacagccgcttcgcaggaagccacccgtggacattctcaaagacaaaatccgctcggaaggcatcgtcctttccgagcacgtactcaaggtcgacgcctttctcaaccaccagatcgacccgcagctgatgcagcaggtcggtcacgcgttcgccatgcgcttccgcgaccagggcatcaccaagatcgtcaccatcgaggcttccggcatcgccccggcggtcatggccggcctggagctgggcgtcccggtgatcttcgcccgcaagtaccagtcgctgaccctgaaggacaacctgtacatctccaaggtgttctccttcaccaagcagaccgagagcaccatcgccatctcggccaagcacctgaacgcccacgaccacgtgctggtgatcgacgacttcctcgccaacggccatgccgccaaggcgctgatcgacctgatcggccaggccggcgcgagcatcgccgggctcggcatcgtcatcgagaaatccttccaggatggccgcgccctgctggaaagcgaaggctaccgggtcgagtccctggcccgggtgaaatcgctggccggcggtcaggtcgagttcctcgactga

SEQ ID NO: 7415 - DNA, 195 bp, Pseudomonas aeruginosa
gcgccactcagccccgctcttcctggctggctcgcaggccggccagcagcaagcgctggtagagttcctcgcgaagcccctgcggatcgtccaggtccatgcgccgcagatgcgccgggtaggcttctggctccggcgcatccagggtcgccttgcccagttcgaggatctcgctcagcttcagcttgcgcttga

SEQ ID NO: 7416 - DNA, 471 bp, Pseudomonas aeruginosa
cgaagccgatgccggtcatgccgatcccggcgcgctcttccagcgacatctcgcgcaggcgccggtagaacgccaacggaccgaggaaaaagccgccgtgcagccacaccccgccctccaccggcgcctcaccgcgctcggcggcacgctgccgcgcttcgtcggggtagacccggcggctcagcacgccggcctcggccagcgccagcagacccggcacgaacatctcgctgcaaccgtaaagcccccggcggaacggctccaggccaccgtcgcgctcgatcgtctcggcccagcgcgcacgcacacccagctcgtcgatcaacgcccggtaggtggcgttgtcgcgctggcgcagcagcagggcggcggtcagcgcgtcgcccatcgagccgatgccgatctgcagggtgccgccgtcgcgcaccagcgcgctggcgtggagaccgatacagtgatcctgcaggttga

SEQ ID NO: 7417 - DNA, 267 bp, Pseudomonas aeruginosa
tgtagtgctgctgcgccggcgcgctgtccagcaggctgccgggctgcaggtagaactcctcgacgcggatgttcgccggcagttcgtcgcggcgtagggcgtgcaggtaatccagctccgggtagtcggcgaagacccgttcggcgaaaggctcgaggaaacgccgttgcaggtcgccgccagcggcgggacgccccagggaaagcgcggtatacagcgtcagttggcgctccggcagggtccgcaggcgctggtacaacgcattga

SEQ ID NO: 7418 - DNA, 423 bp, Pseudomonas aeruginosa
ctcatcatcacgatcttcgccaccttgccgctggcccgcaggcgctcgtgggcggcgcggaagtcctcggggaagaagccgacgcggtgcatgcccgaatccatcttcagccagacgttcagcgggcgggccaggctggcgcgttcgatcgcctccaattgccaggcgcaatgcaccacgcaccagaagtcgtgggcgacgatcagctccagctcggacgcctcgaagaagccctccagcagcaggatcggctggcggataccggcctcgcgcagctccaggccctcctcgatgcaggccacggcgaagccatcggcctcggccaccagcgcttcggcacagcgcaccgcgccgtggccgtatgcgtccgccttgatcaccgcgagcgcacgggcgccggtggcctcgcgggccagccgatag

SEQ ID NO: 7419 - DNA, 1428 bp, Pseudomonas aeruginosa
acggtgccgttgtggacgacgatctggctcatacgctcgttagtgtgctggcgctggatgggcattcttggcgttctccggggaattgctatagcgggaaatatccaggccttcggtactgatctgcgggcgcttcttcgccatcaggtcggccaggtagcgacccgacccgcaggccatggtccaacccagggtgccgtggccggtattgaggaacaggttgcggtagcgggtggcgccgacgatcggggtgccatccggggtcgccgggcgcaggccggtccagaaggtcgcctggctgatgtcgccgccctcgggatagaggtcggtggtgatcatttccagggtctcgcggcggcgcgggttcagcgacaggtcgaagccggcgatttccgccatgccgccgacgcggatgcgctggtcgaagcgggtgatcgccaccttgtaggtctcgtcgaggatggtcgaggtcggcgccatctccgggttggtgatcggcacggtcagcgaataacccttcagcggatagaccggagccttgatacccagcggcttgagcagttgcggcgagtagctgcccagggccagcacgtagtggtcggcggtgagcaattcgccgttgaccagcacgccgttgatgcggtcgccggcgaagtccaggcgctcgatgttctggccgaagcggaactccacgcccaggcccttggccatttccgccaggcgggtggtgaacagctggcagtcgccggtctggtcgttgggcaggcgcaaggcgccgaccagcttgtcggcgaccttggccaaagccggctctacgcgggcgatgccgtcgcggtcgagaacctcgtagggcacgccggagcgctcgagcacggcgatgtccttgccggcggcgtccagctgcgcctgggtgcggaacagttgggtggtgccgagggtgcggccctcgtaggcgatgccggtctcggcgcgcagttcgtcgaggcaatcgcggctgtactcggacaggcggaccatgcgctccttgttcacggcgtagcgctcggcggtgcagttgcgcagcatctgcagcatccaggcgtactggctgggatcggaggtgagcttgatggccagcggcgcgtgcttttccagcagccacttcatggccttcaggggaatgcccggggctgcccagggcgaagcgtagccgggagacacctggccggcgttggcgaagctggtttccagggcgggaccgtcatgacggtcgaccaccaccacctcgaacccggcacgggccaggtaatacgcactggcggtaccgatgacaccgctgccaaggaccagaactcgcattgtcgcctcccacgtcgcggaggaaccgcggacgtttgttattttgagcgtgtagatgcgcgcagtataggaagagggaggcagaaataa

SEQ ID NO: 7420 - DNA, 735 bp, Pseudomonas aeruginosa
cctggccgccggagacgctgggcttccagcggttcagcatcagcggcagctcgccgtccagggcgccttcgccggccaggccctccgccggatagacccggaaaatctcgccgagttgtatgccctggatacgcaaggcgaacttctgctcggcctgacccaggcggatgctccccgcggggaccgaggcctgcccgccgaacaggccgctctgcaacgtctgccagctcaaacggccgctgcccggcgcggaaagcggggcctcatagcgcccgcggaaactcaccggccccagcggcaggccgggattggcctcggccaggctcaggccggggctgtccaggctcaactgaccgccacgcaggcgcaaggccaggctgccgcccagccccttcagctcgctgcggtcgtagataccgtcgaggcctttcagggtcaggtccaggtcgagggacgaggcgcccgccgcatcgagcttccagccggccgcggcggtcgctcgcccattgcccagttcgagcagccccggccagtcggcgagggtcgcggccagcggattgccggtacggaagaacacctcggccagcctggcggagagcgccaggggcgtcttcgcgtcgcgctgcagctggatgtccgccgccaaccccgcgccgttgctcagccgtcccttcaggctggtgcgctcgagggtggtgtcgagcggcccctcgaaggtccaggccaacggtttga

SEQ ID NO: 7421 - DNA, 1335 bp, Pseudomonas aeruginosa
gctcctcgaagagctgggcgtcgagctgggcctgctgcgcctcctgttgcaggcgcagttgcgcagccagcggaaacagcgctcccgacgggcggccgatgtccagtccgccgtcctgctcgcagcggccggcgggacaaggcaggtcgagatggaagcgttcgaggtggatctgttccggcagccaggcgagggtctcgcgcagggacgtccagtccagcgcagcggcgtcgtcgtcggaactcgcggcagccggttgccaggcgagcgccacttgctccacgcgcaggccgggtagacgcggacgccaacccgacagcccgggccagcgcagcagcgcgtgttccacgtccagtcgcaggctggcgccatccgcgccgcgccgctccagcgccagccgtcgcagcccgatgccttcggcggacaggcccaggccttgccactccaggcgctcgacaccctgctcgcgcaacaggctgcgccaggcatgccagccgtagccgaacgccagcagcaacagcactgcaaataccagcagcaacgtcgtccttctgcgcaaacgcatgtcccacctctgtccgttgccgacccggccaagggtggcggggccctcgtgcaagatcaaggcgttttccctggccagtgtttttccctgctttcgacgttatattggcggaaaatttccggattttccgagccagacggggagcctccatccatgcgtacccagcatcagagcaagcgcgagctggacaagatcgaccgcaacatcctccgcatcctgcaggaggaaggtcgcatttccttcaccgagctgggcgaacgcgtcggcctctcgaccacaccctgcaccgaacgcgtgcgccgcctggagcgcgaaggcctgatcatgggctatcacgcccggctcaatccgcagcatctgaaggccagcctgctggtgttcgtcgagatcagcctggactacaagtccggcgataccttcgaagagtttcgccgggcggtgctcaagctgccccatgtactggaatgccacctggtgtccggccacttcgactacctggtgaaggctcgcatctcggaaatggcgtcctaccgcaagctgctcggcgacatcctgctgaaactgccgcacgtacgcgagtcgaagagctatatcgtcatggaagaggtcaaggagtcgctcgacctaccggttccggattgacccatgacgcgctccgggagtccgccaggactcccggcatagacgggaaacaccgtcttttctgtacacgatccccgcaacacctcgcagttttttcctttttcgcccttggcgagcgcctcgactga

SEQ ID NO: 7422 - DNA, 321 bp, Pseudomonas aeruginosa
ccacgcgcgccctcgcctacgagttgctcaaggcagccgaccgtggcgtgcgggtacgcatcctcatcgacgacaccgccagcgatggctgggactacgagatcggtgtgctctccgcccatccgaacatccaggtgcgcctgttcaacccgttgcacctgggccgcgccaccggcatcacgcgaggcgtcggccgcctgttcaacctgtcccagcaacaccggcgcatgcacaacaagctgtggctggccgacggcacggcggccatcgtcggcggacgcaacctcggcgacgagtatttcaacgccaagccggagatga

SEQ ID NO: 7423 - DNA, 531 bp, Pseudomonas aeruginosa
cgctcgccgatcaggatcagcgccagggtgaacaacccgccggcgctggccccgaacagcaccagcagcggccagatcaacggcgtctgcagcagcaggggaatcgccaggctgctcagcagcagcaccaggccgcagccgccgaacaggccgctgcgcgagacccggtcggcgagccagccgatcggcagctgcaacaatgcatcgcccaccaccacggtactgaccatggccagcgccaccgcttgcggaaagccctggcgcaacccgtataccggcagcagggtgaggatcatcgcctcgaaggcagcgaacaacaccaccgcccaggcgatcgccggcagaccccggcagaaggcccacaaaccgcgcccggaggcactgtgcggatcgaccctgggcgcaccgctgcggcccagcagcagcaacgagccagcaatcagcaggcagacgccgaaccagaagccacggtcgtcggcggtaccgatgaaggtcagcagtaccggcccggacagttggctgagggcgtag

SEQ ID NO: 7424 - DNA, 219 bp, Pseudomonas aeruginosa
ctcaagttcgatactcagtttcaccggggtcttacccgctgcatcccgacgaaggagagcgtggccccagaaaagagcgcagctttatatcagaaaggcgccccgcgccgcaagggtgaagaccatggcgcagccgcggcccgcctcactgcgggcttcgcaccgcggccgttcgtcgccttgcctcgttgtcgctgcccgccgcatggtctagggtag

SEQ ID NO: 7425 - DNA, 1719 bp, Pseudomonas aeruginosa
ctgcgcccaaccgctgcggatgggcatgttaaccgttcgaatggagcccgtcatgcgcctcgccgctttatccctgttcctcgcccccctgctgctcgcccagcccgccgccgctgccgccttgagcgtgtgcaccgaagccagccccgagggcttcgacgtggtccagtacaactcgatgaccaccaccaacgcctcggccgatgtgctgatgaatcgcctggtcgagttcgacgccggcaaggggacggtggtgccctcgctggccgagcgctggtcggtgtccgacgacggcctgagctatcgcttcgacctgcgccagggtgtgcacttccacagcaccgcctacttcaagccgagccgtacgctcgacgccgacgacgtggtgttcagcttccagcgcatgctcgatccggccaatccctggcacaaggtggcgcagaacggcttcccgcacgcccagtcgatgcaactgccggagctgatcaagcgggtggagaaaagcggcgaccaccaggtgctgttcgttctcgaccaccccgacgcgaccttcctgccgatgctgagcatgggcttcgcctccatctattcggcggaatacgccgaccagttgatgaaggccggaaccccggaaaagctcaacgccgagccgatcggcagcggcccgttcgtgttcaagcgcttccagaaggacgcggtggtgcgctacgccgccaaccccgagtacttcgccggcaagccggcggtcgacgcgctgatcttcgccatcaccccggacgccaacgtgcgcctgcagaagttgcgccgcggcgaatgccagatcgccctgtcgccgaagccgctggacgtggagagcgcgcgcaaggacgccagcctgaaggtcgagcagacgccggccttcatgaccgccttcgtcgccctcaatacccagcatccgccgctggacgatcccaaggtgcgccaggcgatcaacctggccttcgaccgcaccagctacctgcaggcggtattcgaaggcagcgccagtgccgccaccggcatctatccgccgaacacctggagctatgccagggatattcccgcctacccgcacgcccccgaacaggcgcgcaagctgctggccggcaagcagcttcccgagctgaacatctggacccgcccgtccggcagcctgctcaaccccaacccgagcctcggcgcccaactgctccaggccgacctggcggaggccgggatcaaggccaacatccgcgtcatcgaatggggcgagttgatccgtcgtgccaagaacggcgaacacgacctgctgttcatgggttgggcaggcgacaacggcgatccggacaacttcctcactccgcaattcagctgcgccagcgtcaagtcggggctcaacttcgcgcgctattgcgaccccggcctggacaagctgattgccgacggcaaggccgccagcagccaggaacaacgcaccggcctgtaccaccaggcgcagaaactgatccacgaacaggcgctctggctgcccctggcccacccgaccgccttcgcccttacccgccaggaggtgcagggctaccaggtcaatccgttcggtcgccaggatttctctcgggtcgccgtgaaacgctgaaggccacgcccgggagaacccagcgatggatctcgaccgtctctacctgccgcattggcagttcagcgaacaccaccagcggctga

SEQ ID NO: 7426 - DNA, 444 bp, Pseudomonas aeruginosa
tcgacgcgccggccgcagcggtactcgacgcggtggaagacctgctgcgcttcgacgacccgctggtgcgcgccttcctcgtcctgcgcgaagcgccgggaaggctggccggcctgctgggccggcgcaacgacctggccggccgcccacgcttcggcctgcatgagttcacccgcctggagcgccgcgccgaccaggccatcgcctacggcctggtcggccgcttctggcgcgccgacttcgccctggaacgcatcgcggacggcgagcatttccgctgctacgaccagcccggagtggccaagctcgtgctgtgtttccgttgcacgcccagcgccagcggtaccctgctgcacacggaaacccgggtgttctgccccgatcgcgccagccgcctgcgcttcaccccctactggttggcgatccgcccggtcagcgggctga

SEQ ID NO: 7427 - DNA, 1113 bp, Pseudomonas aeruginosa
agtccgagtggtgatgacccagggcggccgcgagttcatcacgcccctgaccctccaggcgttgtccggccatccggtgcataccgatctgctggacccggcggcggaagccgcgatgggccacatcgaactggcccgctgggccgatctggtgctgatcgcaccggctaccgccgacctcatggcgcgcctggtccagggcgtggccaacgacctgctgaccaccctggtgctggccaccgacgcgcaaatcgccctggcaccggcgatgaaccaggccatgtggcgcgacaccgcgacccaggccaacgccgagctgctgcgccagcgcggcttccacctgttcggtccggcagcgggcagccaggcctgcggcgatgtcggcctcggacgcatgctcgaagccgaggaactggcgcagcgcgccgccgactgcttccagcgccaggcgctgaccggcgtgcatgtgctgatcaccgccggcccgacccaggaaaacatcgacccggtgcgctacatcaccaaccacagttccggaaagatgggcttcgccctcgccgaggcggcggtggaagccggcgcacgggtgaccctggtcaccggcccggtgcacctgcccacgcccgaccgggtgcagcgcgtcgacgtggtcagcgcccgcgacatgctggccgcctgcgaggcggagatgccctgcgacctgctgatcgcctccgcggcggtcgccgactaccgcccggaagtggtcgccgcgcacaaactgaagaaagaccctaccagcggcgagggcttgctcttgcagctggtgcgcaatcccgacattctcgccaccctcgcacagcgcgaggatcgtcccttcagcgtgggcttcgccgcagaaaccgaaaacctgctggactatgctgcacgcaagctgaaggacaagaacctcgacctgatcgtcgccaacgacgtggccaacccctcgatcggcttcaacagcgacgagaacgcgatcacggtgatcgaccgcgacctgcatccgagcaccttcgcccagaccagcaagggcaagatcgctcgccagctgatcgccttcatcgccgaccgcctcaaccagcaatgagttactga

SEQ ID NO: 7428 - DNA, 783 bp, Pseudomonas aeruginosa
  unsure (422): Identity of nucleotide at the above locations are unknown.
ggcgcagcagcgccagttggacgcggcctgggccgaaggccaggccggcgccttgcgccaggccttgcagcaactcgccgccgacacccgcgccgccgcggccagccccctcgccctcgaagccctgcaaagcggcgacgccacccgcatcgaggccgcccagcgcatcctgctggcctgggacggcgtggtcgatgcccacctgaacgcgcccggccaggccgcccaggacaacgacagccccggcccggtcagcttcgccgccctggatatcctgcaccgggtggaaagtggccagaacgtcgccgccgaagcctacaaggtcggccagcgctggctgctgtacagcgccgcgccggtgcgcggcgccgaccagagcctgcaaggcacgctgctgctggcggtcgacctgcaacggctgntgcgcgccctgccgcccttgccgggcgatgccggccaggtacaactggtccagcagttctccggcgcaccggcccaggtgctgctgcaacgcggtacgccggcgccgggcaagggtgcgcaagcgctggacagcggcaatccgaactggaaactgaactacacgcccggcagcgtcgcttcgacccaggcctcgccgctgctgctggcactcgcggcgctgctggcgctgctcggcggcatcctcggcacctacctcacccgttcgtcgctgttgcgccgcctgcatcaggatgtcctgaccctcggtcagtatcttcaggaactcggcgggcaacgcactgccaaaccccctgtgcctag

SEQ ID NO: 7429 - DNA, 1113 bp, Pseudomonas aeruginosa
agaccaggacctcctgggattggagcaaacccccatcatgagcactgcaaaagcaccgacgctgcccgccagcatcttccgcgcctacgacatccgtggcgtggtaggcgataccctcaccgccgagaccgcctactggatcggtcgcgccatcggctcggaaagcctcgcccgcggcgaaccgtgcgtcgctgtcggccgcgatggccgcctgtccggtcccgagctggtcaagcagctgatccagggcctggtggactgcggttgccaggtcagcgacgtgggcatggtgcctaccccggtgctgtactacgcggccaacgtgctcgagggcaagtccggggtgatgctgaccggcagccacaacccgccggactacaacggcttcaagatcgtggtcgccggcgagaccctggccaacgagcagatccaggccctgcgcgagcgcatcgagaaaaacgacctggcatccggcgtcggcagcgtagagcaggtcgacatcctgccgcgctacttcaagcagatccgcgacgacatcgccatggccaagccgatgaaggtggtggtcgactgcggcaacggcgtggccggggtgatcgccccgcagttgatcgaggccctgggctgcagcgtgatcccgctgtactgcgaggtcgacggcaacttcccgaaccaccatccggacccgggcaagccggagaacctgaaggacctgatcgccaaggtcaaggccgagaacgccgacctgggcctggccttcgacggcgacggcgatcgcgtcggcgtggtcaccaataccggtaccatcatctatccggaccgtctgctgatgctgttcgccaaggacgtggtctcgcgcaacccgggggccgacatcatcttcgacgtcaagtgcacccgccgtctgatcgccctgatcagcggctacggcggccgtccggtgatgtggaagaccggccactcgctgatcaagaagaagatgaaggaaaccggcgccctgctggctggcgagatgagcggccacgtgttcttcaaggagcgctggttcggcttcgacgatggcatctacagcgccgcccgcctgctggaaatcctcagccaggatcagcgtga

SEQ ID NO: 7430 - DNA, 1392 bp, Pseudomonas aeruginosa
ctggtgcgcgttgaggccatgcagcttgccccagtgcggacgcccggcgtatttccagaagatcggttccaccgcggcgaagaagttgtggtggtccatgctgtagtgctgatgcacggaaatggaacaactgtcgcggccctcgaacatgctcaggggaatgtcgtcggccttcacgtagcggtactcgatgggaaaccaggtgcgcaggtccttgtcgcggatcagcgcgaggatctcccgcaggcaggcgggaccatgctcggcggggaccgaatactccatctcgttgaaacgcacgttgcgcacgttggcgtagaccgcataggaatcgtcgacccgctcgtcgaagcgggcgaaatggcgcaggctgttgagcagggtgcggcgggtctccgggaagtcgctgaggtacttgtcgagaccttcgatcaggccgacgaactcgttgccgccttccttcgccgggtccaggggcggggtcttcggctcgtcggtctcgttgagggcgatcgacagggcgtagtcggaatgggtcaccaccagcatctcccagtgctggttctcgcgcgtattcttctccacgtcttccagcaattcttcggtccgggcgatccactgccgttcacgcaggcggtaggccgcgcggttctgcaggcgcacccgggtcacgacgcccagcgcccccagcgagacccgcgcggcatcgaacacctccacgttgcgcttggcgtcgcactcgagcacctcgccgctcgcggtgaccagttgcagaccgcgaacctgggcggaataggaaccgaagccgaccccggtgccatgggtggaagtagcgatggcgccggccagggtctggtaatcgatatcggccatgttcaccagcgcctggccgatctccttgagcggagcgcccatctgcgacatcggcgtaccgccgccgaactcggcctggagggtcgcgctgtcgtggctgagcaagccgctgaagtaggcgagcgagagcagggtgccgtcggtcgggaccaacgcgctgaacgaatgcccggagcccaccgggcggatcctgccggacgcctggcggatgatccggaccagttcgtcgaggtctttcggtgcctcccgcgccaggggcaggcagctttgcgcgccggaccagttgcgccagggaatcaggcgcggtgcgcggagcaactccgccagcgcggggtttcccaccatggcggcgaacgcaccgagcgctcccgcccgttgcaggagctggcgtcgcgacagatgacttggcatgccggtatcccctatcggtcctgcgctgcggacatgaaatcgatcaaagcccggaactgtttttccgagcactgcatgcacatgcccatgggtggcatgcccttgtag

SEQ ID NO: 7431 - DNA, 780 bp, Pseudomonas aeruginosa
cgtagcggtacagctccaccgctccgcccggcgccgcctgggcgccgaaggaaatcccctggagcaccagccccagggccatcaggcaacgcattacatcctgtccgaccatgccagtcccttgtgaaaggttcagataccgtattgggcgcgataggcctctaccgccggcagatgcttcttcagttcagcatcttcggcaagatattccagcacctgctccagggaaacgatgctcaccaccggcatgccgaagtcgcgctcgacctcctggatcgccgacagctcgcccttgccgcgctcctggcggttcagcgcgatcagcacgcccgcggccctggcgccctgggcgtcgatgatctgcatcacttcgcggatcgcggtgccggcggtgatcacgtcgtcgatgatcagcacccggccgctcagcggcgcgccgaccagcgtgccgccttcgccgtggtccttggcttccttgcggttgaagcaccagggcaggtcgcgctggtgctgctcggcgagggccaccgcggtggtggcggccaggggaatgcccttgtaggccgggccgaacaggacgtcgaagtcgattccgctgtcgatcaccgcctcggcgtagaagcgtcccaggcgggccagcgccaggccgctgtcgaacaggccggcattgaagaaataggggctggtgcgcccggacttgagggtgaactcaccgaagcgcagaaccccgcgctcgatggcaaaacgaatgaaatcgcgctgatacgcctgcatgaatga

SEQ ID NO: 7432 - DNA, 987 bp, Pseudomonas aeruginosa
acccatggtgcacagcatgaccgccttcgcccgcgtcgagcaggctggtacccacggcaccctgagctgggagctgcgctcggtcaaccaccgttacctggagccccacctgcgcctgcccgacgccttccgcgacctcgagggcgcggtgcgcgaggcgctgcgccagggcctgtcgcgtggcaaggtggaatgcaccctgcgcttcgccgaggaaaccgccggcaagagcctgcaggtcgaccaggagcgcgcccgccaactggtcgccgccgccgaaggcgtagccgccctgatccgccagccggcgccgctcgatccgctcgccgtgctggcctggcccggcgtactggtggccgactcggccgatccgcaggcgctcaacgccgccgccctggaagccttcggccaggccctggagcaactcaaggccggccgctcgcgcgaaggcctggagctggcgaagctgctcaacgatcggctcgacgcgatgctggtggaagtcggcaacctgcgcgaactggtgccgaccatgctggccaaccagcggcagaagatcctcgaccgcttcgccgaactcaaggccgaactcgatccgcagcgcctggagcaggaactggtcctgctggcgcagaagagcgatgtcgccgaggagctggaccgcctcgccacccacgtcggcgaggtccgccgggtcctcaaggccggcggcgccgccggtcggcgcctggacttcctgatgcaggaactcaaccgggaagccaacactctaggctccaaggcgttcgacccgcgctcgacccaggcggcggtcaacctcaaggtcctgatcgagcagatgcgcgagcaggtccagaacatcgaatgacccgcgggcgcctccgcccgatctctttccaacccgtacgaagcaccaggaacacctcatgtccggcaccctgtacatcgtttccgctccctccggcgccggcaagaccagcctggtga

SEQ ID NO: 7433 - DNA, 321 bp, Pseudomonas aeruginosa
actattcagtccgcccggcaaacgtcgggctcacttttcgttacgaggaacaccatggcccgcgtcaccgttgaagactgcctggacaacgtcgataaccgtttcgagctggtcatgctcgccaccaagcgcgcccgtcagctggctaccggcggcaaggagccgaaagtggcctgggaaaacgacaagccgaccgtcgtcgccctgcgcgagatcgcttccggcctggtcgatgagaacgtcgtccagcaggaagacatcgtcgaggacgaaccgctgttcgcagcgttcgacgacgaggccaacaccgaggccctgtaa

SEQ ID NO: 7434 - DNA, 378 bp, Pseudomonas aeruginosa
tcggccgcgagaagcacctctacagcatctaccagaagatgcgcggcaagcgtaaggcgttcaacgagatcatggacgtctacgccttccgcatcatcgtcgacaaggtcgatacctgctatcgcgtgctgggcgccgtgcacagcctgtacaagccgttccccggacgcttcaaggactacatcgcgattcccaaggccaacggctaccagtcgctgcataccaccctgttcggcatgcacggggtgcccatcgagatccagatccgtacccgcgagatggaagagatggccaaccacgggatcgccgcgcactggctgtacaagtccaacgacgagacgcccaagggcacccatgcccgcgcccggcaatgggtga

SEQ ID NO: 7435 - DNA, 468 bp, Pseudomonas aeruginosa
tccggatcacccgcctgcgtagctgacccgctttttcctgtgtcatccggcgcccccgcgcccactcgatttcagcaaggagttcccatgaccaagaccgttatccacaccgacaacgccccggccgccatcggcacctactcccaggccatcaaggccggcaataccgtctacgtgtccgggcagatcccgctggacccgaagaccatggaactggtggaaggcttcgaggagcagaccgtccaggtgttcgagaacctcaaggcggtgatcgaggcttccggcggctacctgcacgacgtcgccaagctgaacatcttcctcaccgacctgtcgcacttcgccaaggtcaacgagatcatgggccgctacttcacccagccctacccggcgcgcgccgctatcggcgtagccgccctgccgaagggcgcacaggtggaaatggacgccatcgtcgtcctcgaataa

SEQ ID NO: 7436 - DNA, 786 bp, Pseudomonas aeruginosa
gccggatgttcgcgacggggcccaaggccccgtcgctctgcatggagtagcacgatgcgccgcgtgattttcctcgccgcagccgccaccctgctggccggctgcgccggcacggccgatccgtccggcacctggatcaaccaggccgcgatcgacgccgcgagcaaggacggcaagctgcgcgaggccctgctcgcctatggcccgaacctggaatggaagctcgacagcaaggcaggcgaagccaccttcagcaacggcttcgaactgggcgaagggaccctgagcaagagcgatgacgagcactggaaggttgccttctatggcgacgacaaccaggagagtctcgaactggacggcaaggagctgatccagcaggccagcgccaacggcccggaacagcgtttccgccgtctcgacccgcaacccgcggccaacagccctgccggcagcggtttcgagcgggccttgtatggcagctatctgaagggcagctggaagatccgcgaaggccagggccagggcggcaaggtcgagttccaggccaatggcctggtcagcggtctgcccggcgccgaacgctacgcgctgtgcctggccggcgattgcgcagcgatgagcggcgacaacgacagcatctggctgcaacaaggcaaccgcggccgcgaattgctgttcagcctcgacgacgacgagctgcaactgttcgaagcggtcaataccgccggcgccaacgagatgcccagctacgtgcccggcaagcgcgtctggctgctggagcgctga

SEQ ID NO: 7437 - DNA, 1521 bp, Pseudomonas aeruginosa
ggcctctcagagggcggccagcaccagccagccgcccagcgccagcagcaggacgccgcacagccggtccagcgcacctacccgccgttgcaaccagccgcgccagcgcggcctgtccagcaggcgcaccagcgccatgtcccagcacagcaccgccaggctcatccacgccaggcacagggccagcgcccagcccggcaggctgaagcgcgccagcacgccgaacagccccgcatagaagatcggcagcttgggattcaggctgctcgccagcaggccgtcgcgcagcccgcgcagatagccgccgcgggacgggacgtcgcgctgcgccggcatttccagtcgcctctgcgcaagcagcgcctggcccgccagccagaggaagtacagtccgccgagcgcctgcagccagcgcaaggcgctgtgcgccgagtccggcacgctggccaacaggccgagcaccagcagcatgctcaggaggttggccagggcgatgccggcggccaccccgtcggcctggcgccggccgcgcagcagggcggcgcgcaccaacaggaagaagtccggccccggcgacagcagggcggcgaaatgggtactggcgacaaggacgaacgcggcgaacatgaaggcccctcgaaacgcgaaggcctccagtctgtgcagcacggcgggcgccgtattggaaaaaactcaggtcttggcgctgcgccggaactgccccggagtgaccccggtgaaacgccggaaggtcgtggagaagtgcgcctggtcgtagaagccgaggtgctgggcgagttccgccagcggccgttcttccagcaacaggcgcttggcctggcgcacccggcattgcagttggtaggtatgcggcggcacgccgtaggcacgccggaaagcctcgatcaggtggcgcgggtggcgctgcagcaactgcgccagttggtccagaccgagcgcctcggtagcatgcgcttccaggtaatcgcgcaggcgtgcggtggttccgccgtcgcggggcgccgcggccgccgggcgcaagccgccgtgacgcacgaagacctgttcgagcaaggccagcaggcggctttccaaccccaatgcgtcgctgcgctggaaatcctcggccagccacgccaggccagccgccacgctgccgtcgtcggccgggttcagttcgccgaagccgcgcggcaactgtttgcggccgagcaggccgagcaggcgcgtttcctcgacatagagcatccggtagaccagccgctcggattcggcgtgcccggtatgtggctcttccgggttcatcagcgacagggtgccggccggcagcgcatggcgccgcccgcggcactggtagccgccgacgccgtggaggatcgagccgatggcgaaggccgaatggctgtggcggccgaacgcctggccggagaagtccgcatggaacagctccacgccaggcagccagggacgcgccaacaaccggttggcagccatcaggcgtccccgagcaccgccgcgtag

SEQ ID NO: 7438 - DNA, 2094 bp, Pseudomonas aeruginosa
cggatgagcagccatgaccctcaccgaactgcgctacatcgtcaccctcgcccaggaacaacacttcggccgcgccgccgagcgttgccacgtcagccaaccgaccctctcggtcggcgtgaagaagctcgaggacgagctgggggtgctgatcttcgagcgcagcaagagcgccgtgcgcctgacgccagtgggcgaaggcatcgtcgcccaggcgcagaaggtcctcgaacaggcccagggcatccgcgagctggcccaggccggcaagaaccagttggccgcgccgctgaaggtcggcgccatctacaccatcggtccctacctgttcccgcacctgattccccagctgcaccgggtcgcgccgcagatgccgctgtacatcgaggagaacttcacccatatcctccgcgacaagctgcgtaccggcgaactcgacgcgatcatcatcgccctgccgttccaggaagccgacgtcctgaccaagccgctgttcgacgagcccttctatgtgctgatgccggccgaccatccctggaccgccaaggccagcatcgattccgagctgctcaacgacaagagcctgctcctgctcggcgaaggccactgcttccgcgaccaggtgctggaagcctggcccgaccgtgcgcaagggcgacgagaacaagcacaccacggtggagtcctcgtcgctggagaccatccgccacatggttgcctccggactgggcgtctcggtgctgccgttctccgcggtggacagccaccactacgcgccgggcgtcatcgaagtgcgcccgttcagcgcgccggtgccgttccgtaccgttgccatcgcctggcgcgccagcttcccgcgtccacgcgccatcgaagtgctggccgactcgatccgcctgtgctcggtggcccgtccgcaaacccaggaacaaccgcaaatcgcatgaccgagctgtccagggtcccggttaccgcgctaaagggcgtaggcgccgcgctggcggagaagctcgctcgggtaggcctggaaaccctgcaggatatcctgttccacctgcccctgcgctaccaggaccgtacccgcgtcaccgccatcggcgccctgcggccaggggccgacgcggtggtcgagggcgtggtggccggcgccgacgtggtgatggggcgccgccgcagcctgctggtgcgcctgcaggacggcagcggcaccctgagcctgcgcttctaccatttcagccaggcgcagaaggacggtctcaagcgcggcacccacctgcgctgctacggcgaagtccggccgggtgcctcgggcctggagatctaccatccggaataccgcgcgctgaacggcgacgagccgattccggtggagcagaccctgacgccgatctacccgactaccgagggcctcacccagcagcgcctgcgccagttgagccaacaggccctggccatgctcggccccagcagcctgcccgactggctgccggcggaactggcccgcgactaccaacttggcccgctcgaccaggcgatccgctacctgcaccggccgccgccggatgccgacatcgaggaactggccgaaggccggcactgggcgcagttgcgcctggccttcgaagaactgctgacccaccagttatccctgcagcgcctgcgcgaagccgtgcgctcgcaggcagcgccgcgcttgccggcggccagccgcttgccgaaacgcttccttgccaacctcggcttccagccgaccggcgcgcaacgccgggtcggcgcggagatcgcctacgacctggcccaggacgagccgatgctgcgcctggtgcaaggcgacgtcggtgccggcaagaccgtggtcgccgccctcgccgccctgcaagccatagaggccggctaccaggtggcgctgatggcgccgaccgagatcctcgccgagcagcatttcctcaacttcagcaagtggctccagccgctggacatcgaagtcgcctggctggccggcaagctcaagggcaaggcccgcgcggcggcactggaacgcatcggcgacggcgcgccgatggtggtcggcacccacgcgctgttccaggatga

SEQ ID NO: 7439 - DNA, 966 bp, Pseudomonas aeruginosa
agtgaaattcaagcgccttgcactggcgatcatcgacgaacagcaccgcttcggcgtgcagcagcgcctggccctgcgccagaagggcgtggacggcaggctctgcccacaccagttgatcatgaccgccacgccgatcccgcggaccctggcgatgagcgcctatgccgacctcgacacctcgatcctcgacgagctgccgcccgggcgtaccccggtgaataccgtgctggtggccgacagccgccgtatcgaggtgatcgagcgagtccgcgcggcttgccgcgaagggcgccaggcctactgggtgtgtaccctgatcgaagagtccgaggagcttacctgccaggccgccgagaccacctacgaagagctttcctcggcgctgggcgaactgcgtgtcggcctgatccacgggcgcatgaagccggcggacaaggccgtggtgatggaggccttcaaggaaggcatgttgcaactgctggtggcgaccacggtgatcgaggtcggcgtcgacgtgcccaacgccagcctgatgatcatcgagaaccccgagcgccttggcctggcccaactgcaccagctacgcggccgggttggccggggcagcgccgccagccactgcgtgctgctctaccacccaccgctgtcgcagatcggccgcgagcggctgggcatcatgcgcgaaaccagcgacggcttcgtcatcgccgagaaggacctggaattgcgcggccccggcgaaatgctcggcacccgccagaccggcctgctgcaattcaaggtcgccgacctgatgcgcgacgcagacctgctgccggcggtccgcgatgccgcccaatccctcctggcgcactggccgcagcatgtcagcccgctgctcgaacggtggttgcgccacggccagcaatacggtcaagtgtgatctatttcgctctcgctgaccggcgtaggtctcagtcttga

SEQ ID NO: 7440 - DNA, 771 bp, Pseudomonas aeruginosa
agcagctctggttatactgagggaaaatccagctcgcatggtctcgtcatgacagaagccgccctggcctccgccgatgctccgcacgccccccaggtcatcctccagctgctcgccaagctaggcatcgcctgccgcgaggtcagcgacagcgcggagctgcctgccgcccgccgggtccaggcggtgctgctggacgacgccgtcggcaccctgctggtgctgttcccgcagagccagttgctggacctcgcccggctcaccgaactgaccggccgcaagctgctggcgatcaagcccgagcgcctggaacgaatgctcggcaagcacgagttgcaccgcctgccggcgttgccgcccctgaccagttcgccctgcctgtacgacgagcgcctgttgcaggaaccgcgcctgctgatcgagtccggccagcccggcatcctcctggagatcgccagcaacgacttccgcggcctgctgggcaaggccagcgccgcgcgcttcggcgaaccgctggaaaacatcaacctgaaccttgaccgcccggacgacgaccgcgcggaaatcagccaggccgtgcaggccttcaccgcccggcgcatccagcagcgcctggagcagaccatcgagattccaccgctgccgcagacggcgcagaagatcatcaagctgcgggtcgaccccaacgccagcgtcgacgacatcaccggcctggtggaaaccgatccggcgctcgccgcccaggtggtcagttgggcggcctcgccctaa

SEQ ID NO: 7441 - DNA, 1326 bp, Pseudomonas aeruginosa
ccattggccatccattccgcggggcggtggcgacaccaccagcgggcaggccggggtcttcaccgtcaccggcatgggaccgtaggccacctggctggggttgccggcgagggtctgcgccagcgcgcgtgcgcaagccatcagcggcatcacatagagcaggttgaggccgtccacttcggcgcagtcgcccagcgcgtagatgttggcgtgggaggtgcgcagcgagcggtcgacgacgatcccgcggttgaccgccagcccggcggcgaaggccagttcggtgcgcggacgcaggccgacggcggagaccaccaggtcgcagggaatcacctcgccatccgaaagatgcgcttccagcccctcgccggccttcttcaggctggccagcaccggccccaggtggaagcgcacgccgaggccttccaggcctgcctgcacggccttcgccgcggccgggtggagcaggcccggcatgacctgctcgcaaggcgccaccacgtcgagctggtagccgccgctggagaggtcgttggcgaattcgcaaccgatcagccccgcaccgagcagcagtacccggtgcttgccggcagccgcctggcggaagcgcgcgtagtcttccaggtcgttgatcgggtagagcgcgtcctgggcatcgccctcgaccggcacccggatcggctccgcgccccaggccaggaccaggtcgcgataacgcacctcttcctcgccgatccagatccgctgatggccgggatcgataccggtgacccgggtatgggtcaggatgcgtgcgttcagttgctcggccatggcgcccggttcggccatggccaggccgtcggcgtccttgttcttcgagaagccggtggagagcatcggcttggaataggaacggccgtcgtcggcggtgatcatcagcagcggcgtctcgctgtccagcttgcgccactcgcgggccaagttgtagcccgccaggccggttccgatgattaccaggggcgcacgctcgctcatttccgttcctctgtgattgccggcgccgggcgccgcttctgtggatttcgctcaggcgatctcgatcatctcgaaatcgatcttgccgacaccgcaatccgggcagacccagtccgccgggatgtcttcccaacgggttcccgccggaatgccttcttcgggcaggcccagggcttcgtcgtagatgaagccgcagaccacgcattgccacttgcgcatagccaccctcctcgttcgtcgaacctagctcagcgtcggtggccggccaacggcaaggctgccgggcgttcccggcaggacagtcaatga

SEQ ID NO: 7442 - DNA, 630 bp, Pseudomonas aeruginosa
acggctggggctgacgcgccaccgcgtcgcagaccggccgccggccgaacgtgctaccctcgccgccttctgccgccgtctcgtagtcccgtcatgcccagcaatgcgctctggcttcgcgccgaccaactgtcaagcgtctcccccgccgtcctcgactggctgttcgacgaggggtcgctgacccggcgcctgaccgccctggccgacggcgcgttccgcgtcgaacccctgctggaaggctggcagaccctgcgcgacgacgaatgccaggggctcgacgtccctaccggcagtagcggctgggtccgcgaggtctacctgcatggccacgaccgtccctgggtgttcgcccgcagcgtggcggcgcgcagcgccctggaaggctcgggcttcgacctggcgctgctcggcacccgctcgctgggcgagttgctgttcagcgacagcgccttcgagcgcgggcccatcgaagtctgccgctatccggcggccggtctgcccgccgaggtccgcgccgagggtctctggggccgtcgctcacggttttcccgcggcgcgctcggggtgctggtggcggaggtgtacctaccgcgcctgtgggaccaggcgggaatcgccgacgtataa

SEQ ID NO: 7443 - DNA, 369 bp, Pseudomonas aeruginosa
aggtataaaggggcttgccgtagtaggcccactgctgggtgccgtcctcgcgagcgaccaggctccagtcgccgctggcctgcgctccctgggccgctgccagcggcggccagttcttcgcgcactgcccggaacaggcggattgcccttcgctgtccttgtcgtaggtatagagcgtcatgcccttgccatcgaccagcacgccgtccttctcggtggccggcgccaccgtttcctgggccagcgcggcgaacgccggcagggccagcgccagacccagcgccaggtggattctgttcatcgcgtctctctcctgtgtcttcaggtggagcgttcgccgcccgcagggacggcaccggaacctgttga

SEQ ID NO: 7444 - DNA, 792 bp, Pseudomonas aeruginosa
ccccgccgcgggcagtcggcggaaactacgccgttgtgtcacatacctgacacaatttcgttatctaatgcggcgcaagacagatcgacccgaggcaagaccatggttggcaagacaatcctcatcgttgatgacgaagcaccgattcgcgagatgatcgccgtggccctggagatggccggctacgagtgcctggaggcggaaaatacccagcaggcgcacgcggtgatcgtcgaccgcaagccggacctgatcctgctcgactggatgctccccggcacttccggcatcgaactggcgcgacgcctgaagcgtgacgaactgaccgtcgacatcccgatcatcatgctcaccgccaagggcgaggaggacaacaagatccagggcctggaggtcggcgccgacgactacatcaccaagccgttctcgccccgcgagctggtcgcccgcctgaaggccgtgctgcgccgcaccgggcctggcgacagcgaggcgccgatcgaggtcggcggcctgctgctggacccgatcagccaccgcgtgaccatcgacggcaagccggccgagatgggccccaccgagtaccgcctgctgcagttcttcatgactcaccaggaacgcgcctatacccgcggccaactgctggaccaggtctggggcggcaacgtctatgtcgaggagcgcaccgtcgacgtgcatatccgccgcctgcgcaaggcgctcggcgaggtctacgaaaatctggttcagactgtccgcgggaccggctatcgtttctccaccaagagctga

SEQ ID NO: 7445 - DNA, 906 bp, Pseudomonas aeruginosa
ccccgctcccggccgcccagcggccggagtcgtttcccctggacggtccgtgacggaccgccactggacaggatgcaatccgtcgtgaaccaagactggcgtggagcgctgatccgccacctgcttctcgtgctggccgccagcctcgtgctcggcgtggtcagcggccattacggctgggccctggccctcggcctggctctctacctcggctggaccctctggcagctactgcgcctgcaccagtggctgcgcaaccaccagccagacgagccaccgccggacagctacggcctctggggcgaagtcttcgacaatatctaccacctgcaacgccgcaaccagcgcgcccgtggccgcctgcaggcggtgatcgaccggatccaggagtccaccgcggccctgcgtgacgcggtgatcatgctcgacagcgacggcaacctggaatggtggaacctcgccgcggaaaacctgctcggcctgaagaccccgcaggacggtggccagccggtgagcaacctgatccgccatccgcgcttcaaggaatacttcgaccaggaggattaccgcgagccgctggaaatcccctcgccgatcaacgagcgcctgcgcctgcaattccacatcaccctctacggcaaccgcgagcacctgatgctggtccgcgacgtcacccgcgtccaccagctggagcagatgcgcaaggacttcgtggccaacgtctcccacgagctgcgtacgccgctgacggtgatcgccggctacctggagaccctcctcgacaacgtcgaggatgtgaacccgcgctggctgcgcgccctgcagcagatgcagcagcaggccggacgcatgcagaacctgctcaacgacctgctcctgctggccaagctggaggccaccgagtaa

SEQ ID NO: 7446 - DNA, 564 bp, Pseudomonas aeruginosa
cgacgcccaggccctgtccgccgggcgcaaccaccgcatcagcctggacgccgcacccgctgtgcagctcaagggcagcgaggcggaactgcgcagcgccttctccaacctggtattcaacgcggtgaagtacacccccgacgaaggcgagatccgcatccgctggtgggccgacgaacagggcgcgcacctgtcggtgcaggacaccggtatcggcgtcgaccccaagcacctgccgcgcctgaccgagcgcttctacagggtggactccagccgcgcctccaacaccggcggcaccggcctcggcctggccatcgtcaagcacgtgctgatccgccaccgcgcgcgcctggaaatcagcagcgtgcccggcaagggcagcaccttcacctgccatttcgccccggcgcaggtcgccgaggccgagcgcaaggcgccgaagtgaacctcgtcgcagtgccgcgccgccggcgtcggcacggccaaggcttgcaagcgacgacacagcccctcattcttaagggccttttggctaccgcacacccccatggacccttctcctag

SEQ ID NO: 7447 - DNA, 2490 bp, Pseudomonas aeruginosa
gacgcctcgatgacgttcgccggccagaagtggccgaggccgcgtaccgcgatcaccgccagcaggccgatggtcatgatcaccgcgatcgacaccgcgccggcgttcatccacacccagggcgagccgctgccgaaccaggctttgacggtttcctgtttctgtttcacagagctatacctccgccgcttacaacgacgcgtatttcttgcgcagacgctgacggatcagctctgccagggtgttcatcacgaaggtgaacgtcagcagtaccagcgccgagaggaacagcacgcggtagtggctgccgccgacctccgactcgggcatctccaccgcgacgttggccgccagggtgcgcatcccctcgaagatattcacttccatcaccggggtattgccggtcgccatcagcacgatcatggtctcgccgacggcgcggcccatgccgatcatcagcgccgagaagatgcctggactggcggtcaggatcaccacgcgggtcagcgtctgccagggcgtggcgcccagggccagggagccgtaggtgaggctgcgcggcacgctgaagatggcgtcctcggcgatcgagaagatattcgggatcaccgcgaagcccattgccagcccgacgatcagggcattgcgctggtcgtaggtgatgcccaggtcgtggctcagccagaggcgcatgtcgccgccgaagaaggtggtctccaggtgcgggctcagccacagggcgaaggcgccgacggcaagcaccaccgggatcagcagcgcggcttcccagccggccggcaggctcagacggatacgctcgggcaggcggctccagagcaggccggcaagaaggatgcccagcggcgtcagcaacagcaggctgaacacacccggcaggtggccttcgacgtagggcgccaggaacaggccggcgaagaagccgaggatcaccgtcggcagcgcctccatcagctcgatcaccggcttgaccttgcggcgcatcgccggagccatgaaataggcggtgtagacggcggccgcgatggccagcggagctgccaggatcatcgcgtagaaggcggccttgagcgtgccgaaggtcagcggcgagaggctcagcttcggttcgaagtcggtggtcgcggcggtggactgccagacgtaggccggcttgtcgtagctctcgtaccagaccttgccccagagcgcgctccaggagatttccgggtgcgggttgctcagggcgaagcggtggatcttgccaccctgctccagcagcaggcggttggcccgcggcgacagggtgatgaccccggaagagtcggcgaccggctggaccagcagggtacggtgcgcggtgctgtggaagacgccgaggttgcccttctcgtccagggcgatgaagcccttgcgccgttgttccggagcgatggcgctgatcggcgcgccatccagattgaagtcgcgaacgtgcgacaggcgcggttcgccgtcggtatcgcgagccatgaaccactgggcgatgccacccttggagtcgcccaccagcagcgagatgccgcccagcagttgggtgctcgcggtgacctcggcgttggggtcttccagcagcttgtagcgaccgttcaactggcggctgtgcaggtcgaacacatcggcggtggcacgtccgttgatcacgtacagccactgcttgcgcgggtcgaggtagatggctttcaccggttcggcgatctgcgggagttcgatgcgctcctcgtccagcgtgctttcgccggtcagcatgttctcttcccgagtcatgctcaacagcagcagttgcttgtcgacggagccagccagcagcaggctgtcgtcgccggcattgatgctcacatgctccagcgggcggccctgcggatcgagaccgatcggggtctcgccgtaggggaaggcgatctccggggtgatggtcttcttgttgtccgggtaggtgaccttgtaggtgtgctggaacaccagcacctgtccgttggacaggcccagggcgaccgtcgggctgcccggctggtcctgggcgatcgagcggatctcgctgcccgccggaagcggcagagcgacacgcttcagttcgacaccggtcttggcgttgaagaagagaatctcgccctggccgccgacgcgcatggccacctggttctgctcctcgatgctgagcagcaggggcacctgcgcctgctgcatccaggccggagtcagcgcttcgcgggtctccaggtcggcgccgcggaacagggggagcacgacgtaggccaggtagaagaagatcagggtgatcgccgccagcacggccaggccgccgaccagcacgtaccagcgggtcaggcggtccttgagggcacggatgcggcgcttgcgttgcagggctggcgtattgaagtcaatccgctcgggagcaagggaggagttcatcggggagttggccatgtcgttcatggggtgacaccctaa

SEQ ID NO: 7448 - DNA, 240 bp, Pseudomonas aeruginosa
cgttgcgcaggaacccttggtctttcggcgtgggtgtttttcacacccattgtcgttactcatgtcagcattcgcacttctgatacctccagcaagcttctcaactcaccttcacaggcttacagaacgctcctctaccgcgtcacttacgtgacacccgcagcttcggtgtgtggtttgagccccgttacatcttccgcgcaggccgactcgactagtgagctattacgctttctttaa

SEQ ID NO: 7449 - DNA, 243 bp, Pseudomonas aeruginosa
agcttcgtttcgaccccctttcgggaccgaaccgctgcggcgaacaacctgccggagcgcttcaccaccccctggaagagaatccgtaaatccttgattttcaagcatttactcttcgtcgtcgccgggagtggtgcgcattatagggagatagaaactggcgtcaacacttatttgaaacttttattacgaaacaccgtgacgagttcgaagcctgggcaggcggcgagcgatcgagggtag

SEQ ID NO: 7450 - DNA, 1722 bp, Pseudomonas aeruginosa
ctaggaagacaactccgccggcccaggctttataccagatcgccaggcaagaacgaaaaaacgcggccggggccgcgtttcttcgtctgtcgccggagccgcttagttcttgctcttgtcgacgatcttgttggctgcgatccacggcatcatcgcgcgcagcttctcgccgatctgctcgatcgggtgagcggcgttgttgcggcggtaggcagtcatcgacgggtagttggccgcaccttcggtaatgaacatcttcgcgtattcgccgtcctggatgcgcttcagggcgttgcgcatggcagcacgggactcggcgttgatcacctccggaccggttacgtactcaccgtattcggcgttgttggagatggagtagttcatgttggcgatgccgccttcgtacatcaggtcgacgatcagcttcagctcgtgcaggcactcgaagtaggccatttccggcgcgtaaccggcttcgaccagggtttcgaaaccggccttgaccagctcgacgcaaccaccgcagagaacggcttgctcaccgaacaggtcggtttcggtctcgtccttgaaggtggtttcgatgataccggtacgaccgccgccgacgccgcaggcgtaggacagggcgacgttcttggcgttgccggaagcgtcctggtagatggcgatcaggtcagggatgccaccgcccttgacgaactcagaacgcacggtgtgacccggggccttcggcgcgatcatgatcacgtcgaggtcggcgcgcgggacgacctggttgtagtggatggagaagccgtgagcgaaggccagggtggcgcccttcttcaggttcggctcgatctcttccttgtacaggcggccctggaactcgtccggggtgaggatcatgaccacgtcggctgcggcgacggcggtcttcacgtcggcaaccttcagaccgtgcgcttcggccttggccacggtggcggagccgctacgcaggcccacggtgacgtcgacgccggagtccttcaggttgcaggcatgggcgtggccctgggagccgtagccgatgatggcaactttcttgccctggatgatcgagaggtcacagtctttatcgtagaaaacgcgcatgggaattccccttcagtaaggcctcgcgggcctgctttcagttcagatgctcagagtcttgtcgccacgggcgatgccagtgacgccactgcggaccacttccaggatcgacgcagtgccgatggcctggatgaagctgtccagtttgtcgctggtacccgccagttgcacggtatagacgctactggtgacgtcgacgatctgcccacggaagatatcggtggtgcgcttgacctcggcgcgctgggcgcccgtggccttgaccttcaccagcatcagctcgcgctcgatatgggcgctttccgacagatccaccagcttgaccacttcgatcagcttgttgaggttcttggtgatctgctcgatcacctcatcgtgccccacggtggtcagcgtcagacgcgacagggtcgggtcctcggtcggcgccacggtcaggctttcgatgttgtagttgcgttgggagaacaggccgaccacgcgggacaatgcgcctggctcgttttccagcagcagggaaatgatgtgtcgcatgatcaggtacgctccgtcttgctcagccacatgtcgcgcatcgcgccgtcacggatctgcatcggatag

SEQ ID NO: 7451 - DNA, 486 bp, Pseudomonas aeruginosa
ttagccgcagttagcgcattccaaggactccgcatgcgacgcatgatcctcccggccagcttgttgctcgccctctcctctttcgccatggccgccccgatctacaaatgggtcgacgccgagggcgtcacccacttcggcgcacaaccgccgcaaggtgcgcaagcgaccacggtgaatacccagaccgccccgccgccggacaacttccccctgcccccctcgaccccggcaccgaccatccagcagaaaccggccgatcccgagcagaaggcgatcgacgacaaggtgaagcagcaagtggcgaaggaagaggccgagcgcaagcagttctgcgaagagacccgcaacaacctcgcgcaactgaagaacaacccgcgcgtaagggtcgacgaaggcaagggcgaactccgtcgcctcggcgaggaagaacgccaggagcgaatcgccaaggccgaaaaggcgatccaggagaattgccgctga

SEQ ID NO: 7452 - DNA, 1212 bp, Pseudomonas aeruginosa
tgcgggttttcgcatatttcagaggcaaggatatcccgtgagccagaccctgatcgccgccctgcagaacccggccctctacccccacccggtggagcgcttcgaggtcatcgagacgcacatctcctgggtcctgttgaccggtccctacgcctacaagatcaagaagccgatggatttcggctttctcgatttcaccagcctggacaagcgccgcttctattgcaacgaagagctgcgcctgaaccagcgcctcaccgacgatctctacctggaggtcctaccgatcaccggcagcgaagaggcgccgcggatcggcggcgacggcgaggcaatcgaatacctgctgaagatgcgccagttcccgcaggacaacctgctggcggcaatccagggccgcggcgaactgtccaaccagcatatcgacgaactggccgagcagatcgcgcacttccaccagaacactccgaaggtgccgctggagcacccgctgggcaccgccgagtcctgcatggcgccggtgcggcagaatttcgagcaggttcgcccgctgctcaaggacaaggccgacctgcaacagctggatgccctcgaagcctgggcggaaagcagcttcgaacgcctgctgccggtgctccaggagcgcaaggcgaagggcttcatccgcgaatgccacggcgacatccacctgggcaacgccgcgctgatcgacggcagggtagtgctgttcgactgcatcgaattcaacgaaccgttccgcttcaccgatgtctgcgccgacttcgccttcctcgcgatggacctggaagatcgcggcctgaagtgccacgctcgacgcttcgtcagcctctatctggaacacaccggcgactaccaggccctggaactgctgaacttctacaaggcctaccgcgccatggtccgcgccaaggtcgcgctgttcagcctcggctaccagaccgatgccgtgcagcgcgccgcgaccctgcgccagtaccgcaactacgccaacctggcggaaagctacagcgccattccctcgcgcttcctggcggtcacccatggtgtctccgcggtcggcaagagccaggtggccatgcgtctggtggaggctctgggcgccgtgcgcctgcgctcggatgtcgaacgcaagcgtctgttcggcgagcagccggaacacgacaggggccagttcgccgccggcatctatag

SEQ ID NO: 7453 - DNA, 576 bp, Pseudomonas aeruginosa
cgaacaggccgaacgcctggtgcgccacgcctgccgggtcgccgaacgtcggcacctgccctggagcgtggtacacgtcgataccggcggcttgcgcggcgagcacgcgcggatgcgcctgcagggtgcgcagcaactggccgagcggctcggcggcgagatcgtcgtgctgcgcgccggcgaggtggcgcggaccctcctgcaacatgcccgcgagcgccgcgccagcctggtcctggttggccagtcgcggcgccgctggtaccgccgggccttcggcggtggtctcgccgggcgtctgctgcgcgacggccagggcctggagatcagtgccctggacagcgaggccgacctgcgcccggcggaaccgcggccacgctatccggtggtgtggaacgactatctgctggcgctgctggcgaccgccctggccagcggcctggcctggatcgtggcgcacctgctggagctgccgaacatctccctggtgttcctgatggcggtgctgctggtggcagtgcgcaccagcctgatgccggcactgctgtgcgcggtggcgtcgttcctggcctatga

SEQ ID NO: 7454 - DNA, 1194 bp, Pseudomonas aeruginosa
cttcctgttcatcccgccgcatttttccttcgccatccatcgccacgaagacctgctgagcctggcgttcttcctgttcatggccggcctcaccggcaacctggcggcacgccagcggcgccagctggaggcgctgcgcgatacccaggaggaaaccagcctgctgctggagctgtcgcgcaagctcaccgccgccaccgaccgccaggcggtgctggccgccgccgcccagcagttcgacgactggaaggacgtcgaggtctgcctgctcggtcaggtcaatggcgagtggaagaccgaggccggcgtgcagcggcaactcgccgaccaggaacgggtcgccgcggactgggcctgggcccacgaccagccggccggcctcggtactggcacgctgcccggaggacgctggtggtggtggccgctgtcggcggaagagggaccgctggcactgctcggcgtcgcgccgctggacggccagccgctgagcccgcagcgccggcgcctgctcgctgccctcggccagcccctggcccaggccctggcccgtgcgcgcctggccgaggacctggaggccgcgcgcctgcacggcgagaccgagcaactgcgcagcgccttgctcgcctcggtgtcccacgacctgcgcacgccgctgacggccatgcgcggttccatcgacagcctgctggcgctgggcgaggcgatcccgccggcggatcgtcgcgaactgctggaaagcacccgcgacgaggccgagcgactggaccgctatatccagaacctgctcgacatgacccgtctcggccacggtggcctgaagctggcgcgcgactgggtggcgccgggcgacatcgtcggcagcgcgctgaaccgcctgcgcgcggtgctggcgccgtaccgggtgcaggcgatcgtggccaacgacctgccgttgctctacgtgcatgcggcgctgatcgaacaggcgctgatcaacgtgctggaaaatgccgcgcgcttctcgccgagccacggccggttgcgcatcgaggtcagccaggatgccgccgagctgcgtttcgcggtgagcgacgaggggccggggattcccgaggcccgagcgggagaagatcttcgacatgttgtacaccgctgcccgtggcgaccgcggtggccagggcaccggcctgggcctggcgatctgccagggcatga

SEQ ID NO: 7455 - DNA, 915 bp, Pseudomonas aeruginosa
tcggcgcccacggcgggcgtatcagcgtcggcgaaggcctcgacggtcgcggcaccacgctggtcctgcacctgccgctgcatccgcagccggacctcgggcaactggagggcgacgaatgagcccggcgcacttgcctggcgcctgcgctcgcgctattcctgccgtttccgcgacgccgccgctggcctgtcgccgtgttcacctgccgtgccgagtgccatgacccaattgcagaacagcatcctgctgatcgacgacgaaccgcagatccgcaagttcctccgtatcagcctcaatgcccagggctaccgggtgctcgaggccggcaccggcgaagaggggctggcccaggccgcgctgaaccgaccggacctggtggtgctcgacctcggcctgccggaccgcgacggccaggacatccttcgcgacctgcgcgaatggtcgcaggtgccggtgctggtgctgtcggtgcgcgccagcgagggcgagaaggtactggccctggacggcggcgccaacgactacgtgaccaagccgttcggcatccaggagttcctcgcccgcgtgcgcgtcctgctgcgccaggcggcgcagggcgaaagcccggaggcgtcggtggcggtcggcccgttgcaggtggacttcgcctatcgccgagtcaccctggagggtgcggaagtggcgctgacacgtaaggagtacgcggtgctcgccgcgctggcacgccatctcggacgggtagtgacccagcagcaactgctcaaggatatctggggcccgacccacgtcgaagacacccattacctgcgggtcgtggtcggccacctgcggcagaaactcggcgacgatccggccagcccgcgcttcctggtgaccgaggcgggcgtcggctatcgcctgcgcgacagctga

SEQ ID NO: 7456 - DNA, 1029 bp, Pseudomonas aeruginosa
cgcgcagcgcaattctgcgcgaggggcatgcctcccgcgcgttcatcgcctatgatgccgcgcattcgcgctggcccggatgcgccgggtcggtgccccggtgtcacgacgaaggtcatcatgcagcaactgttgaacgagattctcgatgaagtccgcccgctgatcgggcgcggcaaggtcgccgactacattcccgcgctcgccggcgtcgagccgaaccaactggggatcgccgtgtacagccgcgacggcgagctgttccatgccggcgacgccctgcggccgttttccatccagagcatttccaaggtgttcagcctggtccaggcgatccagcattccggcgaggacatctggcaacgcctcggccacgagccctccggccagcctttcaactccctggtgcagctggagttcgagcgcggcaagccgcgcaatccgttcatcaatgccggcgccctggtgatctgcgacatcaaccagtcgcgtttcgccgcgccggcgcaatcgatgcgcgatttcgtccggcgcctgtgcggcaacccggaagtggtgtcggactcggtggtggcgcgctcggagtaccagcaccgctcgcgcaacgcggcggcggcctacctgatgaaatcgttcggcaacttccacaacgacgtcgaggcggtgctgctcagctatttccatcattgcgcgttgcgcatgagctgcgtcgacctggcgcgggcgttctgcttcctcgccgacaagggcttctgcaagcacagcggcgagcaggtgctcaacgagcggcagaccaagcaggtcaacgcgatcatggccaccagcgggctctacgacgaggccggcaactttgcctaccgggtcggcctgccgggcaagagcggcgtcggcggcggcatcatcgcggtggtgccggggcgcttcacggtctgcgtctggtcgccggagctgaacgccgcgggcaattcgctggcgggtatcgccgcgctggagaaactcagcgagcggatcggctggtcgatcttctga

SEQ ID NO: 7457 - DNA, 741 bp, Pseudomonas aeruginosa
aaccgccgcccgtcgtggtggcgctcgaattcccggcgccgctgcgctatgttctgcggctaccgcttgccggcgccggatgcgccggtccactcgccaggatggtcgccatgtcccgcccgattcccgtttcccgtgtcttcgcctgcctcaccgttctcgccgcctgcgcgcacgccggcgccgccgagccggactggcgtggctataccagcgaccagcagcagcgcagcgtgctggccgtcgagcaggacgccgaggccatcaacaagcgctactacgacagtgccttcgaggaattcctgccggaactggagcaactggaactcagcctggcgcagcccgtcgtcgccgtcgacgagaaaggcctgctgggcgactggaagtgccgctcgacccaggccgaccagtacggcatctatcgctatccgaacttccagtgccgcatccggcgtaccgaccgcggcctgttcctggagaagaccagcggttcgcagcgggtcagcggctacctgttccgcgaaggcacgcagcgctacgtgttcctcggcggcgccacggtcaacgacgagccccaggtggccttcagtggcctggcccacggcgcgccggctgagtccgacgtggttgcgctgctgcgcccgcacgccggcggcttcatcctgctgttcccggaacggcgcggcggctacgaggtcctcgagttcagccgctgaggctcaggcgttgtcttcctcgtag

SEQ ID NO: 7458 - DNA, 801 bp, Pseudomonas aeruginosa
ccctgctcaccggggccaagacccagcagcagttcgaggcctacgagggctgcaccagcaaggccgagaaggcgcgcttctatatccgtgagtcgcgcgccgggcgctgagccgggcgcggcgatcggtcctctggcggcggcgccggctttgctagaatgggcacttttccgacatccacgggagtacaccgatgagcgaggcgatccgcctgacccagtacagccacggcgccggctgcggctgcaagatttcgcccaaggtactggaggtgatcctcgccggcagcggcgcgcagaacctcgatccgaagctctgggtcggcaacgcctcgcgcgacgacgcggctgtctacgccctcgacgaggagcgcggggtggtctccaccaccgatttcttcatgccgatcgtcgacgaccccttcgatttcggccgtatcgccgcgaccaacgccatcagcgatatctacgccatgggcggcgacccgctgatggccatcgccatcctcggctggccggtcaacgtgctggccgcggaagtcgcccgcgaggtgatcgccggcggccgcaaggtttgcgaggaagccggcatcccgctggccggcggacactccatcgacgcccccgagccgatcttcggcctggccgtgaccggcgtggtggagaagcgcttcatgaaacgcaacgacaccgccgaggccggctgcaggctgtacctgaccaagccgctgggcatcggcatcctcaccactgccgagaagaaggccaggctgcgcgccgaggacgtcggcgtggcgcgtga

SEQ ID NO: 7459 - DNA, 1536 bp, Pseudomonas aeruginosa
ctggatgtgcaccctgaacaggcccggcgcgcgcttcggccggttggcgggggtcaaggcgatgaccgacgtcaccggtttcggcctgctcggccacctggtggaaatggccgacggcagcaagctcaccgcacgcgtggagtacgccgcggtaccgcgcctggccagtgccgaatattacctggagcagggctgcgtgcctggcggcacactgcgcaacttcgacagctatggcgagcgcatcgcgccactgccggaagtgcagaagctgttgctttgcgatccgcagaccagcggcggcctgctggtggcggtggctccggaaggcgaggcggagttcctcgccgtggcggcggaactcggcctgcaactggcgccgatcggcgagctggtcgagcgacagagtctcgcggtacaggtgctgtaatgcgcgacaacacccagcactaccgcgaactgtttctcgacgatatccccctgatggatgtgcgcgccccggtggagtaccacaagggcgcctttcccaacactgtcaaccggccgctgatgaacgacatcgagcggcagaaggtcggcaccagctacaagcagcacggccagcaggccgccatcgcccttggccacgaactggtctgcggggcgctcaaggccgaacggctggcggcctggaaagccttcgccgaagccaacccgaacggctacctgtattgcttccgcggcggcctgcgctcgcagatcgtccagcagtggctgaagcaggacgccggcatcgactacccacgggtgatcggcggctacaaggcgttgcgcaacttccttttcgaaaccacccgcgcggcggtcgacgagtgcgatttcgtgctggtcggcggcctcaccggttgcggcaagaccgaggtgatcgcggcgctggacaacagcctcgatctcgaaggccacgccaaccatcgcggctccagctttggccggcgagccacgccgcagccggcgcagatcgacttcgagaaccgcctggccatcgacatcctgaagaagcgtcatcgtggcgtcggccagttcgtcctcgaggacgaggggcggatcgtcggcagctgctccttgccgctggagctgtaccagggcatgcagggctacccgctggtctggctggaggatgccttcgagcagcgtgtcgagcgtatcctcagggactacgtgatcgacctgcgcagcgagttcgagcgcgtggtgtgcgtggaggagggcttcgccgccttctccgcctacctgcagaagagcctcgccggcatcgtcaagcgcctcggcggcgagcgctaccagcggctggcggcgatcctcgtgcaggcgctggaagagcagggccgcgacggctcggtggatacccatcgtggctggatcgaggggctgctcaaggagtactacgacccgatgtacgccttccagcggcagagcaaggaagaccgcgtggagttccgcggcaaccaggccgaggtgatcggctacctgcgccagcgtcaggcgttgcggccatcgtag

SEQ ID NO: 7460 - DNA, 1116 bp, Pseudomonas aeruginosa
gtcggcgccgctgatggcgaagccctgggagaccccggcgccgatgttggccaggccgagggcgacgaattcgtggttggggttgatgctgtagccgtgacgggcggcgaagctgcgcgcggtgagcatggcgctgcagaagctgaccaccgtgatgccggtggcgtcgcgcagcaggcttttcagttcctccaggctggtctgcggccagctcagttgcggcagcccggccggtacctcgccaagcagttccacgccgtagcgatccaggcccagcagcgccgcggcgaggctggccaggaagacgccgcagagcgccccgggcaactgcgggaagcgccgcggcagcagcaccatcagcaagagcgagaggctgccgaggatcagcgtcggccaatggatgtgcagcaggttctccagcagcgcgaggatgccggcgacgaagccgctggtcgccgcctcgtagccgaacagcttgcccagttgcccgaccagcaggctcaggccgatgccgttgaggtagccgaccaggatcggtcgcgagaggaagctggcgatgaacccggcgcgggccaggccggcgacgatggagaacagcccgaccatgatcgcgacgatcatcgacaggtccaccaggcgctgcggatcgcccgccgccagcggggtgatggcggcggcgaccatcgccgcggtcgccgcgtcggggcctaccatcaactgccgcgagctgccgatcagggcgtagatcagcatcggcaggatgcacgcatagaggcctacctggggcgggaagccggcgatctgggcgtaagcgatggcggtggggatctggattgccgctaccgacagcccggcctggacatccggacggaaccaggcgcggcggtagtggagcaggctatcgagtccgggtacccagcgggcgagtggcatgcggctgattccttgcaggcgcggatgccgcagcttagcccgaaggacaggctgcaggattgccgggaatcattatttcttcagtgcacacgctcttcgaggcgaggcgctatccgccgcttcttcgcgccggcggcggacctcagaccttcaacaccaacttgccgaagttttccccgctga

SEQ ID NO: 7461 - DNA, 906 bp, Pseudomonas aeruginosa
ttcgccgccatcagtcttatcagcgggctggatggcccatcctccagtcccctgatagtgctatgccttgcgccggccctggctagactggcgcggcccggttccgtcgcggttggcggaaggcgattttccgaggagcagcagatgagcaaacttctttccggccaggtcgcactggtcactggcggtgcggcgggcatcggccgcgctaccgcgctggccttcgccgccgccggggtcaaggtggtggtcgccgacctggacagcgccggcggcgagggcacggtcgaagcgatccgccaggcaggtggcgaagccctcttcattcgctgcgacgtcacccgcgacgccgaggtcaaggcgctggtagagggttgcgcggcggcctacggccgtctcgactacgccttcaacaacgccggtatcgagatcgagcagggcaagctggccgacggcaacgaagccgagttcgacgccatcatggctgtcaacgtgaagggcgtctggttgtgcatgaagcaccagatcccgctgatgctggcccagggcggtggcgcgatcgtcaacaccgcctcggtcgccgggctcggcgcggcgccgaagatgagcatctacgctgcttccaagcacgcggtgatcggcctgaccaaatcggcggcgatcgagtacgcgaagaagggcatccgcgtcaacgccgtgtgtccggcggtgatcgacaccgacatgttccgccgcgcctacgaggccgatccgcgcaaggccgagttcgccgccgcgatgcatccgctgggtcgggtcgggcgggtcgaggaaatcgccgccgcggtgctctacctgtgcagcgaccacgcgggcttcaccaccggtatcgccttgccggtggacggcggggcgacggcgatctga

SEQ ID NO: 7462 - DNA, 2484 bp, Pseudomonas aeruginosa
ttggccatacagtcgcagctgccggaagctggcggagctggtaacttcccggcatttgccgaggagcttcgccatggatgcaaacccctacgccacgccgcgtgtcgaattggtcgagcagggcataccggatgctttccgccggcgctggacgcccgcgcaactgcgcatcctcgcctggctctgcctggcctcgatagccggcggcgtggtgctgatggtgctcagcctgctggaggcattcggcgacggcgccgcgttcagggtctacgccgactggctgggcctgctcctcagcctgctcggcgcctacctgctgctgcggctcaagcacctggtcgagtcgcgctttcgcggcccctcgctggcctggccggtatggttgtcgattctcctgaccctgctgggcgagggctggagcctgctggcggttaccgacgatgcgctgcagggctggaactggcaggcgctggtgtacttcgcgctgcttgcgctgatcggcgctaccaccctctggctgggcctgcgtctgctcaagcaggaaaacctctatccgtcgctgcggatcatggcctggctggacatcgccggcggcgcgatgctggcttcggtgctgttgctggtgctggcggtactgccgctgctggcagccaccgtggccatggcgctggcctgctggcgcgcggcgcgggagttggagcggagctagcgggcagccggtcggcttgtcgagcgtccatgcgccaggcccatggggcgtcagtcggcggcctccgtcgccgcttcgccgcggctgcctgcatgcgcccgagccagggtgcgattgaccgccagccagccggagaccgcttcgccgccggcttcctcgaagcagcgttggagcagccgcgactgctcgcgacgcagcgccttttccaaccgcacgccctcggcggtgaggccgaggaggcgtttgcgcttgtcgtcgtcggcggtggcgctgccgatcaagttcatctccagcaactggcgcagcgggatgttcagcgcctgcttggtcacgccgagcagggccagcagttccttcacgctgaggcccggatagcgggcgatgaagaacagcacgcggtggtgcacacgtcccaggccgcggcgggcgagcatctcgtcaggcttggtggtgaaggcctggtacgcgaagaagaaggcttccatcatggcctgctgctggacggcgtggtttttcaggtcaggcatattgacgcttccgggcgcggcatcgtagcttcggtcaagcagtttgactcattttttcccgcctacgctaccggtgatcccatggccttctctgaacgcatctcccgcctgaaaagctccttgatccgcgaaatccttgccgcggcgcagcgtccggaggtgatgtcgttcgccggcgggctgccggccgagccgatgctgccgaaggtgcagtgggagcagatgccggcctccatgggccagtacggcatgagcgaaggcgagcctgccctgcgcgaagccatcgccgccgaagcgcgtgccctcggcgtcccctgcgaggcgagccaggtgctgatcgtcagcggttcgcagcagaccctcgacctggccagcaagctgttcatcgatccgggcaccgaggtgctgctcgaggcgccgacctacctcgccgcgctacaggccttccaattgttcggcgccgattgcgtgaccgtgccgctgggtgccgagggccccgacctggttgccctgcggcagcgcctggagcgacacaagccggccttcgcctacctgatcccgactttccagaatccgtccggcgtgcgctacagcgaggaacgccgcgacgcggtggcggcgctgctagacgaattcggcgtgaccctgatcgaagacgaaccctatcgcgaactggtgttcgacgagggccgcgcaaccccgctggtcagccgcctgcgcaagtccagctggatctataccggcacggtgtcgaagaccctgctgccgggcctgcgcgtcggtttcctgatcgccaccccggacctgttcccccacctgctgcggctgaaacagtcggccgacctgcataccaaccgggtagggcagtggcaggcgctgcaatggttcggcagcgaggcctaccgccagcacctggccgaactgcgcgagttctaccgggtccgccgcgacgccatgcaggaggcgctgctggagcacttcggtgagctggccgaatggaatatcccggagggcgggctgttcttctggctgaccctcaggcagccgctggatacccgcaccctgctccagccggcgctggccgccgatgtcgcattcatgcccggcgaacctttcttcgccgagccggagcagaacctcgggcgtctgcggctgaacttcagccacgtcgccccggagcgcctgcacgaaggcctgcggcgcctggccaaggtcgtccgcgacgcccaggccgccgaagcggcctga

SEQ ID NO: 7463 - DNA, 1122 bp, Pseudomonas aeruginosa
ctcgcagtcggtcagggtcagcagctcctcgccggtgaccatcgaaacgggacagtccttgacgcaggtctgggcggcctggtcggcgggtttgccggcgggcgtcctaccgggtgcggaggcatcgggcgtcgcatgactgctggagagcgaggtgttcgcgcgctttcctcggctcagcggcagggtgtcgggctcggtgcgggcgatgccttgggcggtgctctggatctgtgcggtgatcttgttggagctgttggccatcacttcaccgcggacggccagaggtttcagcttttccgcgtgcaactggagggaatgccgacagctggtatcgatcagcacctgcatggctttgcgcagcagcatcgcaccttcggaggccttgatcgctttcgagcccttgacggccaggcgaacggcgagaccggctccgccggtcaggatgatgccgagcagaatatcgaggagcaggccggtggagagttccgcgaccatttccgcggcagtcgtgggcggcagcaactgggtccagcacacgatggcgctggcatagatgaacagaagcggttcgtcgctggcgatcagcaaggcggtaccgaggagttccttggcctgagccttgagcttttcgaaatccgcttcgttgatgaactcaaggagtttcgccgcgtgctcgtcgaggttcgcgaggatgctgaacagctcgaccacatcatcccagagattgaccagcgctttgcccatgccgtccagataggcgtcgtttatctgctccatccgcctacggtcgccaaccggcgcgagccttttccattcggcggaaagcgggccgttccattgctccagaagccattcgttcagcttggcgattacgtcgtcgtaggagcggtagagcgcgtcgatctcctggatgcttacctctgggtagaacttgacctggtacagcgtattgggagcgcagccgcttatgctcgccatcccatctgcatccagtacgcccttgaactgcggtgtcctgctgcctatccgagtgatttcgtaaggcgtgttgccgatgggcacgaaactggtcgattcgaaagtatgcagcagtttcagttgaccgttgaccggacatga

SEQ ID NO: 7464 - DNA, 612 bp, Pseudomonas aeruginosa
ccagcaactgctgctgtcgtcggcctggccctcgcgatcccagtggaattgcaccttcacccgaccgtagcggtcgcaatggatttcctcgcccttcggtccggtcaccaccgcgctctgcgtgccgaggatgcgcggcttcggcggcgtcggcgggggacgaaagaacgcctcccagggcgtggcctggaagcggttgcggtaaccctgccggaagtcgtccgggctcgcagagacgtcggagacgatgctttcttccagcacctgcggctgccgcccctcgtgaatcacctcggtgagcagccagaggtcgttccagcccgcctggggatgggcggccagcggcaggaagtggccgctgagcagcaacgattggtcgctgcggccctcggccaggcggtagtcgctgcgctgccgttcgagggcacgcctggccaggtgcttgccgcgctcgcggtcgacgaagcgaccgggatagtcgtagtcctcgaggtccggccgggcttcgccgcgggcggcgctttccagcgtcaggcgcggtttctcgaagtcgtagtcgcggcgggtgacgcggctggtgcgggtttccaggcgtacgccgaagcggcttga

SEQ ID NO: 7465 - DNA, 1218 bp, Pseudomonas aeruginosa
gcaagttgttgcacagtgctatgcaagaacttgctcacttcatcgaagaccccgtcaggccttggccccagcgtggtatccacagcttttcccgaagttatccagcaaaaagttgcacacctgccgagtgcctcagagccagttcttgaacttgaaccagaggtacggaaggatcgccgataccaccatcatccccagcgccatcggatagccgatggaccagtccagctcgggcatgtccttgaagttcatgccgtagacggtgcccaccagggtcggcggcaggaacagtacggcggcgatggagaacaccttgatgatgctgttctgctcgatgttgatcaggccaagggtcgcgtcgaggaggaagttgatctcggtggacatcttcgccaggtactcgtccagcgagcgcacgtcgcgctccacggtcttcgccagcaccttcgccggctcggaaagccagccgttgcaaccctggcggaaatagctgttcatccgattgatgctgagcaggctgtcgttgagcttggacagcagcgagctgctgcgcccgaggtgcttgatgatctgctgcaggtcggtcttcggcttgcgggtctgggcggtggactcggcgaagatctcccgcgacatgctgctcagttgcccctgtacggcctccaacacgtcggcgatgcggtccaccaggctgtccatcatcagggcgaacaactgggtgctgctgcggttggcgtcgagctggcggatgcaacggttctcgaactcgcggaacgaacgcaggtcggcgtagcgcacggtaatcagccatttctcgctgagaacgaaggtcacttcctctgtgctcggccggtgctcggtgatcccgccgaccaccgaagtggtcatgtagaggacgttgccgtcctcgtagaagcgcgacgaatcctcgatctcggccatctcctcgcgggtcgggatgttcacctgcaggtgggattcgagcaggcgctcctcttcgggggtcgggtgatgcaggtcgatccacagggtgcccggcggcaacccccgctgggcatcgtcgtgctggcgtcgctccaggcggtcgccggaaaggatgtaataggtgatcatgtcgggtatcgctaccttcgcggccatccgttggccaagcagggtggacaacttcccgccgccgcacaagcggtactttgcgccagaacgaggaacgcccgatga

SEQ ID NO: 7466 - DNA, 417 bp, Pseudomonas aeruginosa
ccctcggctatgaatacggcgacggcttcgatcgccgccacgacctggtgcgcatcccggtacgcaaggactactacggtttcctcatgctccagcgcggccgcgtcgactacgccctggcctaccgcaatacggctcgccagttgttcagcgaacatcccgaactggaaggccagttccagccggtggccacggtccaccgcccggagctgtacctgtcgttctcgcgccgccacccgcaggccgagcatctgctcgaacgcttcgacctcggcatgcagcgcatcctcgccagcggcgagtatcagaagatcctcgacggctggagccaggccgccgacgctacgccctagtccaactacactcaccggtgctcaacaccgcaaggagccgacatggccttcactcccgagctga

SEQ ID NO: 7467 - DNA, 2898 bp, Pseudomonas aeruginosa
ccggagccaggcacggcgcctggccttgcctgtgcccggacgcccatgaaccgacatcccgcactcagcctcgatctcgacgatggcatcgaccgcaaggtcctcggccagttgcgccaacgcttcctggcggtcaatgccggtcgcctgcaacgcgcccggcaggcgttgtccagccgccaggagcgggtcctgcgcctgctaccgctgctgttccacatcaaccatccgctgctgccgggctacctgtcggccagcacgccagcgggcctgagcggtttcgaggcggacgacgaagtactcgccgaagcccagcgcctggcccgctcgtttgtctacaagccacgcaggcaagaacccgcacagcagccgatccacggcctgttcctgatgggcagcctggggagcctggcccaggaggaacagagcgatctcgacctctgggtctgccatgccccagaactggagcccggcgcgcgccaggagctgcgccgcaagtgcgcgttgatcgaggactgggcgcgcagccagggcagcgaggtgcactgtttcctgatcgacgtcgcccgtttcggccaggacgaacgcaaagactggaaagagtccggcggcgacggcaatacccagcacttcctgctgctcgacgagttctaccgtagcgcgatctggctcggcggacgcacccctctatggtggctggtgccgcaggcccatgaacggcgctacgacgaatactgccggaccctgctcggcaaacgcttcatccgcgccgaagaggtgctcgacctcggccacctggcgcacatccccgcccgggagttcatcggcgccggcctctggcagttgtccaaggccatcgattcgccctacaagtcgctgctcaagctgctgctcaccgaagcctacgccagcgagcacccgcgggtccgctgcgtcgccctgcgcttcaaggagcaggtattcgccggccagctcgatctcgacgaactggacccctacgtcctggtctatcgccatctcgaacgctacctgcgggaacagcaggcgccggaacgcctggaactcgtgcggcgctgcctgtacctcaaggtcgggcgcaagctcggcggtcgccagcgccaggcgcagaagggctggcagcacctgtcgatggagcggctcgtcgcggaatggcaatgggagcctcgccgcttggccctgctcgacagccgcagccagtggaagatgcgccaggtgatggaagagcgtcgcacggtggtcaacgaactgacctacagctaccgcctgctgttccagatcgcccgccagcaaggcgctgacagcggcatcgacagccgtgacctgggcctgctcggccgccgcctgtatgccgccttcgagcgcaaggcaggcaaggtggagaacatcaacccggggatcgccccggatctcggcgaagacgtcctgaccctggtccagctgcccgccgacgacgaccgcgagcaggcgcagtgggcgatcttccccggtgccctgggcgctcaccagtggcctgactacgcgcctctgaaacgcagcctcaggctggtcgagctgctcgcctggtgccatcgcaacggcgtcatcgacagcgccacccggctgtccctgcatcccggccagagcgacctcggcgatgccgaactggacaatctcctgggcagcctgcggcagttcctgcctgtccccctggcgaccgtggacgacgccgacctgctgcaaccgcgtcggctcaagagcgtcctgctgctggtcaacgtcggtgtcgacccgctgcgccaccacagccagatgaacctgcacatggctaccgggcgtaccgacgtgctcggttatgccggggtgcgcgacaacctggtgctgaccctcgaccagctcagcctcaacagctggaacgaactgacggtgcgccattacgcaggcccccaggcgctgcccgagtgccttgccgagttcctcgacgccgtccgcgaaaagcccggaagcccgccgcagccgcctgaactgatggtgcgctgcttctgtcgcaaccgggccgccgccatcgccgtgcgggtcgaagagctgttccgcgagacctacgggcaactgcttggcggccagccaagccgctacctgctgcagatccgccagcagtaccacctgctggaaatgtcgccggaagcggtcagccacgagagcctgcccgacctgccgagcctgctccagcacctgggccgcgagcgagatggctacagcgccctgaagctggatcgtcacgccctggagggcgaggacctcgggctgatcctgtccatggggcggccggactgcatccaggtgttctaccggcgcgacttcgacagcgccgagatcagcctgctcgacgaacgcaacgccctctggcgccagcgccaggcattgcgtgacgaacgcagcctgctcgcaccgctgcagcgcttcctgcaatcgctgctgtaccggcgcaacgccctgtcgctggcggaacaggtgccggccgcgctggatatccgctactacgagttgctctccaacgacggcagagtgcatgtcgagcctcgcgaggcgccggaggccctggccgggcccgcgctgtacgagctacaggcgctactcgagcgcggcgaacgcaagcgcgtgcaggtcaccctgtactgcgaccaccaggagttttccgaactggagtacggcgccggcctgttcaaggcggtcgcccggcatatcctggcgcatcgcgcggaaagcgaaccctacccctgctacctgaccgacctcgacctgtcgcggctgttcgccgacgaacagccgcaaacgctgcactatctgcgttataaaagcgtcctggaaacggcgctgaaccaggcgctgctggaacaatga

SEQ ID NO: 7468 - DNA, 966 bp, Pseudomonas aeruginosa
gctcgaactacaacacccgcggccgcgccgcggaggtgctggtggatggcgagcagacccacgaggtccgtcgccgcgagaccgtccaagagctctacgccggcgaaagcctgctgccgcagtgaggcccagaccatgcttttgcgcttcaccaagatgcatggcctgggcaacgacttcatggtcctcgacctggtcagccagcacgcccatgtgcagcccaagcacgtcaagctctggggcgaccgcaacaccggaatcggcttcgaccagttgctgatcgtcgaagccccgagcagccccgacgtcgacttccgctaccggatcttcaacgccgacggctccgaggtcgagcagtgcggcaacggcgctcgctgcttcgcccgcttcgttcaggacaagcgcctgacggtgaagaagagcatccgcgtagaaaccaagggcggcatcatcgagctgaatatccgcccggacggccaggtcacggtggacatgggtccgccgcgcctggccccggccgagataccgttccaggccgagcgcgaagccttgtcctatgagatagaggtgaatggccagcgcgtcgaactggccgcggtatccatgggcaatccccatggcgtgctgcgcgtcgagaacgtcgacagcgcaccggtacacagcctcggtccgcaactggaagtccatccgcgcttcccgaagaaggccaacatcggcttcctccaggtgctcgatccgcaccatgcgcgcctgcgcgtctgggagcgcggcgtcggcgagacccaagcctgcggcaccggcgcctgcgccgcggcggttgccgggattcgccagggctggctgcaatcgccggtgcagatcgacctccccggcggccgcctgcacatcgagtgggcaggtcccggccagcccgttatgatgaccgggcctgccgtccgcgtgtatgaaggccaggtccgcctgtaa

SEQ ID NO: 7469 - DNA, 732 bp, Pseudomonas aeruginosa
gggccgtcgcccgcgagaaccgagacgcttatgaccgagaaaagccaggaaccgacagcagcgctggacgccgagcaggtggccgcctatctgagccagcacccggagttcttcgtcgagcatgacgagctgatccccgagttgcgcatcccacaccagcccggcgacgcagtgtcgctggtggagcgccaggtacgcctgctgcgcgagcgcaacatcgagatgcgccaccggctctcgcaactgatggacgtggcccgcgagaacgaccgcctgttcgacaagacccgccgcctggtcctcgacctgctcgacgccaccagcctggaagacgtggtcagtaccgtcgaggacagcctgcgccacgagttccaggtgccctacgtgagcctgatcctgttcagcgacagtagcgtctcggtgggccgctcggtgagcagcgcggaggcgcaccaggccatcggcggcctgctctccggcggcaagaccgtctgcggcgtgctgcgtccgcacgaactggcgttcctcttcggcgagagcgaccgcgacgagatcggctccgcagcggtggtctccctgagtttccagggcctacacggcgtgctcgccatcggcagtcccgatccgcagcattacaagagttccctcggcaccctgttcctcggctacgtcgccgaggtcctggcccgcgtgctgccgcgtttctcctcgccgctgcgctcggtccgctga

SEQ ID NO: 7470 - DNA, 1254 bp, Pseudomonas aeruginosa
cttcatcgcccgccgcgaccaggccctgctggagctgttctattcctccgggctgcgcctctcggaactggtcggcctcgatctcgaatggctggacctcaaggaaggcctggtgcgagtgcgcggcaagggcaacaaggtccgcgagctgccggtcggcaaggccgcgcgccaggcgctcgaagcctggctgccgctgcgcgcccaggccgctccggaagacggtgcggtgttcatcggtcgcggcggcaagcgcctgacgccgcgggcgatccagctgcgggtgcgccaggccggcgtccgcgagctgggccagcacctgcacccgcacatgctgcggcactccttcgccagccatctgctggagtcgtccggcgacctgcgcgccgtgcaggaactgctcggccacgccgacatcgccacgacccagatctatacccacctggacttccagcacctggcctcggtctacgaccgcgcccatccccgcgccaagcgcaagggcaacgccgatggaggcaacgacccatgagcagcctgcgactgatcaccttcgacctcgacgacaccctgtgggacgtcgccccggtgatgaacaacgccgagggccctgctccgcgaatggctggcgagcaacgcggcgcgcctgggtccggtacccatcgagcacttgtgggcgatccgcacccgcctgctggatcgcgagccgatgctgcgccaccgtctcagcgagctgcgccggcgcatcctgttccatgccctgctcgacgccggttatccacaggcggaggcggaaagcctggccgaggccggtttccaggtattcctcgaagcgcgccaccgggtcaccctgtttcccgaggtccacccgaccctggagatcctcgccgaccgcttcaccctcggcgtgctcaccaacggcaacgccgacgtgcgccgcctgggcctggccgactacttccggttcgccctctgcgccgaggaactgggcgtcggcaagcccgacccgacgccattccgcgaagccctgaagcgcgccggcgtcgaggcctcggcagcggtacacatcggcgaccaccccagcgacgacatcgccggagcgcgccgcgccggcatgcgtgccatctggttcaacccaagcggcaagccctgggccggggaggaagagccgagcgcggagatccgcagcctcgccgagctgccggccctgctcgcccgcctgcaatgacggaccgggcccccggtcgcgggtag

SEQ ID NO: 7471 - DNA, 909 bp, Pseudomonas aeruginosa
gccgtggatcgcgccccaggccagcagggcatagctcggcggcaggatcaccagccccaggcaggtcgccgaggccggcgccatccgccgcgccagcggctggaacagcaggccgcagctgatcacggtgaaggtcgagaagcccgaccagcgcgccagcccgtgggccgccagcagcgaaggcaggaccgcgatgaccagacccacagtggcccatgccagcaggatcgagaggccgtacggcaggctgccggcgggaaagaacggcagccgcagcatcggcgtatcgcgcccgcgcggcgcctcgtccggcaggcccgccaccgccgccagggccacgcaggccagtcccagctggacccagaagctgccgggcaccaggctctcccggaacagcaggaacagactggtcagtgccgcgccgaggccgaagccgagcgaggtgctggcggtcacccagttggccgaggtgcgagaatccccgcccgcgatcagttcgctcatgtaggccgtcccggtggccgatgccagggccgtgccgacgccgagcaacaggcgcgccacgccgagcgcctccaggcgcggccagagcgccatcaccagggtggccaccatcgacagcagcagcgcgacgacgatcggcggcttgcgcccgatccgatcggacaacccgccgagtaccagcagcaccggcagtacgccgagcacatagccggagaaagcgctggcggtagctgccgcgccgtagccggaaagctccgcgtaggcggtgtacagcggcgcctggaggttcaccgccaaggtgatcaggcacaggccgaaggccaggcatgcggcgtggcgacgggtattgctcatgcgtttctccgttcaagggcctgccgcggcagagcggtgggcattggctag

SEQ ID NO: 7472 - DNA, 1488 bp, Pseudomonas aeruginosa
cccgcgagaagaggcgtcgactatccggcgcggcggcgctacggaacaagtaacagctgttcggatttgtgcttaactgttcgcctgaaaaaaccgaacagtgagtcagacatgcacctccggatcgaccgcaatgccagcgagccgctggtgcagcagatcgtcgcaggggtcagcggctggatccgcggcaatcgcgtccgcgccggcacgcggattccgtcgatacgccagttggccagggaaaaccagctcagccagtccagcgtgatcgaggcctacgaccgcctggtcgccctggggatgctggaatcgcggcacggctcggggttcttcgtcgccgaggcgcccgccgccactaccgacctcgacagcgaatggcacgaaggcgcggaaaacgcatggggccagttcagcggcagctcgacgaaactcaagctcggctgcggctggattccggacagttggcgggaagtcgaggaactcagctacgcgatccgccaggtcgcccgcagcgaactcgccgggctgttcgactacagcactccgctgggcctgccggcgctgcgccagcacatccagaaacgcctgcggctgatcgatatccatgtcgacccggagcagatcctcaccaccaccggcgccagccatgccctcgacctgttggtacgcacgctgctcaagccgggcgacgtggtggtggtggagaaccccggctactacaacctgttcaacctgctgaagttccacggggtgaagatgctcggcgtgccgcgcacccgccacggcccggacaccgccgcgctggagacgatcctccgcgcgcacaagccgaagttccttttcaccaacagcatgtaccacaaccccaccggcaccagcctcagcccctcagtggcccaccgcgtgctgcaactggccgagcagcatgatttccacatcgtcgaggatgacatctacgccgacttccagaacggccccagcacccgcctggcaaccctcgattcgctgcgccgggtgatctacctggcgagcttttcgaagaccctcagttgctcgctacgggtcggctacctgatcgccggccccgagctgatccggcgcctggcggatgtgaagatgtacaccagcatcggcagccagcgcttcgccgaatgcgtggtctcgaccatgctcgccaacggcagttaccgcaagctggtgcaacgcctgcgccagcgcctgacccggcagatggcggcgaccctgcgggtgcttggggacaacggctgggaggtgttcgccgaaccggtcggcgggatgttcgtctgggcccatatcggcgactacccgttcgccgaattgcaggccatggcgacacgcctggacgtgctgctgtcgccgggcagcggcttcagcccggaaggcgaggagagcgactggctgcgtatcaacatcgcctatgccagcgacccgcgggccctggcgttcttcgaggcgttcgggtga

SEQ ID NO: 7473 - DNA, 1551 bp, Pseudomonas aeruginosa
cgccgcccgccgactgatcctcccccctgcgagcggcgtgagatcaaggagcgatccatgtccctggcgattgtccacagccgagcccaggtcggcgtcgaagccccctgcgtcagcgtcgaggcgcacctggccaacggcctgccttcgctgaccctggtcggcctgccggaaaccgcggtgcgcgagagcaaggaccgcgtgcgcagcgccctgctcaatgccggtttcgacttccccgcgcggcgcatcaccctcaacctcgcccccgccgacctacccaaggacggcggtcgcttcgacctggccatcgcactcggcatcctcgccgccagcggccagttgcccggcaccgccctcgacggcctggagtgcctcggcgaactggccctgtccggggcgatccggccagtgcgaggcgtattgccggccgcgctggcggcgcgcgacgcaaggcgcgttctggtggtaccgaaggaaaatgccgaagaggccagcctggccagcgggctgacggtgttcgccgtggaccacctgctggagatcgccggacacctctccggccaggccccgctgccgccctaccaggcccgcggcctgctccgcgcgcccttcccttatccagacctggccgaggtccagggccaggccgccgccaagcgcgccctgctggtggccgccgccggcgcgcacaacctgttgctcagcggcccgccgggcaccggcaagaccctcctggccagccgcctgcccggcctgctgccggcgctcgacgaggacgaagccctggaggtcgcggcgatccattcggtggccagccacgtccccctcaggcactggccgcagcgaccgttccgccagccgcaccactccgcctccgcgccggccctggtcggcggcggcagccgcccgcagccgggcgagatcaccctggcgcaccagggcgtgctgttcctcgacgaactgccggagttcgagcgcaaggtcctggaggtcctgcgcgagccgctggaaagcggcgagatcgtcattgcccgggccaacggccgggtacgtttcccggcgcgcttccaactggtggcggcgatgaatccctgtccctgtggctacctcggcgatcccagtggccgctgccgctgcaccccggaacaggtccagcgctaccggggcaagctgtccggaccgctgctcgatcgcatcgacctgcacgtcagcgtgctccgcgaaagcaccagcctgcagccaggacacggcgaaaccgctaccgccgaggtcagcgaacgggtgggcgccgcacggcaacggcaactggcccgccagggctgcgccaatgcccatctcgatctccaggcgatgcaccgcaattgtgcactcgccgaagcggaccgccgctggctggaggctgccggagagcgcctggaactttccttgcgcgccttgcatcgcatactcaaggtggcccggacgctggccgacctggagcgcatcgatgccatcgaacgccggcacctggcggaagccctgcagtatcgggcaatgacctccacgtga

SEQ ID NO: 7474 - DNA, 2124 bp, Pseudomonas aeruginosa
ctatcacgatgtgttaggctgtttcgtcttccgccttcggcgggcaatccgatcacaaggagagctagcttacatggagacacccactaccccccggagcaccctgaatcctccggtcttctatacctccgccgccctgatcctggccctggtgctgttcaccgtgctcctccaggaagaagcgcaatcgctgttcaaccacgtccagcaatggatcatcaccaacgccagctggttctatgtactggccgtggcgctgatcctgatcagcgtggtgttcctcgccgtcagccgctacggcgacatcaagctcggccccgaccacagtcgtcccgactaccgcaacaccacctggttcgccatgctgttctccgccggcatgggcatcggcctgatgttcttcggcgttgccgaaccggtgatgcacttcaccaccccgccggtgggcgagccgaacaccgtgcaggcggcgaaggaagcgatgaagctgaccttcttccactggggcctgcatgcctgggcgatctacgccatcgtcgcgctgatcctggccttcttcagctatcgccacggcctgccgctgaccctgcgctcggcgctgtatccgctgatcggcgaacgtatctacggccccatcggccacgcggtggatatcttcgcgatcatcggcaccgtgttcggcgtggcgacttcgctcggctacggcgtgctgcagatcaacagcggcctgcaccacctgttcggctggccggtgaaccagaccgtgcagatcgccctgatcgccgccacctgcggcctcgccacgctctcggtggccagcggactggaccgcggcatccgcatcctgtccgaactgaacctgagcctggcggtgatcctgctgctcttcgtgctggtcctcgggccgaccgtgtttctcctgcagacctacgtgcagaacaccggggcctacctgtccgacatcgtcaacaagaccttcaacctgtacgcctacgagcccaccgattggatcggcggctggaccctgctgtactggggctggtggctgtcctggtcgcccttcgtcggcctgttcatcgcccgtatctcgcgcggccgcaccatccgcgagttcgtctgcggcgtgctgttcgtcccggccggcttcaccctgctgtggatgacggtgttcggcgataccgccatccacatggtcctgcaggagggcttcacccagttggccgaagtggtcaaccaggacagttcggtggcgctgttcgccttcctcgagcacttcccgctgggcagcgtgatctcgctggtggcggtgctgatggtggtggtgttcttcgtcacctcggccgactccggcgcgctggtggtggacatgctagcctccagcggcaaggaccactcgccgctctggcagcggatattctggtcggtgctgatgggcgtggtggccatcgccctgctcctcgccgatggcctcaaggcgctgcaaaccgcgaccatcgccagcgcgctgccattctccatcgtgctcctggcgtcgatctggggcctgttcaaggcgctgcacctggatgccaccaagcgcggcatccgctaccaggcgctgaccttctcccgccccaccacgcgcagcggcgcaagcgagggcgacggttggcagcgccgcctgcgcaacatcgccatgttcccaaggcgcagccacgtcaaccgcttcatcaccgatgtggcgcgaccggcctgcgaggacgtcgccgccgaactgcgcaagcagggctacgaagtccaggtgcaggacggcgaggacggccgggttcggctggaagtcagccacggcggcgaggtcgatttcatctacgaggtgcgtccgcgcgccttcaccacgccgagcttcgtgatgcgcgacaccgaggacagcagcgagtcgcgcaagtatttccgcgccgaggtccatctccaggaaggcggccaggactacgacatcatgggctggagccgcgacggcgtgatcggcgacatcctcgaccagtacgagcggcacatgcacttcctgcacgtggtgcgctgagggatgcgggggccggccaatgccggcccctcgccgtttcgcctactggatctgctccggagtga

SEQ ID NO: 7475 - DNA, 708 bp, Pseudomonas aeruginosa
actgcatgccgctgctgctggccctgtatatccgcctgcagccggcctatgccgagtactcgctgctgcgcggactgggacggccgcagcgggcgatggtcgaggagatactgcgcctggggctgcccatcggtggcacctacgcggtggagtcggggatgttcacggtcgccaccctgtgcatgggcatcatcggcgatcacgccctggccgcgcaccagatcgccatccaggcggtatacgtggcgttcatggtgccggtggggttgtcgtacgccaccacctaccgcatcggccagcatttcggcgccggccgcctgctcgaagcacgccgcgccgggcgtgtcggcatcggcttcggcgcgctgtgcatgctgctcttcgccgggctcttctggtggatgccggaggccatcatcggcctgttcctcgaccgcgacgccccggccaaccgggaggtggccgcgatggccgtctcgctgctggcgatcgccgcctggttcgagctgttcgacggcacccagaacgtcgccatgggcgcgatccgcggtctcaaggacgcccgcaccaccttcctggtcggcctggcctgctactggctggtcggcgtgccgctggcctgcctgctggcgttcgcggccggctggggcgccgcgggcgtctggtgggggctggccggcggcctggcctgcgcggccattggcctga

SEQ ID NO: 7476 - DNA, 1677 bp, Pseudomonas aeruginosa
ccctggccttcgagtggaagaccgcgcggttgctgccgaaagccacggccagcgaggcgtcggcgctcaattgccgagcggctggccgcggtgcgccgagcgctcgcctatgcccaggaaacgcgccagttccgccaacggcagcggcggactgatccagtagccctgcacctggtcgcaaccgaaatcgcgcaactgctcctgctggcgcagggtctccacgccttcggcaaccacttccaggttgaggttgtgcgccaggttgatcatcgcccgcaccagttggaagttttccgcccgctggtccatgccgccgacgaagctgcggtcgatcttcaacagggtgatcggcaggctattgaggtggacgaaggacgagaaaccggtgccgaagtcgtccagcgaaaagcgcacgcccagttggccgagcgcctgcatggtctgcagcacctggtcgctgcgccgcatcacggcggtctcggtcagttcgaactcgagccagcgcgcgtcgacgccgtgctcttcgatcaaccgttgcagggtcggcagcaactggctgtcctggaactggcggaacgacaggttcaccgccatgtgcaacggctccaggccgcgcccgttgagccactgcatgtcgcgcagggcgcgggcgatgacccagtagccgagcggcacgatcagcccgctctcctcggccagcgggacgaactcgctgggcgtgagcaggccccgctcgccgtggcgccagcgcaccagcgcctccaggccgacgatgcgcccgctgtccaggcacagtcgcggctggtagtgcagctccagctcgtcgcgacgcagcgcccggcgcagttcggcttcgaggtcggcgaggctgcgcacgccacggttgatgcgttcgtcgaagacatggaaggtgcaaccctggcggctcttggcctgctgcatggcgatgtgcgcatgccacatcagcgggtcggcaccttcgtcggcacgggcatgggcgagtcccaggctgcaacccagcaacaggctctcgccatcgatccagtagggctcgccgaggcattcgacgatgcgttcggcgacccgctcggcgcgttgcggatcgcgacgggtgtccagcagcagggcgaactcgtcgctgcccaggcgcgccaggctgtcgccgttctccatgaagccgcgcaggcggttgaccacctgcaggatcaggcggtcgccgccctggtggccgagggaatcgttgacgtgacggaagttgtccaggtcgaggtggccgagcaccaggccacgcccgtcgaattcgctgaggcgcgccgcgagcagggtctggaagccctggcggttggcgatgccggtcagcggatcctgctcggcgagcagttgcagggtcgcctgcaaacccaggcgctcgcgcgcgtagcgcaggcagcggcgcaggctgtcctcggaaagctgttcggcggccagccagtcgaccaccccaaccggcgcctgcgccggctcctgctgcaacagcaggatcaccggccagggacagggagtccccagcggcaggcaggccggcgtggccaggagcagcccccggggctcggcggcgaacagggtggccgcaccctcccaggtggtgacgatgctcagcgaaaaggcaggccccagcgctctcaggcgttcacctag

SEQ ID NO: 7477 - DNA, 2106 bp, Pseudomonas aeruginosa
aatacgcccccgcttcaaccctctcttccggcctgttcctatgtcccgactcaatccccggcagcaagaagccgtgaactacgtcggcggtcccctgctggtcctggctggcgccggctccggcaagaccagcgtgatcacccgcaagatcgcctatctcgtccagcagtgcggtatccgcgcccagtacatcgtcgccgtgaccttcaccaacaaggccgcgcgggagatgaaggagcgcgtcggcaccctgctgcgcggcggcgagggcaagggcctgaccgtctcgaccttccacaacctcggcctgaacatcatccgcaaggaacacgaacggctcggctacaagcccggtttctcgatcttcgacgagtcggacatcaaggcgctgctgaccgacatcatgcagaaggagtattccggggacgacggcgtcgacgagatcaagaactacatcggcgcctggaagaacgacctgatccttccggaggaggcgctggaaaaggcccgcaaccccaaggagcagaccgccgcgatcgtctacctgcattaccagcgcaccctgcgcgcctacaacgcggtggacttcgacgacctgatcctgcaaccggtgaagctgttccaggaacatccggacgtcctccagaagtggcagaacaaggtgcgctacatgctggtggacgagtaccaggacaccaacgccagccagtacctgctggtcaagctgctggtgaaggaccgcgcccagttcaccgtggtcggcgacgacgatcagtcgatctacgcctggcgcggcgcgcgtccggaaaacctgatgcagctgaaggaagacttcccttcgctgaaggtggtgatgctggagcagaactaccgctccaccagccgcatcctcaagtgcgcgaacgtcctcatcgccaacaacccgcacgtattcgagaagcagttgtggagcgagatgggccacggcgatccgatccgggtgatccgctgccgcaacgaggacgccgaggccgagcgcatcgccatggaaatcctcaccctgcacctgcgcaccgagcggccgtacagcgagttcgccatcctctaccgtggcaaccaccaggccaagctgatggagctgaagctccagcaccaccagattccctatcggctctctggcggcaccagcttcttcgggcgccaggaagtgaaggacctgatgtcctacttccgcctgctggtgaaccccgacgacgacaacgccttcctcagggtgatcaacgtgccgcgccgggaaatcggttcggcgaccctggagaagctcggcaactacgccacccagcgcaagatctcgatgtacgccgcctgcgacgagatgggcctggccgagcacctcgacagccgtttccacgaacgcctgcaacgcttcaagcgctggatggacgatatccgccgacagtgcgcggagaacgagccgatcgccgtgctgcgcagcatggtgatggacatcgactacgagaactggctgcggcagaacgcctccagcgacaaggtcgccgaattccgcatgagcaacgtctggttcctcatcgaggcactgaagaacaccctcgagcgcgacgaggaaggcgacatgaccatcgagcaggccatcgccaagctggtcctgcgcgacatgctggagcgccagcaggaagaagaggaaggcgccgaaggcgtgcagatgatgaccctgcacgcgtcgaaggggctggagttcccctacgtgttcatcatgggcatggaggaagagatcctgccccaccgttccagcatcgaggccgacacggtggaagaggagcgccgcctggcctacgtcggcatcacccgcgcgcggcagaacctggcgatgaccttcgccgccaagcgcaagcaatacggcgagatcatcgactgctcgccgagccgcttcctcgacgaactgccccccgaagacctcgaatgggaaggcatggaagacgccccgcaagaggtcaaggcggccaagggcaacgccgccctcgccgacatccgcgccatgctcaagcgctgagcccgccgcgcctcgactgtctcgattttcacaaaagtgtcttgcccgatgcctag

SEQ ID NO: 7478 - DNA, 1695 bp, Pseudomonas aeruginosa
aatcgctggccggcggtcaggtcgagttcctcgactgagcgccactcagccccgctcttcctggctggctcgcaggccggccagcagcaagcgctggtagagttcctcgcgaagcccctgcggatcgtccaggtccatgcgccgcagatgcgccgggtaggcttctggctccggcgcatccagggtcgccttgcccagttcgaggatctcgctcagcttcagcttgcgcttgagccaacccagcgcccgcagcaggtcctgctcgatctcgtcgaaatcgctgcccaggggaaactccggcagcgccgctgcgtgggcctggtgcaaggcctgcaggcgctccggggtattgttgcgatagcgttcgggcaggacgaaatccttcggcagcttgccggccgactgggcctgctcggccagcgcctgctggaagcgcgagtcggcgatggccagcagcgcggcgatcacttccgcgtcattcttgccgcgcaggtcggcgatcccgtactcggtcaccaccatgtcacgcaagtgccggggaatggtggtgtgggcgtactgccagacgatgttcgaactgacctccccgccggattcgcgccagctacgcagcatcaggatcgaacgtgcgccctccagctcgtgagcctgggcgacgaagttgtactgcccgccgacgccactgagcacccggccgtcctccaactggtcggcgaccccggcgccgagcagggtcacggtgaaggcgctgttgatgaagcgcgcgtcgcgccgctgcagacgcttcagctcttcctggcggtacaggttgttgacgaagccgatgccggtcatgccgatcccggcgcgctcttccagcgacatctcgcgcaggcgccggtagaacgccaacggaccgaggaaaaagccgccgtgcagccacaccccgccctccaccggcgcctcaccgcgctcggcggcacgctgccgcgcttcgtcggggtagacccggcggctcagcacgccggcctcggccagcgccagcagacccggcacgaacatctcgctgcaaccgtaaagcccccggcggaacggctccaggccaccgtcgcgctcgatcgtctcggcccagcgcgcacgcacacccagctcgtcgatcaacgcccggtaggtggcgttgtcgcgctggcgcagcagcagggcggcggtcagcgcgtcgcccatcgagccgatgccgatctgcagggtgccgccgtcgcgcaccagcgcgctggcgtggagaccgatacagtgatcctgcaggttgaccggcatgttcggcgtggagaacagccggctgctttccgccggcgcgtcgatcagcaggtcgaataccgactcctcgacctcggcgtcgcccggcaggtagggcaggtcatcgtggaccacgccgatggcgacgatggtctcgccagcggcgcgacgcttctccagcatcggcaggaggtccagggtgatatccgggttgcaggccaggctcagcttgcccggccgctcgggatgccgcgccaccagctgggccaccgcgttgacgcccttggcattgatgtcgcgggcgacgtggctgtagttgcaactgatgtagtgctgctgcgccggcgcgctgtccagcaggctgccgggctgcaggtagaactcctcgacgcggatgttcgccggcagttcgtcgcggcgtag

SEQ ID NO: 7479 - DNA, 444 bp, Pseudomonas aeruginosa
cggccgcgaaggcggcgagctgttcctcggtgcgcgggcaatccagttcgtcggcgcgggagaagtgactcatcatcacgatcttcgccaccttgccgctggcccgcaggcgctcgtgggcggcgcggaagtcctcggggaagaagccgacgcggtgcatgcccgaatccatcttcagccagacgttcagcgggcgggccaggctggcgcgttcgatcgcctccaattgccaggcgcaatgcaccacgcaccagaagtcgtgggcgacgatcagctccagctcggacgcctcgaagaagccctccagcagcaggatcggctggcggataccggcctcgcgcagctccaggccctcctcgatgcaggccacggcgaagccatcggcctcggccaccagcgcttcggcacagcgcaccgcgccgtggccgtatgcgtccgccttga

SEQ ID NO: 7480 - DNA, 2415 bp, Pseudomonas aeruginosa
tcggctcgctgggagccgccagctgcacggtgggcgtgcaggccatcgtcaggctgcccagcagcaggacagcgaatagagcgcagaggcgcatcgggggttctcctgtatggctcatggcgccgaagccttgcgtttctgcatgcgctcctgcacacgttggcgaatggtttcactgacccggtcgctcagttgcaggctggtcagcagtgccgggatatcctcctccagattgacgttgaggttgaccgggcgccccttctccaggtccgggttgctgccctgcaagcgcaggccgagcaacagcttgccgttctcatgataatcgacgctgctttgcaggacgtcgtaatggaaatcgtcgagggcatcggcgaccagcttcatccccgggttgctgcgccccagcgcctcgatcttcgccgagcggaagcgcaggtagccgggctcgcgggccttgacctggccgccggagacgctgggcttccagcggttcagcatcagcggcagctcgccgtccagggcgccttcgccggccaggccctccgccggatagacccggaaaatctcgccgagttgtatgccctggatacgcaaggcgaacttctgctcggcctgacccaggcggatgctccccgcggggaccgaggcctgcccgccgaacaggccgctctgcaacgtctgccagctcaaacggccgctgcccggcgcggaaagcggggcctcatagcgcccgcggaaactcaccggccccagcggcaggccgggattggcctcggccaggctcaggccggggctgtccaggctcaactgaccgccacgcaggcgcaaggccaggctgccgcccagccccttcagctcgctgcggtcgtagataccgtcgaggcctttcagggtcaggtccaggtcgagggacgaggcgcccgccgcatcgagcttccagccggccgcggcggtcgctcgcccattgcccagttcgagcagccccggccagtcggcgagggtcgcggccagcggattgccggtacggaagaacacctcggccagcctggcggagagcgccaggggcgtcttcgcgtcgcgctgcagctggatgtccgccgccaaccccgcgccgttgctcagccgtcccttcaggctggtgcgctcgagggtggtgtcgagcggcccctcgaaggtccaggccaacggtttgaggttggcctggcggagttgtccgacctgcgcctgcagcggcccggcgaaatgcagcgccagcggctggtaggccagttcgagagcggccccggcgaggtcgaggcggggctggccaaggtgcagcgtcgacggctcggccagggacgccgcctgcaaccgcgcgcccctgccgaaggagaggttggcgcgctgcccgtccagccggccctccaggggaatctccgcgaccagtcgctcggctttccagcccaggtattgcaggcgcggcgcgtccacctgcaagcgaccctccaccagcctggcggcccacggcgagatgcccagcaggtcgagccgcgtctccagcttcagcgtactcgcgccctcgctggtgaacgccaggcgcaacgcggtgacgctatcggcatcgcgctccagcggctcgctgcgcaagcccagcgcgctcggccgcaactcggccggcagcgcctgcaaccactcgccgtgcaactggctcaggcgcaagtcgctgcgcagctggcgtggcaaccaggcgccctcgtctccatccagttggacttgcagttcgccctgtacattacccagaccgggcagcggccaggcttgcggagcctgcaccagcagcgccgccgagccaccgccgtcgagcacccggcgcggctccagccagtcgctgccaggcgccaggcggatcgtccagtccgcttgcagatgcagggcttgcggtgcgtcgggcaggcgctgggcttccggcaaccagcgattgagccagaccaccaggccacgggtgtccggcaggccgggcgcctccaggcgcccctgccagaggccgtcgccatcggacggcgcgagctggctgtccagcgtcagcagcgcctgccggtcgagttgcgcgcgcgtccgcaggcgccaaccagtaggctcctcgaagagctgggcgtcgagctgggcctgctgcgcctcctgttgcaggcgcagttgcgcagccagcggaaacagcgctcccgacgggcggccgatgtccagtccgccgtcctgctcgcagcggccggcgggacaaggcaggtcgagatggaagcgttcgaggtggatctgttccggcagccaggcgagggtctcgcgcagggacgtccagtccagcgcagcggcgtcgtcgtcggaactcgcggcagccggttgccaggcgagcgccacttgctccacgcgcaggccgggtag

SEQ ID NO: 7481 - DNA, 909 bp, Pseudomonas aeruginosa
acgcggacgccaacccgacagcccgggccagcgcagcagcgcgtgttccacgtccagtcgcaggctggcgccatccgcgccgcgccgctccagcgccagccgtcgcagcccgatgccttcggcggacaggcccaggccttgccactccaggcgctcgacaccctgctcgcgcaacaggctgcgccaggcatgccagccgtagccgaacgccagcagcaacagcactgcaaataccagcagcaacgtcgtccttctgcgcaaacgcatgtcccacctctgtccgttgccgacccggccaagggtggcggggccctcgtgcaagatcaaggcgttttccctggccagtgtttttccctgctttcgacgttatattggcggaaaatttccggattttccgagccagacggggagcctccatccatgcgtacccagcatcagagcaagcgcgagctggacaagatcgaccgcaacatcctccgcatcctgcaggaggaaggtcgcatttccttcaccgagctgggcgaacgcgtcggcctctcgaccacaccctgcaccgaacgcgtgcgccgcctggagcgcgaaggcctgatcatgggctatcacgcccggctcaatccgcagcatctgaaggccagcctgctggtgttcgtcgagatcagcctggactacaagtccggcgataccttcgaagagtttcgccgggcggtgctcaagctgccccatgtactggaatgccacctggtgtccggccacttcgactacctggtgaaggctcgcatctcggaaatggcgtcctaccgcaagctgctcggcgacatcctgctgaaactgccgcacgtacgcgagtcgaagagctatatcgtcatggaagaggtcaaggagtcgctcgacctaccggttccggattga

SEQ ID NO: 7482 - DNA, 1455 bp, Pseudomonas aeruginosa
acgggaaacaccgtcttttctgtacacgatccccgcaacacctcgcagttttttcctttttcgcccttggcgagcgcctcgactgacgtttatgctccgtcaaattttccacacataataatcaggatttcacacatgaacgcccgcgttcaccagccggtgcataccgcccaacacgccccctcctactacgccgccacgctcaaccgacgcatcgagtgccctcccctggccggcgaagaacaggccgacgtgtgcgtcgtcggcggcggcttctcgggagtgaacacggcgttggaactggcccagcgcggcttctccgtggtcctgctggaagcgcaccggatcggctggggcgccagtgggcgcaatggcggccagttgatccgcggcgtcggccatgacgtcgagcagttcttcccggtgatcggcgccgacggcgtgaaggcactcaagctgatgggcctggaggcggtggagatcgtccgtcgccgggtcgagcagtacgccatcgactgcgatctgcgctggggctactgcgacctggcgaacaagcccggcgactaccagggcttccgcgaggacatggaggaactccaggccctcggctatcgccacgagatgcgcctggtgccggccgcggagatgcgcagcgtggtcggctccgatcgctacgtcggcggcctggtggacatgggctccggccacctgcatccgctcaacctggtcctcggcgaagccgccgctgcccagtcgctgggcgtccgcctgttcgagcgctcgccggtgacgcggatcgactacggcgcggaagtccaggtgcataccgccaccggcaaggtgcgggcgaagaccctggtgctgggctgcaacgcctacatgaacgacctcaacccgctgctcggcggcaaggtactgccggccggcagctacgtgatcgccaccgaaccgctggacgagcaactggcccgccaactgctgccgcagaacatggcggtgtgcgaccagcgcgtggccctcgactactaccggctctccgccgacaaccgcctgctgttcggtggcgcctgccattattccggccgcgaccccagcgacatcgccgcctacatgcggccgaagatgctggaggtattcccgcaactggcgaacgtccgcatcgactaccaatggggcggcatgatcggcatcggcgccaatcgcctgccacagatcggccgcctgccggggcaacccaacgtgtacttcgcccaggcctattccggacacggggtgaacgccacgcacctcgccgggcagttgctcgccgaagccatcggcggccagcagagcgacggcttcgacctgttcgccaaggtgccgcacatcaccttccccggcggcaagctgctgcgctcgccactgctggcgctgggcatggcctggtaccggctgaaggaaaaactcggtagctga

SEQ ID NO: 7483 - DNA, 1809 bp, Pseudomonas aeruginosa
ctgcggaacagacggcgaaatagcttccccaacgcattgcgattctcccgttggcaccccgaaagccttgccggggcgagcggatatatccggcgcacgaagcacagcggccgggcttccagaaggaaacccggccgcgggtgtggctcgagagagccggcccggaagggccgacctaggcgatcagagcttgatccaggtcgccttcagctcggtgtacttgtcgaaggcgtgcagcgacttgtcgcgaccgttgcccgactgcttgaagccgccgaacggagcggtcatgtcgccgccgtcgtactggttgacccagacgctgccggcgcgcagggccttggcagtcaggtgcgccttggacaggttgctggtccagaccgccgccgccagcccatagggcgtgtcgttggcgatgcgcacggcttcctcggcatcctcgaactcgatcaccgagagcaccgggccgaagatttcctcgcgggcgatcttcatcgcattggtcacgccgtcgaagatggtcggctcgacgtaggtgccgccggtttcttccagggtccgcttgccgccggcgaccaacttggcgccgtctttgtgaccggcctcgatgtaggacagcacggtgttcatctgctgggtgtccaccagcgcgccgacgttggtttccggatccagcgggttgcccggcttccagcccttgagggcctcaatcaccaggggcaggaacttgtccttgatggagcgctccaccagcaggcgcgaaccggcggtgcagacttcgccctggttgaaggcgatggcgccggcagcggcttcggcggcggccttcaggtccggggcgtcggcgaagacgatgttcgggctcttgccgccggcctccagccagacgcgcttcatgttcgactcgccggcatagaccatcagttgcttggcgatcttggtcgaaccggtgaacaccagggtgtcgacatccatgtgcaatgccagcgccttgcctaccgtgtggccatagcccggcagcacgttgaacacgcctttcggaatgccggcctcgacggccaactgggcgatgcggatggcggtcagcggcgacttctcggagggcttgaggatcaccgagttgccggtggccagggccggaccgagtttccagcaggacatcagcagcgggaagttccacggcacgatggcggcgaccacgccgaccggctcgcgggtcaccaggcccagctcggcatggggagtggcggcgacttcgtcatagatcttgtcgatcgcctcggcgctccagcgcaggctgttggcggcgctggcgacgtcgatgtgcagcgagtcgctgatcggcttgcccatgtccagggtttccagcagtgccagctcctcggcgttctccagcagcagatcggcgaagcggatcatcgtctgcttgcgcttggccggcgccaggcgcgaccaggcgccggaatcgaaggcattgcgggcgaccttgaccgcctgctcggcatcggccaggtcgcaactggcgaccttggccaggaagcggccatccaccgggctcaggcaatcgaaggtctcgccggaggcggcgttgctgtattcgccgttgacgaaggcacggccttcgatcttcaggtctttggcgcgggcttcccagtcggcgcgggtcagggtggtcatgacaacgtgtcctcttattggtgttctgggcgcctgggagacaggcgcgctgtcagattctgcaaggcgggcgcgcggcccgtggtgtccgccaccctaaaccagagcagcgcctgttttcaatatatttga

SEQ ID NO: 7484 - DNA, 1749 bp, Pseudomonas aeruginosa
cgagccgcagtcgagcagcctcgacaacttctggatgcccttcaccgccaaccgccagttcaaggtgcggccgcgcctgctggaaagcgccgaaggcatccactatatcgcccagggcgggcgccgcatcctcgacggcaccgccggcctctggtgctgcaatgccggccacggccggcgcgagatcagcgaagcggtggcccggcagatcgccaccctcgactacgccccgccgttccagatgggtcacccgctgccgttcgaactcgccgcgcggctggcggaaatcgccccgccgggcctgaacaaagtattcttcaccaactccggctcggaatcggcggacaccgcgctgaagatcgcccttgcctaccagcgcgccatcggccggggcacccgcacccgcctgatcggccgcgaactgggctaccacggggtcggcttcggcggcctgtcggtaggcggtatggtcaacaaccgcaaggccttctccgccaacctgctgccgggggtcgaccacctgccgcacaccctggacgtcgcccgcaacgccttcaccgtcggcctgcccgagcatggcgtggaaaaggccgaggagctggaacgcctggtgaccctgcacggcgccgagaatatcgccgcggtgatcgtcgagccgatgtccggctcggccggcgtggtgctgccgcccaagggctaccttcagcggctgcgcgagataacccgcaagcatggcatcctgctgatcttcgacgaagtgatcaccggtttcggccgcgtcggcgaagccttcgccgcgcagcgctggggcgtcgtcccggacctgctgacctgcgccaaggggctgaccaacggcagcatcccgatgggcgccgtattcgtcgacgagaagatccatgctgccttcatgcaaggcccgcagggcgccatcgagttcttccacggctatacctattccggccatccggtagcctgcgccgccgccctggcgaccctggacatctaccgtcgcgacgacctgttccagcgggccgtcgaactggaaggctactggcaggacgcgctgttcagcctgcgcgacctgcccaacgtggtcgacatccgcgccgtaggcctggtcggcggcgtgcaactggcgccgcacgcggacggccccggcaagcgcggctacgacgtcttcgagcgctgcttctgggagcacgacctgatggtccgggtgaccggcgacatcatcgccatgtcgccgccgctgatcatcgacaagccccacatcgaccagatcgtcgagcgcctggcccaggccatccgcgccagcgtctgatccaggcgggcggctggcgccgccctgcccccaactggccagaaccacaagaaccgagagtcagcatgaacatcgaacagatcgtcgacttcgcccaggccaacagcgccccggagcactacagcccggcgccggagaaaatcctcaagggcgacccgaaacagagcgtgcgcaaccactacggcagcccctgcgggcagttcaacgccggtatctgggaaggcgccgtgggccagtggacggtgaactacaccgaacacgagtactgcgagatcatccagggcgtctcggtgctgcgcgaccggcacggcaacgccaagaccgtgcgcgccggcgaccgcttcgtgatccctgccggcttccagggcacctgggaagtgctcgaagcctgtcgcaaggtgtatgtgatcttcgaagccaaggcctga

SEQ ID NO: 7485 - DNA, 1668 bp, Pseudomonas aeruginosa
ggtagcgattcaaggtcgccaacggccttgcatgactgcgcccaaccgctgcggatgggcatgttaaccgttcgaatggagcccgtcatgcgcctcgccgctttatccctgttcctcgcccccctgctgctcgcccagcccgccgccgctgccgccttgagcgtgtgcaccgaagccagccccgagggcttcgacgtggtccagtacaactcgatgaccaccaccaacgcctcggccgatgtgctgatgaatcgcctggtcgagttcgacgccggcaaggggacggtggtgccctcgctggccgagcgctggtcggtgtccgacgacggcctgagctatcgcttcgacctgcgccagggtgtgcacttccacagcaccgcctacttcaagccgagccgtacgctcgacgccgacgacgtggtgttcagcttccagcgcatgctcgatccggccaatccctggcacaaggtggcgcagaacggcttcccgcacgcccagtcgatgcaactgccggagctgatcaagcgggtggagaaaagcggcgaccaccaggtgctgttcgttctcgaccaccccgacgcgaccttcctgccgatgctgagcatgggcttcgcctccatctattcggcggaatacgccgaccagttgatgaaggccggaaccccggaaaagctcaacgccgagccgatcggcagcggcccgttcgtgttcaagcgcttccagaaggacgcggtggtgcgctacgccgccaaccccgagtacttcgccggcaagccggcggtcgacgcgctgatcttcgccatcaccccggacgccaacgtgcgcctgcagaagttgcgccgcggcgaatgccagatcgccctgtcgccgaagccgctggacgtggagagcgcgcgcaaggacgccagcctgaaggtcgagcagacgccggccttcatgaccgccttcgtcgccctcaatacccagcatccgccgctggacgatcccaaggtgcgccaggcgatcaacctggccttcgaccgcaccagctacctgcaggcggtattcgaaggcagcgccagtgccgccaccggcatctatccgccgaacacctggagctatgccagggatattcccgcctacccgcacgcccccgaacaggcgcgcaagctgctggccggcaagcagcttcccgagctgaacatctggacccgcccgtccggcagcctgctcaaccccaacccgagcctcggcgcccaactgctccaggccgacctggcggaggccgggatcaaggccaacatccgcgtcatcgaatggggcgagttgatccgtcgtgccaagaacggcgaacacgacctgctgttcatgggttgggcaggcgacaacggcgatccggacaacttcctcactccgcaattcagctgcgccagcgtcaagtcggggctcaacttcgcgcgctattgcgaccccggcctggacaagctgattgccgacggcaaggccgccagcagccaggaacaacgcaccggcctgtaccaccaggcgcagaaactgatccacgaacaggcgctctggctgcccctggcccacccgaccgccttcgcccttacccgccaggaggtgcagggctaccaggtcaatccgttcggtcgccaggatttctctcgggtcgccgtgaaacgctga

SEQ ID NO: 7486 - DNA, 1218 bp, Pseudomonas aeruginosa
ggcaagcctatgcagcggctctatcggaaacgcatcgtcctcggcgtgggcggcggcattgccgcctacaagagcgccgaactggtccgccgcctgcgcgaccagggcgctgaagtccgagtggtgatgacccagggcggccgcgagttcatcacgcccctgaccctccaggcgttgtccggccatccggtgcataccgatctgctggacccggcggcggaagccgcgatgggccacatcgaactggcccgctgggccgatctggtgctgatcgcaccggctaccgccgacctcatggcgcgcctggtccagggcgtggccaacgacctgctgaccaccctggtgctggccaccgacgcgcaaatcgccctggcaccggcgatgaaccaggccatgtggcgcgacaccgcgacccaggccaacgccgagctgctgcgccagcgcggcttccacctgttcggtccggcagcgggcagccaggcctgcggcgatgtcggcctcggacgcatgctcgaagccgaggaactggcgcagcgcgccgccgactgcttccagcgccaggcgctgaccggcgtgcatgtgctgatcaccgccggcccgacccaggaaaacatcgacccggtgcgctacatcaccaaccacagttccggaaagatgggcttcgccctcgccgaggcggcggtggaagccggcgcacgggtgaccctggtcaccggcccggtgcacctgcccacgcccgaccgggtgcagcgcgtcgacgtggtcagcgcccgcgacatgctggccgcctgcgaggcggagatgccctgcgacctgctgatcgcctccgcggcggtcgccgactaccgcccggaagtggtcgccgcgcacaaactgaagaaagaccctaccagcggcgagggcttgctcttgcagctggtgcgcaatcccgacattctcgccaccctcgcacagcgcgaggatcgtcccttcagcgtgggcttcgccgcagaaaccgaaaacctgctggactatgctgcacgcaagctgaaggacaagaacctcgacctgatcgtcgccaacgacgtggccaacccctcgatcggcttcaacagcgacgagaacgcgatcacggtgatcgaccgcgacctgcatccgagcaccttcgcccagaccagcaagggcaagatcgctcgccagctgatcgccttcatcgccgaccgcctcaaccagcaatga

SEQ ID NO: 7487 - DNA, 3099 bp, Pseudomonas aeruginosa
  unsure (1117): Identity of nucleotide at the above locations are unknown.
gttactgatgcactctctccaagccaagatcctcgacccccgcctgggctccgacttcccgctcccgcagtacgccacgccgggctcggccggcctggacctgcgcgccatgctcaaggaagacagcgtcctcggcccgggccagaccctgctgattcccaccggcctgtccatctacatcgccgatcccggcctcgccgccctggtcctgccgcgctccggcctggggcacaagcacggcatcgtgctgggcaacctggtcggcctgatcgactcggactaccagggcgagctgatggtgtcgtgctggaaccgcggcgagtcgccgttcaccatcgccgtcggcgagcgcatcgcgcagttggtactggtgccggtggtgcaggcgcatttcgagctggtcgaagcgttcgacgaaagccagcgcggcgccggcggcttcggccattccggcagccactgaccccgaacacaggacgagacgccgaggagacgcggcatgaagcttttccagcgcaccgcccaaggatgggaacgagttgggcgacgtgctcgaaccggaaaagaagccgcgccaaggcagcgtccgaacgcgctgacggcaaggacctgttgcccggcatatgcgccagcctactgggcgtggcggccgccggcgccctgctctggttcggcgtcttcggcggcgccggtgaggcgcagcagcgccagttggacgcggcctgggccgaaggccaggccggcgccttgcgccaggccttgcagcaactcgccgccgacacccgcgccgccgcggccagccccctcgccctcgaagccctgcaaagcggcgacgccacccgcatcgaggccgcccagcgcatcctgctggcctgggacggcgtggtcgatgcccacctgaacgcgcccggccaggccgcccaggacaacgacagccccggcccggtcagcttcgccgccctggatatcctgcaccgggtggaaagtggccagaacgtcgccgccgaagcctacaaggtcggccagcgctggctgctgtacagcgccgcgccggtgcgcggcgccgaccagagcctgcaaggcacgctgctgctggcggtcgacctgcaacggctgntgcgcgccctgccgcccttgccgggcgatgccggccaggtacaactggtccagcagttctccggcgcaccggcccaggtgctgctgcaacgcggtacgccggcgccgggcaagggtgcgcaagcgctggacagcggcaatccgaactggaaactgaactacacgcccggcagcgtcgcttcgacccaggcctcgccgctgctgctggcactcgcggcgctgctggcgctgctcggcggcatcctcggcacctacctcacccgttcgtcgctgttgcgccgcctgcatcaggatgtcctgaccctcggtcagtatcttcaggaactcggcgggcaacgcactgccaaaccccctgtgcctagcctgccgggcttcgccccgctgatccaggcattggcccgccagccgcggcgcaagccggagccgaccagcgtgcccagccctgccaaggcagcgccggtggcggtggcgaaagcgcctcctcgcgaggagccggcattggcagatccgttgttccagaacaccgacattctggatatcgacattctcgatgaagaccaggacctcctgggattggagcaaacccccatcatgagcactgcaaaagcaccgacgctgcccgccagcatcttccgcgcctacgacatccgtggcgtggtaggcgataccctcaccgccgagaccgcctactggatcggtcgcgccatcggctcggaaagcctcgcccgcggcgaaccgtgcgtcgctgtcggccgcgatggccgcctgtccggtcccgagctggtcaagcagctgatccagggcctggtggactgcggttgccaggtcagcgacgtgggcatggtgcctaccccggtgctgtactacgcggccaacgtgctcgagggcaagtccggggtgatgctgaccggcagccacaacccgccggactacaacggcttcaagatcgtggtcgccggcgagaccctggccaacgagcagatccaggccctgcgcgagcgcatcgagaaaaacgacctggcatccggcgtcggcagcgtagagcaggtcgacatcctgccgcgctacttcaagcagatccgcgacgacatcgccatggccaagccgatgaaggtggtggtcgactgcggcaacggcgtggccggggtgatcgccccgcagttgatcgaggccctgggctgcagcgtgatcccgctgtactgcgaggtcgacggcaacttcccgaaccaccatccggacccgggcaagccggagaacctgaaggacctgatcgccaaggtcaaggccgagaacgccgacctgggcctggccttcgacggcgacggcgatcgcgtcggcgtggtcaccaataccggtaccatcatctatccggaccgtctgctgatgctgttcgccaaggacgtggtctcgcgcaacccgggggccgacatcatcttcgacgtcaagtgcacccgccgtctgatcgccctgatcagcggctacggcggccgtccggtgatgtggaagaccggccactcgctgatcaagaagaagatgaaggaaaccggcgccctgctggctggcgagatgagcggccacgtgttcttcaaggagcgctggttcggcttcgacgatggcatctacagcgccgcccgcctgctggaaatcctcagccaggatcagcgtgacagcgagcacgtgttctcggccttcccgagcgacatttccaccccggaaatcaacatcaccgtcaccgaggacagcaagttcgccatcatcgaggcgctgcaacgcgacgcccaatggggcgaaggcaacatcaccaccctcgacggcgtgcgggtcgactaccccaaaggctggggcctggtacgcgcctccaacaccactcccgtgctggtcctgcgcttcgaagcggacaccgaggaagagctggagcgcatcaagaccgtcttccgtaaccaactgaaggcagtggattcctcgctgcccgtgcccttctga

SEQ ID NO: 7488 - DNA, 2082 bp, Pseudomonas aeruginosa
cgccgcccaggttgccaaggtcctttccgaggccctgccctacatccgccgcttcgtcggcaagacgctggtgatcaagtacggcggcaacgccatggagagcgaggagctgaaggccggcttcgcccgcgacgtggtgctgatgaaagcggtcggcatcaacccggtggtggtgcatggcggcggcccgcagatcggcgacctgctcaagcgcctgtcgatcgagagccacttcatcgacggcatgcgcgtcaccgacgcggcgaccatggacgtggtggagatggtcctcggcggccaggtgaacaaggacatcgtcaacctgatcaaccgccacggcggcagcgccatcggcctgaccggcaaggacgccgagctgatccgcgcgaagaagctcaccgtgacccgccagaccccggagatgaccaagccggagatcatcgacatcggccacgtgggcgaagtcaccggggtcaacgtcgggctgctgaacatgctggtcaagggcgacttcattccggtgatcgcgccgatcggcgtgggcagcaacggcgagtcctacaacatcaacgccgacctggtggccggcaaggtggcggaagcgctgaaggccgagaaactgatgctgctgaccaacatcgccggcctgatggacaagcagggccaggtgctgaccgggctgtccaccgaacaggtcaacgagctgatcgccgacggcaccatctacggcggcatgctgccgaagatccgctgcgccctggaagcggtacagggcggcgtgaccagcgcgcacatcatcgatggccgggtgccgaatgccgtgctgctggaaatcttcaccgacagcggcgtcggcaccctgatcagcaaccgcaagcgtcactgatcgcccggccatggcgcgctccggcgcgccatgacggttctcccttagcgtcgcgcggccagcgcgaaggcctgctccagcgggctcgcaccctcgctgcggaaggtcgccgggctcactcccgtccaacgcttgaaagcgcgcctgaaactgcggatgtcacggtatcccacttcctcggtgatacgttcgatggacatcccagggttgcccagcaggctcatcgcccgccctcgtcgcacctgctccagcaacgcctcgaaggtcagcccgtgttcggccagccggcgccgcagggtgcggctgctcatgttcagttcggcggaaatcctttcgatctggctgcccaggctgaggtcgcgggcgatggcccgttccaccgcctggaccaggtcgagtttccggtgcacctgggtgttttcctgctccagcagggccagcgcctggcgcaacgccggcaggttgtggttgggcaggcgcatgtccagccagtggctggcgatcgccatgcggttgtgcaggcagccgaagcgtacctgggggcccagcaggcgcaggtactcgcccgcgtagggcggagcggcatggatgagttcgatgcccagcggttcgaacgccgggctgaccagggcacgcccatacaccagcaggctggcgaagaactcctcgatggcgaacacctgcacctcactgctgggcaggtggcattcgacctcgacgaagaaggtttcgccctgctggtagacgctggaggtgacgatcccgcccgagctgtgctggtagcgcacgccgatgtcgaacgcgtcgcgcagggtccggcacagcgacagcacatggcccagcaggccaagggtgccgagcacgttctggtgtccgacccacagccccagtccccgctccggcagggcctggagggcacgctggatcatgctcacggcctggcggtaggagatgcgctgggtagggtcctgcaggtcttcgacggtgaagcccaggccccggcacagccgcgcgggatcgacaccatggccttcgaccacctcggccagcgtctgcagcaggaaggtggatacctgggcgagttcgtagcgcgcatcggcggcattgttgtgcatgggcgaaatcctgagccggtctcggcttcgttcttgttctggcggtggatcgcgacatgggatgagcgtcccatcatatag

SEQ ID NO: 7489 - DNA, 1077 bp, Pseudomonas aeruginosa
caaagcattgcacggtgtccgcaaatccccccctcgctgaccgtcaatgccctgcctcggcctgtcgatagggcttattcctatgccgtaccccgagccacgccaaacaataataagagcccgcccatgaatcggacccacccccgcaggcccctgcgcctggccgcctgcgtcaccctcgccttcagctgctgcacccatgccagcgaaggcggcgtggacaacataggtccaggaaccgacggtttcttcaccctgccactggacgtcgacaacctcccggaccacatgttcgccttcaacgtctactacaaccactacgaagccaggaagctgaacatcagctccttcggcggcaaggtgtccgacgtgaagatcagctcggatgcgatcatccctcgcctggactacctgagcccgctgcggatcttcggcgggcgcctgggcggctacatcgcccagccctatatccgccaacgggtggccgcgttcggcctgagcgacgaacgggaaagcatgggtgacaccaccttcgcgccgatcatcctctgggacatgggcaaggacctgaccctggccgccgccgtggaggtcaccgtgcccaccggcaagtacgatgccgagcggctggccaacaccagcaacaacttctacacctacaagccgctgttctccttcacctggctgcccaccgaacgcaccgagctgtcgctgaaggccacctacagcttcaacatggaaaaccacgacaccgactatcgctcggggcagatcttccatttcgactattccgccagctatcgggtgaccgacaacctgcgcctcggcctgaacggctactacctcaagcagaccaccgacgacaaacagaacggcgagaccgtacgggtgttcggtttcggcgaggaagtcgacgacggcgtacgcggccaggtcttcgccatcggcccggccgtgcacctgaccttcctcaagtacgccagcgcggagatccgctgggccaaggaattcgacgtggagaaccgccccgaaggcgacatgctctgggccaagctgaccattccgttcgaactctga

SEQ ID NO: 7490 - DNA, 498 bp, Pseudomonas aeruginosa
agtcgatgtctgcagcagcgtcgaggagccggcatgagcagcgcagcacagcgccagaactacaccttcttccattccctgcgggttcgctgggcggaggtcgatccgcagggcatcgtcttcaacggcaactacctgacctatctcgacgtcgccaccaccgagtactaccgccagctcggcatgtcctacccggccgacctgctgcgcggcggaggcgacctgttcgcggtgaagagcaccctggaataccgcgccccggcgcatttcgacgactggctggacatcggcacccgcgtggcgcggctggggcgcagcagcctggttttcgagctgggcatctggcgcgacgagcagttgctcaccgtcggcgagctggtctacgtctatgcggatgcgaacgagcgacagagccagcccctgccggactggctgcgcgagaagatcagggcgttcgagcgacagtcgccagtggaatcagggactcacgccgagtag

SEQ ID NO: 7491 - DNA, 405 bp, Pseudomonas aeruginosa
gcctctaccgccggcagatgcttcttcagttcagcatcttcggcaagatattccagcacctgctccagggaaacgatgctcaccaccggcatgccgaagtcgcgctcgacctcctggatcgccgacagctcgcccttgccgcgctcctggcggttcagcgcgatcagcacgcccgcggccctggcgccctgggcgtcgatgatctgcatcacttcgcggatcgcggtgccggcggtgatcacgtcgtcgatgatcagcacccggccgctcagcggcgcgccgaccagcgtgccgccttcgccgtggtccttggcttccttgcggttgaagcaccagggcaggtcgcgctggtgctgctcggcgagggccaccgcggtggtggcggccaggggaatgcccttgtag

SEQ ID NO: 7492 - DNA, 807 bp, Pseudomonas aeruginosa
cgctccttctccggggcccggcaggcagtgccgggcgtctgctcattcggccagcgcggcgcgctgaagttcgaacagctcctgcatgccctgctgggccagttcgagcatggcgttcagctcggcgggacggaacggcgcgccttcggcggttccctgcacctcgatgaagccgccggcatcggtcatcactacgttcaggtcggtttccgcggcggaatcctccaggtagtccaggtcgaggaccggcacgccctggtagatgcccacggaaacggcggcgaccatctgcttcagcggattgcccttgagcgcgccacgcttcttcagcaccgccagggcgtcgatcagcgccacggtggcgccggtgatcgaggcggtgcgggtgccgccgtcggcctggatcacgtcgcagtcgatgtacagggtgttctcgccgagcttgctgaggtccagcgccgctcgcagggagcggccgatcaggcgctggatctccagggtacgaccgccctgcttgccgcggctggcctcgcgctggttacgctcgccggtggagcgcggcagcatgccgtactcggcggtcaaccaaccctggccctggcccttgaggaagcgcggcaccccggactccgcgctgacggtgcagatcaccttggtatcgccgaactcgaccagcaccgaaccttctgcgtgcttggtgtaatggcgggtgatacggatcgggcgcagctggtcggcggcacggccactgggacgattcatcgtggatatcctgtactgagaaagcggaattggccgccattatag

SEQ ID NO: 7493 - DNA, 999 bp, Pseudomonas aeruginosa
aggccagcccgggctctcaaccaccgtcggcgtgcgggccccgccggacgtgggttacaatgcccggctcgaatcacggcagccgcgcgcgaccggcgccgaacgcactccccacacgactatcgaggtagacccatggtgcacagcatgaccgccttcgcccgcgtcgagcaggctggtacccacggcaccctgagctgggagctgcgctcggtcaaccaccgttacctggagccccacctgcgcctgcccgacgccttccgcgacctcgagggcgcggtgcgcgaggcgctgcgccagggcctgtcgcgtggcaaggtggaatgcaccctgcgcttcgccgaggaaaccgccggcaagagcctgcaggtcgaccaggagcgcgcccgccaactggtcgccgccgccgaaggcgtagccgccctgatccgccagccggcgccgctcgatccgctcgccgtgctggcctggcccggcgtactggtggccgactcggccgatccgcaggcgctcaacgccgccgccctggaagccttcggccaggccctggagcaactcaaggccggccgctcgcgcgaaggcctggagctggcgaagctgctcaacgatcggctcgacgcgatgctggtggaagtcggcaacctgcgcgaactggtgccgaccatgctggccaaccagcggcagaagatcctcgaccgcttcgccgaactcaaggccgaactcgatccgcagcgcctggagcaggaactggtcctgctggcgcagaagagcgatgtcgccgaggagctggaccgcctcgccacccacgtcggcgaggtccgccgggtcctcaaggccggcggcgccgccggtcggcgcctggacttcctgatgcaggaactcaaccgggaagccaacactctaggctccaaggcgttcgacccgcgctcgacccaggcggcggtcaacctcaaggtcctgatcgagcagatgcgcgagcaggtccagaacatcgaatga

SEQ ID NO: 7494 - DNA, 1086 bp, Pseudomonas aeruginosa
cccgcgggcgcctccgcccgatctctttccaacccgtacgaagcaccaggaacacctcatgtccggcaccctgtacatcgtttccgctccctccggcgccggcaagaccagcctggtgaaggccctgctcgacgccgcccccgaggtccgcgtgtccgtctcccataccacccgcggcatgcgtccgggcgaggtggacggggtcaactaccacttcaccagccgcgaggaattcctcgccatgctcgagcgcaacgagttcctcgagcatgccgaagtcttcggcaacctctacggcacctcgcagcgctgggtcgagaaaaccctcgccgaaggcctcgacctgatcctcgagatcgactggcagggcgcccagcaggtgcgccggctgatgcccgaggcccaatcgatcttcatcctcccgccgagccaggaagccctgcgccagcgcctgaccaaccgcggccaggacagcgacgaggtgatcgagcggcgcatgcgcgaagccgtcagcgaaatgagccactacgtggagtacgatcacctggtgatcaacgacgatttcgcccacgccctggacgacctcaaggcgatcttccgcgcccgccagttgcgccaggacgcccagcagcaacgccacgccgaactgctcggtcgtctgctcgcctaaatcggctcttccataaagattggcgattttttagactattcagtccgcccggcaaacgtcgggctcacttttcgttacgaggaacaccatggcccgcgtcaccgttgaagactgcctggacaacgtcgataaccgtttcgagctggtcatgctcgccaccaagcgcgcccgtcagctggctaccggcggcaaggagccgaaagtggcctgggaaaacgacaagccgaccgtcgtcgccctgcgcgagatcgcttccggcctggtcgatgagaacgtcgtccagcaggaagacatcgtcgaggacgaaccgctgttcgcagcgttcgacgacgaggccaacaccgaggccctgtaagccatggcctcggctcgacgtcgcctgcgagcgccgcaacccgcctacgggcagggggtga

SEQ ID NO: 7495 - DNA, 1347 bp, Pseudomonas aeruginosa
ggcgttcaacgagatcatggacgtctacgccttccgcatcatcgtcgacaaggtcgatacctgctatcgcgtgctgggcgccgtgcacagcctgtacaagccgttccccggacgcttcaaggactacatcgcgattcccaaggccaacggctaccagtcgctgcataccaccctgttcggcatgcacggggtgcccatcgagatccagatccgtacccgcgagatggaagagatggccaaccacgggatcgccgcgcactggctgtacaagtccaacgacgagacgcccaagggcacccatgcccgcgcccggcaatgggtgaagggcgtgctggaactgcagcagcgcgccggcaactcgctggaattcatcgagaacgtgaagatcgacctgttcccggacgaggtctacgtgttcacgcccaagggccgcatcatggaactgcccaagggttccaccgcggtcgacttcgcctacgcggtgcacaccgacgtcggcaacagttgcatcgcctgccgcatcaaccgtcgcctggcgccgctctccgagccgttgcagagcggccagacggtggaaatcgtcaccgccccgggcgcccggccgaacccggcctggctgagcttcgtggtcaccggcaaggcgcgcacccatatccgccatgcgctcaagctgcaacgccgctccgagtcgatcaacctcggcgagcgcctgctgaacaagacccttaccggcttcgacagccacctcgagaagattcctcaggaacgcatccaggccgtgctcgccgagtaccgcatggaagtcttcgaggacctgctggaagagatcggcctgggcaaccgcatggcctacgtggtcgcccgccgcctgctgtccagcgagggcgaggaagcgccaagcgccgagggtccgctggcgatccgcggcaccgaaggcctggtcctgagctacgccaagtgctgcacgccgattcccggcgacccgatcgtcggccacctgtccgccggcaagggcatggtggtgcacctggaaagctgcaagaacatcagcgaagtacgccacaacccggaaaaatgcatccagctcagctgggccaaggatgtcaccggcgaattcaatgtcgaactgcgcgtcgaactggagcaccagcgtggcctgatcgccctgctcgccaccagcgtcaacgcggccgacggcaacatcgagaagatcagcatggacgagcgcgacggtcgcatcagcgtggtccagctggtcgtcagcgtgcacgatcgcgtccacctggcccgcgtcatcaagaagctgcgcgccctcaagggagtgatccggatcacccgcctgcgtag

SEQ ID NO: 7496 - DNA, 405 bp, Pseudomonas aeruginosa
gcggcgacaacgacagcatctggctgcaacaaggcaaccgcggccgcgaattgctgttcagcctcgacgacgacgagctgcaactgttcgaagcggtcaataccgccggcgccaacgagatgcccagctacgtgcccggcaagcgcgtctggctgctggagcgctgaggcctctcagagggcggccagcaccagccagccgcccagcgccagcagcaggacgccgcacagccggtccagcgcacctacccgccgttgcaaccagccgcgccagcgcggcctgtccagcaggcgcaccagcgccatgtcccagcacagcaccgccaggctcatccacgccaggcacagggccagcgcccagcccggcaggctgaagcgcgccagcacgccgaacagccccgcatag

SEQ ID NO: 7497 - DNA, 411 bp, Pseudomonas aeruginosa
tccgtccggaatagacctgggaaagcgccggcgactcctcgtcgatccagccgccatcggtctgcgcgtagaccccggtgctggagacgaacagcaggcgcctgggccgctggccgcgggcctgcaaccagcccagcacatggcgcaggccgtcgacgtaggcggcacggtagccagcctcgtcgtgctgactggcggcggcgctgtacaccaggtagtcgagcggctcgctcggccactgcgcgggacactccggagcctgcagatcgccagccaccggcaggatcccctgcggcaaggcgtccaccgagcgacgcaggccatggacccgccagccatcggccagcagcgcctcgccgaggcgcccgccgacatcgccgcagccggcgatcatcactgtttgcgacatga

SEQ ID NO: 7498 - DNA, 3012 bp, Pseudomonas aeruginosa
gcagccatgaccctcaccgaactgcgctacatcgtcaccctcgcccaggaacaacacttcggccgcgccgccgagcgttgccacgtcagccaaccgaccctctcggtcggcgtgaagaagctcgaggacgagctgggggtgctgatcttcgagcgcagcaagagcgccgtgcgcctgacgccagtgggcgaaggcatcgtcgcccaggcgcagaaggtcctcgaacaggcccagggcatccgcgagctggcccaggccggcaagaaccagttggccgcgccgctgaaggtcggcgccatctacaccatcggtccctacctgttcccgcacctgattccccagctgcaccgggtcgcgccgcagatgccgctgtacatcgaggagaacttcacccatatcctccgcgacaagctgcgtaccggcgaactcgacgcgatcatcatcgccctgccgttccaggaagccgacgtcctgaccaagccgctgttcgacgagcccttctatgtgctgatgccggccgaccatccctggaccgccaaggccagcatcgattccgagctgctcaacgacaagagcctgctcctgctcggcgaaggccactgcttccgcgaccaggtgctggaagcctggcccgaccgtgcgcaagggcgacgagaacaagcacaccacggtggagtcctcgtcgctggagaccatccgccacatggttgcctccggactgggcgtctcggtgctgccgttctccgcggtggacagccaccactacgcgccgggcgtcatcgaagtgcgcccgttcagcgcgccggtgccgttccgtaccgttgccatcgcctggcgcgccagcttcccgcgtccacgcgccatcgaagtgctggccgactcgatccgcctgtgctcggtggcccgtccgcaaacccaggaacaaccgcaaatcgcatgaccgagctgtccagggtcccggttaccgcgctaaagggcgtaggcgccgcgctggcggagaagctcgctcgggtaggcctggaaaccctgcaggatatcctgttccacctgcccctgcgctaccaggaccgtacccgcgtcaccgccatcggcgccctgcggccaggggccgacgcggtggtcgagggcgtggtggccggcgccgacgtggtgatggggcgccgccgcagcctgctggtgcgcctgcaggacggcagcggcaccctgagcctgcgcttctaccatttcagccaggcgcagaaggacggtctcaagcgcggcacccacctgcgctgctacggcgaagtccggccgggtgcctcgggcctggagatctaccatccggaataccgcgcgctgaacggcgacgagccgattccggtggagcagaccctgacgccgatctacccgactaccgagggcctcacccagcagcgcctgcgccagttgagccaacaggccctggccatgctcggccccagcagcctgcccgactggctgccggcggaactggcccgcgactaccaacttggcccgctcgaccaggcgatccgctacctgcaccggccgccgccggatgccgacatcgaggaactggccgaaggccggcactgggcgcagttgcgcctggccttcgaagaactgctgacccaccagttatccctgcagcgcctgcgcgaagccgtgcgctcgcaggcagcgccgcgcttgccggcggccagccgcttgccgaaacgcttccttgccaacctcggcttccagccgaccggcgcgcaacgccgggtcggcgcggagatcgcctacgacctggcccaggacgagccgatgctgcgcctggtgcaaggcgacgtcggtgccggcaagaccgtggtcgccgccctcgccgccctgcaagccatagaggccggctaccaggtggcgctgatggcgccgaccgagatcctcgccgagcagcatttcctcaacttcagcaagtggctccagccgctggacatcgaagtcgcctggctggccggcaagctcaagggcaaggcccgcgcggcggcactggaacgcatcggcgacggcgcgccgatggtggtcggcacccacgcgctgttccaggatgaagtgaaattcaagcgccttgcactggcgatcatcgacgaacagcaccgcttcggcgtgcagcagcgcctggccctgcgccagaagggcgtggacggcaggctctgcccacaccagttgatcatgaccgccacgccgatcccgcggaccctggcgatgagcgcctatgccgacctcgacacctcgatcctcgacgagctgccgcccgggcgtaccccggtgaataccgtgctggtggccgacagccgccgtatcgaggtgatcgagcgagtccgcgcggcttgccgcgaagggcgccaggcctactgggtgtgtaccctgatcgaagagtccgaggagcttacctgccaggccgccgagaccacctacgaagagctttcctcggcgctgggcgaactgcgtgtcggcctgatccacgggcgcatgaagccggcggacaaggccgtggtgatggaggccttcaaggaaggcatgttgcaactgctggtggcgaccacggtgatcgaggtcggcgtcgacgtgcccaacgccagcctgatgatcatcgagaaccccgagcgccttggcctggcccaactgcaccagctacgcggccgggttggccggggcagcgccgccagccactgcgtgctgctctaccacccaccgctgtcgcagatcggccgcgagcggctgggcatcatgcgcgaaaccagcgacggcttcgtcatcgccgagaaggacctggaattgcgcggccccggcgaaatgctcggcacccgccagaccggcctgctgcaattcaaggtcgccgacctgatgcgcgacgcagacctgctgccggcggtccgcgatgccgcccaatccctcctggcgcactggccgcagcatgtcagcccgctgctcgaacggtggttgcgccacggccagcaatacggtcaagtgtga

SEQ ID NO: 7499 - DNA, 927 bp, Pseudomonas aeruginosa
accttgaccgcccggacgacgaccgcgcggaaatcagccaggccgtgcaggccttcaccgcccggcgcatccagcagcgcctggagcagaccatcgagattccaccgctgccgcagacggcgcagaagatcatcaagctgcgggtcgaccccaacgccagcgtcgacgacatcaccggcctggtggaaaccgatccggcgctcgccgcccaggtggtcagttgggcggcctcgccctaatacgccgcgccgggcaagatccgctcgggtggaagacgcgatcgtccgcgtcctcggtttcgatctggtgatcaacctggccctcggcctcgccctgggcaagagcctgagcctgcccaaggaccagccacagcaggccacgccctactggcagcaagcgatttacaccgccgcggtgatcgagggcctgacccgcgccatgccgcgcgagctgcgcccggagtccggcctgagctacctgggcggcctgctgcacaatttcggctacctggtcctggcgcatgtcttcccgccgcatttctcgctgatctgccggcacctggaggtcaacccgcacctcggccatgcctatatcgaacagcacctgctggggatcacccgcgagcagatcggcgcctggctgatgcgcgtctgggacatgcctgacgacctctattgcgccctgcgcttccagcaggaccccagctacaccgggccgaacgcggtctacgccaacctgatctgcctgaccaaccggttgctgcgcaacagcggcatcggcgatggcccgcagcaagcgattccggcggcattgtacgagcgcctggggatcaccccggagaaggccggggacgccgtgaaaaaggtgctggaagcggaagcggccctgcgcgaactggcggcccagttcaatcgcttgccggggtga

SEQ ID NO: 7500 - DNA, 312 bp, Pseudomonas aeruginosa
atgttggcgtgggaggtgcgcagcgagcggtcgacgacgatcccgcggttgaccgccagcccggcggcgaaggccagttcggtgcgcggacgcaggccgacggcggagaccaccaggtcgcagggaatcacctcgccatccgaaagatgcgcttccagcccctcgccggccttcttcaggctggccagcaccggccccaggtggaagcgcacgccgaggccttccaggcctgcctgcacggccttcgccgcggccgggtggagcaggcccggcatgacctgctcgcaaggcgccaccacgtcgagctggtag

SEQ ID NO: 7501 - DNA, 429 bp, Pseudomonas aeruginosa
ttcccaggcggtccagaacccgcgcggcggcggcgttggtgttcggcgacagcgccggctgcacgcaaccttcgagcagcagcacgcgccgtgcatgccggggctgcggccgcctgcccggcgccgcgacccgacgtggcagcttgccctgcatcgcctcaggcagcagaggcctcagccgcccggcagtgccggccagcgcgccgaacaaccccgggcgcggggccagcaggcgcagcccgtcgcgcagcaggcgttgccggaagccgcgcggcaggcgttcggcgaggaggtcgcggccgatatccagcagcttgtggtactcgactccggacgggcaggtggtttcgcagttgcggcagctcaggcagcgatcgaggtgcaggcgggtgcgctcgctggcctcgtcgcgctcgaggaactgcttga

SEQ ID NO: 7502 - DNA, 561 bp, Pseudomonas aeruginosa
gtgcccggtgcaggccgagcagtccaggcggtagcggctggaacggcgcatcgagatggccggcgcggtagcaggtggcgtggccgccatgggcggcggtccacgcacggatgtccgcggccggcgcgtcgctcttcagccagcgcagcgccccgccccagtccagcaactgacgaccgggcaacggcgtctccggcgccagcgccggcagcgacaggcgccagagcggtcgcgggtcgatcgaagaacggcaggcgctgctcgcgcaggtcggcccagaagccgtcctcgagcgcttcgccaccgaggcggtcgcgcgccgagcgtaccgagccctcgccgccctccaggcgcaggcgcagggcttcgccgtcgtggcaggccgcactgatcggcaatggctggcctccccactcggccagcttgcgcaacgccgtcgccaccggcaggtccaggctcaggccggcctggcagcgcggcatgggcagcaccttgaaggacacttcggtgaccaccccgaggcaaccgaagctgcccgccagcaaccgcgacaggtcgtag

SEQ ID NO: 7503 - DNA, 273 bp, Pseudomonas aeruginosa
ccggcgacgttcttcatcacctcgccgccgaagcgcaggtgggtgcccaggccactgatcagccgcgtgccgaggacgaaatcgcgtaccgctcccgcccagggccggcgcggtccggacaggccgctggcgagcaccccgccgaccgtcgcccggccgccgaaacccggcgcctcgcaggcaagcatctgcccgccgcgcgccagcacggcctgtagctcgtccagcggcgtaccggcacgggcggtgatcaccagttcgcagggatcgtag

SEQ ID NO: 7504 - DNA, 753 bp, Pseudomonas aeruginosa
acagcgccagcaggtcgaagccggcgctgtccagggcgctggaccccaggctcaggcgctcgccttccagggtcacgatgtccacctgcaacaggttgtgcacggtcaggccgtacttcaggcaatgcacgccgccggcgttctccgcgacgttgccgccgatggagcaggcgatctgcgaggacgggtccggtgcgtagtacagaccatgaggggcagcggcctgggagatcgccaggttgcgcacgccaggctggacccgggcgaaacgacccagcggatcgatctcgaggatccgccggaaacgcgccatcaccagcagcacgccgttctccagcggcagcgcgccgccggacaggccggtgccggcaccgcgcgccacgaccggcaccttcagccgatggcagagggcgagcaggccctgaacctgttcgatgcgttccggcaatgccaccagcaacggcgtgcagcgatacgccgagagtccgtcgcactcgtagggacgcaggtcttccgcggcgtgcagcagttcgaggtcgggcaggcggaggcgcaactcggccagcaggccatccttgtccacctgcggcagcggaccgtccagacgctcgtcgtagaggatgttcatggcggctgtccttgttgtggttgtcggcgggatcagcaagcgtccacagcctgtaccgcgcggacgccggggtccagcaggcgtctaactggtcctaccagtatcaccaggagccatgggcatga

SEQ ID NO: 7505 - DNA, 969 bp, Pseudomonas aeruginosa
gtaacgacagccaactggtcctaccagtgcaacgggagcttccatgcagaaacagcgggtggccgaccaggtcgcagagcgtatcgagcggctgatcgtcgacggcgtgctcaaggtcggccaggctctgccgtccgagcggcgcctggtggccaagctcggctgctcgcgctcggccctgcgcgagggcctgcgggcgctgcgcgggcgcggcatcatcgacaccgagcatggccgtgggtcgttcgtcgccgacctcgaccgcaacgccgacgtcagcccgctgatgcacctgttcggctcccagccgcgcaccctctacgacctgctcgaagtccgcgccctgctggagggcgaggcggcccgcctggcagcgctacgcggcaccgaggcagacttcgtcctgctcgcccgacgctacgaagagatgctcgccagccacgaggaagcccagccgatcgatccccgcgagcacgcccgccgcgaccacgcgttccaccgggcgatcagcgaggcatcgcacaatccggtgctggtgcataccctgcaatcgctcaacgaactgctgctgagcacggtgttcgcctcagtgaacaacctctatcaccggccgccgcagaaacgccagatcgaccgccagcacgcgcgcctctacgcggccctccgcgagcgccagccggaccaggcgcaacgggcggcgcgcgaacatatccacagcatccgcgacaacctgcgggagatcgagcaggaagaacagcgcctggtccgcgccaccctgcgcctgaacggctggggctgacgcgccaccgcgtcgcagaccggccgccggccgaacgtgctaccctcgccgccttctgccgccgtctcgtagtcccgtcatgcccagcaatgcgctctggcttcgcgccgaccaactgtcaagcgtctcccccgccgtcctcgactggctgttcgacgaggggtcgctga

SEQ ID NO: 7506 - DNA, 606 bp, Pseudomonas aeruginosa
acccgcgctggctgcgcgccctgcagcagatgcagcagcaggccggacgcatgcagaacctgctcaacgacctgctcctgctggccaagctggaggccaccgagtaaccccggcgacaacaagccggtggcggtggacgctctcctcgccagcatccgtaacgacgcccaggccctgtccgccgggcgcaaccaccgcatcagcctggacgccgcacccgctgtgcagctcaagggcagcgaggcggaactgcgcagcgccttctccaacctggtattcaacgcggtgaagtacacccccgacgaaggcgagatccgcatccgctggtgggccgacgaacagggcgcgcacctgtcggtgcaggacaccggtatcggcgtcgaccccaagcacctgccgcgcctgaccgagcgcttctacagggtggactccagccgcgcctccaacaccggcggcaccggcctcggcctggccatcgtcaagcacgtgctgatccgccaccgcgcgcgcctggaaatcagcagcgtgcccggcaagggcagcaccttcacctgccatttcgccccggcgcaggtcgccgaggccgagcgcaaggcgccgaagtga

SEQ ID NO: 7507 - DNA, 657 bp, Pseudomonas aeruginosa
gtacagccgctacccggtctgggacagccacaagggcgagttcatcggcctgctgcacatcaaggacctgctgctggcgctgtccgccctggacagcctgccggagaccttcgacctcgacgaactggtgcgcccgctggagatcgtcaccaagcacaccccactgtcgcgcctgctggagcagttccgcaagggcggcgcgcacttcgccgtggtggaagaggccgatcacaaggtggtcggcttcctgaccatggaggacgtgctggaagtgctggtcggcgacatccaggacgaacaccgcaagaccgagcgcggcatcctcgcctaccagccgggcaagctgctggtgcgcggcgacacaccgctgttcaagctcgagcgcctgctcggcatcgacctcgatcatgtcgaggcggacactctcgccgggctggtctacgacaccctgaagcgggtgccggaggaagaggaagtcctcgacaccgagggcctgcggatcatcgtgaagaagatgcgcggtccgaagatcgtcctggccaaggtggtcaagctcgactgagacgagccggcgccgccacggcgccggcgacttttcaaggctcgcggacgatggcgaagttcggcaggctgtcgaccggctgggcgaagtcgtag

SEQ ID NO: 7508 - DNA, 1617 bp, Pseudomonas aeruginosa
catcaacgagctacggagagcgccggaggcagcggtatcgccgcgcctccggacgcgccgctagccgtagcggccggtgatgtagtcttcggtctgcttcttcgccgggttggtgaacagcgtatcggtgtcgccgaactcgatcagcttgcccatgtacatgaacgccgtatagtcggaaacccgcgcggcctgctgcatgttgtgggtaacgatgacgatggtgaacttcgacttcaactcgtagatcagctcttcgatcttcagcgtggagatcgggtccagcgccgagcacggctcgtcgagcagcagcacttccggttccaccgcgatggtccgggcgatcaccaggcgctgctgctggccgccggacaggccgagggcggactcgtgcaggcgatccttcacctcctcccacagcgcagcccccttcagcgcccactcgacggcctcgtcaagtacgcgcttcttgttgatgccctggatacgcaggccgtagaccacgttctcgtagatgctcttggggaacgggttgggcttctggaacaccatgccgacgcgacggcgcagctcggcgacgtcgacgcccttggcgaagatgttgtggccatcgaggcgaatctcgccttcgacgcggcagccatccaccaggtcgttcatccggttgaagcagcgcagcaaggtcgacttgccgcagccggacgggccgatgaaggcggtcacgcgctgcttcggaatgttcatccggacgtcgaaaagggcctgcttggcgccgtagaacaggttcagcccgggcacttccagttcgacactttcggaagccaggtcgaggctctggcggtcgcggccgagcgcatcgaagttgatgccgtggctggcggtctcgttttgcatgggaagctccctcaatcagttttccagggccttgtacttctcgcgcaggcgattgcggatcgcgatggcggagaagttcagcagggcgatcaccacgaccagcagcaacgccgtagcgtataccagcggccgtgcggcctcgacgttggggctctggaaaccgacgtcgtagatatggaaaccgaggtgcatgatcttctggtcgagatgcacgtacggatagttaccgtcgaccggcagcgacggtgccagtttcaccacgccgaccagcatcagcggcgccacttcgccggcggcacgggccacggcgaggatcaggccggtcatcatcgccgggctggccatcggcaggacgatcttccacagcgtttccgccttggtcgcgccgagcgccagggagccttcgcggaccgcgcgcggaatccgcgccaggccttcctcggtggcgacgatcaccaccggcacggcgaggatcgccagggtcagcgaggcccagaacagccccgggggtaccgaaggtcggcgccggcagggcctcggggaagaacagccggtcgatggaaccgcccagcacgtagacgaagaaacccaggccgaacacgccgtagacgatcgccggtacgccggcgaggttgttcacggcgatgcggatcacccgggtcagcggcccctgcttggcgtactcgcgcaggtagaccgcagcgatcacgccgaacggggtga

SEQ ID NO: 7509 - DNA, 312 bp, Pseudomonas aeruginosa; identical to SEQ ID NO: 4717

SEQ ID NO: 7510 - DNA, 192 bp, Pseudomonas aeruginosa
atccttcaccctagccggcgcaccttctcccgaagttacggtgccattttgcctagttccttcacccgagttctctcaagcgccttggtattctctacccgaccacctgtgtcggtttggggtacggttcctggttacctgaagcttagaagcttttcttggaagcatggcatcaaccacttcgtcatctaa

SEQ ID NO: 7511 - DNA, 246 bp, Pseudomonas aeruginosa
atcaagcaattcgtgtgggagcttatgaagaagctgagatcttcgattaaggaggtgatccagccgcaggttcccctacggctaccttgttacgacttcaccccagtcatgaatcactccgtggtaaccgccccccttgcggttagactagctacttctggagcaacccactcccatggtgtgacgggcggtgtgtacaaggcccgggaacgtattcaccgtgacattctgattcacgattactag

SEQ ID NO: 7512 - DNA, 1554 bp, Pseudomonas aeruginosa
gggtcgacgaaggcaagggcgaactccgtcgcctcggcgaggaagaacgccaggagcgaatcgccaaggccgaaaaggcgatccaggagaattgccgctgaggcgaacacagccccgtcccgcagcatggggctgacccggctctccgccttgcttgaagcaaagaaaaacccggcctgtagccgggtttttctttactgccgaagcttcatgacggcccgccgatcagccggtcgaactcgccaagcgccgccagcaggccggcgacttcctcgccacgctgcgcataggccacctcggctatggccaggatacccgaggcttgcggcaaggcgctgtcgctttcgagaatcagcttcatccgtggcaggaagatccattgcagccattgctcgagcgccagcgtatccacgcagaacggctcggggctggccagcgcttccggggcggggctgctttcgctccaccagccgagggcacgcaactcacgctcgatcagcaacaactggtcggccagcgcatagacccgtcgatccatcaggagctgaccttggccttctgccgggccagcgcagcgccggcggagtctccctgcttctcccgagcctgggcgatcagttcccagagcccggcctgcaaggccggccggccattggcgtagctcaagccacggcgcgcgacctgctcggcctgggccgcatcgccctgggccaggcgcacctgggccaggcgatagagcacctgcggctcgcgcggagcgatgcgctgggctcgctcgaggctggcggcggcgctgttcaggtcgccgctgccctgctgttgctgggcggttgtgagcatcgccaggaccggcccgtccaactgctcgtcggccgccaggctgccggccgagccggaggccggaatgccggtgggcgcggaacgactggcgccgctgggcggcatgttgtagctgccacccagcggtggcgtggaggcgctgctgggcggagcctggtactgggtgccggtgccgagcggagcgctgctgatcggcgcggcgccggactgcgccgggaaagtctggatcggtgcggaattggcgccctgcggcaccatcaccaccacaccggagtcgccgccctggggaatgccctgggtggcggcgccttgctgggtacgcggtacctgggtacgggtgatgcggaaaccgccgctttcctggttggacaccggagtaccggaatccaccaccgggatcgccccgtgctgcgggctggcgcagcccgcgagcacggcactgccggcaagcgcggcgaatacgaaaatcttcttcacgtcaggtcctctcggatcaattcagccagccacgtacccagtccatcacctcgccggcggggttctggctcccgcagcctgggccctgggcgggctcgctgccacgaatatagggcatctgtacggcattcgggcaatccgccgccgagccctgcccggtctgcgcgtccacccaggccatcaccacgttctccggcatcggcatttccagcgattgcggatgcgccttgcgcatga

SEQ ID NO: 7513 - DNA, 1692 bp, Pseudomonas aeruginosa
gcgcggcggcagcgcggcgcattcgaccggcgatccggcaaatggttgctatccgccagcgaggtttgcactgtcaccccttcccgccataatgcgggttttcgcatatttcagaggcaaggatatcccgtgagccagaccctgatcgccgccctgcagaacccggccctctacccccacccggtggagcgcttcgaggtcatcgagacgcacatctcctgggtcctgttgaccggtccctacgcctacaagatcaagaagccgatggatttcggctttctcgatttcaccagcctggacaagcgccgcttctattgcaacgaagagctgcgcctgaaccagcgcctcaccgacgatctctacctggaggtcctaccgatcaccggcagcgaagaggcgccgcggatcggcggcgacggcgaggcaatcgaatacctgctgaagatgcgccagttcccgcaggacaacctgctggcggcaatccagggccgcggcgaactgtccaaccagcatatcgacgaactggccgagcagatcgcgcacttccaccagaacactccgaaggtgccgctggagcacccgctgggcaccgccgagtcctgcatggcgccggtgcggcagaatttcgagcaggttcgcccgctgctcaaggacaaggccgacctgcaacagctggatgccctcgaagcctgggcggaaagcagcttcgaacgcctgctgccggtgctccaggagcgcaaggcgaagggcttcatccgcgaatgccacggcgacatccacctgggcaacgccgcgctgatcgacggcagggtagtgctgttcgactgcatcgaattcaacgaaccgttccgcttcaccgatgtctgcgccgacttcgccttcctcgcgatggacctggaagatcgcggcctgaagtgccacgctcgacgcttcgtcagcctctatctggaacacaccggcgactaccaggccctggaactgctgaacttctacaaggcctaccgcgccatggtccgcgccaaggtcgcgctgttcagcctcggctaccagaccgatgccgtgcagcgcgccgcgaccctgcgccagtaccgcaactacgccaacctggcggaaagctacagcgccattccctcgcgcttcctggcggtcacccatggtgtctccgcggtcggcaagagccaggtggccatgcgtctggtggaggctctgggcgccgtgcgcctgcgctcggatgtcgaacgcaagcgtctgttcggcgagcagccggaacacgacaggggccagttcgccgccggcatctatagcagccaggccagcgaagcgacctatgcgcaccttcaccagttggccgcgaagatcctccaggctggctatccggtggtgatcgatgccgcctacctgaagcagagtcagcgccaggccgcttgccacatcgcggaagaaaccggcgtgccgttcctgatcctcgactgccaggcgcccgaagcggtgatcgccggctggcttgcgcaacgccaggcggaaggcaaggacccgtccgacgcgactctcgacgtgatccgcacccagcaggctacccgcgagccgctgacagcggcggagacggtccagagcaagcgcgtagacacccacgacgcggccagcctcgacgggctggtcgacggcattcgccagcgcctgcccggtctctga

SEQ ID NO: 7514 - DNA, 621 bp, Pseudomonas aeruginosa
tctgcccggcgatcacgaaggcgtggaacaacaactgcagggaaaagccgagcaaggcgccgaccaggatctgctcgccgatcagcagcatggccttcatgctcagcgcgtccacctgcggcatcggcggcaggttcggcaccagcaccacgcagacgcccagcgccaggtacagtcgcacccgcaccggcaccagctgggtgccaatcaccggcatggtcatcagcagcgccgcgacccggaacagcggcagcacgaagctggcgatccagccgccgatctgcgcgttggtcagctccagcatcagccgatcagcagcgggatgttgccgatcagcgtctgggtgtattccatcagctgccgcagcagccaggggcccagcacgatcagggtgagcaggatcaccatcaggcgcggcaggaagctcagggtctgttcgttgatctgggtagcggcctggaacatcgccaccacgagaccgaccagcaggctcggaaccaccagcacgccgacgatcatcgccgtcagccacaacgcctcgcggaacaggtcgagtgccacctcaggggtcatgtctctctccagcgcgccagcggcgcgtcaagccggcggcaccgctag

SEQ ID NO: 7515 - DNA, 1155 bp, Pseudomonas aeruginosa
tccggccgggcgtcaggccgagcaggatctgctcctcaccgacctgcaccagcaccagccggtcgcgcggacccagcggctggctggcaagggtgcggatcaagcggttgccgcgcggaccggcctgttgcacccggcgcaccagccaggcgagcaggaagatcaggccgatcaccaggcccaggccgagcaccagttgggccagttgcgcggcggcgccggaagcggcgcccaccgtcggcgcggcggcacccgtcgtcccctcggcggcgcacagcggcgcgctcagcgaggcgagtgccggcaggaagccggcgaacaggtagcgacgcatgtcagcgcagcttcttgatgcgttcgctgggactgatcacgtcggtcaggcggatgccgaacttctcgttcactaccaccacctcgccgtgggcgatcagggtgccgttgaccagtacgtccagcggctcgccggccaggcgatcgagttcgatcaccgacccctggttgagctgcagcaggttgcggatgctgatgtcggtatgcccgacctccatggaaatggtcaccgggatgtccaggatcacatccaggttgggcccctccaggccggaaatggtcggtgccttcggcgaagcgccgaactcttccatcggcgcccgcggggtactcgactccgccacgggagtcgcgccgccctgggccatcagcgcatcgatgtcgtcctggctggcgtcgcccgcctcggccagcgccgccgcccactcgtcggccagtgcctgttcctcggtggtcactttttcttcgtctgccatggttcgtctttcctccgggggaagcggtcagcgcgagcgctcgaccgcttcgagaatctgtagcgccaggttgcccttgtgggcgcccagcttgaccttgaaggcgggcacgccgttggcgcgcatcaccatgtgttccggcatctccaccgggatcacgtcgcccggctgcatgtgcaggatgtcgcgcagcttgagctggcggcggaccacggtggcgccgagcggtacctggacgtccagcacgtcctcgcgcagggccttgatccagcgctcgtcctggtcgtcgtggtcggactggaaaccggcgtcgagcatctcgcggatcggctcgatcatcgaatag

SEQ ID NO: 7516 - DNA, 1686 bp, Pseudomonas aeruginosa
cgtcaaatgaagggtttcacaggggcagagcaagggttgtgccatttctgcaacgccgccccgcctcctgggaccagccccggagggctgtccgagatgatagacggcgcggatattacagcctggccacaggaaatcatccccgtcttttgcgaaattgcccgctccggaaaaagaaaggcctcccgcaggaggcccaaaggggaaatgcagtcgttcgcctcaggcgtagtagtcgaccagaccgcgcgccgccgacgcacccggccggctgcggatctcgctgactccggcgagggtttcctcatcgcccgaggcctcgccggccaagccgcgtccgcgcgccgatccgccctcgccctgctgctggccctgccagccccgcgccagcgactggtcggagacgttcacgtcgagctggttcatgccctgctggctgaacatgtcgcgcagccggtgcatctggctttccagggcgtcgcgaacgccggcgttgggactggcgaaggtcacctgggtctggtcggcggtcatgtggatgcgcacgtccaggcgtcccagctcggccgggtcgagctggatctccgccgacttcaggttctggctggacatccacatcacccggtccaccaccgcctcgctccagccgttctgctgtatcgccaccggctggccgggcaccgtaccgttcaccggacggttggtcagggcctgctgcgccatggcctgggtcagcccgttgagcttggccgcgaaaggctcgccgcgcggctccgccttgctctccagcaggctctcggaggcggcgctggcgatggccggctcggcggtctgctgcaactgggcctcgagcgccttgccgtcgacggccttgggcaaggagtcggaagtcaggctggcaagggcatcgccgaggttcgcctggcgcggatcggcgctcttcgccggcccgcctttcgccgcctgcgcggcgtcctgggcaccctgctccaaggccatgttcaccgccggaacgccgttgagcttgaccagggtcgggtcgctgctggcttcggtcaggctggccggagcactgctagccgtcggcacggccggcggcagcaaagtcgcctgggtattctcgtcgagcatcggcacggcgccgccgaggccgagcagttgcagcggatcgaccggcgtttcgactttatcttcgccgtcggccttggcctggccgtcggccggcaaaggcttgccgtcttcggcaacggccggttgcccggcggcatccgtcggctgcgcctcggcagcctccttgccggcgtcccgcggcttgtcccgcgaacccttggagggaccgtcggcgcgctcggcgggcttcttcgcggtctccttggcatacatgtcggagaagctggaagtcttgtcgttactaggctcaggcgttttctgctggctcttcggcgcagcggccttgggctttacatcaggcgtcggcggcaacaacacaccaggggcgacggccatgggaattctccatttgcgaagggattgcatcgtggcttgcgcaagggatggagcaaggtccgggccaacttcgccgagagcgtccgtgaaacgctcgccagggcgccgcagcaggcacgctcgctttgcccgcaggtcccgtctggactacaatccagagccgcatccctcccgaggtag

SEQ ID NO: 7517 - DNA, 819 bp, Pseudomonas aeruginosa
ggagcgccaggagatcgagacttccctcgagcagctcaaggcgcacatcacccgcgtgctggccagcgacgaagacctcgagctgccctgcgacctcgacctcggcgacgagccggacgactccgacctgcgcggctggtgcatcggcttcatggaaggcgtgttccttcgcgaggaagtctggttcgagcaggccgaggaggaagtcagcgagctgctgctgcctatcatggtcggctccggcctgttcgacgagcagcccgagttcgacgagatcgcccgcgaccgccacctggtggacgacatggtcgcgcagattcccgacctgctgaccaacctgttcctgctctgccaggcgccggaagaaaagcccgccctgctcaagccgcgcacgcactaaggagcgccgcggtggcgcagcgggaaattcgcccgagcgctcgtgcctgggtgcgctatagcctccaggccgtgggtttcctaagcgtagccctgggcgtgatcggcatcttcctgccggtgctgccgaccacgcctttcctgctcctcgcggcggcctgcttcatgcgcagctcgccgcgcttctaccactggctggtcggccatccacggctcggcccgtggatccgcgactatctcgacggcgaaggcatcccgctcaagggcaaggtctacgccatcggcctgatgtgggccagcatcgccctttcctgctacctggtccgacgcccctgggcccagggcttcatgctgaccagcgcggtactggtcagcatctatatcctccgccagaagacccgcccgccgcacgacgcctga

SEQ ID NO: 7518 - DNA, 402 bp, Pseudomonas aeruginosa
aagcgttcgaacaggtgcctgcggtgctcgtcggcgatcggcacgccggggttgctcaccgccacccgcacttcgtcgccgcgccgctcgacgccgacccgcagcgtgccgccggcggcggtgtgctgggcggcgttgtacagcaggttggtcaccgcccgctggaacagggcgcgctcgaccagcgcgcgggcctcgccgcgcacctcgataccgaccccggcctcgtcgaagatcacctcgaggaaatccaccgtggtggcgatctcgccggccagcgaggtttcctcgcgctcgcaggccaggcgtccctggtcggcgcgggcgaggaacagcatgtcgttgacgatcgcccgcagccgctccagctcctccaggttggattgcaggacctcttcgtaa

SEQ ID NO: 7519 - DNA, 975 bp, Pseudomonas aeruginosa
agcatggtgccgatgagggcgaagatcaccaccgcggcgccggcgaacattcccgccaggcgggtcgacaaggacatgcccacctcagcccgactccgccagcgcacggttctccaggacgtagcccatgccccggatggtatgcagcagcttgttctcgaacggaccgtcgagcttggcgcgcaggcgcttgatcgccacctccacgacattggtgtcggtatcgaagttgatgtcccagaccagttcggcgatcgccgtcttcgacaggatctcgccgctgcgctgggccagcacgcagagcagcgcgtactccttggcagtcagctccagacgggtgttgccacggaagaccttgcggctgagcaggtcgatggacaggtcggcgatgcgcatctgcgaatggctttcatggttgccgccgcgccgggtcagggcctgcaggcgggcgaccagttcgaggaaggagaacggcttgatcaggtagtcgtcggcgccctcgcgcagcccgcgcacccggtcttccacgcgctcgcgcgcggtgagcatgatcaccggggtctgccgccgctcgcgcaacgcccgcagaacgccgtagccgtcgacgcccggcagcatcacgtcgagcacgatcacgtcgtactcgccatggagcgccaggtggcgaccgtcgatgccgttgtccgccaggtccacggtgaacccctgttcgctgaggccacggttcaggtagtccgccgtcttcgcctcgtcctcgacaatcagtacccgcatctatcgcccgatcctctgttcgccttcgcatcccgggcgggacgcatgcctgcctgcatcctagccacgcgccgccgtccaggaaagccgcgtccgttacgcctcatgtcgccgtcgccccagcggttccgccgtccgaggtcgtggtcccgcgccggtggaacagccgctccagggccaggtataccaccggcgtgctga

SEQ ID NO: 7520 - DNA, 1386 bp, Pseudomonas aeruginosa
tctggatggtcgggaagtccgcctccggcaacggcgccacaccgagccggaggaacgccagcagccccagcagcagcgaggccagggtcagcagcgcggtggcgatcgggtgccgtatgcaccagccggaaatcccggcgcgcggcgtcacggctgccgctccgccgcctgagccaggctcgggcgcggctcctggatatcgaccagggcgccgggcatcagccgcgagtggccgtccaccaccacctggtcaccgctggccaggccttccaccacactgaggccgtcgatgtcctggagcacccgcactggcaccgcctcgacccggtcggcggcgacccggtagacgaaattgccctccaggccgcggcgcaccgctttgctcgacagcaccaactggtcgcgccggaccccggtgtgcaggctcaccgcgacgaactgcccgggccagagccgggcctggcggttatcgaaggaggcgcgcacgcggatggtaccggtggaactgtcgatctggttgtcgatggtcagcaaccggccctcgcccagcgcgctcccgccgtcgcggctgtaggcgcgcaccgccgcctcgccgccgagcagcgcctgcaactggggcaactgttcctgttgcagggagaagactacggagatcggtgcgatctgggtcacgctgaacaggccgagactgtcgccgacccgcaccaggttgccgacatcgacgttgcggataccgaccttgccggataccggcgaggtgatccgggtgtaggacaggcgcacccgctcggcgttgatggtggcatcgttggccttcagggtcgcgcgcaactggtcgaccgtcgcctgctgctggtccagcagttggcgcgacaccgcacgctcggcatacaggctgcggtagcgttgcaggtcctgctcggcggatttcagctgggcctggttgctcgccctggaggcctgagcctgctccagcgcggcgacgacggcgcggtcatcgatggtcgccagcaactcgcccgcctcgaccatctgcccttcgctcaccagcaggcgggtcaactggccgtcgatctgggtgcggatcaccacgttgtgcaacgaagtcaccgtgccgatgccgctgacctgttgctcgacgtcgcgccgctccacccgcgccacgttcaccgggaccctggccggcgcgggcgccgccttcgccccggcgtcgccgccgagccatgcccaaccgccgaaggcgaccaggcccgccgccagcacgcccaccaggacccgtcccccaccactgcgcaacgcctgcatctgtccacctttcccagtggccggcctcgcgcggccgacttcgttcttctttataagcagcgcagcgggaccccaccctga

SEQ ID NO: 7521 - DNA, 744 bp, Pseudomonas aeruginosa
acttcgctgagtccttccggagcccgctcgatgtccccaacccccggcgcccgccggccctgccccagggcctacgccccctggctgctgtcgctggcggcgacattgctgctggcagtcggcgcggcgctggcgcagtgggacctggagtcgatactgagccgtgccgagcagcgctacggcgagctgggcgcggcgaaatcacgcctgggcgactggggccgcctgctcgaacagggcggcacgctcgacgaagcggccaagctgcgcgcggtcaacgacttcttcaaccggtcgctgcgtttcaccgacgacatcgagatctggcaacaggaagactattgggcgactccggtcgaggcgctggtcaagggcgccgccgactgcgaggactacgccatcgccaagtacgtgaccctgcgtcgcctcggcgtcgccagcgacaagctgcgcatcacctacgtcaaggccctgcgcctgaaccaggcgcacatggtgctgacctggtacgccagcccgggcgccgacccactggtgctggacaacctgatcggcgagatccgccccgcttcgcaacgtgacgacctgttgccggtgtacgccttcaatgccgagggcctctggctgcccggcgccgacggcggacgccggaccggcgacagcaagaagctgtcgcgctggcaggacctgctgaccaagatgcgcgccgaaggcctcgacctcgacgcacccaaggaggattga

SEQ ID NO: 7522 - DNA, 1953 bp, Pseudomonas aeruginosa
atgtcactgctcaagcaattgttcctcgccatctgcctgttcctcgtcgtcgccttcagcggcagcttcgtcagcagcgtggagaactcccgcgagcagttgcgcggccagttgcgctcccacgcccaggacgccgccaccgccctcggcctgtccctgacgccacacgtggacgacccggcgatggtgcaactgatggtcagctcgatcttcgacagcggctacttcgccagcatccgggtgatcgacatcaagagcggcaagccgctggtcgagcgcgtgcaggcgcatgccgagcgtacggtgcccggctggttcgaacgcctggtggatctccagccccagggtggcgacgcgctgatcatgcgcggctgggaacaggcggcgcgggtcgaggtggtcagccatccgcaattcgccctggcgcgcctgtgggacagcgccctgggcagcctctactggttgctggcctgcggcgcggcgagcctgctgcttggcggctggctgctgcgccgccaactgcgcccgctcgaccagatggtgcgccaggcccatgccatcagccggcgggaattcctcagcctgcccaggctgccgcgcacgccggagctgcgccgcgtggtgcaggcgatgaaccagatggtggagaaacttcgcacgctgttcgccgaggaggctgcgcgtagcgacaagctacgcgcccaggcctaccaggacagtctcaccggcctgcccaaccggcgcctgttcgacgcccgcctcaacgaacagctgggtgccggcgagcacgagcatgccgggcagctcctgctggtgcgcctgaacgacctgaacgggctgaaccagcgtctcggcgggcaacgcacggatgaattgatccaggcggtcgcccgcttgctggtcgactcctgcggccagcaagggcgcgccgactggctgctggcccgcagccgcggcggcgagttcgccgtgctggctcccggttgctcccgcgagcaggccgaacgcctggccgaggaactctgcgaaggcctggagaaccttgcccgcaccggtgccagcgatctcacgccggtcgcctatctcggtatcagcgcgttcgccgaaggcgactcgcccgcggatctcctggcccgtgccgaccaggccctggcccaggccgaaagccagcccgcccagccctgggcgagccaggacggcaccgcgctcgcggcgctcaacgatagccaggactggcacgactggatcgaccaggccctgacggagcgccgcctgctgctctatttccagccggtggtggactgcctggacacccagcgcgtcctccaccacaaggtcctcgcgcgtctgctcgacccgcaggccacggccatcgccgccgggcgcttcctgccctggatagaacgtttcggctgggccgcgcgcctggacctggcgatgctcgaacagagcctggagcacctgcggcgccatccacggccgctggcgctgagcctgtcggccgccagtgtccgcaatgcgcagacgtttgccccgctactggccctgctcaaggcgcatccgcaggaggcgcgccagctgaccctggaactggacgagcggcacctgccagccgcggccgaactggaacgcctcagccaggtcctgcgcgaactgggctgcggtctcggcctgcagcatttcggcggccgcttcagcctgatcggcaaccttacccatctggggttggcctacctcaagctggacggctgctacctgcacgccgtcgaccgggaaggcgacaagcggttgttcatcgaagcggtctatcgcaccacccacagcatcgatctaccgttgatcgcggaacaggtggaaaccctcggtgaactcgaagtactgcgggaaatgggtttgcgtggcgccatgggacgcctgttcggcagcccggcgccctggtccggggatgcctga

SEQ ID NO: 7523 - DNA, 453 bp, Pseudomonas aeruginosa
agctggcgatctgtcgcagcagcggagtggccagggtgcggacttcgcgcaacagcgtaccgatccggcccagttcggtatccccggcggtggcgaccaccactccgcgcgcctggccgctggtcaccagggtgccggaataggccatgcaacggcggtcgccgagcagcgcgtcgatggccaccgcgacgcagcccttctccaccggcaccgactcaccggtcagggccgactcgtcgacatggaagttcttcgtttcgaacagccgcaggtcggccggcacccggtcgccggaggccagcagcaccacgtcgcccggtaccaggcgttcggcgtccagcgcctggcgctggccgtcgcgcaggaccagggcatgcagcgaaagcatgtcgcggatggcgtccagcgcgttggccgccttgccctcctggacgaaaccgatcagcgcgttga

SEQ ID NO: 7524 - DNA, 2733 bp, Pseudomonas aeruginosa
cagctgcgccggccggtcggcgtagagcaccagggccagggccgccttcaggcgttcgccgccgctcagcgtcgcgcacggctgggcgagccgttcagccggcaagccgagttgcgccaggcgcgtgcgcagccagctttcgccgcgactgcgattgacctccagcaactgctccagcacgcctcgcccgtggtccagcacgctcagccgctggtcgagataggcggcgcccaccgtcaccgcgcaggttcccgccagcggcgcccgttgcccggccagcagccgcagcagggtcgacttgccgctgccgttcgggccgaccagcgccagccgtcgcggaccgctcaggagcaggtcgatttcgcgcaacggcccgcgcaaatgcggcaggaccgcgcccttcaactcgacgatccggcgctgtgccgccagttcggcatcgggcgaatcgagcagcagcggcgacgcctcctcgacctcccgggcagcctcgcgcacctcgcggtcgagacgctcgcgctccgcctggtgggcgttgcgcatcttgccggcgctgacctcgctacgttccctgaacccaccgagcaggatcttcgcctggttcgccgtcttgccttcgcgccggccgctggcctggcaccgctcctggcgctgctgctgttcgcgcatggccagggtctgccgcttgcgctccagacgacgctggtccaggcgacgttcggcggcctcgcgcgcctcctcccggctctgcgcgtagaaggaatagccgccgccatagctgcgcaggccgagggtcgacagctcgacgatccgctgcatgccctccagcagttcgcggtcatggctgaccagcagcaggccgccgtcccatgccgccaggcgcgcccgcagcaaagcgcgtgccggcccgtcgagagggttgctcggttcgtcgaggatgagaaagtcggcgtcgtcgaggaatgcgccgagcagcgctacgcgcatgcattcgccgccgctcaggcgttcgctcggggtatccgcgcggagatggccgagcccctcggcggccagggcgtcggccaggcgttggcggatgtcccagcgctcgcccaggcattcgtagtcggcggcgtcgaggctacccgcctcgatccgcgccagcgcctccagccatgggcggacgccggccagatcggcgacggtcgggtagtcggccggttcgagctgctgcgccaggtagcgcacgcgcccctggcgccggacgctgccgctggacggctgcaagtgtccggcgagcaggcgcgcgagcagcgacttgccaacgccgttgcgtcccaccagcccggtgtgccgggtgtcgaacgtttcgtcgagatcggaaaacagaaggctgccgtccggcagctggaaagagacgccatcgagcgtcagggtcgacgtattcgtcatggatacccccttgatgccatgcattcccccgggccctcgggccagggacggaaaaccggccgtgcagacacggcagcatcaattgcgcatcggacgaacacctcgtacggaaggaaagaccgcggcagtctactccgcccatgcggccctgccaatcgggcatacttttcgtttccgacagacacgaccgaccgacatggccagaccgcgcatctccgaactcttcgaacaggaaccctcgcgctggggcggccgtggcgacccctacctctggcaggaaatggccgggcaactggcggacgcgtcctggccggcttccgcagcggccctggaacacctgctcggcgagaccttcgagcgcctcagcggccattcgctggaatacgatgccttgatctacctcgcgcgccacgcccacggcggcatgtccagcggcatggtcagcccggagttctggcgcgaaacggcaatcccggaactgctcgaccgctatcggcggcggcgctcctggctgagatggttgcgccgataggtgtcctcgcccatcgccgcgatctgcccctcgatcagggcatcgaagggtttcaacaaggcttcgtgggtacgcggcgcctccagttcgtcgagcgccgcagcgattgcttcgatggtcgacagcgcgccctctcccggcgccttgcgcaggcgataacgcgacgccatgccttcggccaggctcacccgcggcagggccgccagggccgggttcaggtgcaggagcttgcgcgccttgcgccaggtgccgtccggcaccaccagcaggaggggctcgccggcggcctcggcggccatctctgccagcgcacgcgcctgctcgccgggaaacagcaggcaggcccggtagcccggtacccgccaggtctcctcggcgaaacgctcgccaacccgcagctccgcattgcacaagccgaggacggccaatcctgcggtattcaacgcgtgcccgacctcgctggggtgctgcaggaccagcacccgcgtacgcgacggcaaggagggaatcagcgcgcagaggcaatggctggcggggcgagcgcaacgctcgcagcggatacgtggcatgggacgactcctggaaggggcccagtgtgccacaggcggagggggcttcctctcactcgcaaaaacgtcatatttccgacgaatggcggtaatttgtttcacccattaagaataacgacgaatttttgtcgttcgatgaaaaaatacaatcgtcccaccctctcaactcccgcccatcggcgccgaagacagggatga

SEQ ID NO: 7525 - DNA, 885 bp, Pseudomonas aeruginosa
aatgccccgcttcggcggcatcgccaccatgatgcgcctgccccatgtccagtcccccgccgaactcgacgccctcgatgccgccttcgtcggcgtgcccctcgacatcggcacctccctgcgctccggtacccgcttcggcccccgcgagatccgcgccgagtcggtgatgatccgtccctacaacatggccaccggcgccgcccccttcgactcgctgaacgtggcggacatcggcgacgtcgcgatcaacaccttcaacctgctggaagccgtgcgcatcatcgagcaggaatacgaccgcatcctcggtcacggcatcctcccgctgaccctcggcggcgaccacaccatcaccctgccgatcctccgcgcgatcaagaagaagcacggcaaggtcggcctggtccacgtcgacgcccacgccgacgtcaacgaccacatgttcggcgagaagatcgcccacggcaccaccttccgccgcgcggtggaagaagacctgctggattgcgaccgtgttgtgcagatcggcctgcgcgcccagggctacaccgccgaggacttcaactggagccgcaagcagggcttccgcgtggtgcaggccgaggagtgctggcacaagtcgctggagccgctgatggccgaggtccgcgagaaggtcggcggcggccccgtctacctgagcttcgacatcgacggcatcgacccggcctgggcgcccggcaccggcaccccggaaatcggcggcctgaccaccatccaggcgatggaaatcatccgcggctgccagggcctggacctgatcggctgcgacctggtcgaagtctcgccgccctacgacaccaccggcaacacttcgttgctgggcgccaacctgctctatga

SEQ ID NO: 7526 - DNA, 471 bp, Pseudomonas aeruginosa
aatgctctgcgtcctcccgggcgtggtgcgtcgctgagccgtagcgcgaccatgaccgacgaccgcgtcgaacaggtgctggaggccgcccgccgactggtggcggccttcgcccgcaacgatgccgaggcctatttcgccgccttcagcgaggacgccagcttcatcttccacaactggcctcagccgctgcgctcgcgcgcggcctaccgcaagttgtgggagcgctggcgacgcgaggacggcttcgaagtgctggcgtgcgaatccagcaatacctgcgtcagcctgcaaggcgacctggcgatcttcagccacgatgtcgccacccggctgcgcctccagggaacggaaagcctgaaccgggaacgggaaaccatcctgttccgcctagaacaacaagaaggccgttggctggcctgccatgagcacttgtcggcgatgccggagtacctgccatcgactagctag

SEQ ID NO: 7527 - DNA, 1530 bp, Pseudomonas aeruginosa
ctctcccgggagaacgtcatggataacaacaataaccaacacgcaatcacacgcatcgaaaccttcggggtcgaacagattcccgaccacgaacgcaacgccacgccggtcgatctgttccgcatgatcttcggcggcgccaataccttcgccaccgccgtgctcggcagctttccggtgctcttcgggctgtccttccaggccgggctgtgggcgatcctgctgggcgtcacgctgggcgcgctgatcctcgccccgatgggcctgttcggcccgctcaacggcaccaacaacgcggtctcctccggcgcgcacttcggcgtgcacgggcgcatcgtcggctccttcctctcgctgctgaccgccatcgccttcttctcgctctcggtgtggagttccggcgatgccctggtcggcggcgcccggcgcctggtcggcctggaagagagcgaactgaacctgggcctggcctacggcctgttcgccgtgctggtgctgaccgtatgcatctacggcttccgcttcatgctgctggtcaacaggatcgccgtgtgggccgccagcctgctgttcctgctcggcctgttcgccttcgccggccccttcgacgccgcctacgccggcagcgtgcaactcggccagccgggcttctgggccgccttcatcggcgccaccctgctggccatgagcaacccgatctccttcggcgccttcctgggcgactgggcccgctacatcccgcgccagacctcgcaggcacggatcatgctggcggtgatcggcgcgcagctggcgaccctggttcccttcctgttcggcctcgccaccgcgaccatcgtcgccgtccgcgcgccggactacatcgctgccaacaactacgtcggcggcctgctggccatcgctcccggctggttcttcctgccggtatgcctgatcgcggtgatcggcggcatgtccaccggcaccacttcgctgtacggcaccgggctggacatgtccagcgtgttcccgcgcctgctctcgcgggtgcaggccacggtgctgatcggggtcgcctcgatcggcttcatcttcgtcggccgcttcgccttcaacctggtgcagagcgtctctaccttcgccgtgctgatcgtcacctgcaccaccccgtggatggtgatcatgctgatcggcctgctgacccgtcgcggcttctaccgcccggacgacctgcaggtgttcacccgcggccagcgcggcggcgcctactggttcgagcacggctggaactggcgcggaatgggtgcctggattcccagcgcggcagccggcctggccttcgtcaacctgccggggcaattcgtcggtccgctcggcgaactggccggcggcatcgacctcagcctgccggtcgccctcggcctggccgccctgctctacctggcactgctgcgcctgttcccggaaccgccttgcgtctatggcccgcgaggaccgcgctgggtgcgcgcgcacggcacgcggagggcaccggcgatagccaccgcctga

SEQ ID NO: 7528 - DNA, 1485 bp, Pseudomonas aeruginosa
  unsure (696): Identity of nucleotide at the above locations are unknown.
ggtgggggacacacacggcgggacgccagcgtcccgcgcttccggcgcctcgccggatacaacaatgacaatgagaaacttgggagacctgatatggccctcgacatattcgtcgttctgatctacgccgcgggcatgatcgcgctgggctggtacggcatgcgccgcgccaagacccgcgacgactacctggtggccggccgcaacctcggccccggcttctacctgggaaccatggccgccaccgtcctcggcggcgcctccaccatcggcaccgtgcgcctgggctacgtccatggcatctccggcttctggctgtgcggcgcgatcggcctcggcatcgtcggcctcagcctgttcctggccaagccgctgctgaagctgaagatctacaccgtcacccaggtcctggagcgtcgctacaaccccgccgcgcgccacgccagcgccctgatcatgctggtctacgcactgatgatcggcgccacctcgaccatcgccatcggcaccgtcatgcaggtcctgttcggcctgccgttctgggtctcgatcctgatcggcggcggcgtcgtggtgctctactccaccatcggcggcatgtggtcgctgaccctgaccgacatcgtgcagttcctgatcatgaccgtcggcctggtgttcctgctgatgccgctgtcgatcaacgacgccggcggntgggacgccctggtagccaagctgccggccagctacttcgacttcaccgcgatcggctgggacaccatcgtcacctacttcctgatctacttcttcggcatcttcatcggccaggacatctggcagcgggtgttcaccgcccgcagcgagaccgtggccaaggtcgccggctccgccgccggtatctactgcgtgctctacggcatggccggggcgctgatcgggatggccgccaaggtcctgctgccggacctggagaacgtcaacaacgccttcgccagtgtggtcgagcacagcctgccgaacggcatccgcggcctggtcatcgccgccgccctggcggcgctgatgtccaccgccagcgccggcctgctggcggcgtccaccaccgtcacccaggacctgctgccgcgcctgcgccgcggccgcggccagtccgacaacggcgacgtgcacgagaaccgcatcgcgaccctgctgctgggcctggtagtgctcggcatcgccctggtggtcagcgacgtgatcagcgccctgaccgtggcctacaacctgctggtaggcggcatgctgatcccgctgatcggcgcgatctactggaagcgcgccaccaccgccggcgccatcaccagcatgaccctgggcttccttaccgtactggtgttcatgatcaaggacggcctcgacgccaatacgccgatctactacagcctggcggtcggcctgctcagcttcgtcctggtcagcctgttctcgcggcgcccgacgggtgtcgccagcgccgcctga

SEQ ID NO: 7529 - DNA, 474 bp, Pseudomonas aeruginosa
accaggcacaaccccgacaggcgagggactttccctcgccttttccattcccgagaacatgaaaaaggaacggccatgaccacctgcggcgaattcctcgtcaagcaactcgaagcctggggcgtcgagaccgtcttcggcatccccggcgtgcataccgtagagctctatcgcggcctgcccggcagccgtatccgccatgtcaccccgcgccacgagcaggggcgccggcttcatggcggacggctacgcacgggtcaccggcaagcccggcgtgtgcttcatcatcaccggcccggggatgaccaacatcctcaccgccatggcccatgcctacgccgactcgattccgatgctggtgatctccagcgtcaacgaacgcgcgcgcctggcccacggcaacggctacctgcacgagctgccgaaccagcgcaacctggtaggcaacgtctgccccttcaggccataccctga

SEQ ID NO: 7530 - DNA, 693 bp, Pseudomonas aeruginosa
tgcgcaactacacgccgagcctggccatccacagcgacgcccggctggccatgcgcgtgctgctggccgaactgccgggcggcgaggcctcgccggacagccccggggcccggcgcgccgccgccgtgcgccagcgcctggccgaagacttcgccggctggtcgcactatcgccagctgttcgccgcgatcctcgccgagtggccggacgcccgcttcgtcggcgactcgacccagaccgtctacagcggcaaccacctggtcgatctcgacgagccgcgccgctggttcaacgcctccaccggctacggcaccctcggctatggcctgcccgccgccatcggcgccaagctcggtgagcccgggacgcccggtggtcagcctgatgggcgatggcggcctgcagttcaccctgccggaactggccagcgcggtggaagccaaggtcggcatcgtcgtgctgctgtggaacaaccacggctatggcgagatcaagcgctacatggagcggcgcgagatcactccgctcggggtcgatatatacaccccggacttcctcgccatcgcccgcggcttcggctgcgccgccgaacgcgcgcgcgatctcgaacacctgcgcgaactgatgcgcggcgccccggcggaccgtccgctgatcgtcgaggtgctgcaagccgcgcccttccatccctga

SEQ ID NO: 7531 - DNA, 2169 bp, Pseudomonas aeruginosa
cccggagcccgccatggacgattccgaactctaccgctccctctgcgagatcctcggcgcccgtggcgtgcgcgacagtgccgcgctcgccgggcaggaccccggctaccatccgcagaacctcgccggaagcttcctggtcctgccggaaagcaccgaccaggtcgccgccgtggtgcgtctgtgccgccaggcgggacgcgccctggtaccccagggcggactcaccggcctggtcggcggcggcgccgcgcaagccggcgacgtgctgctctcgctgcgcaggctgaaccgcatacatcggctggatgcggccagccagaccctcgacctcgacgccggcgtcaccctcgaacaggcccaggcgctggccgccgaggccggactcgaccccggcatcgatctcgccgcgcgcggcagcgccagcgtcggcgggctggtcgcgaccaacgccggcggcatccgcgccttccgcttcggcaccatgcgccagcgcgtgctcggcctggaagcggtactcgccgacggcagcgtctacagcgacctgcgcgggctgctgaagaacaccaccggctacgacctcaagcagttgttcgtcggcgccgaaggcaccctcggcatcgtcacccgtgcggtactgcgcctggagccgttgcagcgtcccggcgccaccgccctgctcggcctgcccgacgtcgacgcggcgatcaccatcgccgcgcgcctgcgccgcgagcacgccgaacgcctgttcgcctgcgagatcctctggcacgactacctgcaatgcaccgccgcacccatgggcgacagcgcgccgagcctggcgccctgccctctctacctgctggtggaactggccgaggaccgccacctggatgccggcgaggcgctcaccgccctgctggaagactgcttcgaggacgggctggtggaagacgccctgctcgccgccaacgaaacccagcgcctggccatctggcgcctgcgcgaagactccgacgcggccatccacgccggcgtcgacagcctgtccttcgacgtatcgctcccggtgccggccctggccggctacgtcgagcgcatccggcggcgcctggacgacctggtgaagggcatgcaggtcttcctcttcggccatttcctcgacggcaacctgcacgtcatgctcgccgccgacgtcccgctgctgccgctgcaccaggcggtggaggaaatcctctacggcgagttgggcgaatgcgctggcgtgatctccgccgagcacggcatcggcctggagaagaaggaagccctgggacgctacgccgatccgctgaagctcgcgctgatggcgcagatcaaggaactgctcgaccccagcgggctgttcaacccgggcaaggtcataccctgaacgcctatccttctgggatagcctttccaccgacagagaccgcgatgagaatcgtcagccgcgaccgctggttcgaaacccggcacttctacaacggtatcagcctgatccacgagccctacgtgcgccccttctatcgctgcaacatgtggcatgtccagggccgcgagcgcgacgtgctggtggacagcggctccggtctggtcagcctgcgcgagcaactgccctggctcaccgaacgaccgctgctggcggtggccagccacacccacttcgaccatatcgccggccaccacgaattcgccgagcgcctggcgcatccggccgaggcggagatcctcgccgcgccggacggcgacaacaccctggcgcgcgcctatgtcggcgacgagatgttcgaggcgcatccggagtgcccgctgtgctacgccgaataccgggtgcgagcagcgccggcgacccgactgatcgacgaaggcgacgtgctcgatctcggcgaccgcgtgctgcaggtgctgcacacgcccgggcactcgccgggcggcatcagcctgtgggaagcggcgacacagacgctgttttccggcgacatcgtctacgacggtccgctggttgaggacgcctatcattccaacctcgacgactatgcctccagcctcgcgcgcctgcgcgagctaccggtgcgcaccgtgcatggcgggcatttcgcgagcttttccggggagcgtttgagggaaatgatcgtcgcctggttcaggaaccacgatcgatag

SEQ ID NO: 7532 - DNA, 885 bp, Pseudomonas aeruginosa
cctgaatcaagccaacgccgattcccgcccttgcaggagaccgatccaggccttcaggttggcgccgaccatgcccttgcgccagaccagccaggtattcgcccgggcgaacggttcggccagcgcatgcaccgccaccgactcccgccccggcaggctttgcagcatcgacaccggcatcagcgccaccccgccgccggccaccacgcaggccagcatgctgtggtaggactcgatctccatcacccggcccatgctcacccgcgcgctggcgaaccaggactccagcagcaggcgataggagcagcgcgggcggaaggcgatcaccgcgctgccggccacgtcctcgggaccgcgcaccggcgggtggccattctcggtgaccagcaccatgcgctcctcgaacatcggcaggccctccagaccgtcgaagtccagcgggccgtccaccagcacggcatccaggcgcccgcccagcagcgactcgaccagctcgccgctgggcgcggtctgcaattgcaggttcaccgccggatagcgccggtggtattccgccaggcgcggcggcaggtggatcgccgcggtgctgtacatcgagccgagggcgaagtcgcccaccggttcgcccccctgcaccgccgcgcgcgcctcctcctgcagggcgaacagccgcgcggcgtagtccagcaggaccttgccggccggcgacagttgcaggcgctggcgttcgcggaggaacaggtcgacgccaagctgttcctccagttgccgcaggcgcgtcgacaggttcgacggcacccggtgcaggcgttcggcggcgcgggcgatggagccttcctcggcgaccgcctggaaaatcctcaactggccgaactccacgattaa

SEQ ID NO: 7533 - DNA, 1947 bp, Pseudomonas aeruginosa
cccggcgcatgccacgaacaattggtagaacagcgtcaggcttggcggtgcctcggacagccgggtgccgcgcactgccaccgtggtcgcgccccaggacatcccggcgagcaggccgaaagcgtcgccgagcagcatccgcccatccatttccgcccacgacaggcctccgccgaaggccaccgctatgccgccgaagcacaccgccacgcccagccactgcaagggccgcaggcgttcgctgggaagcaggaagtgcagcccgagggcagagaagatcggcgcggtatagaggaacaccgacatgtgcgaagccgtggtgtattgcaggccgagggcgatgaacaggaactccagggcgaacagcgtgccggtcagcaggccggcgcccagggtgccctggcgcaagccctcccagccgccgcgccagcacatcagcaggccgaccagggcggcggcgatgccggaacggatggccgcctgcatgaccggcgcgatgtccgtcgccgcccacttgatggtcacctgctggatgccccagatcacgcagagcaacagcatggtctggaaggcgaaggcatcggcggacttacgcatggcggactcacaggcaggcatggaaggaagcggccgccagcggcgaccgtcgggcagcgccattatggacaagccggcgcgcccggtcgaagcctggaagcgacctccagcgggccgtgggcggcggttccggcctgcttgcctggcctggcctggcctggcctgggggacgctatccgtcctgcgaacccgccatctggccgcggccgctcacttgccggtcttgatcttgctccaggtccgcgtgcgcagccgctccagcttcggcggcagcatttccaccgaatacagcctggcctgcacttcttccggcgggtagacgttcgggttgtcgcgcaactccgccgagatcaggccgtccgccgccttgttcgggttggcgtaggccacgtagtcggagatcggcgccactacctccgggcgcagcaggtagtcgaggaaggcgtgcgcctgctcgacgttcttcgcgtcgcgcggaatcgccagcacgtcgaaccaggccgcggcgccctccttcgggatgcggtactcgatgcgtatgccgttcttcgcttccctggcccggttggccgcctgcatcgctccgccggaccaggcgatggccacgcagacgttaccgttggccaggtcgctgacgaacttcgaggaactgaagtaggtgatgtacgggcgcagcttcgccaggtgctcctcggctcggcggtagtcttccggctggtggctgttgggcgacaggccgagatagtgcagcacctcggggatcacctcggtgggcgagtcgaggaaggccacgccgcactgttgcagcttcgccaggttctccggcttgaacaccaggtcccaggagtccagcggcgcatcgtcgccgagcaccgcgcggaccttgtcgaggttgtaggcgatgccgttggtgccccacatgtagggcatcacgtagcggttgccggggtccttgccggcgagcaccttgagcagggccgggttgaggttcttccagttcggcagcttgctcttgtccagcggctggaacacctcggccttcaggtagttgggcaggaagctgtcgctgggcaccaccaggtcgtagccggaatgcccggacagcagcttggcctcgagcacctcgttgctgtcgtagacgtcgtacttcggcgcgatgccggtctgcgcctggaagttcttcagggtgtccggggcgatgtagtcgaaccagttgtagatccgtacttccggcgcggcctgaaccagcccggcggaaacggccagcgcgaggccggccagcagcttgcgagtcgattgcatgcttcgctcctcagcgggccgcgccttcgtagccctgcagcacgttga

SEQ ID NO: 7534 - DNA, 2451 bp, Pseudomonas aeruginosa
gccagtcaggatcgaaagggggattcgatgaggcgcgccagcctgcatatgttgctctgccagttcgccatggccctgggcctgctcctgagcctgggcagcgaggcctgggccgccaggccggctccgcaggcggccgtcgacctggaagcgccggccgccctggccgaggacgccagcctcgaccagctcaacgcgcaactcgacctgatccgccagcgcgtcaccgccgacgccagcgacgacctcctcgccgagttgcgccagagcgcgctgcaagtccagcgccaggccgacgccctgctcgcgctgcgggtggccgacatcgagcggctcgacgatcagttgaaagtgatcggcccgccgcagcccgacgaggcggaaagcctcgccgcccagcgccaggccctgacccggcagaagaacgccctgctcgatgacgaacgccaggccacccagctcggccagtcgtcccgcgacctggcggcacagatcgtcaacctgcgccgcagcctgttcaactcgcagatcagcagccgcgcggcgacaccgttcagcccgagcttctggtcgaccctgatccgtcccaccgacgacgacctgcgccggctggacaagctgaaggcggaggccctggtcgccttcgacagcgccatcgcgcccggacaccgctgggccttcgccggaaccctgctggccaccgtgctggtctggagcttcggccgccgcctgctggagcgcatgcttacctgggcgatgatccgctggctgccggaaggccgcctgcggcgcagcgccctggccctggcggtcgggctggcgaccatcctgaccatcgtcggcgcggtgtcgctgatgcgctggggcctggaaagcaacgccagcctgagccccgacatggccagcctgaccgatcaactggtgagcctggcgaccttctgcgccttcatcgccggcctcggccgcgccctgctgatgctgccgcgaccatcctggcggctgccggcgatcccggacaggatcgccagcgccctcggcccgttcccggcgatcctcgcggtggcgctgatgctggtggccaccgaggaacggatcaacagcgtcaccggcaccagcctggccctgaccgtcgccctcaacggcctgaccgcgctggtcaccgcgctgatcttcgccgccgccctgctgcgctaccaccatgtgcggcgcaagcacgacctggagcggccaggcgggatcgccgggctgatccccttcgtcgcctcggtatggatcgcagcgatcctcctcgccctgttcaccggctacctgtcgctggcctacttcctcaccggcaagctgctgtggatcagcgtgatcgcggccaccacctacctgctgatcgctttcttcggcgacatctgcgaaaccctgctctcgcccaagcatcccagcggcctggcgctggccaatgcgctcggcctgtcgccgcgccaccaggcccaggccagcacggtgctggccggggtcggccgcaccctgctgctgctcaccgcgctgctgctggccttccttccggtcggctcgagccccagcgaactgctgcagggcttcgcccaactgggcgaaagcagcaggaccctgggcaacctgaacatcgtcccgcaggacatcctggtcgccctgctgctgttcgtcggcggcctgttcgccctgcgcatcgtcaagcgctggctgagcgagcggttgctgccggaaaccaacatggacgccggcatgcgcgcctcgctggtgaccctggtcggctacctcggcttcgtgctcctggcgatgctggtgatgtccaccctgcgcatcaacctgaccagcctgacctgggtggtcagcgccctctcggtaggcatcggcttcggcctgcaggccatcgtgcagaacttcatttccggcctgatcctgctgaccgagcggccggtgaaagtctgcgactgggtcagcctgggcggggtcgagggcgatatccggcggatcaacgtgcgcgccaccgagatccagatgggcgaccgctccacggtgatcgtgccgaactcgcagttcatctcccagaccgtgcgcaacgtgaccatgggcaatgccctcggggtggtcggggtgaacctgaccctgccgctggacaccgacgcgatgaaggtccgcgaactgctcttgcaggccttcgccgaacacccggcgatcctcgacgcgccggcgccctcggtgacgttcaaggatctcgccagcaacggcctggtgctcaacgccagcggcttcgtcaacagcccgcgttcggtggccggcgcgcgcagcgacctgctcttcaccatcctcgaccgcttgcgcagcgaaggcatcgcgctgtcctcgccgcagagcctgctgatgatccaggatggcggcccggccagcgccgcgcctgcgcccgcgacgcccgattga

SEQ ID NO: 7535 - DNA, 972 bp, Pseudomonas aeruginosa
aatccgcccctttttcaacgccgaaccgccatgaatcgcgaagccctcgataccctcctccagcacctgctcgccgcgctgtccccggcgccggcggagacccgccgtctgttccatggtcgcggccgctgctggccgggcctggaacaattgaccgcggactggctgcagggcgtcctgctggtgactctgttcaaggagccgcagccggaggaactggaggccttgcgtcggaccctggagcaactgaccacggcgccggcctgggctgcgagccagggccggcacctggtcctgcagcaccgctaccgcccagacagcgcctgcgaatggctgtcgggcgagccgctggaaacctgggacatcgtggaaaacggactgcgcttccgcctcgacctgggacgcaaccagaacaccgggctattcctcgacatgcgcctgggccgccgctgggtgcaggagcaggccgccggccgccgcgtgctcaacctgttcgcctacacctgcggcttctcggtggcggccattgccggcggcgccagccaggtggtcaacctggacatggcccgcggcccgctcaaccgcggccgcgacaatcaccgcctgaacggccacgacctcggccgggtgagcttcctcggccacgaactgttcaagtcctggggcaagctgcgcaagctcggcccgtacgacctggtgatcgtcgatccgccgagcttccagaaaggcagcttcgtcctgacccaggactaccgcaggatcctccgccgcctgccggaactgctggtgcccggcggcaccctgctggcctgtatcaatgacccggccatcggccccgacttcctcctcgaggaaaccgcccgcgaggcgccgtcgctgcacttcgtcgaacgcctggagaatccgccggagttccccgatgtcgaccccgcggcgggcctcaaggcgctgctgttccgcaacgcaggctga

SEQ ID NO: 7536 - DNA, 1254 bp, Pseudomonas aeruginosa
ccagaggacgatctgcggcgagacatcctggaactcgtcgatcagcagatgggtgaacggcgccagcgccgtttccgccagggccccgccggccatccgctcgccgagctgctggaacgcggcgtcgaaggtcatcaggccctcctcgcgcaacagcgcctggaacctcgcccagaacagtgccatggcttcgacgaagatcttctcgcgcaacccgcattccagcttgccgctgtccaggcgttcgacgcgcaggcccaggctctcggcgaacccggcctgggcatggaaggcttcgtacagcggcagcgcctggaactcgccggccagcttgaacggctccagcggcgccttcggctgccgccgcgcgccctcttccggctccgccggcggcggcagttccagcagcttgtggatcttggcgcggaacgccgggctttgcgcgtaacactgctggtaggcctgcttcagcaggcgctgctgggccggacgcaggcgtccggcggcaagggggttgtccggctcggcggcggggtcgcggtcgtccagttgttcgaaccagcgcggattgccgagcacctcgcgggccaggctgccgagcgccgaatggaaagtgcgcacgcactgccgcgcctgggccgcgtcgaacgggtactgccagtgcgcgagcagccgcagcaattgttcgcgcaactgcgcacaggaggcgttggtgaaggaaatcactgtcagccgctgcggctcgacgcccaggtggcagagcatgaacaccacccgcaggaccagggtggtcgacttgcccgagccggcaccggcgaagatccgcgccagcggctggcggcagaggatcatcgcccactgttcctcggacggcgggctgaccacaccgagcgtcacggcctgcgccacctgctcgcgcatggcgcgctcctgggattcgtcgaccttcagtgcggcagccggatagattccctgcggcgcgcgccgcgaggcggcagcgggcttgcgtggggccccccgaacggcgcccttcgcaggcttgccggcggccttggccggagccttcgcggcgttcttcctggagcgggccttggccggctgcaacaaggcttcgcgagcctcgcgctcggcctgcaggtaggcggtggtacgcgggaaacaacgcgccagggcgctggagagcatcgacttgtagcgccgtacggcagacagcatcggggtccggtccagacaaagcatgtggctgaatcataa

SEQ ID NO: 7537 - DNA, 471 bp, Pseudomonas aeruginosa
cggcgtctcgcgggtttgctagggtctggctcatgccgcccggacagctcgaaggagacccgcatgacccgtgaccgactcgccgagcgctaccgcgcctacatcgactgcctgaaccgccaggactgggcgcgcctgggcgacttcgtccatgaccgggtgcgctacaacgacgtgcagatcggactcgacggctacctgcggatgctcgaaggcgacttcctggcaatccccgacctgcgcttcgagatcgaacgcctgctcgtcgatcctccgggcgtcgcctgccgcctgcacttcgactgcacacccagcggccggctgttcggcatcccggtcaacggccagcgggtacgcttcgccgagaacgtcttctacgaattcgaagacgagcgcatcgccggcgtctggtcggtgatcgacaaggcggcggtcgccgcgcaggttcaggcgacgccgccgtcgtcctga

SEQ ID NO: 7538 - DNA, 2718 bp, Pseudomonas aeruginosa
ggcgccagggcactgcgggccgaccatctaccaggtatccacgaacggccgcttgcgccccgccctcggcgccggttctccggcgacggccaggccgcgcaggagccaggcgcgggtctccgccgggtcgatcaccgcgtcgatctccaggtagctggccatgttcagcgccttgccgttgcggtaggccttgtccaccatgccacggaacagcgcctcgcgccgctgggagtcttcctcggccgccagctccttggcgaagcccagccgcaccgcgccttccaggcccatggcgccgaactcgccgctgggccaggcgacggtgaacagcggcgaatggaagctgcccgccgccatggcctgggcacccagtccgtagcccttgcgcaggaccacggtgaagaacggcaccgtcaggctggcggcgctgacgaacatccgcgagacgtggcgcaccgtggcctgtttttccgcctccgggccaaccatgaagccaggggtgtcgcagagcgagacgatcggaatgtcgaaggcgtcgcacaactgcatgaagcgcgcggccttgtcgccggccgcggcatcgatggcgccgccgagatggccagggttgttggcgatcaggccgaacgcccggccctcgatgcgcagcagcgcggtgaccaggccgggagcgaactggcgccgcagttccagcacgctgtcccggtcggccaggacctcgatcgcctggcggatgtcgtaggcacgcaggcggttctccggcaccaggtggcgcaactcgcgctggtcggcgcaactccagtcgggcagcaggccctggaaatagccgaggtagcgcctggccaccgcgaccgcttcggcctcgtcctccaccagtacgtcgatcactccgttgggcccctgcacgcccgtcggaccgacctcctcggcggcgaaacggcccaggccgccgccctcgatcatcgccgggccggccatgccgatggtggcgtcgcgggtggcgatgatcacatcgcagcagcccagcaacgcggcattgccggcgaagcagcgaccggagaccactcccaccagcggcaccagcccagagagccgggccatgccgacgaaggtatggcaatcgagaccggcgacgccgacgaaatcggtatcgcccgggcgcccgccgccaccctcggcgaacagcaccagcggcaagcgccactgttcggccaggccgagcaggcggtcggtcttcttgtggttcatcaccccctgggtgccggcgaacaccgtgtagtcgtaggccagcaccaggcaacgcgcggcctgcgcgccgaagctggcggcccccaccgtaccggtgccggcgaccaggccatcggcggggctcagctccagcaactcctcggcggagcgccggcgacgctgggcggccagggcgaaaccgccatattcgctgaagctgccctcgtccagcaggtcgagcacgttctcccgcgcggtacgctgtccggtcttgcgccgcctggccagcgcctgcggacgacgctcgtcgcccagcgctgcctggcgctcgagtacctcggcgagatcggcgcggatatgcgccaggtccagcgcctgttcggtcggtgcctgctcgtcgtcatcctccgtcggttcgaggaacagcagcgtcgcgccctcctccagaggctccccgaggctcgccgcgagtcgccggacgataccgccgccgggtgccttgacctcgaattccatcttcatcgcttccaggatcgcgacccgctggccggcacgcacccgttcgccatcgcccacttccagggccaccagcaccccgctgctcggcgcagacagcggcaggctgccgagtggcgcctcgacccgcgcaggcgcggcgtcctcggcgagcgggcactcggcgcggagccgcggatggctcgccgggataggcgccagcagtgtctccaggtggctttcgacgaagcgggtgtcgacccggttggcctgtaccgccggatgcagcagaaggttgcgcagcagatccaggttgctcgccacgccctccaggcggaattcgcagagcgcccggtatgcccggcgcaacgcggcgggataatccgcaccacgcacgacgagcttggccagcagcgaatcgtagctggggctgacccgatagccggcatagccgtagccgtccacccgcaggccgggaccgctgggcggttcgtaggcgccgatagtgcccaccgccggacgggcgctgccgtcggccgccagggtctccaggttgatccgcagttgcaccgcgcagccgccgatcgccggcggtcgctccaggccgagggcggcaagctccatgccggcggcgagacgcaactgggcgtgcagcaggtcgaccccggtgacttcctcggtgacggtgtgctccacctggatgcgcggattggcttccatgaaatagaagcgcccggggcgctcgtcgtcgaccaggaactcgaaggtaccgatcccccgatagcgcaccgcgccggccatgcgcagggcgcaatcgatcagcgcctcgcgagtggcctccggcaggtccgggctgggggctatctccagcagcttctgctggcaccgttgcaggctgcaatcgcgctcccagaggtggctgaccgcaccgctgccgtcgccgagcacctgcacctcgatgtgccgcgcccgcgctacccgttgctcgacgtataa

SEQ ID NO: 7539 - DNA, 954 bp, Pseudomonas aeruginosa
  unsure (676): Identity of nucleotide at the above locations are unknown.
gctggcgccttccccagacaggcgcgcgcaaacatgaatcagccacatgaatggtcgcccctcagccgtttcgatctgaacctgttccgggtcttcgaagtggtctatcgagaacgcaacctgacccgcgcggcgggcctcctgcatctcagccagtcggccgtcagccacgccctggcgcgcctgcgcgaccagctcggcgacccgctgttcgtccgccaggggcgcggggttgcgccgacgccgctggccgagcgactggcgccgggcatccatgacgccctcgccggcctgcaccgcagcatgaatcgctgccagacgttcgaccctcggcgcgacgcgcggaccttccaactgaacatgccggagcaactggagccgctggtgctcccggcgatcctcgcccacctgcgccaggccgcgccacgcatcgagatacgctgcaacagcctgcactgggcggacctgaaggcggaactgggcgccggacgcatcgacctcgccatcgagatcgcccggcccaccgacgccgccctgcgccgccagcacctgctcgacgacagcctgtgcgtgatggccgggccgggcttcgccggcgacctgagtgcggaggagtacctggcggcggaccatgtcgcggtgacctcgcggcgacgcggcatctgcatcgaagacntggccctcggccacctcggcctgacccgccaggtgcgccagcgctgccagcactacctgtcggcggcgttgctggtggcccagggcggctacctgctgaccctgacccgaggctacgccgacctgatcaaccgcggcctgggcaaccgcctgctgccgatgccgctggccctgccagcggtgactctgaatctctactggtcgcgccaggccgacgacgaagccggcagcctctggctgcgcggcgaactggcggagctggcgacgcgcctgcgctga

SEQ ID NO: 7540 - DNA, 861 bp, Pseudomonas aeruginosa
cgaagggggcgaaacagaggaaaaggcgcgcggcgctcccatgcacacggaggtgcacatgaagttcgagaagaataccgagctggaccaggccaacctgcgactgattgtggccacctgcgcgatcctctacgtggtgctgatcggcctgctgcccggcctgaaggtcgagacctacctgccgatcgttgcctagtacggcctgttcctgatcgcctccatactgctgcgccaggccatcgtgcgctggccggggcactacccggcgcggcggatcttctgcatgctgcacgactacgccggcacctcgttcggcctgatcgtgggcggcgaggcagcgctgccgctgtacgcggtgatggtctggatcaacctgggcaacggcatgcgctacggctcgcgctacctggccatcgccaccgccctggcgctgctcgcgctactggtcatctatcgactgaccccggcctggcaggcccagccgttcatggtgctgatgctgatgaccaccagtaccgtcattcccttctacgcgcacctcctgctggagcgcacgcgcaaggccaccgaggaagcgttgcaggcgaaccaggagaaatcgcgcctgctggcccaggccagccacgacctgcgccagccgatccactccatcggcctgttcaccgcctgcctgcgcgacgcccgcctgggcgacgaggaacggcgcctggtggacaacatcgaccgctcgctgctcaacgtctcgcaactgttccgctccatcctcgatctctacaccctcgacaacggccggctccagcccaagcaggagaacgtccacctgggcgagttgctgcgcgacctggtccggcgcaacgctga

SEQ ID NO: 7541 - DNA, 477 bp, Pseudomonas aeruginosa
agcggcgcgctgggccggggtggaactgcgcctgcgcccttgccgcctgtggacgcgaaccgatccggggctgctgtcgaccatgctgcagaacctgctctccaacagcctcaagtacgccgccgagcgcccgctgctgatcggcgtgcggcggcgaggcgacggcctggccgtagccatctacgaccagggccgggggatcgcggaggaacacctgccgcgggtgttcgaggagttctaccgggtacgcgagacgcgcgaccgcgacgtcgagggaatcggcctggggctgtccatcgtccgccgcctggggcagttgaccgggatcgaggtgacgctgcgctcgcgggtcggacgcggcaccgcggtgaccctgcacggcctgccggcggtcgccgcgcaagccctgccccgccgcgacgatcccctgcaggccggcctgctcaccggcttgcgggtgtgcctggtggaagatga

SEQ ID NO: 7542 - DNA, 552 bp, Pseudomonas aeruginosa
aggcatcctcgaggagtcgccgctggccgagatgcgccggcagttcgaggtcaacctgttcggcgcggtcgcgatgatccaggccgtgctgccctacatgcgtcggcgccgccgcggtcatatcctcaatgggcggctacatcaccatgcccggcatcgcctactactgcggcagcaagttcgccctggaagggggtttccgaagccttgggcaaggaggtggccggcctcggcatcgccgtcaccgcggtggcccccggctccttccgcaccgactgggccggccgttcgatggtccgcagcccgcgcaccatcgccgactacgacgcgctcttcgacccggtccgccaggctcgccaggaaaagagcggcaagcaaccgggcgacccgcgcaaggccgcgcgcgccatgctccaggccatcgacgcggaaaacccgccggcgcacctgctgctgggcagcgatgcactggggctggtgcggcagaagctgaaggcgctggaggaggaaatcgcggcgtgggaagaggtcacgcggtcgacggatggatga

SEQ ID NO: 7543 - DNA, 2724 bp, Pseudomonas aeruginosa
tccacccgggaaatgctggaatacggcttcgagcgcgtgcggatgacgcggaactcgacacggtccgcatgcaggaccagccgcggggacaggtcgctgtgggcccagcacagccagggaatgcctttccagccggcgaacgcggcgaccaggcgcacgttcaggccgctgtccgtcgcaggatccttcgtcacgcgccctcgcctcccagataacagccgcgctgcttgtccactgtcaccgtatgcccgaagcccaggacgaacctgtcgtggaacggaagcccggcgagccaggaggtcgcgccggtccgcagcctctcgtcgcgcccgcccctcattcccccacccgcccctcgaccctccgcaagcgcgccatgctgtacacatccacgaagcgcccatcccgcaccgcgtagtcgcgcatctctccttcggtctcgaagccgaacttgcgatacagcgccagcgccggggcgttgtcggtgtagacggtgagttcgacgcggcgcaggttcatccagttgtcggcgatgtccagcagttcgccgagcaggcggctgccgacgcccttgccctgccaggcgacggcgacgcccatgccgatgctgccgctgtggctgcggcggatgcgcgggtgctgttcgaggctggcgctgccgatgacgtccccctggtgcaaggcgacgaggatcagcaggcggtcgtcgtccgcgctgtcgtgcaggcgcttgcggcgctgctccaccgactggtagggcatctgcaggacctggcgggccacggcggggtcgttgtacagggtggtgaggccttccacgtggcgttcgctgtagcgttcgaggcggatcgtcggcgattcggcggtcattgcggtcatccctgggctgtctggccacccagcataagcgtctgcgccgggctcgaccagccggtcggagatcgcgctttccctgccgcgcggctctggctaagctcgaccttcgaacaacgaaaggacgccagcatggtccagagcgccccagccagcgaaatcgccgccctcatcctgcgcggtttcgacgattaccgagagcagttccgcgagatcaccgacggcgcccgtgcccgcttcgagcaggcgcagtggcaggaagcgcagcgcgcctcggcgcagcggatcaacctctacgaggaaaaggtcgccgagaccggtggccgggctgcgcgcggggctggccgacagcgagctgctggacgtggagcgctggccgatcatcaagagcgcctacatcgcgcagatcgacctgcggctggacgacgagctggccgagacctggttcaactcgatcttctgcgggctgttcagccacgacaacatcagcgacggcacgatgttcgtgcacaccacccggccctcgctgcgcgcccacgcccgcgcgccctacacccgcacctaccggccgggcggcgacctgcgccaggcgctggagaagatcttcgacgactaccgcttcgacgtgccctacgacgaccgcgagcgcgacctcgaacggatcgacgcactgctgcacagcaacctgccggactgggtgtgcaaggacccggacctggccatcgagctgatcggctcggtgttctatcgcaacaagggcgcctacctggtgggccgcctgttcaccccggacgagcagtggccgctggtgttcccgctgctgcaccgcgagggccacggcatccagttcgacacggtgatcaccgacgaggcggaagtctcgatcatcttctccttcacccgttcgtacttcatggtcgacgtgccggtgccggccgagctggtggccttcctcaagcgtctgctgccgggcaagcacctggccgagctgtacacctcgatcggcttctacaagcagggcaagagcgagttctaccgcgccctgatcaaccacctggcgaccaccgacgaccgcttcgtcatggcccccggggtgcgcggcatggtgatgagcgtgttcaccctgcccggcttcaacacggtgttcaagatcatcaaggaccgcttcaacccgtcgaagagcgtcgaccacgccacggtgatccagaagtaccagttggtgaagaaccacgaccgggtcggacgcctggccgacacccagcagttcgccgacttccgcttcccggtgagcaagttcgagccggagtgcctggcagaactgctggaagtggcgccgtcgacggtggtgatggaaggcgacgtggtgctgatccgccactgctggacggagcggcgcatgaccccgctgaacatctacctggagaacgccagcgaggcgcagacccgcgaggcgctgaacgactacgggctggcgatcaagcaactggcggcggcgaacatcttccccggcgacatgctgctgaagaacttcggcgtgacccgccacggccgggtggtgttctacgactacgacgagatctgctacctcaccgaggtgaacttccgctacatccccgagccgcgcttccccgaggacgagatgtcgtccgagccctggtattcggtggggcccaacgacgtgttcccggaagaattcccgcgcttcctgttcgtcgacctcaaccagcgccggctattcgccaagctgcacggcaacctctacgacgccaaatactggcagggcctccaggagcagatccgcgagggcaaggtgatcgacgtgtttccctatcggcggcaggagacgcctga

SEQ ID NO: 7544 - DNA, 591 bp, Pseudomonas aeruginosa
ctgctattccaacggaacagaaggactcggaccctcatgagcaaacgtatcgtcgtcaccggcatgggcgcggtcagcccgctgggctgcggagtcgaacccatatggcaacgcctgctggccgggcaatcgggcatcgccacgctcccggcggagctgatcggcgacctgcccatcagcatcggcggccaggtccccgaccgtgcccaggacccgcaggccggcttcgatcccgacctgctgctggccgccaaggaacaacgcaagatggaccgcttcatcctcttcgccctggccgccgcgcaagaggccctggcccaggccggctgggcgccgcagagcgccgaggcgcaggagcgcacggcgaccgtcatcgcctccggggtgggcggcttccatgccatcgccgaagcggtgcggaccaccgacggcaagggaccgcggcgcctgtcgcccttcaccatcccgtcctttctctgcaacatggcggccgcccatgtgtcgatccgccatggcttcaagggaccgctgggcgccccggtgaccgcctgcgcggcgggcgtgcaggcatcggcgacgcggcgcggatga

SEQ ID NO: 7545 - DNA, 1008 bp, Pseudomonas aeruginosa
ttgagcctcccacggcctcctgggactaagaaaatcactcagcagttgatcgccatcgcttgctgcgtttttacacggtctgggccgcgaggtgacgtaggccagtgccatctgcgccggttccattccatgttcgcgggccagcgctacgtagcgcgcgcaggccgcttccgcctgcgggttggtgtagcgggtgaagcggctgtacagactgatgcgcgcgttggccgggcgggcgccgtccgtgtacttgccggaaagcatgccgaaggccatcggcgagtaggccagcaggccgcactgctcgcggatggcgatttccgccaggcccacctcgaagctgcggttgagcaggttgtaggggttctggatcgataccgcgcgcggccagccgcgctcctcggcgagcctgaggaaggtcatggtgccccagggcgtctcgttggacaggccgatgtggcggatcttgccggcgcgcacctgctcgtcgagcacttccagggtttcctccagcggtgtgaagctctcttcctggtgctggtagccgagctggccgaagaagttggtccgccgctccggccagtgcaactggtagaggtccagccagtctgtctgcaggcgctccaggctggcatcgagggcggcgacgatgtgctggcggttgaacttgaggttgccgtcgcgcacatggctgatgccgttgccggggccggcgatcttgctggcgaggatccagtcggcgcggtcgctgctgcggcggaaccagttgccgatgatgcgctcggtgctggcgtaggtctcggcgcggggcggcaccggatacatttcggcggtatccatgaaattgatcccggcggccttggccctggcgatctgggcgaaggcgtcctgctcgctgttctgctcgccccaggtcatggtgccgaggcagagggcgctgactttcagatcggtgcggccgagcgggcgatactccatgcgggtgtcctcgtgaaattaagtggttaa

SEQ ID NO: 7546 - DNA, 1251 bp, Pseudomonas aeruginosa
cgacgtcatcaccatcggcgtggaccaggagaaagcctgatgaacaagttcatggcttgggtcgatgcgcgttttcccgcgaccaagatgtgggaagaccatctgagcaagtactacgcaccgaagaacttcaacttctggtatttcttcggctccctggcgctgctggtgctggtcaaccagatcctcaccggcatctggctgaccatgagcttcacgccgtcggccgaagaggcgttcgcttccgtcgaatacatcatgcgcgatgtcgactacggctggatcattcgctacatgcactccaccggtgcatcggcgttcttcatcgtggtctacctgcacatgttccgcggcctgctctacggctcctatcagaagccgcgcgagctggtgtggatcttcggcatgctgatctacttggcgctgatggccgaggccttcatgggctacctgctgccttggggtcagatgtcctactggggcgcccaggtgatcatttccctgttcggcgcgattccggtggtcggcgaagacctggcccagtggatccgcggtgacttcctgatctccggcatcaccctgaaccgcttcttcgccttgcatgtgatcgccctgccgatcgtcctgctcggcctggtcgtgctgcatatcctggcgctgcacgaagtcggttcgaacaacccggacggcgttgacatcaagaagaagaaggacgagaacggcgtaccgctggacggcatcgcgttccatccgtactacaccgtgaaggacatcgtcggcgtggtggtgttcctgttcatcttctgcaccgtgatcttcttcttcccggaaatgggcggctacttcctcgagaagcccaacttcgagatggccaaccagttcaagacccccgagcacatcgctccggtctggtacttcaccccgttctacgcgatcctccgcgcggttccggacaagctgatgggcgtggtggcgatgggtgcggcgatcgctgtgctgttcgtcctgccgtggctggatcgcagcccggttcgctcgatccgctacaagggctggctgagcaagctgtggctggtgatcttcgcggtgtccttcgtgatcctcggctactacggcgcccaggctccgagcccgctgggtactaccctgtcgcgcgtttgcaccgtcctgtatttcgccttcttcatcctgatgccgttctacacccggatggagaagaccaaaccggttccggaaagggtgactggctga

SEQ ID NO: 7547 - DNA, 837 bp, Pseudomonas aeruginosa
ccttcctggcctattcggccaacccgaacaagctggcctccgagcgtatcggtacctacgtcctgctctacctggccttcttcttcgtattcgcctatctcctcaagcgcgagtactggaaggacgtgcactaacccgcacgttggtcttcgaagcgcgcgccctacggggcgcgcgcgtcttttcacctcccacaagtcgacctgcgaggagggctccatggcttcaatcaacaagctgacctgctattccgaccctgccgatcattactgccatcgcatccgcctggtcctggccgagaagaacgtggcggtagaggtgatcgatatcgaggcgggccgctgtccgccgatgctggcggaggtcaacccctacggcagcgtaccgaccctggtcgatcgcgacctggcgctgtacgagccgacggtggtcatggaatacctcgacgaacgctatccgcatccgccgctgctgcccgattatccggtgaagcgtgccaacagccgcctgttgatccatcgtatccagcgggactggtgttccctggtggaccggatcctggatgcgcgcagcaaggaggccgagcgggtccaggcgcgcaaggagttgcgcgagagcctgaccggggtttccccgctgttcgccgacaaggcatatttcctcagcgaggatttcagcctggtggattgctgcctgttgccgatcctctggcgtctgccgttgctgggcatcgagttgccgcggcaggccaagccgttgctcgactacatggagcgcggattcgcccgggaaagcttccgggccagcctgtcttccgttgaacgagatatgcgttaa

SEQ ID NO: 7548 - DNA, 666 bp, Pseudomonas aeruginosa
ggaaactgctgcagcctcccagggccaggctcagggccagggtggcggcgacgaaggcggtacggctcattcttcactcccgaacagttggcggtcgatcaggtcgcagaggcagtggatggccagcaggtggacttcctggatgcgtgcggtgatcttggaaggaacgcggatctccacgtcttccggcagcagcagcgaagccatgccgccaccgtcgcggccggtcagggcgaccaccagcatctcgcggtcgtgggccgcctggatggcctggatcacgttggccgaattgccgctggtggaaatcgccagcaggacgtcgcccggctggcccagggcgcggatctgcttggagaagacttcgttgtagctgtagtcgttggcgatcgaggtgatggtcgagctgtcggtggtcagggccacggccggcaggctcggacgttcgcgctcgaagcggttgagcagttcggaggagaagtgctgggcatcgccggccgagccgccattgccgcaggagaggatcttgccctcgttgagcagcgcattgaccatcaccaggctggcttgctcgatatagggaggcagtacttccagcgcctgctgcttggtctcgatgctggcctggaagagctggcggatacggtgttgcatgtccatcggtaa

SEQ ID NO: 7549 - DNA, 1740 bp, Pseudomonas aeruginosa
caggagggcgatgcgggtcagcggctgctgggacagcgtcttgagtttctccagcgccgccggcaagtgcttggccgccgggtgctcggggttctgctgttgccagctctcgatgctggcctgctgttgctgcagggtcggcgaggtcttggtgatgcgtgccagggtcagccagccgctgaggtcgccttcgttggcgctcggttgcaactggtcgaccggcaggctgctgaccagggtccagatcttttcctggttctcgatcaccgccgggccctcgagcagcggtgcgaagtagatgcgctccttggctgcggcaaggacctggccgtcggcggcgagggcctgggccttggcgcgctgggtacgaacctgctgggtcaccggcagttcgctgagatgctgcatgctcggatgctgcaatgcctgcagggcggccttgggcttgctgcgggcgagggccagttcggcgttcagggtgctggcgaagacctgctgggccggcttcaggctttccagcggaatctgtcccaggatggcggtggacctggcgaggtccttctgctggtaggcaaggtccgctgccgagaggcgcagcagcgccgcttcctcgggcttgctctggctggcctgttgcaacaactgctcgatgctggcattcggcgtacggggaagttcgcccagtccggaattggacgaggtcgcgcaggcggtcagcagaccggccaggatcagagcagaaagcggacgcaggcaagcgatcatatagggcttctcatggcgcattcacgaagagtcgccgattgtaccggaggcccgcctcgggtgcgatggcggcaccctgaatcgcgatacaatgccgccttttcagatagctcccgaggtattttcgtgtcagcaggcactctgttcgtaatggcgaccccgatcggcaatctcgacgacatcagcccgcgcgccctgcgggtgctgcgggaggtggccctggtggctgcggaggatacccgccattcgatccggctgttccagcacttcggcatcgagacgccattggcggcctgccacgagcacaacgagcgcgaggagggcgggcgcttcatctcccggctgcagggtggggaagacgtcgcgctgatctcggacgccggtaccccgctgatttccgatcccggcttccacctggtgcgccaggcacaggcgctgggtatccgggtggtcccggtgccgggctcctgcgcgctgatcgcggcgctgtcggcggcgggattgccgtcggaccggttcatcttcgaaggtttcctgcccgccaaggctgcgggacgacgcagccgcctccaggcggtacaggaagagccgcgcacgctgattttctacgaggcgccccatcgtctgctggaaagcctggcggacatgcgcgacgtgttcggcggggagcgccgtgcggtgctggcgcgggagctgagcaagaccttcgagaccattcgcagcctgccgttggccgaactgcacgattgggtcgcgtcggacagcaaccagcagcgcggcgagtgcgttgtgctggtggcggggtggcaggcgccggaaggcgaggagtcgatcggtgcggaggcgctcagggtgctcgacctgctgcttgccgagctgccgttgaagaaagccgcggcgctggcggcggaaattaccggggtgcgaaaaaaccttttgtatcaacaggctttgcaacgccaagggaagagttga

SEQ ID NO: 7550 - DNA, 1011 bp, Pseudomonas aeruginosa
agccgacctggcggcaatcaaacaacccggtgggctgccggacgaactacgcgacctgatcctttgactatgaatgccacctaccgccatatcaccgttctgctcgaggaggccgtttccgcactggccccgcgggaggacggctgctatctggacggtaccttcggaagagggggccatagtcgagccttgctcgagaaactgggcgccgggggacgcctgctcggattcgacaaagatccccaggccatccagacaggaaaagcattggcggccgaagacggccgcttcgtcattgtgcagcgctcgttcgccgaactgggcgatgaggtgcgcgcacgcggtctcgaagggcgggtcgatggcgtcctgctcgaccttggcgtgtcgtcgccgcaactcgacgatcccgagcgcggcttcagcttcctcaacgatggtccgctggacatgcgcatgaatcccggccagggcatcagcgcagcggagttcatcgccaacgccaccgaagaggaaatcgcccgggtcttcaaggaatatggcgaagaacgcttcgccaagcggatggcccgcgccatcgtgcagcgccgtcaggagcggccgttcgaacgaactgccgatctcgccgaagtgatcacggttgccaaccccgcctgggagaagggcaagaatccggcgacccgcgcattccagggcctgcgcatccatgtgaacaatgagctgggcgatctcgagcgtggccttgacgccgcgctcgaatcgctggccgtcggcggccggctggtggtgatcagtttccattccctggaagaccgcatcgtcaagctgttcatgcgcaagcacgccaagggcgaggcggacaacctgccgcgcgacctgccgatccgttccaaggtcttcgagccgcgcctgaagctgctgggcaagccgcagtacgcttcggaagaagaactcaaggccaacccgcgctcgcgcagcgcggtcatgcgcgtggcggagaagctgagatga

SEQ ID NO: 7551 - DNA, 1335 bp, Pseudomonas aeruginosa
cctgccgacggccaccgaacagcagcaggtcaatgctgcgcccgcaaaaggagggcgtggctgatgcctatgagcctgaaccaactgtttccccaggccgagcgcgatctgctgatccgcgagctgaccctggatagccgcggcgttcgtccgggcgacctgttcctggcggtgccgggcgggcgccaggatggtcgtgcgcacatcgccgatgccctggcccaagggcgcggctgccgtggcttacgaggcggaaggcgccggagagttgccgcccagcgatgcgccgctgatcgcggtgaaggggctggccgcgcaactgtcggcggtcgccgggcgtttctacggcgagccgagccgcgggctggacctgatcggcgtcaccggcaccaacggcaagaccagcgtcagccaactggtggcccaggccctggatctgctcggcgagcgctgcggcatcgtcggcaccctcggcaccggtttctacggcgccctggagagcggccggcacaccacgccggacccgctcgcggtgcaggccacgctggccacgctgaagcaggccggcgcccgcgcggtagcgatggaagtgtcttcccacggcctcgaccagggccgcgtggcggcgctcggtttcgatatcgcggtgttcaccaatctgtcccgcgaccacctcgactatcacggttcgatggaagcctatgccgccgccaaggccaagctgttcgcctggccgggcctgcgctgccgggtgatcaacctggacgacgatttcggccgtcgactggccggcgaggagcaggactcggagctgatcacctacagcctcaccgacagctcggcgttcctctattgccgcgaagcgcgcttcggcgacgccggcatcgaggcggcgctggtcactccgcacggcgagggcctgctgcgcagcccgttgctcggccgcttcaacctgagcaacctgctggcggcggtcggtgcgttgcttggcctgggttatcccctgggcgatatcctccgcaccttgccgcaactgcaggggccggtcggccgcatgcagcgcctgggaggcggcgacaagccgctggtggtggtggactacgcgcatactcccgacgccctggaaaaagtcctggaggccctgcgtccgcacgcggccgcgcgcctgctgtgcctgttcggctgcggtggcgatcgcgatgccggcaagcgtccgctgatggctgcgatcgccgaacgcctggcggatggggtgctggtcaccgacgacaacccgcgcaccgaggccagtgcggcgatcatcgccgatatccgcaaaggcttcgctgccgctga

SEQ ID NO: 7552 - DNA, 360 bp, Pseudomonas aeruginosa
tcgcctccgaccacttccgcatcgttgtcggcctcggcaagagcggcatgtccctggtgcgctacctggcgcgccgcggcttgcctttcgccgttgtcgatacccgagagaacccgccggagctggccaccctgcgtgcccagtatccgcaggtggaagtgcgttgcggcgaactcgacgccgagttcctctgctccgcccgcgaactctacgtcagccccggcttgtcgctgcgcacccccgcgctggtacaggccgccgcgaaaggtgtgcgcatctccggtgacatcgatctcttcgcccgcgaggcgaaggccccgatcgtcgccatcaccggttccaacgcgaagagcaccgtga

SEQ ID NO: 7553 - DNA, 1173 bp, Pseudomonas aeruginosa
tctgctgtgcctgtctggggatgttgctgcgcatcgaatgggaacggcgaacccacctgggtagcgaggaatatgagttcaacgaagaggactttgccgatgaaaggtaatgtcctgatcatggcgggtggcaccggcggacacgtgttcccggcgctcgcctgtgcgcgggagttccaggcgcgcggctatgccgtgcactggctggggacgccgcgcggcatcgagaatgacctggtacccaaggccggcctgccgttgcacctgattcaggtcagcgggctgcgcggcaagggcctgaagtcgctggtcaaggcgccgctggaactgctcaagtcgctgttccaggcgctgcgggtgatccgccagctgaggccggtctgcgtgctcggcctgggtggctatgtcaccggcccgggcggcctggctgcgcgcctcaacggcgtgccgctggtgatccacgagcagaacgccgtggccggcaccgccaaccgcagcctggcgccgatcgccaggcgcgtctgcgaggcattcccggataccttcccggccagtgacaagcgtctgaccaccggcaatccggtgcgcggcgagctattcctcgacgcgcacgcccgcgcgccgctgaccggccgtcgggtcaatctgctggtgctcggcggcagccttggcgcggaaccgctgaacaagctgttgccagaggccctggcgcaggtgccgctggaaatccgtccggcaatccgccatcaggccggtcgtcagcatgccgagattaccgccgagcgttatcgcacagtggcggtcgaagcggacgtcgcgcccttcatcagcgacatggccacggcctatgcctgggccgacctggtgatctgtcgcgccggcgcgctgaccgtcagcgagctgacggcggcgggattgcccgccttcctggtgccgttgcctcacgcgatcgacgatcaccagacccgcaatgccgaattcctggtacgcagcggcgccggccgcctgctgccgcaaaagtctaccggcgcggccgaactggccgcgcagctgtccgaggtcctgatgcatcccgaaaccctgcgctccatggcagaccaggcacgcagcctggcgaaacccgaggctacccggacggtggtcgatgcctgcctggaggtggcccgtggttaa

SEQ ID NO: 7554 - DNA, 1653 bp, Pseudomonas aeruginosa
cgaagacgccgacgtgcgcgcgatcaacatccgccaggaaggcatgcgcacctggttcaccgtgttgcgcccggagcgcgagccgctggacgtctcggtgaacatgcccggcctgcacaacgtgctgaattccctggcgaccatcgtcatcgctaccgacgagggcatctccgacgaagccatcgtccaggggctgtccggcttccagggcgtaggccggcgcttccaggtctacggcgagctgcaggtcgagggtggcagcgtgatgctggtggacgattacggccaccatccgcgcgaagtcgccgcggtgatcaaggcgatccgtggcggttggccggagcgtcgcctggtgatggtctaccagccgcatcgctatacccgtacccgcgacctgtacgaagacttcgtgcaggtgctgggcgaagccaacgtgctgctgttgatggaggtctatccggccggcgaagagccgatcccgggagccgacagccgccagctgtgccacagcatccgccagcgcggccagctcgacccgatctacttcgagcgcgacgccgacctggcgccgctggtcaagccgctgctgcgcgctggcgacatcctgctttgccagggcgctggcgatgtcggcggcctggccccgcaactgatcaagaacccgctgttcgccggcaagggagggaagggcgcatgaacctttgcctcgatagcctgctgaacggcacccaggatcccaaggcgttcggccgtgtcgccgtgctgttcggcggcaagagcgccgagcgcgaggtgtcgctgaagtccggcgcgatggtcctgcaatccctgctggccgccggggtcgatgccttcggcatcgatgtcggcgaagacctgctgcaacgcctggtcgaggagaagatcgaccgtgccttcatcattctccacggtcgtggcggcgaggatggcagcatgcagggcctgctcgagtgcgcgggcattccctacaccggcagcggcgtgctggcctcggcgctggcgatggacaagctgcggaccaagcgggtctggctcagcctcggcctgccgaccccggactacgcggtgctggccagcgaggatgactgccgcgaagcggcgcagcgactgggtttcccgctgatcgtcaagccggctcacgaaggctcgagcatcggcatggccaaggtcggcgggctcgacgaattgatcgcggcgtggcgcgaagcggcccgctacgactcgcaggtgctggtcgagcagtggatcagcggcccggaattcaccgtggcgaccttgcgcgggcaggtgctgccggcgatccgcctgggcacgccgcacaccttctacgactacgacgccaagtacctggccagcgatacccgctaccaggtgccctgcggtctcgacgaggccaaggaacgcgagctgaaggaactcaccgcgcgcgcctgcgacgccctgggcatccagggctgggggcgggcggacgtgatgcaggacgccgaagggcgtttctggctgcttgaagtcaacaccgcaccgggcatgaccgaccacagcctggtgcctatggccgcgcgggccgccggcctggatttccagcaactggtgctggcgatcctggccgatagccgcgaggcgaggggataa

SEQ ID NO: 7555 - DNA, 867 bp, Pseudomonas aeruginosa
gccatgaatggcgtactgctccgtcatcagcaacccggtggactcggccgcgctccgcgcaagccgatgccgcgcggcgccagccgtctggtggccaaggaaccgctgagcgtgcgcctgccgaaagccgacttcagtttcctcaagtacctggcctggccgctgttgctggccgttctcggctatggcgcctatcgcggcgccgagtacatcctgccgtacgccgaccggccgatcgccaaggtcagtgtcgagggcgacctcagctacatcagccagcgcgcggtgcagcagcggatctccccgtacctggcggcgagcttcttcaccatcgacctggcgggcatgcgcgggcaactggaacagatgccctggatcgcccacgccgaggtgcgccgggtgtggccggaccaggtggtgatccgcctggacgagcaactgccgatcgcgcggtggggcgacgaagcgctgctgaacaaccagggacaggcttttacgccaaaggaactggcgaattatgaacatctgccccgcttgcatggtccacagcgggcgcaacagcaggtgatgcagcaataccagttgctcagccagttgctgcgtcccctcgggttctccatcgcccgcctggaaatgagcgatcgcggcggttgggcgctgaccacggcccagggcgtcgagatccagatcgggcgcgaccacgtggtagacaagattcgccgcttcgtaagcatctacgacaaggcactcaaagatcagatttcgaacattgcgcggatcgacctgcgttaccccaacggcctcgccgttgcgtggcgcgagccggtcacgcccgcgacggtggccacggccagcgccgtgcagtga

SEQ ID NO: 7556 - DNA, 1089 bp, Pseudomonas aeruginosa
gttgaggagacagtaataaccatggcaagcgtgcagagcggcaagatgatcgtcggcctcgacatcggtacctccaaggtggtggcgctggtgggcgaggtgacggccgatggccagctggaggtcgttggcatcggtactcatccgtcccgcggcctgaagaagggcgtggtggtgaacatcgagtccaccgtgcagtcgatccagcgcgccatcgacgaggcccagcagatggccggttgccgtatccactcggcgttcgtcggcatcgccggcaaccacatccgcagcctcaattcccacggcatcgtggcgatccgcgatcgcgaggtgaacccggcggatatcgaacgggtactggatgccgcccaggcggtggcgatcccggcggaccagcgggtgctgcataccctggcccaggattacgtgatcgataaccaggaaggcgtgcgcgagccgctgggcatgtccggggtgcgcctggaagccaaggtgcacgtggtgacctgcgcggtgaatgcttcgcagaacatcgagaagtgcgtgcgccgctgcggcctcgaggtcgacgacatcatcctcgagcagttggcctcggcctattcggtgctgaccgaggacgagaaggaactgggcgtgtgcctggtggatatcggcggcggcaccaccgatatcgcgatcttcaccgaaggcgcgatccgccataccgcggtgatcccgatcgccggcgaccaggtcaccaatgacatcgccatggccctgcgtacgccgacccagtacgcggaagagatcaagatccgctacgcctgcgccctggcccaagctggccggtgccggcgagaccatcaaggtgcccagcgtcggcgaccggccgccgcgcgaactgtcgcgccaggccctggccgaagtggtcgagcctcgttacgacgagctgttcaccctggtccaggccgagctgcgccgcagcggctacgaggacctgatcccggccgggatcgtcctcaccggcggcacctcgaagatggaaggcgcggtcgagctggccgaggaaatcttccacatgccggtacgcctcggcgtgccgtatag

SEQ ID NO: 7557 - DNA, 1203 bp, Pseudomonas aeruginosa
aaaggaaggagaggggaaatgtttgaactggtcgataacatcgcacaaaccgccgtcataaaagtgatcggtgtaggtggtggtggcggcaacgccgtcaatcacatggccaagaacaacgtcgagggcgtcgagttcatctgcgccaacaccgacgcacaagcgctgaagaacatcgcggcgcgcaccgttctgcaactcggcccgggcgtcaccaaggggctgggtgccggcgccaatccggaagtcggtcgtcaggcggctctggaagatcgcgagcgcatttccgaagtgctggaaggcgccgacatggtcttcatcaccaccggcatgggtggcggcaccggtaccggcgccgcgccgatcatcgccgaagtggcgaaggaaatgggcatcctcaccgtcgcggtggtgacccgcccgttcccgttcgaaggtcgcaagcgcatgcagatcgccgacgagggcatccgcgcgctggccgagagcgtcgattcgctgatcaccatcccgaacgagaagctgctgaccatcctcggcaaggacgccagcctgctggccgcctttgccaaggccgatgacgtgctggccggtgccgtgcgcggtatctccgacatcatcaagcgtccgggcatgatcaacgtcgacttcgccgacgtgaagaccgtcatgagcgaaatgggcatggcgatgatgggtaccggctgcgccagcggtccgaaccgtgcccgcgaggccaccgaggcggcaatccgcaacccgctgctggaagacgtcaacctgcagggcgcgcgcggcatcctggtgaacatcaccgcgggtccggacctgtccctgggcgagtactccgatgtcggcaacatcatcgaacagttcgcttccgagcacgccactgtgaaggtgggcaccgtgatcgacgcggacatgcgcgatgagctgcacgtcaccgtagtcgccaccggcctgggcgcgcgcctggagaaaccggtgaaggtcgtcgacaacactgtgcagggcagcgcaacccaggcagccgcaccggcccagcgcgagcagcagtcggtgaactaccgcgacctcgaccgtcctaccgtgatgcgcaaccagtctcacggcagcgcggcgaccgcggccaagctgaacccgcaggatgacctggattacctggatatcccggcgttcctgcgtcgtcaggccgattga

SEQ ID NO: 7558 - DNA, 927 bp, Pseudomonas aeruginosa
gtcatgcacatcatttttctgagccggcaccatggggccgctcgctccgtccatctgcagccgcggttgctgatgctggccggggcctgcgtggtcggtgccagcctgttggccgggggcttcatgggcgcctggctgttccgcgcgccggctccggtggccggcatcgaagtcgatgccgcgctgcaggcgcagagtgccgagatcagcagcgcccgcgaggacgcgcagcggcagatggacgcactgagcgtgcatctcggcgaactgcaggcgcgcctggttcggctggatgccctcggcgaacgtctcaccgagctggccgacgtcgaccccgacgagttcgacttctccctgagcgtcggccagggtggcgtcgacgaaccgctggagggcagcgcatatgccccgccgtcgttcatggcgacgctggacgaactggcggcacgcctggatacccgcgagcagcagctcgaggtgctggagcaactgctcgccgacaagcacatcagccagtcgacctacctggccggccagccggtgcgccagggctacatctcctcgccgttcgggcgccgggtcaatccggtgagcggccgcctgagcatgcacaagggcatcgacttcgccgcgccggccggcagcgacgtggtggccgtggcggcgggggtggtgacctggtccgggcgcaagaacggctatggcaacgtggtcgaggtcgggcacgccgatggctacaccacgttgtatgcccataaccagaagaacctggtcgaggtcggtgacctggtcaagcgcggccaggtgctggccaaggtcggcagcaccggacgctccaccggctaccacgtacatttcgaagtgatgaaggatggccgggtaatgaatccgcaaagcttcatcgcacgcgcgtctgtttccgagtga

SEQ ID NO: 7559 - DNA, 1803 bp, Pseudomonas aeruginosa
attccagcagcgctacgccaagggcgaaacgctcgaccaattgctgcccgaagccttcgccgtggttcgcgaggctggcaagcgggtgatgggcatgcgccacttcgacgtccagctgatcggtggcatgaccctgcacgacggcaagatcgccgaaatgcgtaccggcgagggcaagaccctggtgggcaccctgccggtctacctcaacgcgctgtccggcaagggcgtgcacgtggtcacggtgaacgactacctggcgcgccgcgacgccaactggatgcgcccgctgtacgagttcctcggcctcagcgtcggcgtggtcactcccttccagccgccggaagacaagcgcgccgcctacgccgccgacatcacctacggcaccaacaacgaattcggcttcgattacctgcgcgacaacatggccttcagcctggacgacaagttccagcgcgagctgaacttcgccgtggtcgacgaagtggactcgatcctcatcgacgaggcgcgtaccccgctgatcatctccggccaggccgaagacagctccgagctgtacatcaagatcaacaagctgatcccgcgtctcaagcgccaggtcgaagaggtcgagggcaagccgaccgaggaaggccactacagcatcgacgagaagacccgccaggtcgaactcaacgagcagggccaccagttcatcgaggacctgctgagccagaacggcctgctcggcgaaggcgagagcctctactcggcgcacaacctgagcctgctgacccacgtctacgcagcgctgcgcgcgcacaccctgttccaccgcaacgtcgagtacatcgtccagggcgaccagatcctcctgatcgacgagcacaccggccgcaccatgcctggccgtcgcctgtccgagggcctgcaccaggccatcgaggcgaaggaaggcctgccgatccaggccgagagccagaccctggcctccaccaccttccagaactacttccgcctgtacaacaagctggccggcatgaccggcaccgccgataccgaggccttcgagttccgccagatctacggtctcgacgtggtggtgatcccgacccaccggccgatcgcgcgcaaggacttcaacgacctggtctacctgacccaggaagagaagtacgcggcgatcatcaccgacatcaagcagtgccaggccctcggccggccgatcctggtcggcaccgcgtcgatcgagagttccgagtacgtttccaagctgttgcaagaggcaggcatcgagcacaaggtgctcaacgccaagtaccacgagaaggaagccgagatcatcgcccaggctggcgcgcccggttcggtgaccatcgccaccaacatggccggccgcggtaccgacatcctcctcggcggcaactgggaagtcgaagtcgcggccctggagaaccccaccgaggagcagatcgcccagatcaaggccgaatggcagaagcgccaccagcaggtgatcgaggcgggcggcctgcacgtgatcgcctccgagcgccacgaatcccgccggatcgacaaccagttgcgcggccgtgccggtcgtcagggcgacccgggttccagccgcttctacctgtcgctggaagacaacctgatgcggatcttcgcctccgaccgggtgaagaacttcatgaaggcgctgggcatgcagtccggcgaggcgatcgagcaccgcatggtgaccaacgccatcgagaaggcccagcgcaaggtcgaagggcgcaacttcgacatccgcaagcaactgctggaattcgatga

SEQ ID NO: 7560 - DNA, 1905 bp, Pseudomonas aeruginosa
caagatcctcgagcagatcgtcgccgcctactacgagaaggaagagctggccggcgccgaagccctgcgcgccttcgagaagcagatgctgctgcgggtgctggacgacctgtggaaggaccacctgtcgaccatggaccacctgcggcacggcatccacctgcgtggctacgcgcagaagaatccgaagcaggaatacaagcgcgagtccttcaccctgttccaggagctgctggactcgatcaagcgcgacaccatccgcgtgctgtcccacgtccaggtccgtcgcgaagacccggccgaagaggaggcccgcctgcgtcgcgaggcggaggaactggccaagcgcatgcagttccagcacgccgaggctccctcgatggagcaggccgtggccggcgaggaagaagagcttcccgagggcccggctccggtcgtgccgctcgagcctgtgcgcaacgagcagaagatcggccgcaacgagccttgcccgtgcggttccggcaagaaatacaagcactgccacgggcagctggactaagcttcccgcctggttcaccaacgccgcgaccggtcctgccgctcgcggcgtttgttcgaattggcgccagcccggcgccgatgcgttttccgtcacgccgtcgcggacggcatcgagtccactgtttggtaaaggagcgcgttcccatggctgtcggtcttggccccctgtccaccctgcacccggtccccggtttcgaactcggcatcgcttccgccggcatcaagcgaccggggcgcaaagacgtggtggtcatgcgctgcgccgaaggctccagcgtggccggggtgttcaccctgaacgcgttctgtgccgcgccggtgaccctggccaaacagcgtttcctcggtgaggtgcgctacctgctgaccaataccggcaacgccaacgccggtaccggcgaggccggcctcgccgccgccgcgcaaacctgcgccaagctcgccgaactggccggggtcgccgagacttcggtgctgccatattccaccggggtgatcggcgagcccctgccggtggccaagatcgaggcggcgttgcctgcggccctggccgacctggctgaggaccgctgggccgaagctgctgcggggatcatgaccaccgataccctgcccaagggcgccagccgccagttcgtgcacgatggcgtgaccgtgaccgtcaccggaatcagcaagggcgccgggatgatcaagccgaacatggcgaccatgctcggttatatcgccaccgacgccaaggtcgcccagggcgtgctgcaggatctgttgcgcgacgccgccaacaagtccttcaaccgcatcaccatcgacggcgatacctccaccaacgactgctgcatgctgatcgccaccggtcgcgcggcgctgccggaagtcacccaggccagcggcgcgctgttcgccgcgttgaagcaagcggtaatggaggtttccatggagctggcccaggccatcgttcgcgacggcgagggcgcgaccaagttcgtcactgttcaggtcaacggcggcgccacccaccaggagtgcctggatgtcggctatgccgtggcccactcgccgctgatcaagaccgcgctgttcgcctccgacccgaactggggacgcattctcgccgcggtcggacgtgccggcgtggccaatctggacgtgagcaagatcgacgtgttccttggcgacgtctgtatcgccagccgtggcggccgggcggccagttacaccgaggaacagggcgcggcggtgatggcccaggccgagatcggcatccgcatcgaactgggacgcggcacctgcagcgagaccatctggaccaccgacctgtcccacgaatacgtgaagatcaacgcagagtaccgcacctga

SEQ ID NO: 7561 - DNA, 723 bp, Pseudomonas aeruginosa
aaatcgggaatttgccatcggtccgtgcgcctcttaagttctctggtgcatggccgtccgcgtcgggcggtcgaagaggagaggcgcatggccctgaccatcgtgattggcaatcgcaatgactcgtcctggtcgctgcggggctggctggccttgcgcatgagcggggcggcgttcgacgagatcctcgtcccgctggggcggcccgatacccgggagcggatcctgcaatattcgccgaccggcaaggtgcccttgctgaaaagcgaggatggcgacatctgggattccctggccatcgccgagtacctcgccgagcgcttccccgaggcccacctgtggccgcgcggcgaggcggcgcgggcgctggcccgttcggtttgcgcggaaatgcacagcggtttcgccgcgttgcgcggcgagctgccgatggacctgcggcgccagcagccattggtggaattgtccgaggcgacacgacaggatattcaacgtatctgcgaagcctgggcggattgccggcggcgcttcggccaggacggtccgttcctgttcggccacgccagcctggcggatgcgttctacgcaccggtggcggcgcgtttccgcagttatgcggtggagttgccggatatcgcccggacctatgtcgagacgatttatcagtggcctgcgttccgcgcctggtacgacgcggcattgcgcgagcaggccggtagttga

SEQ ID NO: 7562 - DNA, 2241 bp, Pseudomonas aeruginosa
tgttcatgttcaacgaaaaggcccgcgacgcgctgggcaaggaaggtatcggcattcccttcccgcagcgggtggtcaaggttgtgcagggcgcgatggccgactgaggtccgtgcgatccacgaaaaaggccggcgaatgccggcctttttcattctcgcctcagtgctgctcggcgttctggtgtcccggcgccggcgtctcgctggacggcgcgcggcgcagccacaaccagccgatcagcagcagggtgggaatgcccatcaccgcggtgacgtagaagaagtgctcgtagccgaggctctcgaccatggttccggagtagccgccgatgaagcgcggcagcaggagcatggtcgagctgagcatggcgtactgggtggcggagaacttcaggttggtcaggctcgacaggtaggcgacgaaggccgaggcggcgaggccgccgctgaagttgtcgagggtgatggtcatcaccagcatcagcacgtgcggctcgagcgccatcaccaggctgatcacgtcatggctgggcagggcctcggcgtgcagcgggccgagctgggcgagcatggcgaacagcaggttggtggcagccgaagcggcaccgccgatgaacaggatggagaggatgctgaagcgggcgatcagcaccccgccggcggcggcgccgatcagggtcatgagtacgccgaagaccttgctgacactggcgatgacttccttggagaagcccatgtcgatgtagaagaccccggccatcacccccatcaccgtgtccgacaggcgataggtggagatcaggccgagcagcagcagggcctgccagcgatagcgctggacgaactcggtgatcggcgtcagcaccggggccatcagcaggcgtccgggtgccgacaggcaggacgcggcgatcagcaggaacagcgtgccgcgcggccaggcgccggagtagtaggcgcggcacatggcggtgacggtgacgaggaggatgatcagcaccatcaccgagaccgcctggtggacgaaatcgaacagcggcacttccttgccgcgcgccgccaccagcagcggcctgcgcacggtggcgagcagttcgcggaccgggcggatctgctggcgtccccacggcgacaggcagatccccatgagcagcgcgtagaggccggcgcgcggccaggcgcggtcgaggagggcggtgatcatcgccggcagcgagatcagcaggatcagcagcaggagcaccgagagcagttggtggttgaagtcgaaacgcgacgggttgacgtggatcggcacgtccaccgccggctcgcggatcagcaggctggtgaccagcccaggcaggatcagcagggcgaacaacgcataggtcaggccccaggccgactggctgtagttgaggctggtggagccgaaccattcggcgagaatcagcgcgccggcgctggccagcaggatcgccgcgcggtagccggtcatgtagcaggcagcgagggcggcctggcggctatcctcggcgatttccaggcggtaggcgtcgatcgcaatgtcctgggtggcggaggcgaacgccaccagcagggccaggccgatcagccagggcaggtggctctgcggattgcacagggccatgccgagcagtcccagggcgatcagcacctgcgagaacaccagccaggaacggcgccggccgagacggccgacgaagggcaggcgccactggtcgagcatcggcgaccagacccacttgaaggcgtacaccagccccagccaactggcgaaaccgatggtatcccgcgccacgccggcttcgcgcagccacaccgacagggtgttgaacaccagcatggtcggcaggccggcggcgaagccgagcagcaggagggccaggctggcgggagacttgtaggcgaccagggcctctcgccaggattgctgagtcatggggtaaccgttccgcaaaaaataacgcgcactctaaccgctctacttcgctgtaagccagccatgccgacgtatgtccaccctgtcgttgtgcaggagaacgccttcctcgcgcaagcgtgcgcgttgttcgcgaccgccgggactgtccgccggcaggctgatgcgaccgccggcgccgagaacccgatgccagggcaggcgggtatccaccggcaactggctgagcgtcctgccgacccagcgggcgggcgcggcctatgccggccagttcggccagttgcccgtagctga

SEQ ID NO: 7563 - DNA, 1008 bp, Pseudomonas aeruginosa
acgcccatgtcgctcagagccctctgttcaatcgtcgtgatgctcctggccggccccgcgctggccgacaccgtatggctggacaacggcgaccgcctgtccggcgagatcgtgctgatggacggcggcaagctggcgctgaagacccgttatgccggccaggtgctgatcgattggaaggatatcgacaccatcagttccgacaaacccctgctgatcaagcagcagggcgtatccgggcagcgtagccgaaccctggaggcggcgggcaagggcatggtgcggatcgtcgatggcggcagccataccgtcccgctggccagtattcgccagatggtgccgccgcgaccgctggtggaggacctggtctgggagggcaatctcgacgtcaagctggatagcaagcgcaacgacagcgacaaggacgaatggaagctcaagggcgatacccggcttcgccacggtgcctggcgccacgtgctggcgggggaagtggagcgggaaaagaaggacgggcgcaaggtcgaggacaactgggagctggactacgacctcgatcgcttcttcgacgaacactggttctggcgcggcagctattcgcagaagcacgatgcgatcgacaacctggagcgccagagcgcgctgggaaccggccccggctaccagttctgggacgacgaactcgggcgtttcgacctggtcgccgagatcagtcgctggcaactggagtggcgcgatcagccgcgcgaggatttcacctcctattcgctggagtgggactacaagcggctgctcgccggcacccggctggagctgtacagcaagggaaccgtgctggttcccggcatcgagcggatcgactacctgctcgacagcgaatacggcctgcgctatcgcctgaacagttgggcgcgtctttcgttcctctatgaactggaccagttgcgcaccgaggggggcacccagtccgaccggcattacctgatcggggtcggcgtcggctggtga

SEQ ID NO: 7564 - DNA, 1011 bp, Pseudomonas aeruginosa
tttgtgctcatgttgtcgagaatcctgctgtgcctcgctgcccttgcaagttccacctctgcccttgccgatacggtctggatgaagaacggtgaccgccttaccggcaagatcaccctgttcgacggcggcaagctgctgctgaagaccgactatggcggcgacatcacgctcaagtgggacaagatctccaccttcgagagcgagcagaacctgctggtcaagcaggatgccgagactggcgagcactccaagggcatcaaggccgccgggccgggccaggtgaccctggtcaacggcgagccgaagaccgtggagctggccagcatccagcagatgatgccgcccaagccgatcctccaggactgggtatggaacggcaacgtcgatttctcgctggaccgcaagcaggccgagaacgatgtgtccgactacgacatcgatttcaagaccaacgcccgccacggactctggcgccacaacgtgcagggcgagtacaaccgcgagaagaagaacggccaggtcagcaccgacaattattccggccagtacgcgctggaccgcttcatcgacgaccactggttctggcagggccaggtcgcctacaagcgcgacatgatcgaggacctggcgaagaagcgtaccgtcggtaccggccccggctaccagttctgggacaacgagctgggcgcgttctccatcgccaccctggtcaaccgcaacgactacgagttcgccgatggcgagaaggagcacttctattcgtcgagcttcaagtgggactacaaccgctacctgctggccaagcagttcgagctgttcaccaacggcgaggtcagcaagccgctgcaatccggcctggactacgagctgcagaccgaggcggggatccgctacaagctgaccagctgggcttcgctgagcatgaaggcggaatgggacaagttcagcggcaacgacggcaacgtcaaccagcgccgctataccatcggcctcggggtcggctggtaa

SEQ ID NO: 7565 - DNA, 741 bp, Pseudomonas aeruginosa
cccgagcttgacggctggattcataccgttcgtctcatgaatcctggagttcccgtcatgaacaatccgcctgtcgacctcgacttttctcacaagtatgatcgcgagcatgctgaggcctacctgaagaagcatcaggacggcctcgcccggaaactttcccaccggcgcgacgtccaactcgcccggcacgcgctgaagctcgcggggcagcccaacctggtgctcgacctgccctgcggcgccggacgcttctggccgctgctggcggaaaaggacaaccgggtgatcatcggcgccgacaattccgcggacatgctggcggtcgcctgcgccggccagccggacggtgtagtgaaacgggtacggcccttgcagacttccgctttcgccatcgacctgccggacagctcggtggacaatatcttctgcatgcggctgctccaccacatcggcgaggcggatgatcgacgcgtcctgctccgcgagtttcaccgggtcacgcgggacagcgtgattctttccctctgggtcgatggcaatttcaaggcctggaagcgtaggcgcatggaggcacggcgggtagcgaacggggaacagaccggctaccagaaccgcttcgtgttaccagccgaaacggtcgagcgcgagttccgcgacgccggcttcgtcgtccagaagcatctcgatttcatcccgctgtatcacatgtggcgggtctatatcttgcgaaaggaataa

SEQ ID NO: 7566 - DNA, 426 bp, Pseudomonas aeruginosa
gcagggggaagtcctgctcgggcaggtggaaatccaggagcagggtggaaaggtcctgcaaggtggcgatcggcgtcccgggcgagacgtagtcgccgacgtccacctggcggatgccgatggtcccggcgaagggcgcgagcacgcgcttcttcgccagcgccgccttcagctcggcgacggtggcgctggtcttggcccactgcgcggcgagacgatcgaattcgcttttcgagatggccttgctgccgatcagttcgcggccgcgctggtactcggccctggccaggccgagatcggcctcggcagtgcgcagggtggcttcctcgacgtcgctttccaactggatcagcggttggtccagcttcacctggtcgccggaaaggaacagtacgtcgcgtaccgtgccggagacttcggcggtga

SEQ ID NO: 7567 - DNA, 1224 bp, Pseudomonas aeruginosa
cggcggggttcgccagtcccgcccgctggcgagaaattccgggcgattgtccgccaagccgtcgcccatgtcatgcagcaacaggtcggaatagggacgaatccgctggttggccagctccggctcgctggcgtcggaaccggtagtgaaggcgggaacgtggcaggccacgcagttggcctgggcgaacagacgcttgccggccagcacctgcgggtcgtccaccttgcgccgcgccgggaccgccaggttgcggctgtagaacagcacctgggcgaagatgttgtcgctgacttccggctcgccgccgtcgggcgcccggcggcactcgacctgggcggcgctgcagtcgtcgtggggcagcaggctgctggtcaggcccatgtcgttggcgaaggcgtgcgcgttctgctgcgggatatccggctggccggccttccagccgaagcggccgagcgcggtgcgctgccgcgcggcatcccagacctggttggcgcgcccgcggataccgtcgccgttgcggtcgtccggatcggcattggccaggatcgcctcttcgggaatcgcctcgagcaggccgagcccgatcatcggcggggcgacgcgggcggaaaacatcgtctgcggatgcatcggcccatagccgagctggctgatacgcaggatcggcttgcgcagttcgacctcggtgccgtcctcgaacctcaccttcagcggctcgtagtccacccgcaccttgccttccggggcgacgccgggaatgccgacgtcctgcaactggccgccgtaggtcggctcgggaatcaccccctggtgcaacagggtcttgccgtccgcagggccggccgggatcgacaggcgtaccagcatcgacaccgcgctgaccgcgtccgctcccggcgggtggccgcggccgtccttcacatggcagttctggcaggcgttggtattgaacagcggtcccagaccgtcgcgcgcggtggtggaggaaggggcgatgacccaggggttgcggaagaaactgttgcccacgctgaagtccaggcgccggctcggggcgaggttggcggagggcagggagaaggcgttgcggtcgctttgcagcaccgtggtcgcgcccccggacaggtgttcgccgggctcggcgcgcagcggttcgtcgtcggcgccgcatccgcccagaaggagcgccgtcaggagacaggcgagcggcatggaaggtga

SEQ ID NO: 7568 - DNA, 1494 bp, Pseudomonas aeruginosa
aggcccgcgaagaccgctttcgaggccctgaaacgcagcgtgcggccatgggccgcacgctgttggcacaggaaggaatcagaactcgtggtcggcgttgtccggcttcaggtcctggatacccagcttgccagcggcctgctcgatggcgccggtctgcttgaccagggcggcgatggcgtcgcggatcttctgctggccgtccttgttgtccggagcgatcatctggtcgaagtgcacgccatccttctcggcgctgtcgacgatggcctgcagcttggcctcggtgtcggccaggtcggccttcagggtgtcgttggcggcggcgtcggccttggcgaccaggtcggccaggctcgggcccttgaccacgctgccgtcgatgcgcttgtactcgccgaggtagatgttgcggatgctcttgccgttgaagaacagggtgtggtgggtgtcgtcgctgaagcagtcgtgctcgtcttcggtggagttggcctccagcgcgaccttcatgcgctcgccggccagttcgccgagggacaggctgcccatgccgaagaacatcttgcgcaggccggtatccaccggttcggcttccagcttggcgcggtagttgtcggcgacgccggctttccactgtccggccatgtattcgaggtcgctgaccagcaggtcggtgacggccttcaggtaggcggcgcgacggtcgcaatggccgccggtgcagtccttgccctgggcatagtcggtggcgggacggttgccggcgcccggaccggtgccgttcaggtcctggccccagaggaggaactcgatggcgtggtagccggtggcgacgttggcttcggaaccgcccagctcgttcaggctggccagtttctcgccggtgatttccttgacgtcgatcttgtcttcgccgacctggatctcggtgttggcgacgatgttggcggtggcgccggggttccccagggcgtgctggtagtccttggcgacatagtcgatcaggccttcgtccagcggccaggcgttaacctgtccttcccagtcgtcgatgatcgcgttgccgaagcggaaggcttcgctctgggagtaaggggtacgagcggcgaaccaggcttccttggcggctttcagggtctccgcgtcaggcttggcgaggaacgcgtcgatggctttctgcaggtccttggcggtgctcagggcatcggcgaaggtggtttcggcgagttccgcgtagttcttgatcaccgccttggcggcggcctcgtcgaccttggcggccggggccggcggcgggcgcggcgggctgcatgttggccgccggtgttgcgggcgcttcggctttcttgtcgtcgccgcagccggcgagggagatggcgaggcccagcagactggcggtggccaggggcatacgagtcatggcggattcctttgctttattggtggcgtgccgaagcggcgcgcgcttgtcggaaacacccgcgagggcgttaa

SEQ ID NO: 7569 - DNA, 996 bp, Pseudomonas aeruginosa
tcgctcgtgtcgctggcttcaaggccgccgagctgttgcagttcagcgaggcggagaaggccgacgtcgatctcaaggccctgttcggctgagatggacttcgacctgcgctggctgttcatcgccgccagcctggggctctgcgcctgggccggctggcagttcgtgcaccgccttgcccgggcgcgtctgctcggcgacgtaccgacctcgcggatccgttcggcggcgcagggtttcgtcgaactctacggggtgctcgaggagggcccggaaggcccgctgcaggctcccttgaccggcaagccgtgcctgtggtggcgctaccgcatcgaagtcgaggaaaagcgcagtggccgcgagaaggcctggcgcaccgtcgacaaaggtgccagcgagtcgccattcggcttgcgcgatgccaccgatgcctgcctggtcgacccacgcggcgccgaggtgcgacccttgacccagcagcgctgggaggcttttcgcgaagcaccgatcgataccctgcgactgctggagagcttcggcaccctggtcggcggagagcggctctaccgctacaccgaggagcgcctgcatgccggcgagccgctctatgcgctgggcgaattccgcagcagcggtggcggtcgccagggactcgatgccgaacgggcgcagggtgcggtgatccgtgaatggaagggcgatttccacgggctgctggcgcgcttcgacagcgacggcaacggcgagctggacgagcgcgaatggaaccgggtgcgcctggcggcacggctggaggccgaggatcggcatcgggcaagcagcgccgcgccgacccgccaccggctcggcaagccgggggaggcgcatcccttcattctctccagccagggcgaggacgatctcgccgtgcaactgcgccgccaggcggcgggggctgcgttgctctgcctgggcagcgcgctattggcgggctggctgttcagccgcctgttctga

SEQ ID NO: 7570 - DNA, 2001 bp, Pseudomonas aeruginosa
tcagggccgttcgctgctggtggcctggctcaggcgtcgcgcctgcttgaggtactgggtcagttccctggccggcagcggcttgctgtacaggtagccctgaccttcgttgcaaccttcggcgatgatgtacgcctcctgctcggcggtttccacgccctcggcgatcacctgcatgcccaggctcttgccgagctggatgatggcgcgaacgatggtcgcgtcgtcctcgtcctgcagcaggtcctggacgaaactcttgtcgatcttgatcttgtccagcggcaggctcttcaggtagctcagcgaggaatagccggtgccgaaatcgtcgatggcgatcagcgcgccggcgcggcgcaggctgaggaggtgctgggcggcagtggagatgtcctccatcaggccggtttcggtgacttccagctccaggctgcgcgccggcaggcggtagacctgcagcaggttgctgaccacccgtggcagggcgttgtggtggagctgcacggtggaaagattgaccgccatgcgcaggtcgtcgaagccctggtcgtgccattcgcgcaactgccggcaggcctggtcgagcacccactcgccgatgctgaagatgctgccgttctgttccgccagcgggatgaacaggtccggcgggacgaagccgtgcaacggatgttgccagcgcagcagcgcctcgacgccgaccacgcggtggtcgcggtagtccacctgcggctggtagacgaggtgcagctcgtggcgctgcagggcgtcgcgcaggtccttttccagttcccggcggcgacgcatctcgctgtccacgctggcgatgtagaactggtagcggttgcgcgagcgggtcttggccagggtcatggtctgctcggccttctgcagcagtttctccgtggtctcgccgtcctcggggaacagggtgataccgatggtggcgcgcaggcgcacctcgtgctggtcgatctcgaacggcgcttccaggccgtcgaggatgctctgcgccagttcggccgcctcgtagggttgctcgatgtcggcctggaccagggcgaactggtcgccgcccaggcgcgccagcgaaccgagccgcgcgctgtgcccgcgcaggcggtcggcgagggcgatcagcagctggtcgccgagctggtaggtgtactgctcgttgatccccttgaaatcgtcgaggcccaggcacagcactgccacccggcgctgctggcggccggcgccgtcgaggatctggtcgagttgctgctgcagcaactggcggttcggcaggccggtgaggaagtcgtactgggaaatgcgcagcaggttgtcctcggcctcgcggcgcaggtggctgttgctttcgatcgaggcgagcaactggttggcggtggtcacccagagccccagctcgttgcgttcgtgccccttgagcagcggcaactggtgctggctggggcggtcgggattgatgctgaccaggtgttcgatgatcttcgacagcggcttggtcagcatccagtggtagaccaggaacagcaccaggcccatggccagggcgcggagaatgccggagatgaagatgatttccgaagtggtgacgaagttctcgccgtagggcgcggtgtccagggtgatcttcaggtcgccgtagtattcgctatagggcgggcggccgatcagtcgaatgctgaaggtgcgttcctggccgaggatcgggtcggtcagccagcgcgtcggcaggtccagcagcggcctggatttctccgccagcatcggctcgccgggatggccgatgctcgcctggcgcaccgcctcgtgctggaacaggccttcgaggacctgcatcgccatttcccggtcgaggctgtagaccgcctgggtggaagggtcgcggaccatcgcgaggatgcgttgggcgtcgctgctcaccgcctgcttggccttgtaggcgtcgaagacgatctgcgcgcaactgagcactacgccaacggctag

SEQ ID NO: 7571 - DNA, 1176 bp, Pseudomonas aeruginosa
tcagactcaggcagcgaaattcttcgctacgaagtcccagttgaccaggttccagaacgcctcgacgtacttcggacgcaggttgcggtagtcgatgtagtaggcgtgttcccagacgtcgcaggtcagcagcggggtgtcgccgctggtcagcgggttgccggcaccgatggtgctggccagggccagggagccgtcggccttcttcaccagccagccccagccggaaccgaaggtgccgacggaagtcttggtgaactcttccttgaacttgtcgaaggagccgaaggcggcgttgatggcgtcggccagggcgccggtgggctggccaccgccgttcgggctcaggcagttccagtagaaggtgtggttccacacctgggcggcgttgttgaagatgccgccggaggagctcttgacgatctcttcgaggctcttgccttcgaactcggtgcccgggatcaggttgttcaggttcaccacgtaggtgttgtggtgcttgtcgtggtggtattccagggtttctgcggaaatgtgcggctcaagggcgttcttttcgtaaggcagcggcggcaattcgaaagccatggtgtctctcctattcttcctcaggtcaggactggcgcggctagcgcgcgaccggttcacggggccggtccgatgcctgtccgggagcccgtcctggatccccggggggacgttcggcggagcgctccggaaagggcgccgggtgcgactcggagcctaggctcccagtgccgcgaactccggatcatagcacccgtgtcggggcatatccacgcagcaactgtaggggcaaaggccggcggcggcgcgctgcgacgggcttctgcaagctcgccggcgaacaccgccgcattctctctggactgcctggcggcgcgagggttcgctcgggaagacggaaactgcgttatccccggaacagcagttgcgcggccatgcccagcatcatggccgccaccatcaggtcgagcaggcgccaggtggccgggcgcgccagccagggggccagccatgccgcgccgagggcgagggcgaagaaccacatcagcgaggcgctggccgcgccgagggcataggcgcccggcgcggcctgctgggcgccgagcgaaccgatcagaagtacggtatcgagatagacgtgggggttga

SEQ ID NO: 7572 - DNA, 474 bp, Pseudomonas aeruginosa
tcgccgggattgagttcgggagtgagcgtgcgcagcagggtgcgcagcgaggtttcgccagccatggtcggtccgcgtcgggtggatcggaaaagtgctggcgagtgtggccgcgggcggtttataaggaaaacgaatcctgctgatctctcattaggaaaactgattttgttcgactacaagttgctcgccgcgctggccgcagtggtggagcagggcggtttcgagcgcgccgcacaggcgctggggctgtcgcaatcggcggtatcgcagcggatcaagctgctcgaggcgcgggtcggccagccggtcctggtgcgcgagacgccgccgcatcccaccgatctcgggcgccgcctgttcaaccatgtgcagcaggtgcggctgctggagggcgacctgcagcgctgggtgccgaacctggatgaaggcggtgccccggagcgcctgcgcatcgctgctcaacgccgatag

SEQ ID NO: 7573 - DNA, 1449 bp, Pseudomonas aeruginosa
  unsure (143): Identity of nucleotide at the above locations are unknown.
aatagccgccgggaccctggtagtccagcaggtggcgcactgccaggagcacgccgtgcagggtcaggtcgtacacgttggccgtctccaggcgcgccgtgcggcgttcgccgcgggcgttgcgcgcctcgccccagacccangtgcgcaggcgctcgcgggccgcctggtcggggcccggcgatgcgtttgtcgacctgccccttgagccagtcctggacccgttgccgaccgagcagcggacgccagcggatcgatcaggcgcatgcccaggcccagcagcggcggcgccggcaggtagacctcgatgtccgggatgccggtgctgtagtaggcggtggccacgtcgccccagggaatcgtcacggcgtgccgcaggccgcggccgaaatcgatgtcgcggcgcttgtagcccaacggcacgtcgcgcaggcggccattctcgcggatcttgccgccgaacttgaggccttcgacgctggtcttcgcggttcccgtcgaaagcccgctgccggtgtcgaagcccagcgccagccgttgcgcgtccggcagcgcctccttcaggcaggcggccaggcaatcggtggggatcacatcgaagccgacgcccgggcagaccacgatgccggcctcgcgggcctcggcgtcgccggcgtgggcctgctcgaacaccgcgatctctccagtgatatccacgtagtgggtgccggcggcgcggcaggcggcgatcatcggcgtgctggtggcggagaacggaccggcgcaatgggccaccaccttcacctggtccagggcttcgcggcaggcctgcggatcccccaggtcgaagacccggcactccagcccgagctggctgccgagggcgtgcagggcggccgggttgcgtccgccgaggagcggcgtcaggccctcgcgctgcgcctgttcagcgaccagccggccggtgtagccgttggcgccgtagatcatccagtgactggccatggtgcgtctcccagcgtgcaggtggctttcaggttagaccttgtagcgcgcagcgccgcttctgtcgcccaacgcaagtcgtgccggcggcccgcaaggtcgttgttctggcatgctgtgccagtggtggcgcggctccgggttgctagagtcgcggcacaagaagaacaacgggagaaacgcaatgcggattctggtaacgggggcgacgggcttcatcggcgggcgtttcgctcgcttcgccctggagcagggcctgtcggtacgggtcagcggtcgtcgtgcggacgcggtggaacatctggtggcgcggggcgccgagttcgttcccggcgacctcgccgacccggcgctggtcgtgcgcctctgcgaggatgtcgaggcggtggtgcattgtgccggcgcggtcggagtctggggaccgcgcgaacgcttcctggcggccaacgtcgggcttgccgatag

SEQ ID NO: 7574 - DNA, 519 bp, Pseudomonas aeruginosa
gagtcgtttagattctcggtcaccggccagggaggccattggtcccttcctctgcctggaatccgccatgagcgcattgcaaccatcccgttcctaccgcatcaccggttattcccccgccatcagcaacggctatcgccaacgcctgttctccatggggcttctgcccggcgcggcgctgcgcgtggtgcgcatcgccccgctgggcgacccgatccaggtcgagacccgccagaccagcctggcgctgcggcgcaaggacctcgccctgctgaccctcgtcccgctcgactgaccccgcccggaatccccatgaccgcattgaccctcggcctgatcggcaatcccaactccggcaagaccaccctgttcaaccagctcaccggctcgcgccagcgggtcggcaactgggccggcgtcaccgtggaccgcaaggagggtgcgttccataccgtccgtcacgcggtacgcctggtcaacctgcccggcacctattctttgaacaccgtttctgcctag

SEQ ID NO: 7575 - DNA, 2094 bp, Pseudomonas aeruginosa
gcctcgctggacgagcagatcgcctgccgctacatcgccagcggcgaaatggacgtgctggtcaacgtggtggatgcggcgaacctggagcgcaacctgtacctcacggtgcaactgcgggagatgggcatcccctgcatcgtcgcgctgaacatgctcgacatcgcccgtagccagcgcatccgcatcgatatcgacggtctggcgcggcgtctcggctgcccggtggtgccgctggtatccacccgcgccgatggcatcgacgaactgaaggcggccatcgactccctacagctcccgcaggcggcgctggcggtggattacccaccggccatccaggcgcaggtcggctacctcctggaaacgcgcgctccggcggcctcggccatcgagccgcgctggctggcgttgcaggcgctggaaggcgacatcttcaacggcccggcgctgggcttgccgcccgccaccctggaacaggcgcgccggggctgcggcgaggagcccgagctggcgatcgtcgatgcgcgctaccagcttatcggcgagatctgcgcggcggtctgcgaccaccagcaggctcagccgcaccggctgacccaatggctcgaccgggtcgtcctgaatcgctggctgggtctgccgatcttcctgctggtgatgtacctgatgttcttcttcgccatcaacatcggcggggcgctacagccgatcttcgacaagggctcgtcggcgatcttcatcgacggcatccagtggctgggtatccgcttcggcctgcccgattggctcacggtgttcctcgcccagggcatcggtggcggggtcaacacggtgttgccgctggtgccgcagatcggcttgatgtacctgttcctctcgctgctcgaggattccggctacatggcacgcgcggccttcgtcatggaccgcctgatgcaggcgctgggcctgccgggcaagtcgttcgtgccgctgatcgtcggtttcggctgcaacgtaccgtcgatcatgggcgcgcggaccctggacgcgcagcgcgagcggctgattaccatcatgatggcgccgttcatgtcctgcggcgcgcgcctggcgattttcgccgtattcgccggggccttcttcggccagggcggcgcgctggtgatcttctccctgtacctgctcggcatcgtcgtggcgatcctcaccgggctgttgctcaagcacactttgatgcgcggcgaggcctcgccgttcgtcatggaactgccgctgtaccatgtgccacaccttaagagcctgctgctgcagacctggtcgcgcctgcgcggcttcgtggtgcgggccggcaaggtgatcatcctggtcagcctggtgatcggcggcctgaacagcatcaccctcgacggcaagccggtgcagggcgacatcggccattccgcgctggccagcgtcagccagcgtctcactccgctgctggcgccgctcggggtgcagccggacaactggcaggccaccgtcggcctggtcaccggggcgatggccaaggaagtggtggtcggcaccctgaacaccctctacaccgccgagcagatccagggcgaggccttcgactacgaaggctacgacctgcccgggcaactgcgcgacgccctggtcgaaacctgggacggcctggtcgataccttcagcctcagcgtgctggccaacccggtggaggcgagcatggccgacggcgacatggagaccggctcgatgggcaccatggcgagcaagttcggcagccccatcgcggcctacagctatctggtcttcgtcctgctctacgtgccctgcgtgaccgccatgggcgcgatcgctcgggaaagcagcaagggctggatggctttctcggtgctctgggggctgaacgtcgcctactcgctggcgaccctctgctaccaggtcgccaccttcgccgcgcaccccgagcgtagcgtcctgaccatcgccgtggtgctgctcttcaacctgatcctgatgacctgcctgcgtctgttcggccgtgagcaggtactgcaactgccaggccgaatggccgatgccccgagcgggcagggaggatgtcactga

SEQ ID NO: 7576 - DNA, 669 bp, Pseudomonas aeruginosa
tactcggccatcagggcgttgggcacgcggccttcatcggcgcggcagcgagtcagcggcgccatgacgatgcggttgggcagctcgaggtcgccgagcacgatgggatcgaacagagtagccatggaacatcctccactagggaatagacggacaggggatcaatcgaggaccggctgcgcctgggcgcggccgtttccggaaaaggcgatcagggtggccagcagcgccagcgcggccagcgcggcggcggccagcggcacgcgggtcaggcccaggccgtggtcgatgacgctgccgccgacccaggcgccgagcgcgttgccgacgttgaaggcgccgatgttcagggtcgccaccaggttcggcgcggcatgcccgacgcggaccacgttgacctgcagcgcgggcaccgcggcgaaggcggcggcggcccagaagaacagggtgatttccgccggcagcagggcctggctggtccagctgaacagcgccgagaccagcgccatggcggcgaacaccgcggccatggtggtgcccaggcgccagtcggcgaggcggccgccgatcacgttgccgacggtcaggccgacgccgatcagcagcagggtccaggtcacgccgcgcgggctgaccccggtgacttcgccgagcagcggcgcgacgtag

SEQ ID NO: 7577 - DNA, 519 bp, Pseudomonas aeruginosa
gctagcccgcatgaactacctcgcgcatctccacctcggcggcccgcaaccggcccaactgctcggcagcctgtacggcgacttcgtcaagggccgcctgcagggacaatggccggacgagatcgagcgggccatccagttgcaccggcgcatcgacgccttcaccgacagccacccactggtgcatgcggccaagcggcgcttcccgctggagcgccggcgtttcgccggcgtcctgctggacgtgttcttcgaccactgcctggcgcgcgactggaacgactacgccgacgaaccgctgccgcagttcgtcgagcgggtctacggcaccctgcgcaccgcctcgccgctgccggagcgcctggcgcgcatcgcgccgcggatggcggcccaggactggttgggcagctaccgcgagttcgcggtcttgcgcgaagtgctgggcggtatgtcgcggaggctgtcgcgaccgcacctgctggacggctcctgggaagaactggcccagcgctacgatga

SEQ ID NO: 7578 - DNA, 1074 bp, Pseudomonas aeruginosa
cctgagcgcggatttccgcgccttctacccgcaactccaggctttcgccctgagccagcgctgagcctggcgcagcggccattggcccggccggcggaatcacctatcaattgtttcagtccgaagcatccgcttgatgcacatcaaccggcagcggtcgcgtcgatcgttcaatggggccgacgttcaacgctctgccaatggaggtggaagatgaaacgaatcctggtggcgaccgacctgtcctcgcgttccgagctggcggtcatgcgcgccgcggcgctggccaaggcgaggaatgccgaactgaccgtgctgaacgtgctcgacgacgaccagccgccggtgctgatcgcgccgcaacggctggccatcgccaacctgctggaagtgaacggacaggccctgaaggagcgcctcggcgtcgagtccaaggcgatcgtgcgggtcggcgatccggtggtggtgatcaacgcggtggccgaggagatcggcgccgacctgctggtgatgggcgcgcaccggcacacgccgctgcgcgacctgttcatcggcaccaccctggagcgggtggtacgcaatgcgaagatcccggtgctgcgcgcggccggtgcgccggaagaggagtaccgccgggtgctgctggcgctggacttctcgccgacctcgacgcgcgcggtgcagatggccggccagctcggcttcctcgacgccgccagcctcaccgcgctgcatgccttcgagccgttcgccaaaggcatgatgcgttattcggggatcaaggaagaccgcgtcgagcattacgtcgaccaggaggaactcaaggccaacgtcgagctgcgcgactacgtcgccggcctggggctgggccgcgaggacatccagttgcgcgtcggcgaaggcttgccgatcaacgtgatcatgaccgaggtacgccgccaggcgccgcagttgacggtgctcggcacccagggcctgaccggcttccgccgcgcgctgatcggcagcgtggccgaggcggccctcggcgacctgccgtgcgacgtgctggcggtgccgcccaagcgcgactag

SEQ ID NO: 7579 - DNA, 1266 bp, Pseudomonas aeruginosa
tcagcgccttcctctactggatcgagaacctcgagtgcggcatcgacctgctcggcccggacgactaccgcatgccaggctgagtccgcgcttcctggcgtcatcgaggccatgctagggttgcccctcgaccgtcgagagggcccgccgatgcccgctttgccgttgtcccgccgcgccctcgccgcgctggccctggtattcgccctccctgccctggccgaagactggcccgacaccgactggccccgtgcccaacagcccgcggggccggcgctggaggcattcgagcgctatgccttcggtcgtcgcgacgatgttcgtcgcaaaggcatccgcaccgacgcggtagtggtgatccgcgacggtcgtctggtctatgagcgctacgccggcccgagccgtgcagagaccccgcaccttacctggtcggtgagcaagagcctgctcgccacgctgcttggcgtcgccgagggcgaagggcgcttccagctcgacgacccggtggcgcgctactacccgccgttcgcccgtcatcccgaggtgacgttgcgccacctgctgaactggtcttccgggctggactggcaggaggactacgagttcgcgccattgaaatcctccgtggtggcgatgctctacacccgtgggcgtgacgacatggccggcttcgtcgccgaaaccccgcaggcccggccgccgggccggcgtttccgctactccagcggcgacagcaacgtgctggcggcggccctccacggcatgctcggcgcggactatgccgagtacccctggcgcgcgctgttcgagccgctgggcatccgttcggcggtatgggagcgagacgccgccggcacgttcgtcggctcgtcgtacgtctacatgagcgcccgcgacctggcgcgcgtcggcctgctgatgcagcgccacgggcgctggcgcgagcggcaactgctgccgctggcatgggtcgagttcaacctgacgcccttcgcccgctaccggccgagcgcggaagaggagggcgaggcggtgccgggcggccagtggtggttgaaccgtgcggtgaaaggcgcgccggcgccctggccggacgtcgccgagaccgccttcgccgcgctcggccactggggccaggcgctctacgtgctgcccgaggagaagctggtgatcgtgcgctacgccgacgaccgcgacgggcgtttccgccacaacgaattcctgcgcctggcacaggcggcgttcgccggggaggcgcggccatga

SEQ ID NO: 7580 - DNA, 1041 bp, Pseudomonas aeruginosa
cctgcgccaggacatccacgcccatcccgaactgggcttcgaggagcgacgcaccgccgcgctggtcgccgaatgcctgcgcggctggggctacgaagtgcacgaagggatcggccgcaccggcgtggtcggcgtcctccgccagggcgacggcacgcggcggctcggcctgcgggcggacatggatgcgttgccgatcgtcgaggccacggggctcggctacagcagctgccacggcgggcgcatgcacgcctgcggccacgacggacacaccgcgatgctgctcggcgcggcacgctacctggcggcgacgcggcgtttcgacggcaccctggtactgatcttccagcccgccgaggaaggccagggcggcgccgaggcgatgctcgccgacgggctgctggagcgctttccctgcgatgcgctgttcggcatgcacaacatgccgggactggaggccgggcacctgggcttccgcgcgggaccgatgatggcttcccaggacctgctgagcgtcaccctggagggcgtcggtggacacggttcgatgccgcacctgagcgtcgatccgttgctcgccgcgtcgagcgcggtgatggccctgcagagcgtggtggcgcgcaacgtcgatccgcagaaggccgcggtggtcacggtcggcgcattgcaggccggcgaggcggccaacgtcataccccagcgcgccgtgctgcgcctgagcctgcgggcgctcgacggccaggtgcgcgagcaggtgctgcagcgggttcgccagatcatcgagttgcaggccgccagctatgggtgccaggccagcatcgagcactacccggcctatccggtgctggtcaacagcgtcgaggaaaccgagttcgcccgccaggtcggggtcgagctggccggcgcggagcaggtcgacggcgacacgccgaagctgatgggcagcgaggacttcgcctggatgatacagcgctgccccggcagctacctgttcatcggcaacggcagaggacggccgatggtgcacaacccggcctatga

SEQ ID NO: 7581 - DNA, 366 bp, Pseudomonas aeruginosa
gcgccacccgccatcgaagcgacggccacgaggaaatcgtcgcgcttgacgcgctgccgctgtccgcggcgatccgccgacgcgaactgtcctgccgcgaggtcatgcaggcctacctggcgcagatcgaacggttcaacccgcgggtcaacgccatcgtctcgctgcaggcggaaagccgcctgctcgcccaggccgacgagcgcgaccggcaactggcgcgcggcgaatggctgggctggatgcacggcatgccgcaggcgatcaaggacctcgccgccacctccggcattcctaccaccctgggttcgccgctgttcgccgggcaggtgccggagcacgacgccatcgtcgtcgagcgggtga

SEQ ID NO: 7582 - DNA, 795 bp, Pseudomonas aeruginosa
tccgcgcggtggccttgccggtacgcgcccagggtcgcctgctcggcagcgtggcgctgcactggccgcgcgaccaggattgcgtcgaacgggtgcgccgccggcacctgggaaccctggccgataccgtcagtcagttgcagcacgcgctcgactgacgcgggagtttgcctgctcccaggcggccggtttaaggtggcgccggacgcaaagggagcccgcatgcacaagttgatctgcctcggcctggccctcctggccttgccggtccaggccgcctggtacctggactacgagtcgtcgcgactcagtttcatctccaccaagaacgctaccctttcggaagtcggccgcttcctggtcatgcacggcaaggtcgacgacaaggggcaggcgcgcctgcgcgtcgagctggactcggtgagcaccgacatcccgctgcgcgacgaacgcatccgcgagcatctgttcgagaccaagcgcttcgccgaggcggagatcaccgcccagctcgacctggcgccgatcgtcgagctggccgacggcgtgcaactggaaatgcgccagccggtgaccgtcagcctgcacggcaagcgcaagagctacgccagcgacctgttggtgacccgcctggacgagcatcgcttccaggtggtgaccctgtcgccgctggtgctggacgccgccgacttcgacctcgcccccggcatcgagaccctgcgcaagctggccggcgccggcagcatcgggctctcggtgccggtcggcgccgtgctgatcttcacttcgcggtga

SEQ ID NO: 7583 - DNA, 585 bp, Pseudomonas aeruginosa
tggccagcgagagctacgggatcccctggaccggcctgctgcaccgcaatccgttgctgcgcctgccggaattccttggcggcatcctggcctacgggttgttccgcggctaccgcgaccgtggcatggtgccgggacgcggcctgctggccgcgctggtggcgctggtggtggcggccttcctggtggccgactacctgttcacccagggcgccaaacattggtacttcctgctgcacaacggcctgctgctgccggcccagttgctgctggtgtgcctttgcgcgctgcccgccgacccgaagagcgctttcgtccgccactggtcgccgcgcctgggggccgcctcgctgtcgctgttcgccctgcatgtgccgatgttcaccctgttctcccgtagcgagcgccttatcgccgtgccggggcgttgtctcgacgactggcgcgcctgcaccgaggcggcggccgcgttgccatcgtcgctgctctactacccgctgttcctggtcctgctggtggcgttctgcgtgctgttccaggagcgcggcgtggtgccggtgcgcaagtggctggtgcgccggctga

SEQ ID NO: 7584 - DNA, 627 bp, Pseudomonas aeruginosa
gtgcatccccggtatgaccgggccctgcccgaaggagtgcgcgtgatggctgcgaagaagatcctgatgctggtcggcgactatgccgaagactacgaaaccatggtcccgttccaggccctgcagatggtgggccaccaggtgcatgcggtgtgtccggacaagcgggccgggcaaagcgtgcgcaccgccatccacgatttcgaaggcgaccagacctacagcgagaagccgggccacaacttcaccctcaatgccgactttgcccaggcccgcgccgaggattacgatgccctgctgatccccggcggccgcgcccccgaatacctgcgcctgaacgagcaggtgctggctctggtgcgtgacttcgacgccgcgcgcaagccgatcgccgcggtctgccatggcgcccagctgctggccgccgccggcgtcctgcaagggcgggcgtgcagcgcctatccggcctgcgccccggaggtgcggctggccggcggcgaatacgtcgaccttccgccggaccaggcccacgtcgacggtcacctggttaccgcgccggcctggccggcgcatccggcgtggctggcgcgcttcctcgaggcgctcggcacccgcatcagccactga

SEQ ID NO: 7585 - DNA, 1041 bp, Pseudomonas aeruginosa
ccctgctgtatgccgacgacgatctcgacgaggccttgcagcgggccgaccaggcgctctaccgtgccaagcgcggcggacgaaaccgctgcgacgccacctgggaggtcaccagtgcctgacatacgggtcggcgagcgacgccttgccgtcgccgccggcagcaacctgctggatgcgctgctcgccggtggcatcgccgtgccccatagctgccgcgccggaagttgccacgcctgcctggtgcattgcctgcagggcgaggtggacgacaccctcccggaggcgctcgatccggcacggcgcgaagcgggctggcggctggcctgtcagtgccgggtgctcagcgacctcgtgttgcagcctttcgatcctgagcgcgacgggctgccggctagggtcgtagcctgccactggctgggcgatgtgctgcgcctgcgcctggagccggagcggcccttgcgctatcgcgccgggcagcacctgctgctgtggagcgacgatggcgtggcgcgtccctattcgctggccagcctgcctcacgaggacccatggctggagttccacatcgactgtagcgctcccggcgcgttctgcgaccgcgcccggcgcctggcgcctggcgcgctcctgcgtctgggcgagttgcgcggcggggcgttgcgctacgagccggactggcaggagcgaccgctgttgctgatggccgccggcaccgggctggcgccgctctgggggatacttcgcgaggccttgcgcgcggaacaccaggcgccgatccagttgctgcacctggcgcgcgaccactacctggcgagcgagttggcggagttggccgggcgtcatccgcaagtgcgcgtcaacctggtgtcggcggcgcagttgccctctgccttggccgatctccgccttgttccgcggcgcagcatggccttactctgcggccaacccgccagcgtcgaacgcttcgcccggcatctctacctggccggcgtaccgcgtagccagaccctggcggacctgttcctgccccacgcctga

SEQ ID NO: 7586 - DNA, 1248 bp, Pseudomonas aeruginosa
ggatggccagggtgttcagctcccgcgaacgcggcaactgccctttctcgcgcgcctcgcggcggcgtttctccgtgggttcctctgtcttgtcctgcccgctctcgctctcggccatggctatttcgcccgcaccagttcacggaggaattgcagggtctcgccggccagcacctggtactggctgagcaggtcggcggtgccgatccagaggatcaccaggcccagcaccagggtcaacggaaagccgatggagaagatgttcagttgcggcgccgcgcgggtcatggcgccgaaggcgaggttcaccaccagcagcgcggtgatcgccggcagcgccagcagcagtgccgcgcccatcacccagccgagcttgccggcgatgatccagaaatggttgccgctcaggccctcgcccaccggcagggtgacgaagctctcggcgattacctcgaacactaccaggtgtccgttcatcgccaggaacagcagcgtcaccagcatggtgaagaactggccgagcaccggcaccgagacgccgttggccgggtcaaccatggaagcgaagcccaggcccatctgcatcgagatgatctgcccggcgatcacgaaggcgtggaacaacaactgcagggaaaagccgagcaaggcgccgaccaggatctgctcgccgatcagcagcatggccttcatgctcagcgcgtccacctgcggcatcggcggcaggttcggcaccagcaccacgcagacgcccagcgccaggtacagtcgcacccgcaccggcaccagctgggtgccaatcaccggcatggtcatcagcagcgccgcgacccggaacagcggcagcacgaagctggcgatccagccgccgatctgcgcgttggtcagctccagcatcagccgatcagcagcgggatgttgccgatcagcgtctgggtgtattccatcagctgccgcagcagccaggggcccagcacgatcagggtgagcaggatcaccatcaggcgcggcaggaagctcagggtctgttcgttgatctgggtagcggcctggaacatcgccaccacgagaccgaccagcaggctcggaaccaccagcacgccgacgatcatcgccgtcagccacaacgcctcgcggaacaggtcgagtgccacctcaggggtcatgtctctctccagcgcgccagcggcgcgtcaagccggcggcaccgctagacggtgccgaaactgcccgccagcgtcccgatga

SEQ ID NO: 7587 - DNA, 375 bp, Pseudomonas aeruginosa
tgtcggtatgcccgacctccatggaaatggtcaccgggatgtccaggatcacatccaggttgggcccctccaggccggaaatggtcggtgccttcggcgaagcgccgaactcttccatcggcgcccgcggggtactcgactccgccacgggagtcgcgccgccctgggccatcagcgcatcgatgtcgtcctggctggcgtcgcccgcctcggccagcgccgccgcccactcgtcggccagtgcctgttcctcggtggtcactttttcttcgtctgccatggttcgtctttcctccgggggaagcggtcagcgcgagcgctcgaccgcttcgagaatctgtagcgccaggttgcccttgtgggcgcccagcttga

SEQ ID NO: 7588 - DNA, 2046 bp, Pseudomonas aeruginosa
tcgaccagaccgcgcgccgccgacgcacccggccggctgcggatctcgctgactccggcgagggtttcctcatcgcccgaggcctcgccggccaagccgcgtccgcgcgccgatccgccctcgccctgctgctggccctgccagccccgcgccagcgactggtcggagacgttcacgtcgagctggttcatgccctgctggctgaacatgtcgcgcagccggtgcatctggctttccagggcgtcgcgaacgccggcgttgggactggcgaaggtcacctgggtctggtcggcggtcatgtggatgcgcacgtccaggcgtcccagctcggccgggtcgagctggatctccgccgacttcaggttctggctggacatccacatcacccggtccaccaccgcctcgctccagccgttctgctgtatcgccaccggctggccgggcaccgtaccgttcaccggacggttggtcagggcctgctgcgccatggcctgggtcagcccgttgagcttggccgcgaaaggctcgccgcgcggctccgccttgctctccagcaggctctcggaggcggcgctggcgatggccggctcggcggtctgctgcaactgggcctcgagcgccttgccgtcgacggccttgggcaaggagtcggaagtcaggctggcaagggcatcgccgaggttcgcctggcgcggatcggcgctcttcgccggcccgcctttcgccgcctgcgcggcgtcctgggcaccctgctccaaggccatgttcaccgccggaacgccgttgagcttgaccagggtcgggtcgctgctggcttcggtcaggctggccggagcactgctagccgtcggcacggccggcggcagcaaagtcgcctgggtattctcgtcgagcatcggcacggcgccgccgaggccgagcagttgcagcggatcgaccggcgtttcgactttatcttcgccgtcggccttggcctggccgtcggccggcaaaggcttgccgtcttcggcaacggccggttgcccggcggcatccgtcggctgcgcctcggcagcctccttgccggcgtcccgcggcttgtcccgcgaacccttggagggaccgtcggcgcgctcggcgggcttcttcgcggtctccttggcatacatgtcggagaagctggaagtcttgtcgttactaggctcaggcgttttctgctggctcttcggcgcagcggccttgggctttacatcaggcgtcggcggcaacaacacaccaggggcgacggccatgggaattctccatttgcgaagggattgcatcgtggcttgcgcaagggatggagcaaggtccgggccaacttcgccgagagcgtccgtgaaacgctcgccagggcgccgcagcaggcacgctcgctttgcccgcaggtcccgtctggactacaatccagagccgcatccctcccgaggtagtaccctgatgtccttcgccgaaaaactgtcccgtctgcaagccttcctcgatgccgatgacctgcacgaagaagcgctggactacgtggcgacccacggctacctgaccgccctctccatctgcccggagcaggtgccggagcgggagtggatcgacgccctgttcgccgaaccgccgcactaccgcagcgatgaggagcgccaggagatcgagacttccctcgagcagctcaaggcgcacatcacccgcgtgctggccagcgacgaagacctcgagctgccctgcgacctcgacctcggcgacgagccggacgactccgacctgcgcggctggtgcatcggcttcatggaaggcgtgttccttcgcgaggaagtctggttcgagcaggccgaggaggaagtcagcgagctgctgctgcctatcatggtcggctccggcctgttcgacgagcagcccgagttcgacgagatcgcccgcgaccgccacctggtggacgacatggtcgcgcagattcccgacctgctgaccaacctgttcctgctctgccaggcgccggaagaaaagcccgccctgctcaagccgcgcacgcactaa

SEQ ID NO: 7589 - DNA, 408 bp, Pseudomonas aeruginosa
cgatggacaggccgaggccgtggttggcctcgctgttgctgcgcgccgcgtcgacccgatagaagcgttcgaacaggtgcctgcggtgctcgtcggcgatcggcacgccggggttgctcaccgccacccgcacttcgtcgccgcgccgctcgacgccgacccgcagcgtgccgccggcggcggtgtgctgggcggcgttgtacagcaggttggtcaccgcccgctggaacagggcgcgctcgaccagcgcgcgggcctcgccgcgcacctcgataccgaccccggcctcgtcgaagatcacctcgaggaaatccaccgtggtggcgatctcgccggccagcgaggtttcctcgcgctcgcaggccaggcgtccctggtcggcgcgggcgaggaacagcatgtcgttga

SEQ ID NO: 7590 - DNA, 363 bp, Pseudomonas aeruginosa
cccatgccccggatggtatgcagcagcttgttctcgaacggaccgtcgagcttggcgcgcaggcgcttgatcgccacctccacgacattggtgtcggtatcgaagttgatgtcccagaccagttcggcgatcgccgtcttcgacaggatctcgccgctgcgctgggccagcacgcagagcagcgcgtactccttggcagtcagctccagacgggtgttgccacggaagaccttgcggctgagcaggtcgatggacaggtcggcgatgcgcatctgcgaatggctttcatggttgccgccgcgccgggtcagggcctgcaggcgggcgaccagttcgaggaaggagaacggcttgatcaggtag

SEQ ID NO: 7591 - DNA, 3171 bp, Pseudomonas aeruginosa
ccacgcgccgccgtccaggaaagccgcgtccgttacgcctcatgtcgccgtcgccccagcggttccgccgtccgaggtcgtggtcccgcgccggtggaacagccgctccagggccaggtataccaccggcgtgctgaacagggtcagcacctggctcaccagcagcccgccgaccaccgcgatgcccagaggctggcgcagctcggaaccggtgccgaagccgatcatcaggggtatcgcgcccagcagcgcggccagggtggtcatcatgatcggccggaaacgggtcaggcaggcctggtatatcgcctgctccgcgctcatgccctgctcgcgctgggcgacgatggcgaagtcgaccatgaggatgccgttcttcttgacgatgccgatcagcagcacgatgccgatcagcgccatgatcgagaagtcctggccccaggcccagagcacgaacaccgcgccgatccccgccgagggcagggtcgagaggatcgtcagcggatgtacgaaactctcgtagagcacgccgaggatgatgtacaccgcgatcagcgcggcgaggatcagcagcggttgcgaggccagcgagctctggaaggcctgcgccgcgccctggaacacgccgataatggtcgagggcatgccgatctcctcctgggcgcgctgcaccgcctgcaccgcctcgccgagggacaccccggcagccaggttgaaggacaggttgaccgccgggaacatgccgttgtggttgatctgcagcggcccggagcgcggcgccgcgaccttggcgatggccgacagcgggaccatctcgccgctcagcggcgagcgcaggtagaaccagtccaggctttccgcgcggccgcgctggcgcgcatcgagttcgaggaccaccttgtactggttgacctcggtctggtactcgccgacctggcgctggccgaaggcgtcgtagagggtctggctgacatcctcggcgctgaggccgaaacgcgccgcggccacccggtcgatgtccagcgcggtgacgctggcgccgacctgcaggtcgttggacacatccatcagccccggcacctgcttcaggcgctcggtgaggcgttgcgcccagagcgccagctgggtgctgtcgctgctgcgcagggcgtactggtactgggtccgcgagggtccggaactgaggttgatgtcctgcgccgcgcgcaggtagagcatgattcccggcaccttcgccagttgcgggcgcagccggtcgatgaactcgccgaccgagacatcgcgctcgccacggtccttgaggacgatccagaaacgtccgttggccaggctctggctaccgccggtgacgcccaccgcatggttgtagctctgcaccgccgggtcgctggcgatgatctcggccagttgccggtgcttggcgaccatgtcgtcgtaggagatatcctcggcagcctggctcgtgccgaagacgaaggcggtgtcctgcaaggggaagaaacccttgggaatcccgacgtagccggccaccgccaccagcacggtaaaggcgaagccgaccagcatcagccgctggtgcccgagcgcccagcgcaggccgcgctcgtatccgccggtcagccattcggcgaagccctttctcggcgcgtcggcatgccgcaatgccggcatgaagcgcgaagccagcatcggcgccagggtcagcgaagcgagcaccgagatcaggatcgccaccgtcacgctgaccgcgaattcgcggaacagccggccgacgatcccgcccatgaacagcaggggaatgaacgcggcgatcagcgagaagctgatggaaatcacggtaaagccgatctccgccgcgcccttgagcgccgcctcgaccttcgaggcgcccgcttccaggtgtcggtggatgttctccacgaccacgatggcgtcgtcgacgatgaagccgacggcgatgatcagcgccaccagggtcaggttgttgagggtgaagccgagcacgtacatcgccgcgaagctggcgctcagggacaccgccagcaccgtggcgacgatcagggtcgccgacagctggcggaggaacaggcccatcaccagcaccaccaggccaatggtcagcagcagggtcagttcgacctcgtgcagcgacgagcggatggtccgggtacgatcgttgagcacgtctacctcgatggtcgccgggagcatctcgcgcaggcgcggcaatgcggcctggatcgcgtcggcggtatcgacgatgttcgccccaggctggcggaggatcaccagtgccaccccgggcacaccgttcggccaggcctgcacgtagtcgtcctcgggcgccgagacgatccgcgccacgtccttgaggaacaccggcgcgccctggcggtaggcgaccaccaggtcgtcatagtcgctggcgttgaacaactggtcgttggccgcaagggtcgacacccgcccctcgccgtagagcgcgcccttggccaggttgacgctggccgactgcaacgactggcgcaggtcggccagggtcagctggtaggcggcgagcttctccggctgggcctggatgcggatcgccgggcgctgctggccgaccacgaagatctgccccacgccgttcacctggctgagctggcgggcgaggatggtctcggcgtaatcgctgagttcgatcagcggcatcatctccgagttgacccgcaggatcatgatcgggctgtccgccgggttgaccttgcgccaggtcggcaggttcggcatgtccaccggcagccgcccggccgcggcgttgatcgccgcctggacctcctgggcggcgacgtcgatgctcttgtcgaggctgaactgcagggtcagggtggtggtgcccagggcgctgctggaagtcatctcggtgatcccgggaatcgcgctgaactgcacttccaagggggtggccaccgacgaggccatggtttccgggctaccgccgggcaacaaggcgttgatctggatggtcgggaagtccgcctccggcaacggcgccacaccgagccggaggaacgccagcagccccagcagcagcgaggccagggtcagcagcgcggtggcgatcgggtgccgtatgcaccagccggaaatcccggcgcgcggcgtcacggctgccgctccgccgcctga

SEQ ID NO: 7592 - DNA, 2739 bp, Pseudomonas aeruginosa
ccacttttccagttcggcgacgcagaacaggccgagcccggccagcagcacccgcgcccactcgcccggggccaggccgaccgagccgaacagcgcctgcaacggcggcgcgtaggtatagagcagttgcagcaccacgcaggcggcgatcgccagcaagacctggcggttgccgaacaggccctcgcggctgagcaccgaatcgtagatatgccggctgttgagcaggtagaacatctcgcacaccaccacgctgttcaccgccatggtccgcgcgctctccagcccggtgccatgctccagctcccagaggaacacgcccagggcgcccgccatcatcagcagcgagaccagcagcacccgccagacgaagaacagcgacaacaggggctccgccggcggacgcggcggacgctgcatcaggccgcgctcggccggatcgaaggccagcgccaggcccagggtgctggaggtgaccatgttgatccagaggatctgcgccggcgtcatcggcagggtcaactggaacaggatcgcggcgatcacgatcagcgcctcgccaccgttggtcggcagcatgaagaggatgaatttcttcaggttgtcgtagaccgcccttccctcgcgcacggcattggcgatggtggcgaaattgtcgtcggcgaggaccacctcggccgcctccttggccgcctcggtgcccttgttgcccatcgctacgccgacgtcggcgcgcttcagcgccggcgcatcgttgaccccgtcgccggtcatcgccaccacctcgccgctggcctgcagggcctgcaccaggcgcagcttgtgctcagggctggcgcgggcgaacacatcgacgcccggcagcacttcgcgcaggcgctggtcgtcgagcaactcgatctccgcgccggtcagcgccggccggtcgatgccgatcccgagcatggcgccgatcgcccgcgcggtgtcgacgtggtcgccggtgatcatcttcaccgcgatacccgccgcctggcattcggcgaccgcggccacggcttcctcgcgcggagggtcgatgatgcccaccagggccagcagggtgaagccatgttccacgtcggcgaaatccagcgtgcgctgctccgccggcatcgcccgtcgggcgatggccagcaggcgcaggccgcgagcggcggtgtcggtggccaggcgccgccagtagtccgggtccagcggccgcaccgagtcgcccacccgttcagcctcgcacatgtcgaggatgcgctccggcgcgcccttcaggtagaccatcgcctggcctgcgtggtcgtggtgcagggtggccatgaagcgatgctcggactcgaacggaatcgcatcgctgcgtggccgttccgccgccagcgcctgcggatcgaggcccagcttgaggccgaggctgagcagcgcgccttcggtggggtcgccctccagttgccatgcctcgccctcctggtgcaggcgcgcctcgttgcacaacagcgccgcgcgaccgatctcctgcagatcgtcgcgtccggcgggatcgaggccttcgccgttgtggctgaaaccacccaggggggcgtaaccggcgccgctgacctcgattacctggtcggcggtgacgatacgctgcacggtcatctcgttgcgggtcagggtgccggtcttgtccgagcagatcaccgtcaccgaacccagcgtctccaccgccggcaggcggctgacgatggcgttgcgccgggccatgcgctgtacgccgagggcgaggatcaccgtcatgatcgccggcagtccctcgggaatcgccgaggcggtcagcgccaccaccagcatgaacatgtccaccatcggctggccctgccagagggtgccgaggacgaaagtggcgccggccagcagcaggatcgccagggccagccagcgactgaagctggcgatctgtcgcagcagcggagtggccagggtgcggacttcgcgcaacagcgtaccgatccggcccagttcggtatccccggcggtggcgaccaccactccgcgcgcctggccgctggtcaccagggtgccggaataggccatgcaacggcggtcgccgagcagcgcgtcgatggccaccgcgacgcagcccttctccaccggcaccgactcaccggtcagggccgactcgtcgacatggaagttcttcgtttcgaacagccgcaggtcggccggcacccggtcgccggaggccagcagcaccacgtcgcccggtaccaggcgttcggcgtccagcgcctggcgctggccgtcgcgcaggaccagggcatgcagcgaaagcatgtcgcggatggcgtccagcgcgttggccgccttgccctcctggacgaaaccgatcagcgcgttgaccaccaccgccaggaggattaccgcactgtccacccagaagccgagcagcgcggtgaccagcgaggcgaacagcatcatgtacagcaggacgttgtggaactgccgcagcaagcgcagcagcggcccctggcgtttcggcgcgggcaatcggttgtagccgtgcgccgccaggcggcgggcggcttcgtccgcgtccaggccggcggcggagctgtgcaatcgttccagcacccgttgcggcgggctggcatgggcgtcgcgggaagacaggggtgggatgccgttcatgggattcctgcgcctcgttctgatgaacagaactatcgggcaggcctgcgccgcaacgtttga

SEQ ID NO: 7593 - DNA, 825 bp, Pseudomonas aeruginosa
acgacactgcgcccgactctttttcccggtatcgcccatgcccaactccccgcttccttccggccgcaggctgcccgcttgcgccttcgccgacatcggcgagccctacgccgtgttccaggctcccggcggcgcgctccttgcggtggccagcgcctttcatgggcaacacccgggccgacagctcgacgtctacgaacagagcctgcgcctgtaccgcagcggcgacctcgaatgcatcgccgtcctgccggacctgggctttccgctcaacgccatcgcctggcacccgagccggcccgtactggtgatcggcggcggacgctacgacggcggcgccttcttcgaaggcggtctgctggcctgggactacgcgagcggcaagacccaatcgctgctcgccgacaaccgcgaagtgctcgcctgcgacttcgaggacgacggccggcgcctgaccttcaccgtcgcccccagcgacgacctggaggaccgaccgttgttccgccagcgccattcgctagcctttccggtcgacgccccactggtgctggacgacctgcccggcacccgcctgcccttcgactgggccctctaccctgcctcgacacaacgcgaagcagcgctgccgatcctggaaaacctagccctgggcaaagatcggcggttcctgcatcgtccaccggtgtgggacctgtgctttctcgacggccaacgcctggccatcgcccgcgccaacccccggctcgagctctggaatctggccgacgacagcctgcgcagcttcgaactggccgaacggggccagtgcctgcaggtcttccataa

SEQ ID NO: 7594 - DNA, 975 bp, Pseudomonas aeruginosa
cgccacggacgacagcctgctggtcaatctgcaactcgggtatgccgcccagcgactgttcaaggtgccgctgacaccgggacaaccgctgctcctgagcgactgccgccatctgctggcgcaatccgcccaaggcggttttctcgcccgccagatcgccctcgagggcaaagacctggaagacctcgtgctcgacccggccggccggatcatccacaggcgccgtctcggacactacgacctgttcaaccaccatctgcgcatcgaccgtggcgaagccttcttctacctggccggcaatccgccggagcagcaccaggacaagggcctgttccgcctcgacccgcagaccttcaagacccgcgaagtgctacgcctggagcgccacccggagcacttcaacaacctgcacggctgcctgctgggcaatcgcctgctgctcaacgccaaggtctacaactcgccgcatcacgcctacggtacccagcgcctgacctgctacgacctggagagccgcggcacgctctggggcgcgaccctgtccgcccaggtcagcgccttcgcgccgttgcccggcggacaatggatcgcactggcgctggtcgatggtcaggtcgaggtacgcgacctcgccagcggcgaatgtcgctggcgctaccgcacggcagacgccataccgctgtgcctggcagtcagcgacaaactcctcgccatcggtttcagccacggcggagtcagcctcctgcaggtcgcggcggatggccagctcatcggtcctccaggcgccaacccgcggcagtagcccgcagttcgccatccagcgccagtcgccggagaaacaccgggtcgtgggacaccaccagcaaggccccacggtactgcccgagcatgctttccagggcctgccgcgcagccaggtcgaggtggttgtccggttcgtcgagcagtagcagctgcgccggccggtcggcgtag

SEQ ID NO: 7595 - DNA, 198 bp, Pseudomonas aeruginosa
agcaccagggccagggccgccttcaggcgttcgccgccgctcagcgtcgcgcacggctgggcgagccgttcagccggcaagccgagttgcgccaggcgcgtgcgcagccagctttcgccgcgactgcgattgacctccagcaactgctccagcacgcctcgcccgtggtccagcacgctcagccgctggtcgagatag

SEQ ID NO: 7596 - DNA, 534 bp, Pseudomonas aeruginosa
gcggcgcccaccgtcaccgcgcaggttcccgccagcggcgcccgttgcccggccagcagccgcagcagggtcgacttgccgctgccgttcgggccgaccagcgccagccgtcgcggaccgctcaggagcaggtcgatttcgcgcaacggcccgcgcaaatgcggcaggaccgcgcccttcaactcgacgatccggcgctgtgccgccagttcggcatcgggcgaatcgagcagcagcggcgacgcctcctcgacctcccgggcagcctcgcgcacctcgcggtcgagacgctcgcgctccgcctggtgggcgttgcgcatcttgccggcgctgacctcgctacgttccctgaacccaccgagcaggatcttcgcctggttcgccgtcttgccttcgcgccggccgctggcctggcaccgctcctggcgctgctgctgttcgcgcatggccagggtctgccgcttgcgctccagacgacgctggtccaggcgacgttcggcggcctcgcgcgcctcctcccggctctgcgcgtag

SEQ ID NO: 7597 - DNA, 741 bp, Pseudomonas aeruginosa
cgcacgcgcccctggcgccggacgctgccgctggacggctgcaagtgtccggcgagcaggcgcgcgagcagcgacttgccaacgccgttgcgtcccaccagcccggtgtgccgggtgtcgaacgtttcgtcgagatcggaaaacagaaggctgccgtccggcagctggaaagagacgccatcgagcgtcagggtcgacgtattcgtcatggatacccccttgatgccatgcattcccccgggccctcgggccagggacggaaaaccggccgtgcagacacggcagcatcaattgcgcatcggacgaacacctcgtacggaaggaaagaccgcggcagtctactccgcccatgcggccctgccaatcgggcatacttttcgtttccgacagacacgaccgaccgacatggccagaccgcgcatctccgaactcttcgaacaggaaccctcgcgctggggcggccgtggcgacccctacctctggcaggaaatggccgggcaactggcggacgcgtcctggccggcttccgcagcggccctggaacacctgctcggcgagaccttcgagcgcctcagcggccattcgctggaatacgatgccttgatctacctcgcgcgccacgcccacggcggcatgtccagcggcatggtcagcccggagttctggcgcgaaacggcaatcccggaactgctcgaccgctatcggcggcggcgctcctggctgagatggttgcgccgatag

SEQ ID NO: 7598 - DNA, 1437 bp, Pseudomonas aeruginosa
gaatttcctgaccctgctgggctaccgccgcgacgagatcctcggcaaaccgcatcgccagctttgcgacggcgcctacgcgcaatcggaagactaccggcgcttctgggaacgcctgcggcgcggcgaacacttttccggccgctgcaagcgcattacccgcgagggccggccactctggctggaagccacctacaatcccgtacgcgacgggcagggtcgactgctcaaggtggtcaagtacgccagcgacatagatgccatcgtccaccaggaacacgagatgcagagcaagctagatgccctgtcccgctcgatggcgatgatcgagttcgacctcgacggcaatgtcctcgcggccaacgacaacttcctcgccaccatgggctatggccgagccgagctggccagcgccaaccaccgtcagttctgcgaaccgggctaccgcgacggcccgcagtacgccgacctctggcgccgcctgaaccgcggcgagtacgtcaccgggcagttccgccgggtccaccgcaacggccagccggtctggctggaagccagctacaacccggtctacgacgccgacggcaagctctacaaggtggtcaagttcgccagcgatgtcagcgaccgcatgcgccgctaccaggccgaggcggacaacgcccaccaggcccataccctgtccaccgagacccgtacggtcgccgaacacggcgcgctgatcatccagagcgcggtggaggaaatgctcaagatcgcgaataccctggatgcttcctcgctgaacatcggcgaactgtcacagcactcgcaacagatcacctcgatcgtcaacaccatccgcgagatcgccgagcagaccaacctgctcgccctcaatgccgccatcgaggccgcccgcgccggcgaccagggtcgcggcttcgccgtggtggccgacgaggtgcggcaactggcggaacgcaccagcaagtcgaccaaggagatcgccgacatgatcggtcgcatccagaccggcacccgcagcgtcatcgacgacatgcagcacagccaggaacaggcgcggcgcggcgtggagctggccaacgaggccggcgcggcgatcctcggcatccgcgagagcacgcacaaggtggtagaagcggtgcagcagttctcgcgcaccctcaacgccgatctctagggctcaggccaggctcatctgcgtccgcaactggtcgcggaaggcctggatcagcggctcgcgcgagcggccgcgacggaggatcagggagaatggcgcctggtagccgaaggtcgccggcagcagggcgcgcaggcgcccctgctcgacccacgggtgagcgtagtgctccggcaggtaaccgatgtagccgccggaaaggatcaggatcagttgcgcctccatgctctccaccgttcccgcgctgtgcttga

SEQ ID NO: 7599 - DNA, 969 bp, Pseudomonas aeruginosa
ggccaccccgtggacaagaatctccaccagcccctgggcggcaatgaaatgccccgcttcggcggcatcgccaccatgatgcgcctgccccatgtccagtcccccgccgaactcgacgccctcgatgccgccttcgtcggcgtgcccctcgacatcggcacctccctgcgctccggtacccgcttcggcccccgcgagatccgcgccgagtcggtgatgatccgtccctacaacatggccaccggcgccgcccccttcgactcgctgaacgtggcggacatcggcgacgtcgcgatcaacaccttcaacctgctggaagccgtgcgcatcatcgagcaggaatacgaccgcatcctcggtcacggcatcctcccgctgaccctcggcggcgaccacaccatcaccctgccgatcctccgcgcgatcaagaagaagcacggcaaggtcggcctggtccacgtcgacgcccacgccgacgtcaacgaccacatgttcggcgagaagatcgcccacggcaccaccttccgccgcgcggtggaagaagacctgctggattgcgaccgtgttgtgcagatcggcctgcgcgcccagggctacaccgccgaggacttcaactggagccgcaagcagggcttccgcgtggtgcaggccgaggagtgctggcacaagtcgctggagccgctgatggccgaggtccgcgagaaggtcggcggcggccccgtctacctgagcttcgacatcgacggcatcgacccggcctgggcgcccggcaccggcaccccggaaatcggcggcctgaccaccatccaggcgatggaaatcatccgcggctgccagggcctggacctgatcggctgcgacctggtcgaagtctcgccgccctacgacaccaccggcaacacttcgttgctgggcgccaacctgctctatgaaatgctctgcgtcctcccgggcgtggtgcgtcgctga

SEQ ID NO: 7600 - DNA, 1182 bp, Pseudomonas aeruginosa
agctctatcgcggcctgcccggcagccgtatccgccatgtcaccccgcgccacgagcaggggcgccggcttcatggcggacggctacgcacgggtcaccggcaagcccggcgtgtgcttcatcatcaccggcccggggatgaccaacatcctcaccgccatggcccatgcctacgccgactcgattccgatgctggtgatctccagcgtcaacgaacgcgcgcgcctggcccacggcaacggctacctgcacgagctgccgaaccagcgcaacctggtaggcaacgtctgccccttcaggccataccctgatgagcgccggggagttgctggcggtgctcgcccgcgccttcgccgtgttcgacagcgagcggccgcggccggtgcacatcgagctgccgctcgacgtcatcaccgcgcccgccgaacacctggccctgcgcccacgcaccctcgccagccgcccggcgccggccctcgcgcccttgcgcgaggccgcggcgcgcctgcgcaacgcgaaaaagccactgctgctgctcggcggcggctgcgtcgaggccgccgccgaagcgcgtgccctggccgccgcgctggacgcgccgaccgccctgacgatcaacgccaagggcctgctaccggccgaccacccgctgctgctgggcagcaaccagtcctgcgtgccggtacgcgagctggccgccgaggccgacgtggtgctggccatcggcaccgagctgggcgaaaccgactacgacgtggtgttcgacggcggcttcgccctcgatggcgagttgatccgcatcgacatcgacccgcagcaactgatgcgcaactacacgccgagcctggccatccacagcgacgcccggctggccatgcgcgtgctgctggccgaactgccgggcggcgaggcctcgccggacagccccggggcccggcgcgccgccgccgtgcgccagcgcctggccgaagacttcgccggctggtcgcactatcgccagctgttcgccgcgatcctcgccgagtggccggacgcccgcttcgtcggcgactcgacccagaccgtctacagcggcaaccacctggtcgatctcgacgagccgcgccgctggttcaacgcctccaccggctacggcaccctcggctatggcctgcccgccgccatcggcgccaagctcggtga

SEQ ID NO: 7601 - DNA, 1434 bp, Pseudomonas aeruginosa
tcgtcgaggtgctgcaagccgcgcccttccatccctgacccggagcccgccatggacgattccgaactctaccgctccctctgcgagatcctcggcgcccgtggcgtgcgcgacagtgccgcgctcgccgggcaggaccccggctaccatccgcagaacctcgccggaagcttcctggtcctgccggaaagcaccgaccaggtcgccgccgtggtgcgtctgtgccgccaggcgggacgcgccctggtaccccagggcggactcaccggcctggtcggcggcggcgccgcgcaagccggcgacgtgctgctctcgctgcgcaggctgaaccgcatacatcggctggatgcggccagccagaccctcgacctcgacgccggcgtcaccctcgaacaggcccaggcgctggccgccgaggccggactcgaccccggcatcgatctcgccgcgcgcggcagcgccagcgtcggcgggctggtcgcgaccaacgccggcggcatccgcgccttccgcttcggcaccatgcgccagcgcgtgctcggcctggaagcggtactcgccgacggcagcgtctacagcgacctgcgcgggctgctgaagaacaccaccggctacgacctcaagcagttgttcgtcggcgccgaaggcaccctcggcatcgtcacccgtgcggtactgcgcctggagccgttgcagcgtcccggcgccaccgccctgctcggcctgcccgacgtcgacgcggcgatcaccatcgccgcgcgcctgcgccgcgagcacgccgaacgcctgttcgcctgcgagatcctctggcacgactacctgcaatgcaccgccgcacccatgggcgacagcgcgccgagcctggcgccctgccctctctacctgctggtggaactggccgaggaccgccacctggatgccggcgaggcgctcaccgccctgctggaagactgcttcgaggacgggctggtggaagacgccctgctcgccgccaacgaaacccagcgcctggccatctggcgcctgcgcgaagactccgacgcggccatccacgccggcgtcgacagcctgtccttcgacgtatcgctcccggtgccggccctggccggctacgtcgagcgcatccggcggcgcctggacgacctggtgaagggcatgcaggtcttcctcttcggccatttcctcgacggcaacctgcacgtcatgctcgccgccgacgtcccgctgctgccgctgcaccaggcggtggaggaaatcctctacggcgagttgggcgaatgcgctggcgtgatctccgccgagcacggcatcggcctggagaagaaggaagccctgggacgctacgccgatccgctgaagctcgcgctgatggcgcagatcaaggaactgctcgaccccagcgggctgttcaacccgggcaaggtcataccctga

SEQ ID NO: 7602 - DNA, 1323 bp, Pseudomonas aeruginosa
ttttcttcgttcgccgctggtcggcctgctcgcctgcctgctggcactggtggtcgccatgggggtcgggcgcttctccctgaccccgcaactgccgcacctgatccgcgaaggccagctcgacctgaccggcgccggcctgctggccgccgccaactacctcggctacctggtcggcgcgctggacgcgctgttcgcccgcgaagcgcggcaggcgcgcttacgcctgctggtcgggctatgggcctgcttcggcctgaccctggcctcggtctgggccgagggcttctggccgcacgcgctgctgcgcttcggtcttggcgtggccagcgcctgggtactgatcatggtcaccgccctcagccagcgcctcgccgcggaaagcggtcgggcccggctgggcgcgctggtgttcgccggccccggcatcggggtgatggtcaccggcctgctggcggcattgggcaacgccctgggccaggactcggtgttcatctggaagctcttcgccgacctcgcgctggtcctgatcctcatgctcctgccgctgctgccgcgcccggccgcacgcagcgccggccacgacgcgcctgccacggcaagcgagaacgccggcctcggccgcctgacctgggcctacggactggtcggcctcggctacatcatcccggccacctttctctcgcagatggccgcggcgcgtttccacgggcaatggcaggccgacctgttctggccctgcttcggcctggcctcggccaccggggtagtgctgatcagcctgcgccggcagcgcccggacggcacccgccgctggctggtcggcgcgctctggctacaggccctcggcgtgctcgcctgcctgctgccggggatcggcggactggccctgggggtagtgctgaccggcctgccgttcctcgccggcatgcaactggtgatgcaatacgcccgcgaactggcgccgcatacgccgcagcgcaacgccggccaactgaccaccggtttcgccctcggccagttgctcggcccgctgctggcggcgctcagcacgcatttcgccggcggcctgcaaccggcgctggcgctcgccgggctcggcctggtcttcgccggcctgctgttgcgccggccgcactcgctcagcgtcgcagcaggcgtcgcagccactgctcgccgctgaccagggtgatgccggcgaggaccagcgccgcgccggcgacgaagttcaggctgagcggctcgcccagcagcaatacaccgaaggtgacgccgaacaggggggtcatgaaggagaagatcgccaggttgttcgcctggtag

SEQ ID NO: 7603 - DNA, 1323 bp, Pseudomonas aeruginosa
accagcccggcggaaacggccagcgcgaggccggccagcagcttgcgagtcgattgcatgcttcgctcctcagcgggccgcgccttcgtagccctgcagcacgttgaccgcgttgatgccgatggcttccaccgcatagccgccttccatgatgaacagggtcggcaggcccagccgggcgatgcgctcgcccatccgcaggtagtccggcgaatccagcttgaactgggagatcgggtcttccttgtaggtgtccacgccaagggaaatcaccagggcatccggggcgtagccggcgatccgcacgcaggcgtcgtcgagcgccgccgaccagaggtcccagccgctgccatgggccagcggatagttgtggttgcagccctcgccggcgccttcgccgcgctcgtctgcgtagccgaggaagtacgggtattcgaccagcggatcgccatggatcgaggcgaacagcacatcgtcgcggcggtagaagatatcctgggtgccgttgccatggtgatagtcgacatcgaggatcgccacgcgccgggcaccctggtcgaggaacgcctgggtggcgatggcggcattgttgaggaagcagtagccgcccatgaagtcgccaccggcgtgatggcccggcggacggcagagggcgaaggcgctgcgggcgccctggcgcatatgttcctgggcggtcagcgcgacctgggcggagctgtagatggcctgccaggtgccggcggtgatcggcgcctcggtgtcgaagctgtagtagcccagttcgcccatcagcgccgtggggatcggcccgtcgcggcgcaggcggcggccggggaaggtggtggacaccacgtcgccgctgtggccttcggcggtccagcgggcccaggcgccctggaggaagtccaggtaggcggcgtcgtggatgcgcagcagcggctcgcggccgaaatccttcggcgcgatcacctcgccaaggttctgcgacttcacccgggccagcacggtgtcggcccggctgggcatttcgaaacagggttgcagcttgccgtcgaccagttccgactggccgaagtgcagacgatgatcgtcgctgtagacgctcagcatggagagacctcgcaggtttcttgttcttggtggagggattctgcccagcgcgcggtcgcggcaaaacggcggcggcggccaaaaagggatcgatatggccaaaatccatgtccctttagcgccgcctggcgattatcgacgcggggaattactcggcgcccgcgccggtccatactgcttgagccagtcaggatcgaaagggggattcgatga

SEQ ID NO: 7604 - DNA, 357 bp, Pseudomonas aeruginosa
ccacggcgccggcctgggctgcgagccagggccggcacctggtcctgcagcaccgctaccgcccagacagcgcctgcgaatggctgtcgggcgagccgctggaaacctgggacatcgtggaaaacggactgcgcttccgcctcgacctgggacgcaaccagaacaccgggctattcctcgacatgcgcctgggccgccgctgggtgcaggagcaggccgccggccgccgcgtgctcaacctgttcgcctacacctgcggcttctcggtggcggccattgccggcggcgccagccaggtggtcaacctggacatggcccgcggcccgctcaaccgcggccgcgacaatcaccgcctga

SEQ ID NO: 7605 - DNA, 606 bp, Pseudomonas aeruginosa
cccaggactaccgcaggatcctccgccgcctgccggaactgctggtgcccggcggcaccctgctggcctgtatcaatgacccggccatcggccccgacttcctcctcgaggaaaccgcccgcgaggcgccgtcgctgcacttcgtcgaacgcctggagaatccgccggagttccccgatgtcgaccccgcggcgggcctcaaggcgctgctgttccgcaacgcaggctgatcgacgcgcgggcggcgtgtcgctaggctgtcggcatggacatgcccgatggcttcatccccctgccgccacgcgtcgaaccgcaggcggcctttcgccccctgctcgacgacctgcgccgaaccctggcccggcctccgttcgagcgggccgtgcacagcgtctacctgtacggcagcgtcgcccgcggcgaggccatcacggggcgctccgacctcgacctgaccctggtcctgcgcgacccgcccagccccgaactggccgcgcaactggaaaccgcgcgcctggcattgcaggcgcgccacccggaagtcagcaagatcgatttcgatatcggccacctggaccaggcccgcgatccggccaaccgcgatag

SEQ ID NO: 7606 - DNA, 477 bp, Pseudomonas aeruginosa
cgctcgatctccgcctcgctgcgcggctgttcggagaactgcttgccgaccgcgccgagggtggtggtgagcaagtcgccggccaggctgcgctcggcctcggcgacctccggcaaggcctcccggagaaacacctggaacacccgcgcgccctccgccttcacctcccgcgcctcgtcggcgtcgcgatacagcggcgccgcgtcgctcagcgccacgcgtatcgccgcctcttcgcactccgagcgcacgaatgccagcaccagccggcgcaagcgctccagcggcggccgggcggtgtcctcgaggatctcgccgagcagacgcgtggtgcgccgccactcgtcgctttgcaggcggaagaggatcgccgccttgttcgggaaatactggtacagcgaaccgatgctcaccccggcgcgctccgccacccgcgcggtggtgaaacgttgcgcgccttcgctggccagaacctga

SEQ ID NO: 7607 - DNA, 852 bp, Pseudomonas aeruginosa
acagccgcctccaggatgctcgccaccaactcgctggaacgggcctgctgcggctgcttgcgcgaggaaatagcgggtttcgcttgtcgctcatggaaggctccggaatgcgaatggcggaatgcgatgaatccgtcgcattctaggtccacgcacttacgcgctcaaacattcccggagccatccatgaataccctcaccaacgccccgctcgccgatctcctgcaacgcctgttcgccgaagccgaagccagcgcaccgggcgacagtcccgccctcgccgacctctcggaggccgaactgaagcgcctcatgggcagcaagaccgaataccgcgagttctacggtcgcctgaaggacctggcgctgcccgtctcccgcgaaaccggctgcctgctctacatgctggcgcgcagcagctcggcgcgcagcatcgtcgagttcggcacgtccttcggcctgtccaccctgcacctcgccgcagcgctgcgggacaacggcggtggccgcctgatcggcagcgagttcgaaccctccaaggccgagcgggcacggcgcaacctggccgccggggggctgctcgacctggtggaactgcgcgagggtgatgccctgcaaaccctcgccaaggacctgccggacagcatcgacctggtcctgctggacggcgccaaggcgctctatccggaggtcctcgccctgctggaaagccgcctgcgccccggcgcgctggtgatcgccgacaacgccgagcatagtcccgagtacctggcccatgtccgctcgccggccaacggctacctgtcgacgcccttcgccgaggatgtcgagctgtccatgcgcctgggctga

SEQ ID NO: 7608 - DNA, 303 bp, Pseudomonas aeruginosa
accgccaggactgggcgcgcctgggcgacttcgtccatgaccgggtgcgctacaacgacgtgcagatcggactcgacggctacctgcggatgctcgaaggcgacttcctggcaatccccgacctgcgcttcgagatcgaacgcctgctcgtcgatcctccgggcgtcgcctgccgcctgcacttcgactgcacacccagcggccggctgttcggcatcccggtcaacggccagcgggtacgcttcgccgagaacgtcttctacgaattcgaagacgagcgcatcgccggcgtctggtcggtga

SEQ ID NO: 7609 - DNA, 444 bp, Pseudomonas aeruginosa
cgcctggccaccgcgaccgcttcggcctcgtcctccaccagtacgtcgatcactccgttgggcccctgcacgcccgtcggaccgacctcctcggcggcgaaacggcccaggccgccgccctcgatcatcgccgggccggccatgccgatggtggcgtcgcgggtggcgatgatcacatcgcagcagcccagcaacgcggcattgccggcgaagcagcgaccggagaccactcccaccagcggcaccagcccagagagccgggccatgccgacgaaggtatggcaatcgagaccggcgacgccgacgaaatcggtatcgcccgggcgcccgccgccaccctcggcgaacagcaccagcggcaagcgccactgttcggccaggccgagcaggcggtcggtcttcttgtggttcatcaccccctgggtgccggcgaacaccgtgtag

SEQ ID NO: 7610 - DNA, 819 bp, Pseudomonas aeruginosa
gccagcaccaggcaacgcgcggcctgcgcgccgaagctggcggcccccaccgtaccggtgccggcgaccaggccatcggcggggctcagctccagcaactcctcggcggagcgccggcgacgctgggcggccagggcgaaaccgccatattcgctgaagctgccctcgtccagcaggtcgagcacgttctcccgcgcggtacgctgtccggtcttgcgccgcctggccagcgcctgcggacgacgctcgtcgcccagcgctgcctggcgctcgagtacctcggcgagatcggcgcggatatgcgccaggtccagcgcctgttcggtcggtgcctgctcgtcgtcatcctccgtcggttcgaggaacagcagcgtcgcgccctcctccagaggctccccgaggctcgccgcgagtcgccggacgataccgccgccgggtgccttgacctcgaattccatcttcatcgcttccaggatcgcgacccgctggccggcacgcacccgttcgccatcgcccacttccagggccaccagcaccccgctgctcggcgcagacagcggcaggctgccgagtggcgcctcgacccgcgcaggcgcggcgtcctcggcgagcgggcactcggcgcggagccgcggatggctcgccgggataggcgccagcagtgtctccaggtggctttcgacgaagcgggtgtcgacccggttggcctgtaccgccggatgcagcagaaggttgcgcagcagatccaggttgctcgccacgccctccaggcggaattcgcagagcgcccggtatgcccggcgcaacgcggcgggataa

SEQ ID NO: 7611 - DNA, 276 bp, Pseudomonas aeruginosa
tctccaggagtcgcagtttccgccgcgcatgctaccttagcccgctaccggccgggcccacccttcgtccgtcttcgtgacgaagggggcgaaacagaggaaaaggcgcgcggcgctcccatgcacacggaggtgcacatgaagttcgagaagaataccgagctggaccaggccaacctgcgactgattgtggccacctgcgcgatcctctacgtggtgctgatcggcctgctgcccggcctgaaggtcgagacctacctgccgatcgttgcctag

SEQ ID NO: 7612 - DNA, 1485 bp, Pseudomonas aeruginosa
tacggcctgttcctgatcgcctccatactgctgcgccaggccatcgtgcgctggccggggcactacccggcgcggcggatcttctgcatgctgcacgactacgccggcacctcgttcggcctgatcgtgggcggcgaggcagcgctgccgctgtacgcggtgatggtctggatcaacctgggcaacggcatgcgctacggctcgcgctacctggccatcgccaccgccctggcgctgctcgcgctactggtcatctatcgactgaccccggcctggcaggcccagccgttcatggtgctgatgctgatgaccaccagtaccgtcattcccttctacgcgcacctcctgctggagcgcacgcgcaaggccaccgaggaagcgttgcaggcgaaccaggagaaatcgcgcctgctggcccaggccagccacgacctgcgccagccgatccactccatcggcctgttcaccgcctgcctgcgcgacgcccgcctgggcgacgaggaacggcgcctggtggacaacatcgaccgctcgctgctcaacgtctcgcaactgttccgctccatcctcgatctctacaccctcgacaacggccggctccagcccaagcaggagaacgtccacctgggcgagttgctgcgcgacctggtccggcgcaacgctgaagcggcgcgctgggccggggtggaactgcgcctgcgcccttgccgcctgtggacgcgaaccgatccggggctgctgtcgaccatgctgcagaacctgctctccaacagcctcaagtacgccgccgagcgcccgctgctgatcggcgtgcggcggcgaggcgacggcctggccgtagccatctacgaccagggccgggggatcgcggaggaacacctgccgcgggtgttcgaggagttctaccgggtacgcgagacgcgcgaccgcgacgtcgagggaatcggcctggggctgtccatcgtccgccgcctggggcagttgaccgggatcgaggtgacgctgcgctcgcgggtcggacgcggcaccgcggtgaccctgcacggcctgccggcggtcgccgcgcaagccctgccccgccgcgacgatcccctgcaggccggcctgctcaccggcttgcgggtgtgcctggtggaagatgatcgcaacgtcctgcgcgccacctcggcgttgctcgaacgctggggctgcacggtccaggcggaaaccgaggcggacggctggcgaaccgattgcgacatactcgtcgtcgactacgacctcggcccccacgcctccggcgtcgagtgcatcgagcgggtacggcggcaacgcggagaggcgataccggcgctggtgatcagcggccacgacatcgagcgtatccaggctagcgtcgaagacaccaacatcgccctgctctccaagccggtgcgccccacggaattgcgcgccaccctgcgcgccctgcgcgagcgcccggcggccgccagccacgcttcctga

SEQ ID NO: 7613 - DNA, 777 bp, Pseudomonas aeruginosa
cggagtcacaccatgtcgtttcgcaagaccctgttgatcaccggcgccagcagcggcttcggccaggccctggcccgcgaggccctggatgccggtcaccgcgtggtgggcacggtgcgcagcgaggaggccaggagcgcactggaagccgtggcgccgggccaggccttcggccggctgctggatgtcaccgacctcgccgccatcgagccgacggtcgcagccatcgagcgcgacatcggtccgctggacgtgctggtgaacagtgccggctatggtcatgaaggcatcctcgaggagtcgccgctggccgagatgcgccggcagttcgaggtcaacctgttcggcgcggtcgcgatgatccaggccgtgctgccctacatgcgtcggcgccgccgcggtcatatcctcaatgggcggctacatcaccatgcccggcatcgcctactactgcggcagcaagttcgccctggaagggggtttccgaagccttgggcaaggaggtggccggcctcggcatcgccgtcaccgcggtggcccccggctccttccgcaccgactgggccggccgttcgatggtccgcagcccgcgcaccatcgccgactacgacgcgctcttcgacccggtccgccaggctcgccaggaaaagagcggcaagcaaccgggcgacccgcgcaaggccgcgcgcgccatgctccaggccatcgacgcggaaaacccgccggcgcacctgctgctgggcagcgatgcactggggctggtgcggcagaagctga

SEQ ID NO: 7614 - DNA, 1767 bp, Pseudomonas aeruginosa
gctcgaccttcgaacaacgaaaggacgccagcatggtccagagcgccccagccagcgaaatcgccgccctcatcctgcgcggtttcgacgattaccgagagcagttccgcgagatcaccgacggcgcccgtgcccgcttcgagcaggcgcagtggcaggaagcgcagcgcgcctcggcgcagcggatcaacctctacgaggaaaaggtcgccgagaccggtggccgggctgcgcgcggggctggccgacagcgagctgctggacgtggagcgctggccgatcatcaagagcgcctacatcgcgcagatcgacctgcggctggacgacgagctggccgagacctggttcaactcgatcttctgcgggctgttcagccacgacaacatcagcgacggcacgatgttcgtgcacaccacccggccctcgctgcgcgcccacgcccgcgcgccctacacccgcacctaccggccgggcggcgacctgcgccaggcgctggagaagatcttcgacgactaccgcttcgacgtgccctacgacgaccgcgagcgcgacctcgaacggatcgacgcactgctgcacagcaacctgccggactgggtgtgcaaggacccggacctggccatcgagctgatcggctcggtgttctatcgcaacaagggcgcctacctggtgggccgcctgttcaccccggacgagcagtggccgctggtgttcccgctgctgcaccgcgagggccacggcatccagttcgacacggtgatcaccgacgaggcggaagtctcgatcatcttctccttcacccgttcgtacttcatggtcgacgtgccggtgccggccgagctggtggccttcctcaagcgtctgctgccgggcaagcacctggccgagctgtacacctcgatcggcttctacaagcagggcaagagcgagttctaccgcgccctgatcaaccacctggcgaccaccgacgaccgcttcgtcatggcccccggggtgcgcggcatggtgatgagcgtgttcaccctgcccggcttcaacacggtgttcaagatcatcaaggaccgcttcaacccgtcgaagagcgtcgaccacgccacggtgatccagaagtaccagttggtgaagaaccacgaccgggtcggacgcctggccgacacccagcagttcgccgacttccgcttcccggtgagcaagttcgagccggagtgcctggcagaactgctggaagtggcgccgtcgacggtggtgatggaaggcgacgtggtgctgatccgccactgctggacggagcggcgcatgaccccgctgaacatctacctggagaacgccagcgaggcgcagacccgcgaggcgctgaacgactacgggctggcgatcaagcaactggcggcggcgaacatcttccccggcgacatgctgctgaagaacttcggcgtgacccgccacggccgggtggtgttctacgactacgacgagatctgctacctcaccgaggtgaacttccgctacatccccgagccgcgcttccccgaggacgagatgtcgtccgagccctggtattcggtggggcccaacgacgtgttcccggaagaattcccgcgcttcctgttcgtcgacctcaaccagcgccggctattcgccaagctgcacggcaacctctacgacgccaaatactggcagggcctccaggagcagatccgcgagggcaaggtgatcgacgtgtttccctatcggcggcaggagacgcctgagcagttgctcgggtag

SEQ ID NO: 7615 - DNA, 384 bp, Pseudomonas aeruginosa
tcggcgacctgcccatcagcatcggcggccaggtccccgaccgtgcccaggacccgcaggccggcttcgatcccgacctgctgctggccgccaaggaacaacgcaagatggaccgcttcatcctcttcgccctggccgccgcgcaagaggccctggcccaggccggctgggcgccgcagagcgccgaggcgcaggagcgcacggcgaccgtcatcgcctccggggtgggcggcttccatgccatcgccgaagcggtgcggaccaccgacggcaagggaccgcggcgcctgtcgcccttcaccatcccgtcctttctctgcaacatggcggccgcccatgtgtcgatccgccatggcttcaagggaccgctgggcgccccggtga

SEQ ID NO: 7616 - DNA, 759 bp, Pseudomonas aeruginosa
ccgcctgcgcggcgggcgtgcaggcatcggcgacgcggcgcggatgatccgcgcgggagaggtcgacgtggcgctctgcggcggcgcggaagcgaccgtccaccgggtcagcctggccggcttcgccgccgcgcgcgccctgtccagcgatttcaacgacagccccgaacgcgcctcgcgccccttcgaccaggcccgcgacggcttcgtcatgggcgaaggcgccggcctactggtcatcgaggaactggagcacgccctggcgcgcggcgccaggcccatcgccgagctggtgggctacggcaccagcgccgacgcctaccacatgaccgccgggccggaagatggcagcggtgcccgccgggccatgcagcaggcgctgcgccaggccggcgtggaagcggccgcggtgcaacacctgaatgcccacgccacctccacccaagtaggcgacaagggcgaactggccgccatcaaggccgtgttcggcgctggcagcgggctcgccatcagcgcgaccaaatccgccaccggccacctcctgggcgccgccggcggcatcgaggctatcttcacggtcctggcactgcgcgaccagctcgcccccgccacactcaacctggaaacgcccgacaccgacgccgagggcctcgacctggttcgcggcgaagcccggcgctggccgatggaacacgcgctgtccaatggcttcggcttcggcggggtgaatgccagctgttgttccggcgctgggtgtag

SEQ ID NO: 7617 - DNA, 1458 bp, Pseudomonas aeruginosa
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttggcctgttctctgaagcgctggtggccatcgacggcagcaagttcaaggcggtcaacaaccgcgaccgcaatttcaccagcgccaagcttcaacggcgaatggaggagatcgagtccagcatcaatcgctacctgagcgcactggataccgctgatcgtcaggaacctgccgtggcgcaggtcaaagccgaacgcctccacgacaagatcgcgaccttgaaagcgaagctgcaggagctcaaggagatcgaggttcagctcaacgaaataccggataaacagatctccctgaccgatcccgatgctcgttcgatgaaaacgcgtggcaccggaatggtcggctacaacgtgcaggcagcggtcgatgcgaagcaccacctgatcgtgacgcacgaggtcacgaacgacggagtcgatcgagaccagctgagcgccatggccaagcaggcgcgagaggccatgggtgtcgaggaactctcggcggtcgcagacagagggtatttcaaaggcgaagaaatcctcgcctgtcatgaggctggaatcactgttttcgtgcccaaaacgctgacctcgggcgcgacagcggcgggccgcttcggcaaaggtgatttcatctatgacgcagcaaagaacgagtaccgatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 7618 - DNA, 399 bp, Pseudomonas aeruginosa
ctcattatgtcggcgactcaaaattacggcactggccgtcgtaagaccgctaccgctcgcgtcttcctgcgtccgggtactggcaagatttccatcaacaaccgtggtctcgatcagttcttcggtcgtgaaaccgctcgcatggtcgtgcgtcagccgctcgagctgaccgagaccgtcgagaagttcgacatcttcgttaccgtcgttggcggtggcgtaagcggtcaggccggtgcgatccgtcacggcatcacccgtgccctgatcgagtacgacgaaaccctgcgtagctcgctgcgcaaggccggctacgtgactcgcgatgcccgtgaagtcgagcgtaagaaagtcggtctgcgtaaagcgcgtaagcgtccgcagtactccaagcgttaa

SEQ ID NO: 7619 - DNA, 594 bp, Pseudomonas aeruginosa
atgagtaatgacggcgtgaatgcaggccggcgtcgcttcctcgtcgcggccacctctgtggttggcgcggcgggagcggtgggtgctgcggtcccgttcgtagggtcatggttccccagtgccaaagccaaggctgctggcgcgccggtgcaggtgaacgtgggcaagatcgatccaggtcagcagatcatcgctgaatggcgcggcaagcctgtattcatcgtgcaccgcacgaaggagatgctggacgccctgccgagcctcgaaggacaactggccgacccggactccaaggcctcggagcagccggagtacgtcgatcccaagcttcgctcgatcaagccggaactggcggtgatcgtcggcatctgcacccatctgggctgctcgccgaccttccgtcccgaagtcgcccccgccgacctcggtccggactggaagggcggctacttctgcccttgccacggctcccactacgacctcgccggtcgtgtctacaaaggccagccagcgccgctgaacctgccgattccgccttatacgttcgatgctgacgacgtcatcaccatcggcgtggaccaggagaaagcctga

SEQ ID NO: 7620 - DNA, 504 bp, Pseudomonas aeruginosa
aagtgggatcaattggcatggaaagccaaccacaggggaagcgctgacgtgtttcgcggagctaatgccataagtctcgacgccaaagggcgcctcgcgatgccgagtcggtatcgtgacgagctcgtttcgcgttgtgccggccagctcatcgtcactatcgacgcagtcgacccctgcctcaccgtttaccccttgcccgaatgggaactgatcgaagccaagctgcgcgagctgccttctttgcgagaagaaacgcggcgcctgcagcggctgctgatcggtaatgccgtcgatctggaactggacggaaacgggcgtttcctgattccgccgcgcctgcgcgagtacgccaagctggacaagcgggcgatgctggtggggcaactgaacaagtttcagttgtgggatgaggatgcctggaacgccatggctgaagccgacctggcggcaatcaaacaacccggtgggctgccggacgaactacgcgacctgatcctttga

SEQ ID NO: 7621 - DNA, 1815 bp, Pseudomonas aeruginosa
ccgcatcgaaagcctggcggtggaacagttgcgcatgcgcgttcccgacccggccgaggtcaggatggtggcgccatgaaactgaattatttccagggcgccctctacccatggcggttctgcgtgatcgtcggcctgctgctggcgatggtcggcgccatcgtctggcgaatcgtcgacctgcacgtgatcgaccatgacttcctcaagggccagggcgacgcgcgtagcgtgcggcatatcgccatccctgcgcaccggggcctgatcactgaccgcaacggcgaaccgctggcggtgagcaccccggtcaccaccctgtgggccaaccccaaggagctgatgaccgccaaggaacgctggccgcaactggcggcggcgctcgggcaggataccaagctgttcgccgaccgcatcgagcagaacgccgagcgcgagttcatctatctggtccgtgggctgaccccggagcagggcgaaggcgtgatcgccctgaaggtgcccggcgtgtactccatcgaggagtttcggcgtttctacccggctggcgaagtggtggcccatgcggtcggctttaccgatgtcgacgaccgcggtcgcgaaggtatcgagctggctttcgacgaatggctggccggcgtgccgggcaagcgccaggtgctcaaggatcgccgtggccgcgtgatcaaggacgtgcaggtcaccaagaatgccaaaccgggcaagacccttgcgctgtccatcgacctgcgcctgcagtacctggctcatcgcgaactgcgcaacgctctgctggaaaacggcgccaaggccggcagcttggtgatcatggacgtgaagaccggggagatcctggccatgaccaaccagcccacctacaacccgaacaatcgtcgtaacctgcagccggcggccatgcgcaaccgggcgatgatcgacgtgttcgagccgggctcgacggtcaagccgttctcgatgagcgcggcgctggccagcgggcgctggaaacccagcgatatcgtcgacgtctacccgggcaccctgcagatcggccgctacaccattcgcgacgtatcgcgcaattcgcggcaactcgatctcaccggcatcctgatcaagtcgagcaacgtcggcatcagcaagatcgccttcgacatcggcgccgaatccatctactcggtcatgcaacaggtcggtctcgggcaggacacggggttgggcttccccggcgagcgcgtcggcaacctgcccaaccaccgcaagtggccgaaggcggaaaccgcgaccctggcctacggctacggtctctcggtaaccgcgatccagttggcgcatgcctatgcggccctggccaacgacggcaagagcgtgccgctgagcatgacccgagtcgaccgcgtgccggatggtgtgcaggtgatctcgcctgaagtggcttccaccgtgcagggcatgctgcaacaagtggtcgaggcccacggcggggtgttccgcgcccaggtgccgggttaccacgccgccggcaagagcgggaccgcgcgcaaggtctcggtcggcaccaagggctaccgggaaaacgcctatcgctcgctgttcgccggtttcgccccggccaccgatccgcgcatcgcgatggtcgtggtgatcgacgagccgagcaaggcgggctacttcggcggcctggtgtcggcgccggtgttcagtaaggtcatggctggcgcgctgcgcctgatgaacgtgccgccggataacctgccgacggccaccgaacagcagcaggtcaatgctgcgcccgcaaaaggagggcgtggctga

SEQ ID NO: 7622 - DNA, 1401 bp, Pseudomonas aeruginosa
ccctggatagccgcggcgttcgtccgggcgacctgttcctggcggtgccgggcgggcgccaggatggtcgtgcgcacatcgccgatgccctggcccaagggcgcggctgccgtggcttacgaggcggaaggcgccggagagttgccgcccagcgatgcgccgctgatcgcggtgaaggggctggccgcgcaactgtcggcggtcgccgggcgtttctacggcgagccgagccgcgggctggacctgatcggcgtcaccggcaccaacggcaagaccagcgtcagccaactggtggcccaggccctggatctgctcggcgagcgctgcggcatcgtcggcaccctcggcaccggtttctacggcgccctggagagcggccggcacaccacgccggacccgctcgcggtgcaggccacgctggccacgctgaagcaggccggcgcccgcgcggtagcgatggaagtgtcttcccacggcctcgaccagggccgcgtggcggcgctcggtttcgatatcgcggtgttcaccaatctgtcccgcgaccacctcgactatcacggttcgatggaagcctatgccgccgccaaggccaagctgttcgcctggccgggcctgcgctgccgggtgatcaacctggacgacgatttcggccgtcgactggccggcgaggagcaggactcggagctgatcacctacagcctcaccgacagctcggcgttcctctattgccgcgaagcgcgcttcggcgacgccggcatcgaggcggcgctggtcactccgcacggcgagggcctgctgcgcagcccgttgctcggccgcttcaacctgagcaacctgctggcggcggtcggtgcgttgcttggcctgggttatcccctgggcgatatcctccgcaccttgccgcaactgcaggggccggtcggccgcatgcagcgcctgggaggcggcgacaagccgctggtggtggtggactacgcgcatactcccgacgccctggaaaaagtcctggaggccctgcgtccgcacgcggccgcgcgcctgctgtgcctgttcggctgcggtggcgatcgcgatgccggcaagcgtccgctgatggctgcgatcgccgaacgcctggcggatggggtgctggtcaccgacgacaacccgcgcaccgaggccagtgcggcgatcatcgccgatatccgcaaaggcttcgctgccgctgacaaggttaccttcctgccgtcgcgcggtgaggcgatcgcccatctgatcgcttccgctgcggtggatgacgtggtgctcctggctggcaagggtcacgaggattatcaggagatcgacggcgtacgccatccgttctccgacatcgagcaggccgagcgcgccctggccgcctgggaggtgccgcatgcttga

SEQ ID NO: 7623 - DNA, 1404 bp, Pseudomonas aeruginosa
tatactgagcggcttttccgggcgcaccgtcctggtcctcggagacatgggcgaactcggttcctgggccgagcaggcccaccgcgaggtgggcgcctacgccgctggcaaggtgtccgcgctctatgcggtcggaccgctgatggcccacgccgtacaggcgttcggcgccacgggccggcacttcgccgaccaggccagcctgatcggggcgctggccaccgaacaaccgacaaccaccattttgatcaagggttcccgcagtgcggcgatggacaaagtcgtcgcggcgctgtgcggttcctccgaggagagtcactaatgctcctgctgctggccgaatacctgcaacagttctacaagggcttcggcgtcttccagtacctgaccctgcgcggcattctcagcgtgctcaccgcgctgtcgctgtcgctgtggctggggccctggatgatccgtaccttgcagatccgccagatcggccaggccgtgcgcaacgacggtccgcagtcgcacctgtcgaagaagggcaccccgaccatgggcggcgccctgatccttaccgccatagccatcagcacgctgctgtgggcggatctttccaaccgctacgtgtgggtagtgctggtcgttaccctgctgttcggtgccatcggctgggtggacgactaccgcaaggtgatcgagaagaactcccgtggcctgccgagccgctggaagtacttctggcagtcggtgttcggcatcggcgccgccgtgttcctctacatgactgccgaaaccccgatcgagaccaccctgatcgtgccgatgctgaagagcgtcgagatccagttgggcatcttcttcgtggtcctgacctacttcgtcatcgtcggttcgagcaatgcagtgaacctcaccgacggtctcgacggcctggcgatcatgccgacggtaatggttgccggcgcgctgggcatcttctgctacctgtcgggcaacgtgaagttcgccgagtacctgttgattcccaacgtaccgggcgccggcgagctgatcgtgttctgcgccgcgctggtcggcgccggcctcggcttcctctggttcaacacctatccggcgcaggtcttcatgggcgacgtcggcgcgttggcgctgggcgccgcgctgggcaccatcgcggtgatcgtgcgccaggaaatcgtgctgttcatcatgggtggggtgttcgtcatggaaaccctctcggtgatgatccaggtcgcttccttcaagctgaccggacgccgcgtcttccgcatggcgccgatccatcaccatttcgaactgaaaggctggccggagccgcgcgtgatcgtgcgcttctggatcatcaccgtgatcctggtgctgatcggcctcgccaccttgaagctgcgttga

SEQ ID NO: 7624 - DNA, 1359 bp, Pseudomonas aeruginosa
cgccgggctgattgcccaggcactgggcaacgcggtaccgctggtgcgcgtcgcaacgctggacgaagcagtccggcaggccgccgagctggcccgcgaaggcgatgcggtgctgttgtcgccggcctgcgcgagcctggacatgttcaagaacttcgaagaacgcggacgcctgttcgccaaagccgtagaggagctagcgtgatgctgtcggtgttgcgccccttcccgtcgccgctgttgagccggcacggcatcgacctggacttcccgctgctggcgggttgcctggcgctgctcggcctcggccctggtgatggtgacttccgcgtcttccgaggtggcagcggcgcagtcgggcaacccgctgtatttctccgtccgtcacctgatctacctggtgatcggcctgatttcctgcggcctgaccatgatggtcccgatggccacctggcagcgttggggctggaagctgttgctggtcgccttcggcctgctggtgctggtgatcacccccggtatcggccgcgaggtgaacggctcgatgcgctggatcggcttcggcctgttcaacatccagccttcggagatcgccaaggtctgcgtggtgatcttcatggccggctacctgatccgccgccagcaggaggtccgggaaagctggatgggcttcttcaagcccttcgtggtgttgctgccgatggccggcctgctgctgcgcgagccggacttcggcgccaccgtggtaatgatgggcgctgccgcggccatgctgttcctcggcggggtggggctgttccgcttcggcctgatggtgctgctggcggtcggcgcggtggtcctgctgatccagacccagccctaccggatggcacgcctgaccaacttcaccgacccctgggccgaccagttcggcgccggctatcagttgagccaggcgctgatcgccttcggccgcggcggctggttgggcatgggactgggcaacagcatccagaagcagttctacctgccggaggcgcacaccgatttcgtcttcgccgtgcttgcagaggagctgggcatcgtcggcgccctggcgaccgtcgccctgttcgtgttcgtcagcctgcgcgcgctgtacatcggcatctgggccgagcaggccaagcagttcttctccgcctacgtggcctacggcctggccttcctctggatcggccagttcctgatcaacatcggggtgaacgtcggcctgctgccgaccaagggcctgaccctgccgttcctcagctacggcggcagttcgctggtgatctgctgtgcctgtctggggatgttgctgcgcatcgaatgggaacggcgaacccacctgggtag

SEQ ID NO: 7625 - DNA, 1542 bp, Pseudomonas aeruginosa
tgcatcccgaaaccctgcgctccatggcagaccaggcacgcagcctggcgaaacccgaggctacccggacggtggtcgatgcctgcctggaggtggcccgtggttaaagaaccgaatggcgtcacccggaccatgcgccgtatccgccgcatccatttcgtcggcatcggcggcgccggtatgtgcgggatcgccgaagtgctgctgaacctcggctacgaggtatccggctcggacctcaaggcctcggcggtgaccgagcgcctggagaagttcggcgcgcagatcttcatcggccaccaggcggaaaacgccgacggcgccgacgtgctggtggtgtccagtgccatcaaccgggccaacccggaagtggcatcggccctggaacggcggattccggtggtgccgcgtgcggagatgctcgccgagctgatgcgctaccggcacggcatcgcggtagccggcacccacggcaagaccaccactaccagcctgatcgcctcggtgttcgccgccggcggcctggacccgaccttcgtcatcggcggccggctgaacgccgccgggaccaacgcccagctcggcgccagccgctacctggtggccgaggccgacgagagcgacgccagcttcctgcacctgcaaccgatggtcgcggtggtcaccaatatcgacgccgaccacatggcgacctacggcggcgacttcaacaagctgaagaagaccttcgtcgagttcctccacaacctgccgttctacggactggcggtgatgtgcgtggatgatccggttgtgcgtgagatcctcccgcagatcgcccgcccgaccgtgacctacggccttagcgaagacgccgacgtgcgcgcgatcaacatccgccaggaaggcatgcgcacctggttcaccgtgttgcgcccggagcgcgagccgctggacgtctcggtgaacatgcccggcctgcacaacgtgctgaattccctggcgaccatcgtcatcgctaccgacgagggcatctccgacgaagccatcgtccaggggctgtccggcttccagggcgtaggccggcgcttccaggtctacggcgagctgcaggtcgagggtggcagcgtgatgctggtggacgattacggccaccatccgcgcgaagtcgccgcggtgatcaaggcgatccgtggcggttggccggagcgtcgcctggtgatggtctaccagccgcatcgctatacccgtacccgcgacctgtacgaagacttcgtgcaggtgctgggcgaagccaacgtgctgctgttgatggaggtctatccggccggcgaagagccgatcccgggagccgacagccgccagctgtgccacagcatccgccagcgcggccagctcgacccgatctacttcgagcgcgacgccgacctggcgccgctggtcaagccgctgctgcgcgctggcgacatcctgctttgccagggcgctggcgatgtcggcggcctggccccgcaactgatcaagaacccgctgttcgccggcaagggagggaagggcgcatga

SEQ ID NO: 7626 - DNA, 312 bp, Pseudomonas aeruginosa
gcgtgcgcctgccgaaagccgacttcagtttcctcaagtacctggcctggccgctgttgctggccgttctcggctatggcgcctatcgcggcgccgagtacatcctgccgtacgccgaccggccgatcgccaaggtcagtgtcgagggcgacctcagctacatcagccagcgcgcggtgcagcagcggatctccccgtacctggcggcgagcttcttcaccatcgacctggcgggcatgcgcgggcaactggaacagatgccctggatcgcccacgccgaggtgcgccgggtgtggccggaccaggtggtga

SEQ ID NO: 7627 - DNA, 561 bp, Pseudomonas aeruginosa
tcccgatcgccggcgaccaggtcaccaatgacatcgccatggccctgcgtacgccgacccagtacgcggaagagatcaagatccgctacgcctgcgccctggcccaagctggccggtgccggcgagaccatcaaggtgcccagcgtcggcgaccggccgccgcgcgaactgtcgcgccaggccctggccgaagtggtcgagcctcgttacgacgagctgttcaccctggtccaggccgagctgcgccgcagcggctacgaggacctgatcccggccgggatcgtcctcaccggcggcacctcgaagatggaaggcgcggtcgagctggccgaggaaatcttccacatgccggtacgcctcggcgtgccgtatagcgtgaagggcctcaccgacgtggtgcgcaacccgatctattcgacgggcgtcggcctgctgatgtacggactgcagaagcagtccgatggcatgtcgatgtctgtgtcaggcagcagctacagcagcgacgaacccaaggcacctgtcctggagcggctcaaacgctgggtccagggcaatttttga

SEQ ID NO: 7628 - DNA, 924 bp, Pseudomonas aeruginosa
gcggccaaagccatgatcaaacaacgcaccttgaagaacatcatccgggctactggcgtcggtctgcactcgggggaaaaggtttacctgaccctgaaaccggcgccggtggacaccggtatcgtgttctgccgcaccgacctggatccggtagtggaaatcccggcccgggccgagaacgtcggcgaaaccaccatgtcgaccaccctggtcaagggtgacgtcaaagtggatacggtggagcacctgctctcggccatggccggcctgggtatcgacaacgcctacgtcgagctgtccgcttcggaagtgccgatcatggatggcagcgctggtccgttcgtattcctgatccagtccgccggattgcaagagcaggaagctgccaagaagttcatccgcatcaagcgcgaagtcagcgtggaagagggcgacaagcgcgccgtcttcgttccgttcgacggcttcaaggtcagcttcgagatcgatttcgatcatccggtcttccgtggtcgcacccagcaggcctcggtcgatttctccagtacttccttcgtcaaggaggtcagccgcgcccgtaccttcgggttcatgcgcgacatcgagtacctgcgttcgcagaacctggcactcggcggtagcgtggagaacgcgatcgtggtcgacgagaaccgcgtgctcaacgaagacggcctgcgttacgaggacgagttcgtcaagcacaagatcctggatgccatcggcgacctgtatctgctcggcaacagtcttatcggcgagttccgtggcttcaagtccggccatgccctgaacaaccaactgctgcgtacgttgatcgcagacaaggatgcttgggaagtggtgaccttcgaagacgcgcgtaccgcgcctatttcctatatgcgcccggcggcggcagtgtag

SEQ ID NO: 7629 - DNA, 2787 bp, Pseudomonas aeruginosa
gccttccattccccacgtgtggatgaccaagtcgatatgtttgcgcctttgttgaagaaactctttggaagcaagaacgagcgtgatgtaaagcgcatggccaaggctgtacaggccatcaatgcgctcgagccccagatggtggcgctctccgacgagcagttgaaggcgaaaacggctgaattccagcagcgctacgccaagggcgaaacgctcgaccaattgctgcccgaagccttcgccgtggttcgcgaggctggcaagcgggtgatgggcatgcgccacttcgacgtccagctgatcggtggcatgaccctgcacgacggcaagatcgccgaaatgcgtaccggcgagggcaagaccctggtgggcaccctgccggtctacctcaacgcgctgtccggcaagggcgtgcacgtggtcacggtgaacgactacctggcgcgccgcgacgccaactggatgcgcccgctgtacgagttcctcggcctcagcgtcggcgtggtcactcccttccagccgccggaagacaagcgcgccgcctacgccgccgacatcacctacggcaccaacaacgaattcggcttcgattacctgcgcgacaacatggccttcagcctggacgacaagttccagcgcgagctgaacttcgccgtggtcgacgaagtggactcgatcctcatcgacgaggcgcgtaccccgctgatcatctccggccaggccgaagacagctccgagctgtacatcaagatcaacaagctgatcccgcgtctcaagcgccaggtcgaagaggtcgagggcaagccgaccgaggaaggccactacagcatcgacgagaagacccgccaggtcgaactcaacgagcagggccaccagttcatcgaggacctgctgagccagaacggcctgctcggcgaaggcgagagcctctactcggcgcacaacctgagcctgctgacccacgtctacgcagcgctgcgcgcgcacaccctgttccaccgcaacgtcgagtacatcgtccagggcgaccagatcctcctgatcgacgagcacaccggccgcaccatgcctggccgtcgcctgtccgagggcctgcaccaggccatcgaggcgaaggaaggcctgccgatccaggccgagagccagaccctggcctccaccaccttccagaactacttccgcctgtacaacaagctggccggcatgaccggcaccgccgataccgaggccttcgagttccgccagatctacggtctcgacgtggtggtgatcccgacccaccggccgatcgcgcgcaaggacttcaacgacctggtctacctgacccaggaagagaagtacgcggcgatcatcaccgacatcaagcagtgccaggccctcggccggccgatcctggtcggcaccgcgtcgatcgagagttccgagtacgtttccaagctgttgcaagaggcaggcatcgagcacaaggtgctcaacgccaagtaccacgagaaggaagccgagatcatcgcccaggctggcgcgcccggttcggtgaccatcgccaccaacatggccggccgcggtaccgacatcctcctcggcggcaactgggaagtcgaagtcgcggccctggagaaccccaccgaggagcagatcgcccagatcaaggccgaatggcagaagcgccaccagcaggtgatcgaggcgggcggcctgcacgtgatcgcctccgagcgccacgaatcccgccggatcgacaaccagttgcgcggccgtgccggtcgtcagggcgacccgggttccagccgcttctacctgtcgctggaagacaacctgatgcggatcttcgcctccgaccgggtgaagaacttcatgaaggcgctgggcatgcagtccggcgaggcgatcgagcaccgcatggtgaccaacgccatcgagaaggcccagcgcaaggtcgaagggcgcaacttcgacatccgcaagcaactgctggaattcgatgacgtagccaacgagcagcgcaaggtgatctaccacatgcgcaataccctgctgtcggcagaggacgtgggcgagaccatcaaggaattccgcgaggaaaccctcagcgccaccatcaaccagcacattccgccgcagtcgctgcccgagcagtgggacatcgaaggcctggaggctgcgctgtacagcgacttcgccgtgcgcctgccgatccagcagtggctggacgaagacgacaagctgtacgaggaaaccctgcgtagcaagatcctcgagcagatcgtcgccgcctactacgagaaggaagagctggccggcgccgaagccctgcgcgccttcgagaagcagatgctgctgcgggtgctggacgacctgtggaaggaccacctgtcgaccatggaccacctgcggcacggcatccacctgcgtggctacgcgcagaagaatccgaagcaggaatacaagcgcgagtccttcaccctgttccaggagctgctggactcgatcaagcgcgacaccatccgcgtgctgtcccacgtccaggtccgtcgcgaagacccggccgaagaggaggcccgcctgcgtcgcgaggcggaggaactggccaagcgcatgcagttccagcacgccgaggctccctcgatggagcaggccgtggccggcgaggaagaagagcttcccgagggcccggctccggtcgtgccgctcgagcctgtgcgcaacgagcagaagatcggccgcaacgagccttgcccgtgcggttccggcaagaaatacaagcactgccacgggcagctggactaa

SEQ ID NO: 7630 - DNA, 2178 bp, Pseudomonas aeruginosa
atcttcgacaatcgattgcccatggattcaaccttcctcttcgtcgccccgccgcaggctgctaccgggttgcggcagagcgggcggcagggccttggcttgtgccggggcgaccgcttcggagctttccagcggcaggcggatgctgaagcaggtgccgcggcccagttccgagcgtacttccatctggcccttgtgattgttggtgatgatgaaatacgagacggacaggccgagaccggtgccctggccgacttccttggtggtgaagaacggctcgaagatacgcttgcgcaccagttcgggcatgccgctgccgttgtcttccacctggacttccgcccagggcggcgtcaggcgcgtgcgcaggacgatccggccctgttcgccttcctcttcgtcgtcgcgctggtggatggcctgggcggcgttcttcagcaggttgagcaggacctgctcgacctcgttggcgatcaccggcaccgggccgaggttggggtcgaactcgtggacgatctgcaacgacttgaagtcgaagccttcggccaggtcgaagtcgttaccggcgatttccaccgcctgttcgagcagtgcgggcagttcgcaagcggtcatctgccggtggctgcggcggctgaaggcgagcatgtgggtgacgatcttcgctgcccgcgagccggcgtgctggatgccttccagcaggcgcgggatgtcgcggccgtcgaggtagtgattgatgtcttccagcggcactccgacctcggccgccagctcgacgttcttcgccagctccggggacaggcgccgcttgatgttctgcacgttgtgcaggatcgcgccgagcgggttgttgatctcgtgggccatgccggcggcgaggctgccgaccgagagcatcttctccgattgcaccatcacttcttccaggctcagccgctgggtgatgtcgtcgatgcggatcaccgcgccgcggccggtgccgcccatcagcgggtagaaggtcagggcgtagtggcgtggcgtgtcgatcagcgcccaggtgacccgttcgacacgctccacgctgtgcttctcggcagcccgggtgagctgcggaaggaacggcttgagcgagggaaaggcgaggaacaccggctggttgaccgcatcgtccaggctggtgccggaaagctggctggcctcctggttccactgcgtgacgtagagttgctcgtccaccgcgatcagcgccgaaggcatggagtcgatgatgctgttgaggtagtgctggaaaccggtgagcttcttctcgatcttgctgcgcacctgcacttccagttccagcttgcggttcgagcggcgggtttcctcggccaggctctgggcctgctcgaccgcttcctgggcatcgtcgcgggcgcgcttgagctgctgctcgcgggcctcgatgcgggtcagcatggtgttgaacgcgtcggccaggcggccgatctcgtcgccgttgccgcgctgggcgcggagggcgtagttctcctcgcgggtgacctgccgcgacagttcctcgagatcgcggatcggccgggtgatcaggcggcgtatctgctgcgccaccagcagccagagcagcacgctgacgccgaggatcgccaggctggcggtgagggttccggtgtagaacgcgctcggcagttcaccgctggccaccagcagcaggtagccgggacgggcgttttcctggggcagttcgatcagcgcgttgaggcggtactcgccgcgcctccagtgctccaggcggtccaggcgggccggcagcttgagggtgtcgccgcgttgcaggtcggccagcatcagcccattgctgtcgtacagggccgcggcgcgcaacggctggtaatcgttgagctggcgcagcaggacctcggcggtctgcggcgaactgagtgccggctggctgagcgccgggttggcgatcagccggccgatggtctgcatcgcctggggggcgacgctctcctgggaaatccagtaggcggcgctgatgaacgccaggttggccaccagcagcacggtagccagcaggatcagcagggcggcgagcagtttctgccctacgggcaggttgtcgaggcgctggcgcaggttcatgggctctggcggtccgcggcgaaaaggaatggcgggcagggtaacgcgctttag

SEQ ID NO: 7631 - DNA, 804 bp, Pseudomonas aeruginosa
ccggcctggctgagggcgcggccgatcatggcgctggaaaacttggcgtcgtcgacgaccaggatgctgagatcggggttgggcatgaacggactcgagaagaggatgggcgccggtacgctgccggcaagggcccggttcgtcgcgggaggccgggtcccggccgcggtcgcgcgcgccatcgggaagaaatcgtcggtctccgccacaccggcgggcattcgctcgcgagggctcggttataatgggcgggcattttttaccgtcaagccaggcgcggttccgtctgtgaaccctgtcgcgccgtccatctggagagatgacatgccttcgttcgacgtggtgtccgaactggacaaacacgagttgaccaacgccgtggacaacgccatcaaggaactggatcgccgtttcgacctgaaaggcaaatgcagtttcgaagccaaggacaagtcggtgaccctcaccgccgaagccgatttcatgctcgagcagatgctcgacatcctgcgttccaacctggtcaagcgcaaggtcgacagccagtgcatggagatcaaggatgcctacccgtcgggcaaggtggtcaagcaggacgtcaacttccgcgagggcatcgacaaggacctggcgaagaagatcgttggtctgatcaaggagcgcaagctcaaggtccaggccgccatccagggcgagcaggtgcgcgtcaccggcaagaagcgtgacgatctgcaggaggccatcgccctgctgcgcggcgaatcgctcggcatgccgttgcagttcaccaacttccgcgattga

SEQ ID NO: 7632 - DNA, 567 bp, Pseudomonas aeruginosa
cgaggtttttcggaacctctcgccatcccgggcatcgcaatagggagtagcgccgccgcgacctctcccgcgttgtccgcccctgtcggcgcagcgtcggttcgtccgcgctgcgccgattcgtatccaggcccggaaacgtcgccccacggcgtccgggcaggaatctgcaagcccgtcccgtttccgttgcggaagggaggggtgttttttcgagaaatggaggtaatgcatggaattgaactacgaccgactggtgcagcagaccgagtcctggctgccgatcgtgctggagtacagcggcaaggtcgccctggcgctgctgaccctggcgatcggctggtggctgatcaacaccctgaccggccgggtcggcggcctgctcgccaggcgcagcgtcgaccgcaccctgcaaggcttcgtcggcagcctggtgagcatcgtcctgaagatcctgctggtggtcagcgtggcttccatgatcggcatccagaccaccagcttcgtcgccgccatcggcgccgccggcctggccatcggcctggccctgcagggcagcctggctaa

SEQ ID NO: 7633 - DNA, 684 bp, Pseudomonas aeruginosa
tcaagcagcagggcgtatccgggcagcgtagccgaaccctggaggcggcgggcaagggcatggtgcggatcgtcgatggcggcagccataccgtcccgctggccagtattcgccagatggtgccgccgcgaccgctggtggaggacctggtctgggagggcaatctcgacgtcaagctggatagcaagcgcaacgacagcgacaaggacgaatggaagctcaagggcgatacccggcttcgccacggtgcctggcgccacgtgctggcgggggaagtggagcgggaaaagaaggacgggcgcaaggtcgaggacaactgggagctggactacgacctcgatcgcttcttcgacgaacactggttctggcgcggcagctattcgcagaagcacgatgcgatcgacaacctggagcgccagagcgcgctgggaaccggccccggctaccagttctgggacgacgaactcgggcgtttcgacctggtcgccgagatcagtcgctggcaactggagtggcgcgatcagccgcgcgaggatttcacctcctattcgctggagtgggactacaagcggctgctcgccggcacccggctggagctgtacagcaagggaaccgtgctggttcccggcatcgagcggatcgactacctgctcgacagcgaatacggcctgcgctatcgcctga

SEQ ID NO: 7634 - DNA, 279 bp, Pseudomonas aeruginosa
tgccgcccaagccgatcctccaggactgggtatggaacggcaacgtcgatttctcgctggaccgcaagcaggccgagaacgatgtgtccgactacgacatcgatttcaagaccaacgcccgccacggactctggcgccacaacgtgcagggcgagtacaaccgcgagaagaagaacggccaggtcagcaccgacaattattccggccagtacgcgctggaccgcttcatcgacgaccactggttctggcagggccaggtcgcctacaagcgcgacatga

SEQ ID NO: 7635 - DNA, 1743 bp, Pseudomonas aeruginosa
aggcggaatgggacaagttcagcggcaacgacggcaacgtcaaccagcgccgctataccatcggcctcggggtcggctggtaagccggcctgcacgaaaaagccccgcgatagcggggctttttccttgcggggccggggcctacaggcgcaggccgccgtccagttcgagaacgcggccggtgtagtagtcgttctcgaagatgtaggccaccgagtgggcgatctccaccggcttgcccatacgcttgagggggatgccggcggtcatcttctccagcgcctcgggtttcatcccggcggtcatctcggtctcgatgaagcccggcgccacgccggccacgcggatgccgtagcgcgccagttccttcgcccagaccacggtatccgcggccaccccggccttggctgccgagtagttggcctggcccatgttgccggcgcgggagatcgaggaaatgttgacgatcgcgccttcgttcttcagctcgatcatcttcgccgccacttcgcgggtgcagaggaacacaccggtgaggttgacgtcgatcaccgattgccattgggccaggctcatcttgctcaactggccgtccttgaccttgatggtcaggccgtcgcggaggatgccggcgttgttgaccaggccgttgatcgcgccgaagtcgctggcgacctgggccaccatgtgggtaacctgttcctcgtccgccacgttgcacacgtaggcgcgagcgtcgccgccggcggccttgcaggcagcgacggcttcgtcgagacgttcgcggttgagatcgaccagggccagcctggcgcccttgccggcgagatattcgcccattgcccggccgagcccctggcagccgccggtgatgatgatgaccttgtctttcaattgcattgcttggaaccccacgagcagtttctggaagcggaccttgccggcacctgcgaacgtactttgatatgcccgtccgtttacgacggattctatgcaaggagtcataaattgagcgttgaagctgcaaagaatgcccgagaattgctgctcaaggaataccgtgcggtcctttccacccactcgaagaaatggccgggctttcctttcggttcggtggttccctattgcctggatgccgaaggccggccgctgatcctgatcagccggatcgcccagcacacccacaacctgcaggcggacccgcgctgctcgatgctggtaggcgagcgcggcgccgaggatatccaggctgtcggccgcctcaccctgctggccgaggcgcggcaattggcggaggaggaggtcgccgcggcggccgagcgttactaccgctatttccccgagtccgccgactaccatcgggtccacgatttcgacttctgggtgctgcagccggtccagtggcgtttcatcggcggtttcggcgcgatccactggctggccgccgagcgcgtgccgctggccaatccgttcgccggagaagccgagcgcggcatggtcgagcacatgaacagcgaccacgccgccgccatcgcccactatgtggaactggccggactgccggcgcatgccgcggcgcagctggcgggaattgatacagaaggtttccacctgcgcatcggccagggcctgcactggctgccgttccccgccgcctgcggcaaccccggggccgtgcgccaggcgctggtgcaattggccagggccgagcgctggcctaccgtcgagccggagcagggttga

SEQ ID NO: 7636 - DNA, 537 bp, Pseudomonas aeruginosa
attcttcccccggctggcgccaactactggtggtaccgggggcaaacgggccccgccaaggactctgaaatgcgcgctttcctctttctgctgttgctcttcccgctggtcgagctggccgtcctgatcaaggtcggcagtgtcatcggggtcggctggaccctgttcctgatcgtcgccagcgccttcatcggtgctgcattgttgcgcgtggccggcgtggccaccgcctggcgcgcccgcgaacgactggcccgtggcgaactgccggagcaggaaatgctcgaaggcctgttgatcgccgtcggcggcggcctgctgatgctgccgggtttcatcagcgacatcttcggcatcctctgcctgattcctttcacccgtcgcctgatgctcggcggcctgcgccgccgcgtcgaacagcaggcgctgcgccggcgcgccttcgccgacgacctgaacgcccgctacggacagggtccgtcgcggccgaacgtcatcgagggcgagtacgagcgccgcgacgattcgcgcaactga

SEQ ID NO: 7637 - DNA, 192 bp, Pseudomonas aeruginosa
aatggcttgtggcgaccttatgtaacggtcaccgcaaggtccctgccacaagggcaggctgtcttacgcggctcgcgcgtcgagtcgcaacccggcaacgccggcttcaacaaaacccgccggacttcgatccggccgttggaaaccactgtttgggagagttacgactatgaagcttcgtcctctgcatga

SEQ ID NO: 7638 - DNA, 1656 bp, Pseudomonas aeruginosa
aggaaagagaacatggctgccaaagaagttaagttcggcgattccgctcgcaagaaaatgctggtcggcgtgaacgtgctggccgatgccgtcaaggccaccctcggcccgaaaggccgcaacgtggttctggacaagtccttcggcgctccgaccatcaccaaggacggcgtttccgtcgccaaggaaatcgagctgaaagacaagttcgagaacatgggcgcgcaactggtgaaagacgttgcctccaaggccaacgacgctgccggtgacggcaccaccaccgcgaccgtcctggcccaggccatcgtcaacgaaggcctgaaggccgttgccgccggcatgaacccgatggacctgaagcgtggcatcgacaaggccaccgtggctatcgtcgcccagctgaaagagctggccaagccctgcgccgacaccaaggccatagcccaggtaggcaccatctccgccaactccgacgagtccatcggccagatcattgccgaagccatggaaaaagtcggtaaagaaggcgtgatcaccgtcgaggaaggctcgggcctggaaaacgaactgtccgtcgtcgaaggcatgcagttcgatcgcggctacctgtccccctacttcgtgaacaagccggacaccatggctgccgagctggatagcccgctgctgctgctggtcgacaagaagatctccaacatccgcgaaatgctgccggtgctggaagccgtcgccaaggccggccgtccgctgctgatcgtcgccgaggacgtcgagggcgaagccctggccaccctggtggtgaacaacatgcgtggcatcgtcaaggtcgcggctgtcaaggctccgggcttcggcgatcgccgcaaggccatgctgcaggacatcgccatcctcaccggcggtaccgtgatcagcgaagaagtcggcctgagcctggaaggcgctaccctggagcacctgggcaacgccaagcgcgtcgtgatcaacaaggaaaacaccaccatcatcgatggcgccggtgtgcaggctgatatcgaagcccgcgtcctgcagatccgcaagcagatcgaggaaaccacttccgactacgaccgcgagaagctgcaagagcgcctggccaagctggccggcggtgttgccgtgatcaaggtaggcgctgccaccgaagtcgagatgaaagagaataaagcccgcgtcgaagacgccctgcacgctacccgtgcagcggtggaagagggcgtggttcccggcggcggcgtagccctggttcgtgccctgcaagccatcgaaggcctgaagggtgacaacgaggagcagaacgtcggtatcgccctgctgcgtcgcgccgtcgaatcgccgctgcgccagatcgtggccaacgccggcgacgagccgagcgtagtggtcgacaaggtcaagcagggttccggcaactacggcttcaacgctgctaccggcgtgtacggcgacatgatcgagatgggcatcctggacccggccaaggtcactcgttccgctctgcaggctgcggcctccatcggcggtctgatgatcaccaccgaagccatggttgccgagatcgtggaagacaagccggccatgggcggcatgcctgacatgggcggcatgggcggcatgggcggcatgatgtaa

SEQ ID NO: 7639 - DNA, 576 bp, Pseudomonas aeruginosa
actggcacgcttcgggcgatccggcgtactccggcctttgataggtgcctcgctttgtgccaatcttgccgacaggagatggcattcctccttcaaccgcccctggggctgatgatgcctacgcatgaacctggaaaggcgcgtaggcgctcgcctgccgcctgtccgaatcgctcctacaaggacaggactatgtggaaatccattctcgccatcgccctcggcgccgccctgggggcgttgctgcgctggttcctcgggctcaagctgaacagcctgctgcccagcattccccccggcacgctgctggccaacctggtcggcggctatgtcatcggcgcggcgattgcctatttcgcccaggcgccgggcatcgctccggaatggcggctactgatcatcaccgggttctgcggcggcctgaccactttctccaccttttccgccgaggtcgtcagcctgcttcaggagggccgcctgggctgggccgccggggccatcgcgacgcacgtcagcggctcgttgctgatgaccctgctggggttgttctcgatgaactggatgctgggcaaatag

SEQ ID NO: 7640 - DNA, 729 bp, Pseudomonas aeruginosa
atgcgcgagaggcgctcaatcggtcttcctgcgaaggagtgggacatgcgaatactggtggtcgaagacaaccgcgacatcctggccaacctggccgattacctgtcgctcaagggctataccgtggattgcgcgcaggacgggctgtccggcctgcacctggcggccaccgagcactacgacctgatcgtgctcgacgtgatgctgccgggaatcgacggctatgccctgtgccggcgcctgcgcgaagacgcacggcgcgacaccccggtgatcatgctcaccgcccgcgaccagttggacgatcgcctgcaggggtttcgttccggagccgacgattacctggtcaagcccttcgccctttccgaactttccgcacgcatcgaggcggtgctgcgtcgcgcccagggtggcggccgccgcgagctgagcgtggccgatctcagctatgacctggataccctggaggtcaagcgcgcgggcaagtcgctcaagctcaatccgatcggcctaaagctgctcgccgtgctgatgcagaagagcccccatgtggtgcgccgggatgccctggaagaagcggtctggggcgacgactgcccggacagtgacagcctgcgcagccacgtccatcaactccgtcaggtgatcgacaagccattctccgtggccttgctgcatacggtgcatggcgtcggctaccgcctggcggaggagccgaatggagtataa

SEQ ID NO: 7641 - DNA, 423 bp, Pseudomonas aeruginosa
ggccatcgaagtagcgctgatcgacctggagaagagccgccgccgccttacggtgaacaaggcgtcccagcacgacctgaagcagttgaagcgccgttcgtcgtggactggcgcgcagtggcaagccttcatctatggttaccagacggcgtttggcagcgccatcaaagggttgcagacatgaaattagaaatcactcgaggtttgttgctggtcggcgctctcgccgtggctacagccgcggctgccgcctggcacgaacccgcgccgaacgtggtgcagatgagcggcggtcatgagtactgcccgacgccttcggcgctcaaggccgagcggccgacgcgccaggaggtccagccgaacaaggacatcctgctgctgatgttcggtctttcccaggggggagccagcctgtcgcgctga

SEQ ID NO: 7642 - DNA, 1347 bp, Pseudomonas aeruginosa
aagccatgtttcagtcccttggcaagccttccgccacggagtaggaaggcgcgcgactcagtgctcttgctggaggtcccgctcggcgacgatggccaccgcggcgccgttgtcgagcttcagttgcccggaagtcactacctgctcgccgccctccaggccttcgagcaccaccgccaggccttcgcggcgttcgccgatcctgacgaagcggcgctcgacgacctgttgcggctggcccttgtcatccttcgacacctggccctgctcgtccttcttctgcccgacgacgtagatcgagtcgccgtagagggtgaaggtgatcgccgtctccggcaccacgacgcgttgttcctcgccaggcaacatcacctcgaggttggcgaacatgcccggcagcagcttgccgtccgggttctccagggcagcgcggacctgcaggttgcgggtctcgttgtcgaccttggggttgatggcggcgatctcggcgtcgaacacctggccggggtaggcggcgacccggaccttcaccagctggccgcggctgagcagggggaagtcctgctcgggcaggtggaaatccaggagcagggtggaaaggtcctgcaaggtggcgatcggcgtcccgggcgagacgtagtcgccgacgtccacctggcggatgccgatggtcccggcgaagggcgcgagcacgcgcttcttcgccagcgccgccttcagctcggcgacggtggcgctggtcttggcccactgcgcggcgagacgatcgaattcgcttttcgagatggccttgctgccgatcagttcgcggccgcgctggtactcggccctggccaggccgagatcggcctcggcagtgcgcagggtggcttcctcgacgtcgctttccaactggatcagcggttggtccagcttcacctggtcgccggaaaggaacagtacgtcgcgtaccgtgccggagacttcggcggtgagggtcacgccctggaatgccttgaggctgccgatggctggcaggcggctctgccagggacgcttttcggccaggctggcggtcacgctgatcggcggtttcggtgcgctgaaaagggcgatctgctgacggatggagtagaccttgtagccggcgagaatcgccaccacggcgatcaccgcggcgagcatgatcaacatgcggcggagcaacataatcctggtccctggtatgccgagagcgccccgtttcggggcgaatccgacacattacgtgcagctttcagggcttgtcaaagcacaggattggcgaaagatttcaagcgtgttgcaggtcgcttccgactttcgcggaccggtatggcgagaggttga

SEQ ID NO: 7643 - DNA, 834 bp, Pseudomonas aeruginosa
gggcaaaggccggcggcggcgcgctgcgacgggcttctgcaagctcgccggcgaacaccgccgcattctctctggactgcctggcggcgcgagggttcgctcgggaagacggaaactgcgttatccccggaacagcagttgcgcggccatgcccagcatcatggccgccaccatcaggtcgagcaggcgccaggtggccgggcgcgccagccagggggccagccatgccgcgccgagggcgagggcgaagaaccacatcagcgaggcgctggccgcgccgagggcataggcgcccggcgcggcctgctgggcgccgagcgaaccgatcagaagtacggtatcgagatagacgtgggggttgagcagggtgaccgccagtgccgccagaagcaccgccttgcgcgagcgtggcccggtttccgcggcgttgccgagggcgtccgggcgcaacgcgcgaagcagcgccttgagcccgtaccaggtcaggaaggcgatcccgccccagcgggcgatggccagcagcgtcgggttttccagcagcagcttggccaggccgaacacgccgaggctgaccagcaccgcgtcgcagaacacgcagagcgcggccaccgagaggtgatgctcgcggcgcaggctctgcgcgaggacgaaggcattctgcgcgccgatggcgatgatcaggccggcagccaccaggatgccgttgagatagctctgccacatgtcagtgtgcctccgccgccagccgctggagcacggcgagggcgcgccggccctcgtcgcgggcgacgaacaggtggtcgtggaaatagccggccatcacgttgcaactga

SEQ ID NO: 7644 - DNA, 900 bp, Pseudomonas aeruginosa
ttttgttcgactacaagttgctcgccgcgctggccgcagtggtggagcagggcggtttcgagcgcgccgcacaggcgctggggctgtcgcaatcggcggtatcgcagcggatcaagctgctcgaggcgcgggtcggccagccggtcctggtgcgcgagacgccgccgcatcccaccgatctcgggcgccgcctgttcaaccatgtgcagcaggtgcggctgctggagggcgacctgcagcgctgggtgccgaacctggatgaaggcggtgccccggagcgcctgcgcatcgctgctcaacgccgatagcctggcgacctggtgggccgccgcggtgggcgatttctgcgccgagcggcgggtgctgctggaccttgtggtggaggaccaggaggtcgggctcaagcgcatgcgcgcgggcgaagtggccggctgcgtctgcggtagcgcgcggccggtggccggcgcgcgttcgctgctgctcggagccatgcgttatcgcggcctggccagcccggatttcattgcccggcactttccccgcggggtcgaggcggccgccctggccggcgtgccggcgatcgtgttcggcccggacgacctgctgcaacaccgctttctcaaggacctcggcgtcgagggcggtttcatccaccacctctgcccgtcctcggaaggtttcgtccgcctcaccgccggcggtctcggctggggcctggtgccggagcgccaggtgcaaggcgagctggcgcgcggtgaactggtcgagctgctgcccggccaggtcatcgacgtaccgttgtactggcactactggcgcaacggcggcgaactgctcgcgtcgctcaccgagcacctgctcgcccgcgccggcgacggcttggtgcgggtgtcaggctga

SEQ ID NO: 7645 - DNA, 1128 bp, Pseudomonas aeruginosa
cgcgcagcgccgcttctgtcgcccaacgcaagtcgtgccggcggcccgcaaggtcgttgttctggcatgctgtgccagtggtggcgcggctccgggttgctagagtcgcggcacaagaagaacaacgggagaaacgcaatgcggattctggtaacgggggcgacgggcttcatcggcgggcgtttcgctcgcttcgccctggagcagggcctgtcggtacgggtcagcggtcgtcgtgcggacgcggtggaacatctggtggcgcggggcgccgagttcgttcccggcgacctcgccgacccggcgctggtcgtgcgcctctgcgaggatgtcgaggcggtggtgcattgtgccggcgcggtcggagtctggggaccgcgcgaacgcttcctggcggccaacgtcgggcttgccgatagcgtcgtcgaggcctgcatgcggcaaaaggtgcggcgcctggtgcatctgtcgtcgccgtcgatctatttcgacgggcgcgaccacctggacctgaacgaagagtacgtaccccggcgtttttccgaccattacggggcgaccaagtaccaggccgagcaactggtgctcagcgcccgcgacctgggcctggaagtgttggcactgcgtccgcgcttcgtggtcggcgccggcgacaccagcatcttcccgcgaatgatccaggcccaccgcaagggacgtctgcggatcctcggcaacggcctgaaccgggtcgacttcaccagcgtgcacaatctcaacgacgcgctgttcagttgcctgctggccggcgagccggcgctgggcaaggtctacaacatcagcaacgggcagccggtaccgttctgggatgcggtcaactacgtgatgcgccagctcgacctgccgccggtcggcggtcacctgccgtatgccgtcggctatggcctggcggcgctcaacgaaggcgtctgccggatcctgccggggcgcccggagccggtgctgttccgcctgggcatggcggtgatggcgaagaacttcaccctggacatcaaccgcgcccgcgaatacctcgactacgacccgcgggtcagcctgtggaccgcgctcgacgagttctgcgcctggtggcgcgcccagggactctga

SEQ ID NO: 7646 - DNA, 1230 bp, Pseudomonas aeruginosa
cgggccggcgtattgtcggctcggcgcctgcgcgggcaacagggaaggttccgccggcggcagcgcgaccccgctgagcctgccgaggcgctgtcccagctcccgcgtcgtcgcatcgccggagcgggcgcaggccgcctgcatcgcggcgatcgcatcgcgttgctggaagtggatatccagcgcctgttcctcgcgcaggcgtcggcgcacggcgcgcatgcaatccagcaaggatttgttcaactccatgcatcctccggctctcgaatctgcccggcaaagcccaggcaagcggcgtgccatgcgggccgcggaccagcgccggcgtgcgaggcggggaaccgctggcggcctgcggcggtctgtgccggacagcgttcgctccgtcttggggcgcacggcttcgcggtggagcgccccggtccggcaatttgcttcgagcagacgctgaaggggcggggccgaaccgatataatgcgccattcggccctttctcacaggcctccggcaggatgccgttccccttcacaggttttcaccatgcgtaacgatgctttcgacgaactcgacgatgtgcccagcctgaccaccgatgctgccgaccgtgatgaattcggccaccacccgcggcacgtttacgaaccggagcagcgccgggtcgtcgacaccaaggagcgccgtccggcctctaccggccccgttctgggccctgctcggggcgatgctgatcgccctcgccggggtgggttggtggagccaccagcaaatcagcctgatggaacagcagttggtggcgacccaggaaagcttcgtaaggatcagcgaggaagccgccgggcgcctcgacgacattcgcggcaaggtggtcgccagcgagtccagcgtcaccagcgaacgcgaggcgctgcgcctgcaggtcaagcaactgcaggagaaactcggcagccaggaacgccagcaggccgatgtgagcaaccagttcggcggccagggcaaacgcctcgaccaactggccagcgatctcaaggcccagcaggaaagcgcggcgcaactggtcgcgcaactggacggcaagctgcagacactggccgccgaacaggagaagctgaaagccctgcaggtcgaactgggaaagaccaacgagcaactcaaggccctcggcggcgatgtcgcggcgctgaagaagcagggcaacccgagccagacgatcaagggtatccaggatga

SEQ ID NO: 7647 - DNA, 594 bp, Pseudomonas aeruginosa
cctgctggtattgcgcagccagctcgacaaccgcccggcccagggcggcaataccgccgagttcgacgccttccgcacccaggtgatgcgcaacatcaacaccctccaggcccaggtgcagaacctgcagcagcagctcaatacccgctgaccccttgcgccgccagccgcccgtcgcaccgggcgctggcggcgacagttcgccgcgcccggcgaaaatccccgcttccattgctctggatcagcgaatccgctgctcctccactccgatactgcgtccttaagcgagccttaagtgagagtcgtttagattctcggtcaccggccagggaggccattggtcccttcctctgcctggaatccgccatgagcgcattgcaaccatcccgttcctaccgcatcaccggttattcccccgccatcagcaacggctatcgccaacgcctgttctccatggggcttctgcccggcgcggcgctgcgcgtggtgcgcatcgccccgctgggcgacccgatccaggtcgagacccgccagaccagcctggcgctgcggcgcaaggacctcgccctgctgaccctcgtcccgctcgactga

SEQ ID NO: 7648 - DNA, 612 bp, Pseudomonas aeruginosa
tcgaaacgacggttccgtccctggggtaagctagcccgcatgaactacctcgcgcatctccacctcggcggcccgcaaccggcccaactgctcggcagcctgtacggcgacttcgtcaagggccgcctgcagggacaatggccggacgagatcgagcgggccatccagttgcaccggcgcatcgacgccttcaccgacagccacccactggtgcatgcggccaagcggcgcttcccgctggagcgccggcgtttcgccggcgtcctgctggacgtgttcttcgaccactgcctggcgcgcgactggaacgactacgccgacgaaccgctgccgcagttcgtcgagcgggtctacggcaccctgcgcaccgcctcgccgctgccggagcgcctggcgcgcatcgcgccgcggatggcggcccaggactggttgggcagctaccgcgagttcgcggtcttgcgcgaagtgctgggcggtatgtcgcggaggctgtcgcgaccgcacctgctggacggctcctgggaagaactggcccagcgctacgatgacctgagcgcggatttccgcgccttctacccgcaactccaggctttcgccctgagccagcgctga

SEQ ID NO: 7649 - DNA, 678 bp, Pseudomonas aeruginosa
cgcgccgttgttcaacgctggcaccctcggcaggatgccggttccgacacattccacactggagtccgccatgtcctggcaacgcttgctcggcccgctcgaccgcctgcccaccgaaggctccctggaagactggcacgccgccgccctggcgcgcgccgacggtcttggcaccctggagcgggcggtgctcggcggacgattggccgcgagtccgggcctggccttcctcgccggctaccaggcggccctgcgcgcgctctggccggcggcgccggaaggtctcggcgcgctgtgcgtgaccgagaagcgcagcgtgcgcccggcggacctgcagacccgcctggaggggctggtcctgcatggacaaaaggatttcgtcaccgctggcgacagcgcctcctggtggctggtggccgcccgcgacgaggcaccggggcagccgccgcgactgtcgatgacggtggtcctggccggcgccccgggggcgcgcctggaggcgttgccggcgctgccgctgatgccggatgtgccgcattcccgcctgttgctcgacggtgcccattgcgagcgcctgcccggcgatggttgggacgactacgtcaggccgttccgcctgctggaggatgtccatgtgctggcggcgctggtcggctggctctatggggtcggccatga

SEQ ID NO: 7650 - DNA, 1161 bp, Pseudomonas aeruginosa
tcgtgcgctacgccgacgaccgcgacgggcgtttccgccacaacgaattcctgcgcctggcacaggcggcgttcgccggggaggcgcggccatgatccgtcgccatcccttgctcttcctgttcgtcctggggctgctcgccgccctcgcgtgggcctggcagaaccgcatccacctggcggcctttcccgccatcatcggcgcctatacggccaaggagtactgctcctgccgctacgtgatggggaactccgcggactattgccgggcctatacccaacagtacgtgccgatcagcggcttcttcgacgacgaagcccgccgccgggtgaccgcccgcggcctcggcagtacgcagacggccgcctggctgggcccgcgcgagggatgccggctcatgcccgaggcggacaggctgccggactgaccggcggcgcatgtcggggcgcggggcgagggacggcgccggcccgaagccggaggtggaatgcctgttgtattgtgtgtcctgttgttgctcctcagccctctgctgtcggcggcggaatggcaactggagccggattactcgcggatcagcttcgtttccgtgaaacgcgcgaagatggccgaggtgcagcgcttcgatcgtctcagcggccagatcgacaagcagggcgtcgcgcgcatcgtggtgccgctgggcaccctggacagcggcctggccctgcgcgacgagcgaatgaaggacaacttcttcgaaacctcgcgcttccccgaggccaccgtggagagccgcctggacatggccggcttcgacgacctgcgggtcggccagtcgcgggtcgagaagctcgacttcaccctcgacctgcacggccagcagcgccgcctgaaggccgacgtgctggtcacccgccagggcgaagggctggtccaggtggcgaccctggagccggtgctgctgaagctgctcgacttcgacctggaagagaagctcaagcccttgaaggagatggccaatattccctcgatcactcccgaggtaccggtgttcgccgtgctgaacttccgcgaagtgccgccggaacagttctgacgtaccggcggagggcggcgcgggccttgggttccacccagtggaaccgccttccgttgtccttcgccgcgtgccgcgcttag

SEQ ID NO: 7651 - DNA, 1296 bp, Pseudomonas aeruginosa
ccacgcccggccggccttgcgtccgggcctcccgccaacaagaccggagcgcaatccggccagaggagagacggcatggctcgacatcgacacatcgtggcctggctcgaggaggtcgccgacgacctgcgtagcctgcgccaggacatccacgcccatcccgaactgggcttcgaggagcgacgcaccgccgcgctggtcgccgaatgcctgcgcggctggggctacgaagtgcacgaagggatcggccgcaccggcgtggtcggcgtcctccgccagggcgacggcacgcggcggctcggcctgcgggcggacatggatgcgttgccgatcgtcgaggccacggggctcggctacagcagctgccacggcgggcgcatgcacgcctgcggccacgacggacacaccgcgatgctgctcggcgcggcacgctacctggcggcgacgcggcgtttcgacggcaccctggtactgatcttccagcccgccgaggaaggccagggcggcgccgaggcgatgctcgccgacgggctgctggagcgctttccctgcgatgcgctgttcggcatgcacaacatgccgggactggaggccgggcacctgggcttccgcgcgggaccgatgatggcttcccaggacctgctgagcgtcaccctggagggcgtcggtggacacggttcgatgccgcacctgagcgtcgatccgttgctcgccgcgtcgagcgcggtgatggccctgcagagcgtggtggcgcgcaacgtcgatccgcagaaggccgcggtggtcacggtcggcgcattgcaggccggcgaggcggccaacgtcataccccagcgcgccgtgctgcgcctgagcctgcgggcgctcgacggccaggtgcgcgagcaggtgctgcagcgggttcgccagatcatcgagttgcaggccgccagctatgggtgccaggccagcatcgagcactacccggcctatccggtgctggtcaacagcgtcgaggaaaccgagttcgcccgccaggtcggggtcgagctggccggcgcggagcaggtcgacggcgacacgccgaagctgatgggcagcgaggacttcgcctggatgatacagcgctgccccggcagctacctgttcatcggcaacggcagaggacggccgatggtgcacaacccggcctatgacttcaacgacgacatcctggtccggggcgcggcctattggggcgcgctcgccgagacctggctggccgcccccgcggcgtccggccttcgactgactgccgccaataacggcgcggcatga

SEQ ID NO: 7652 - DNA, 1152 bp, Pseudomonas aeruginosa
gccgcgccggcattcccccggttaccaggagattcccatgcacgcttgcccgagcggtacctcgcgtacccgccaggtggcggctgccgtgatcggcaacgccctggagtggtacgacttcatcgtctacggcttcctttccagcctgatcgccaggctgttcttcccttccggcgacgagtacacctcgctgttgatggccctggccaccttcggtgtcggtttcttcatgcgtccggtcggtggggtcctgctcggcctgtatgccgaccgcaggggacgcaaggcggcgatgcaactgatcatcctgctgatgacgctgtccatcgcgatgatcgccttcgccccgacctacgcggcgatcggcgtcggcgcaccgttgctgatcgtgatcgcgcgaatgctgcagggtttcgccaccggcggcgagtacgccagcgccacggctttcctggtggaaagcgcgccgccgcaccggcgcggtctctacggttcctggcaattgttcggccagtgcctggcggtgttcgccggtgcggggatgggcgcgctggtcacccattgcctggacgccgagtccctggagagctggggctggcgggtgccgttcctgttcggtctgctgatcggtccggtgggattgtggatccgccgctacatgggcgagaccgaggccttcctcgaagccatccgggagcccggcgagcgccaggggctgctctgcgtgctgcgcgaataccggcgcagcgtgctggtgagcatgggcctgacggtgatcggcacggtgtccttctacggggtgctggtgaatatgccgaccttcgcccacaatcggttgggcctgccgctggacgaggtgttcatggtgcaaatggctgcggtggcgctgatgaccctggtgatcccgttggctgggggactctccgaccgggtcgggcggcgcccggtgctgctggtcgcgaccctggccttcatgctcatggtctatccgctgttcgcctgggtcgccgcggcgccgagcctggggcgcctgctgctgatgcaactgttgctgtgcacggcgatcggcggcttcttcggcccggcgccgaccgcggtggccgagcagtttccggtgcgggtgcgttccaccggcctggcggtggcgtataa

SEQ ID NO: 7653 - DNA, 1476 bp, Pseudomonas aeruginosa
cgcgctgccgctgtccgcggcgatccgccgacgcgaactgtcctgccgcgaggtcatgcaggcctacctggcgcagatcgaacggttcaacccgcgggtcaacgccatcgtctcgctgcaggcggaaagccgcctgctcgcccaggccgacgagcgcgaccggcaactggcgcgcggcgaatggctgggctggatgcacggcatgccgcaggcgatcaaggacctcgccgccacctccggcattcctaccaccctgggttcgccgctgttcgccgggcaggtgccggagcacgacgccatcgtcgtcgagcgggtgaagagcagcggtgcgatcgtcatcggcaagaccaacgtaccggagttcgggctcggctcgcagacctacaacccgctgttcggcaccacccgcaatgcctacgatccggcgcggatcgccggcggcagcagcggtggggcggcggtggcgctggcgctgcgcatgctgccggtggccgacggcagcgacatgatgggttcgctgcgcaaccccgccgcctacaacaacgtctacggcttccgcccgtcccagggacgggtgccgcacggcccgcaagcggaactgttcgtccagcaactggccaccgaaggcccgatggggcgcagcgtggccgacctggcccggctgctggccacccaggccggctacgatccgcgctgtccgctgtcgttgcgcgacgatccgcgcaggttcgccgacgacctcgggcgcgatttccgcagagcccggctcggctggctcggcgactacgccggctacctgccgatggaggagggcgtgctggagctttgcgaagccgcgctgggcgatttcgccgagctgggctgcgacgtcgaggcgtgcctgccggactatcccctggagcgcctgtggcgcacctggctggtccatcgccagtggctggtgcagggctcgcttggcgagctttacgccgatcccgcacggcgcgtccggctcaagccggaggcgcagtgggaagtggagtccgggctcggcctcggcgccaccgaggtctatcgcgcctcgctggatcgcagcgactggtatcgggcgctggcgcgtctgttcgaacgttacgatttcctcttgctgcccagcgcccaggtgtttcctttcgatgcagaaacggcgtggccgcggcaggtcgccgggcggccgatggacacctatcaccgctggatggaggtggtgatcggcccgaccctggccggtttgccggcgatcagcgtaccgatcggcttcggcgcggcgggcctgccgatgggattgcagataatcggcccggcgcaggccgacctggcggtgctgcaactggcccatgcccacgagggcctgacccgttgggtcagccgccgtccgccggcgatgctcgaggctccagggggcatcgactaggccgcggagcaatgctggcgtattcgcagattcttcctacatga

SEQ ID NO: 7654 - DNA, 618 bp, Pseudomonas aeruginosa
cgccgccgagcgcttccgctgccagatggtggagcgttccgcgccgctgctggtggagttgagcgagcgcaccgggctggtcgccgatttgtcgattctcgacggcgaccgcctgctggtggcggaaagctcggtgcccggcgtcctgcgcaagcgctacccggccaaccggctggtggtcggccagcacgccagcctgttccattcggccatgggcaaggcctgcctgggcgaactggcagacagcgaggtgcgccgcctggcgcgccagcaccaggtagacgaggacctctggttgcgcacccgcgagcaggcccacggccagggctacggcgagcgtaccgagggacactgggagtatccggtgcgcctgccgttcctgatccgcgcggtggccttgccggtacgcgcccagggtcgcctgctcggcagcgtggcgctgcactggccgcgcgaccaggattgcgtcgaacgggtgcgccgccggcacctgggaaccctggccgataccgtcagtcagttgcagcacgcgctcgactgacgcgggagtttgcctgctcccaggcggccggtttaaggtggcgccggacgcaaagggagcccgcatgcacaagttga

SEQ ID NO: 7655 - DNA, 951 bp, Pseudomonas aeruginosa
cggcgtgcggttcttcccgcgcatgctgctggccatcgaggcggcgcagcggagcatcgagctggagctgtacctggtggaagacgggcattgcgccgaactgtttctcgtcgccctgctggatgcccgccgccggggcgtcgccgtgcgctgcctgttcgacggcttcggctgcctcggcctgggcagcgcctggatccagcgcctgcgcgaggccggcggcgaactgcggctgtacaacccgctgcgctggaagctgactggcggcaatctctaccgcgaccatcgcaagctgctgctggtggacgggcgcctcggttatgtcggcggcgccgggatcaccgacgaattctgggaaccggtcagcgacgtcagcgcctggcgcgaggtgatggtcgagatggacggcccggtggtggcggactgggcggcgctgttcgagcggcaatggctggcctgtctcgaagagaaagcctggaagccccgcgagggcatgacccttacccgccttccgccgcagccgggggcggcccgtgggttgggccgggtggcctacgccgacgcccgccagcaccgcgacatcctgcaatcgctggtccgcgcgctgaacggctcgcgccgacggatctggctggcgacgccgtacttcctgccgacctggaaggttcgccgggccctgcgcaaggccgcccagcgcggcgtggaggtgcgcctgctgctggccgggcggctcaccgaccacgccccggtgcgctatgccgggcagcgctactacccgcgcctgctgcgcgccggcgtgcgcatccacgaataccagccgcgcttcctgcacctgaagatggtcatggtcgacgattgggtgagcgtcggctcctgcaacttcgatcattggaatctacgcttcaacctcgacgccaatctcgaggccctcgacccggacttcaccaatga

SEQ ID NO: 7656 - DNA, 762 bp, Pseudomonas aeruginosa
cgagcgccttatcgccgtgccggggcgttgtctcgacgactggcgcgcctgcaccgaggcggcggccgcgttgccatcgtcgctgctctactacccgctgttcctggtcctgctggtggcgttctgcgtgctgttccaggagcgcggcgtggtgccggtgcgcaagtggctggtgcgccggctgatgccggcgccggcgctggccaaggtgccgcgcccggcctgaggccgttctcccggagaaccggactttcgacgggtggcaggcccgacccggctggttatgctgcgcggataaccataagaagagggatggagcatgctgcgcagcctgtcgctggccctgtcgatcgtcgcgagcctggtcggctgcagcacgcccggcgcgttcttcggtgcggtggacggaccggccttcgtcgcccattcgagcgccgatgccagccacgccaccgtctacctctaccgtccgcggagccagtgggcggacgaggaactcgaggcgccggggatcttcctcaacaacgaactgatcggcagcctgccgagcaacggctacctggcgttcgagttcgagaccggcagctacaagctggaaatgcgccggccgctggcgggcagcttctggaccctgttcgccgacggtccgatggatttcacccgcatcgccagcttcatgctcgaggccagggccggctcggtctactacctgcgctacgacgaactcaacccgccaccgaagagcgagcacccggcgggtga

SEQ ID NO: 7657 - DNA, 1449 bp, Pseudomonas aeruginosa
ccggcatgtcctttacctcgaactcgtagatcgcttccatgcccagttcggcgaaggccagcaccttggattcttgatcgcctgggcgaccagataggcggcgccgccgacggccatcaggtataccgccttgttgtccttgatcgcctcgatggcgatgggaccgcgctcggacttgccgatcatgcccagcaggccggtctgttcgaggatctggcgggtgaacttgtccatccgggtggcggtggtgggaccggccgggccgaccacctcgtcgccgaccggatcgaccgggccgacgtaatagatgaagcggcctttcaggtccaccggcagcgtttcgcccttgttcagcatgtcgaccatgcgcttgtgcgcggcgtcgcggccggtgagcatcttgccgttgagcagcagggtctcgcccggtttccagctttgcacctcttccggggtgatcttgtccaggtcgacgcggcgcgcggacgggccggcttcccagacgatctccgggtaggcgtcgagcgacggcgcttccagttcggcggggccggagccgtcgagcacgaagtgggcgtggcgggtcgcggcgcagttggggatcatgcacaccggcagcgaggcggcgtgggtcgggtagtccatgatcttgacgtcgagcacggtggtcaggccgcccaggccctgggcaccgatgcccagctggttgaccttctcgaacagctccaggcgcagttcctcgatgcggttctgcgggccgcgggccttcagttcgtggatgtcgatcgggtccatgaggacctccttcgccatcaccgctgctttctccgcggtaccgccgatgccgatgccgagcatgcccggcgggcaccagccggcgcccatggtcggtacggtcttcagcacccagtcgacgatcgagtcggacgggttgagcatggccatcttcgacttgttctccgagccgccgcccttggccgcgacatcgacctcgaccttgtcgccgggaacgatggagtagtggatcaccgccggcgtgttgtccttggtgttcttccgcgcgccggccgggtcggccaggatcgaggcgcgcaggacgttctccggcaggttgtaggcgcgacgcacgccttcgttgatcatatcgtcgacgctcatggtagcgccgtcccagcgcacgtccatgccgacccggacgaacacggtgacgatcccggtgtcctggcagatcgggcggtggccggtggcgcacatgcgcgagttgatcaggatctgcgccatggagtcgcgggcagccggcgattcttcgcgcaggtaggcctcatgcatggcctggatgaaatcgaccgggtggtagtaggagatgaactgcagggcatcggcgacgctctggatcaggtcgtcttgcttgatcacggccatggagcacggtcctcttcaggcgggtaa

SEQ ID NO: 7658 - DNA, 1488 bp, Pseudomonas aeruginosa
ctggcagttcgttcgactaggcaacccgcagggggcagggtacattgcggccaggtgccattacgggacggagcccatgcgcacagacaagcctcctctgaaacagcgtgcgctgcaaaagctcttgctccgccggttcggcatggccgcaggcacctacctgctcggcctggtcctgctctggctggcgctactcagcggcttctaccgcgcagcgccgaccaccgcggcggccagcaccaccctggtggtggcttgccaactggccttcctctggctgttcgccagcggtcgcaacctgcgttacgccgatcccagcctgaccgagccgcaggtgctggtggcgatcgcctggctgacctatttcctctaccacgtcgacagcctgcgcggcaccttcatggtgttctacgtgctggccctgctgttcggtgtgttccaactgccgccgcgggtcttcgcccgctgtgcggcgctggcgttcatcgctttttccggcatctacctggtagaggccttgcagcagcgtctcgagctaccgggccgggctgcattgcatgtgctcgtgatgttcatcgtaatggtctggctgagcctgttcgccagctacatacaggcgatgcggcaacgcatgcgccagcgccgctatgccttgcaggcgcaccaggacacgctgcgcggcatgatgcgccaactggaagacctggtggccaccgacgaactcaccggtctgttcaaccgccggcatttcatgcgcatggccagccgggcgctggaagacctgctgccgaaccggcagcacggcctggcgctgatcgacctcgatcacttcaagcggatcaacgaccgccacggccacgccgccggcgatcgggtcctgcagaccttcgccgcggtggcgcgttcctgtctgcgcgatggcgacgtcctggcccgttacggcggcgaggagttcgtcctgctgctgccccacgccgacgcggaacagctggaaagctgttgcgagcgcctgcgcctggcgttccaacaggcggaaccggtcggggtcacggtggataccctgagcctttcggtgggcatgaccctgctgtatgccgacgacgatctcgacgaggccttgcagcgggccgaccaggcgctctaccgtgccaagcgcggcggacgaaaccgctgcgacgccacctgggaggtcaccagtgcctgacatacgggtcggcgagcgacgccttgccgtcgccgccggcagcaacctgctggatgcgctgctcgccggtggcatcgccgtgccccatagctgccgcgccggaagttgccacgcctgcctggtgcattgcctgcagggcgaggtggacgacaccctcccggaggcgctcgatccggcacggcgcgaagcgggctggcggctggcctgtcagtgccgggtgctcagcgacctcgtgttgcagcctttcgatcctgagcgcgacgggctgccggctagggtcgtag

SEQ ID NO: 7659 - DNA, 1176 bp, Pseudomonas aeruginosa
tggccgccggcaccgggctggcgccgctctgggggatacttcgcgaggccttgcgcgcggaacaccaggcgccgatccagttgctgcacctggcgcgcgaccactacctggcgagcgagttggcggagttggccgggcgtcatccgcaagtgcgcgtcaacctggtgtcggcggcgcagttgccctctgccttggccgatctccgccttgttccgcggcgcagcatggccttactctgcggccaacccgccagcgtcgaacgcttcgcccggcatctctacctggccggcgtaccgcgtagccagaccctggcggacctgttcctgccccacgcctgacgcggcgcggtggcggtgccttgcagccattgccgcggccctgcgccgcatccctggagtgacgatgagcgagctgattcgggtcgaacgcgaagcggggctgctgaccctgcgcctggaccgccaggacaagaagaacgcgctgacccgcgcgatgtacagtcggatggccgaggcgctgctggaggcgcaggccgatacggctgtgcgggtagtgctgatcactggcggcgatgcctgcttcaccagcggcaacgacatcctcgacttcctcgagcaaccgccatccctgcgcgacagcccggtcggccgcttcatgagcgccctgctggaattccccaagccggtgatcgccgcggtgaacggaccggcggtgggtatcggcaccaccctgctgctgcattgcgacctggtcttcgtcggtcgcaacgcgcgattgaagatgccgttcgtcaacctcggcctgacaccggagttcggctcgagcctgatcctgccgcgcatgctcggtcatgccagggctgcggaattgctgatgctcggccaggacttcagcggcgagcaggcggcggcctggggcctggccaatgcggcgctggaggatggcgccacggtgctggagcacgcccgcgatgcggcccggcgcttcctgcacctggcgccctcggcggtagtggagagcaagcgcctgatgaaagcgccgtttatcgaggagcttcgccgggtgatcgccgaggaaggcgatatcttcagtacccgactgcgctcgcccgaggcgatcgaggcgctcagcgccttcatgcaccggcgccagccggatttctccaggttcgcctga

SEQ ID NO: 7660 - DNA, 2946 bp, Pseudomonas aeruginosa
ccaatgcgccgccagccggagcagggctacatagaccagtacgccgatcaccaggtagaaggccgggcgcaccgtccacagcgcgccgaaggtcgcgccgccgaccagcatgcacagcggagcgaccagcagcacgctcatccattcgccggaagcgccggccagcgtgcccagcagccagcagagcagcgccccgccgagcagccagggccagcgcagcgcccgggcactcaacagcactccggccaacgatccatagatgaaggcgaccagcagcgcccaggcttccgccggcaattgccccagcgagactttcggcgcacccgacgacgcggccgccggcagcgtttcgccgtcgaccaggcggatcagctcgtccaccgcggcctcgatcccgccggcgtagtcaccctcgcgaaatgccggggccatccgctcgcgaatgatccgtccggcgaccacatcgggcaccgcaccctccaggccgtagccgacctcgatgcgcatgcgccggtcatccttggccaccaccagcagcagaccgtcgtcgaccgccttgcggccgagcttccaggcctggaacaacttgtcggagaaggcttcgatatcgagggtaccggtagtcggcagcatcaccaccgcgatctgcgcaccgcgtcgccgctccagcgcctcgagcttctccaccaggcgttggcgcgtcgcctcgtccagcgtgtgggtggcatccaccacccgctccgacaggggcaaggcgacccattccgccggcgcttcggcgtgcgcaggcatccagggcagcagccaggccagggcgagcaacaggaggacaggcgggaaaatacgatcagacaaggttcgatccatgaacggcaaagctctcatcccgagcgggtatcggccaaggctgccacagcgcggcgcgtagctccagccaggtcactcgtcgcgacgcaggtccggcgggatcggcaggtccttcaacgggctcggccgcttgcccttgccggcctggtactgcttgagctggtagacataggccagcacctgggccacggcgagatagagcccggcgggaatctcctggtccagctcggtggagtagtacaccgctcgcgccagcgccggcgactccatgaccatcaccttgtgctcctgggccacctcgcggatcttcagggccaggaaatcgttgcctttggccagcagcagcggcgccccgccgcccgccgggtcgtacttcagggctacggcgaagtgggtcgggttggtgatcaccacgtcggcctccggcaccgccgccatcatccgtctctgcgccatctcgcgctgcatctggcggatcttcgacttgacctcgggcttgccctcggagtccttgtattcgtcgcggacttcctgcttggtcatcagcagcttctggcggttgtcccagatctggtagggcacgtccaccgcggcgatcagcagcaggctgcaagccatccagaaggcgctccagccgaccacccgcacgctgtgcaggatcgcctgctcgagcggctggtgcgccagcgccaggagggcgtcgcggtcggcggagagcaccagcagggccaccgccagcaccaccaggaacttgatcagcgccttgctcagttcgagcagcgacttggcggaaaacatccgcttcagccccgacagcgggttgagccggctgaacttgggttgcagggcgtccatcgagaacagccagccgccgagggcgatcggcccgacgatcgccgccaccagcagcatcagcaggatcggccagagcccctgggcagccaggtaggccgaagcgccgagcaactgcagcatgctctcggtattcatcgcggtttcccgggacagctcgaaattgctgcgcatcaggcgcaacagggcgcccgccaggtcggcgccgtagatcagcaggccgccggcgccggccatgaggatggccagggtgttcagctcccgcgaacgcggcaactgccctttctcgcgcgcctcgcggcggcgtttctccgtgggttcctctgtcttgtcctgcccgctctcgctctcggccatggctatttcgcccgcaccagttcacggaggaattgcagggtctcgccggccagcacctggtactggctgagcaggtcggcggtgccgatccagaggatcaccaggcccagcaccagggtcaacggaaagccgatggagaagatgttcagttgcggcgccgcgcgggtcatggcgccgaaggcgaggttcaccaccagcagcgcggtgatcgccggcagcgccagcagcagtgccgcgcccatcacccagccgagcttgccggcgatgatccagaaatggttgccgctcaggccctcgcccaccggcagggtgacgaagctctcggcgattacctcgaacactaccaggtgtccgttcatcgccaggaacagcagcgtcaccagcatggtgaagaactggccgagcaccggcaccgagacgccgttggccgggtcaaccatggaagcgaagcccaggcccatctgcatcgagatgatctgcccggcgatcacgaaggcgtggaacaacaactgcagggaaaagccgagcaaggcgccgaccaggatctgctcgccgatcagcagcatggccttcatgctcagcgcgtccacctgcggcatcggcggcaggttcggcaccagcaccacgcagacgcccagcgccaggtacagtcgcacccgcaccggcaccagctgggtgccaatcaccggcatggtcatcagcagcgccgcgacccggaacagcggcagcacgaagctggcgatccagccgccgatctgcgcgttggtcagctccagcatcagccgatcagcagcgggatgttgccgatcagcgtctgggtgtattccatcagctgccgcagcagccaggggcccagcacgatcagggtga

SEQ ID NO: 7661 - DNA, 1374 bp, Pseudomonas aeruginosa
cggcctggaacatcgccaccacgagaccgaccagcaggctcggaaccaccagcacgccgacgatcatcgccgtcagccacaacgcctcgcggaacaggtcgagtgccacctcaggggtcatgtctctctccagcgcgccagcggcgcgtcaagccggcggcaccgctagacggtgccgaaactgcccgccagcgtcccgatgatcagcgcccagccatccaccaggacgaacagcatgatcttgaacggcagggaaatgatcagcggcgacagcatcatcatgcccatcgccatcagcacgctggacaccaccaggtcgatgatcaggaacgggatgaagatcatgaagccgatctggaacgcggtcttcagctcggacgtgacgaaggccgggaccaggatggtcagcggcgtcgcctccgggctgccgatgtcggtgcgcttggacaggcggacgaacagctccaggtcggaggtgcgagtctgcgccagcatgaacgccttcagcggtacctcggccttttgcagggcttcctgggcgggaatctgctcgttcaggtagggctgcagggcctggctgttgatcttgtcgaacaccggggccatgacgaacatggtcaggaacagcgccagccccaccagcacctggttcgacggcgtcgattgcaggcccagcgcctggcgcaggatggagaagacgatgatgatccgggtgaagctggtcatcagcatgacgaacgccgggatgaagctcagcgcggtcatgatcagcaggatctgcaggctgaccgaatactcctgctggccctggccgttggtggtcacggtgatcgccgagatcgatgtcgggtcggcggccagcgccggccacggcgccagcagcagaaggcagagcgcggcgagcgcgccggccagggagatgcgcggagtcatggcttgcccttggggtccttgttcagcagctccagcaggcgctgggcgaattccggcgtggccggctcgccgtccggcaggtgtaccggctccttgagcacgtgcaacggcgtgatccggccgggcgtcaggccgagcaggatctgctcctcaccgacctgcaccagcaccagccggtcgcgcggacccagcggctggctggcaagggtgcggatcaagcggttgccgcgcggaccggcctgttgcacccggcgcaccagccaggcgagcaggaagatcaggccgatcaccaggcccaggccgagcaccagttgggccagttgcgcggcggcgccggaagcggcgcccaccgtcggcgcggcggcacccgtcgtcccctcggcggcgcacagcggcgcgctcagcgaggcgagtgccggcaggaagccggcgaacaggtag

SEQ ID NO: 7662 - DNA, 966 bp, Pseudomonas aeruginosa
cgccaggttgcccttgtgggcgcccagcttgaccttgaaggcgggcacgccgttggcgcgcatcaccatgtgttccggcatctccaccgggatcacgtcgcccggctgcatgtgcaggatgtcgcgcagcttgagctggcggcggaccacggtggcgccgagcggtacctggacgtccagcacgtcctcgcgcagggccttgatccagcgctcgtcctggtcgtcgtggtcggactggaaaccggcgtcgagcatctcgcggatcggctcgatcatcgaatagggcatggtgatgtgcaggtcgccgccaccgccgtccagttcgatgtggaaggtggagaccaccaccacctcgctgggactgacgatgttggccatggccgggttgacctccgagttgacgtactcgaagttcatctccagcaccgcctgccaggcttccttcagatcgacgaaggcctgctccagcaccatccgcaccacccgcagttcggtcggggtgaactcgcggccctcgatcttggcgtggcggccgtcgccgccgaagaagttgtccaccagcttgaacaccagcttggcgtcgaggatgaacagcgcggtgccgcgcagcggcttcatcttcaccaggttgaggctggtgggaacgtacagcgagtgcacgtactcgccgaacttcatcacctgcacgccgccgaccgcgacgtcggccgaacggcgcagcaggttgaacatgctgatgcgggtgtagcgggcgaaacgctcgttgatcatctccagggtcggcatgcggccccggacgatgcggtcctggctggtcaggtcataggacttgaccgatcccggcgtcgcctcgacttcggtttccaccaggccatcgtcgacgccgtgcaacagcgcgtcgatttcatcctgggaaagcagatcttgcacggccatgggatacctactgcagcacgaaattggtga

SEQ ID NO: 7663 - DNA, 420 bp, Pseudomonas aeruginosa
ccgccctctccatctgcccggagcaggtgccggagcgggagtggatcgacgccctgttcgccgaaccgccgcactaccgcagcgatgaggagcgccaggagatcgagacttccctcgagcagctcaaggcgcacatcacccgcgtgctggccagcgacgaagacctcgagctgccctgcgacctcgacctcggcgacgagccggacgactccgacctgcgcggctggtgcatcggcttcatggaaggcgtgttccttcgcgaggaagtctggttcgagcaggccgaggaggaagtcagcgagctgctgctgcctatcatggtcggctccggcctgttcgacgagcagcccgagttcgacgagatcgcccgcgaccgccacctggtggacgacatggtcgcgcagattcccgacctgctga

SEQ ID NO: 7664 - DNA, 1899 bp, Pseudomonas aeruginosa
cctccaggccgtgggtttcctaagcgtagccctgggcgtgatcggcatcttcctgccggtgctgccgaccacgcctttcctgctcctcgcggcggcctgcttcatgcgcagctcgccgcgcttctaccactggctggtcggccatccacggctcggcccgtggatccgcgactatctcgacggcgaaggcatcccgctcaagggcaaggtctacgccatcggcctgatgtgggccagcatcgccctttcctgctacctggtccgacgcccctgggcccagggcttcatgctgaccagcgcggtactggtcagcatctatatcctccgccagaagacccgcccgccgcacgacgcctgatggcccgctcaggacagcgccggatcgccctcgcccagcggcaagcggtcgccgggcccgcgccgctcggggctcagcacggtgaagccgaaggtgttccagccgtccgcgctgtcgacgaacaccgaaccgccgtgcatgctcgccaccgccttgacgatggacaggccgaggccgtggttggcctcgctgttgctgcgcgccgcgtcgacccgatagaagcgttcgaacaggtgcctgcggtgctcgtcggcgatcggcacgccggggttgctcaccgccacccgcacttcgtcgccgcgccgctcgacgccgacccgcagcgtgccgccggcggcggtgtgctgggcggcgttgtacagcaggttggtcaccgcccgctggaacagggcgcgctcgaccagcgcgcgggcctcgccgcgcacctcgataccgaccccggcctcgtcgaagatcacctcgaggaaatccaccgtggtggcgatctcgccggccagcgaggtttcctcgcgctcgcaggccaggcgtccctggtcggcgcgggcgaggaacagcatgtcgttgacgatcgcccgcagccgctccagctcctccaggttggattgcaggacctcttcgtaatgttcgccgctgcgttcgcgggacaacgccacctgggtctggccgatcaggttggtcaatggcgtgcgcagctcgtgggcgacgtcggcattgaacgactccaggcgcacgtaggcctgctccaggcggtccagggcgccgttgaacgctcccaccagctcgcgcagctcggccggcagcggcgagagctgcaagcgctgcgacaactgccgcgggctgatccgccgggcctcctcggacagccgatgcaccggccacaggcccaggcgggcgatccagtggccaagcaacgaggccagcagcacaccgagggcggacaggccgagcagccatttcagggtggaggtccgcgcctcatggaacgccgcgctgtcgatggcggtgacgtaggtcagccgcggccgcccctcgcgcgccggcaacacgccgacccgcgcagtcagcgcgtaccggtgctccggcaactccagttcgtagcggccggcgccatcggcgatcagccgctgcaccggttcgctgaagcgcccgtagtgatagcgcgggtcgtcgctgtcgatccagaaacggatcagctcgtactcctggctcaggttgtccagcttgccctgcaggtgcggccagcgctcggccaggtcgggatggtcgagcatccgcgagaccatgttgaagcgcacgtccacctcgccctgctgcaggcgctcggtctggcggtcgaggatgcaatagagcatggtgccgatgagggcgaagatcaccaccgcggcgccggcgaacattcccgccaggcgggtcgacaaggacatgcccacctcagcccgactccgccagcgcacggttctccaggacgtagcccatgccccggatggtatgcagcagcttgttctcgaacggaccgtcgagcttggcgcgcaggcgcttga

SEQ ID NO: 7665 - DNA, 645 bp, Pseudomonas aeruginosa
ggccacggttcaggtagtccgccgtcttcgcctcgtcctcgacaatcagtacccgcatctatcgcccgatcctctgttcgccttcgcatcccgggcgggacgcatgcctgcctgcatcctagccacgcgccgccgtccaggaaagccgcgtccgttacgcctcatgtcgccgtcgccccagcggttccgccgtccgaggtcgtggtcccgcgccggtggaacagccgctccagggccaggtataccaccggcgtgctgaacagggtcagcacctggctcaccagcagcccgccgaccaccgcgatgcccagaggctggcgcagctcggaaccggtgccgaagccgatcatcaggggtatcgcgcccagcagcgcggccagggtggtcatcatgatcggccggaaacgggtcaggcaggcctggtatatcgcctgctccgcgctcatgccctgctcgcgctgggcgacgatggcgaagtcgaccatgaggatgccgttcttcttgacgatgccgatcagcagcacgatgccgatcagcgccatgatcgagaagtcctggccccaggcccagagcacgaacaccgcgccgatccccgccgagggcagggtcgagaggatcgtcagcggatgtacgaaactctcgtag

SEQ ID NO: 7666 - DNA, 810 bp, Pseudomonas aeruginosa
ccggccaccgccaccagcacggtaaaggcgaagccgaccagcatcagccgctggtgcccgagcgcccagcgcaggccgcgctcgtatccgccggtcagccattcggcgaagccctttctcggcgcgtcggcatgccgcaatgccggcatgaagcgcgaagccagcatcggcgccagggtcagcgaagcgagcaccgagatcaggatcgccaccgtcacgctgaccgcgaattcgcggaacagccggccgacgatcccgcccatgaacagcaggggaatgaacgcggcgatcagcgagaagctgatggaaatcacggtaaagccgatctccgccgcgcccttgagcgccgcctcgaccttcgaggcgcccgcttccaggtgtcggtggatgttctccacgaccacgatggcgtcgtcgacgatgaagccgacggcgatgatcagcgccaccagggtcaggttgttgagggtgaagccgagcacgtacatcgccgcgaagctggcgctcagggacaccgccagcaccgtggcgacgatcagggtcgccgacagctggcggaggaacaggcccatcaccagcaccaccaggccaatggtcagcagcagggtcagttcgacctcgtgcagcgacgagcggatggtccgggtacgatcgttgagcacgtctacctcgatggtcgccgggagcatctcgcgcaggcgcggcaatgcggcctggatcgcgtcggcggtatcgacgatgttcgccccaggctggcggaggatcaccagtgccaccccgggcacaccgttcggccaggcctgcacgtag

SEQ ID NO: 7667 - DNA, 609 bp, Pseudomonas aeruginosa
tcgctgagttcgatcagcggcatcatctccgagttgacccgcaggatcatgatcgggctgtccgccgggttgaccttgcgccaggtcggcaggttcggcatgtccaccggcagccgcccggccgcggcgttgatcgccgcctggacctcctgggcggcgacgtcgatgctcttgtcgaggctgaactgcagggtcagggtggtggtgcccagggcgctgctggaagtcatctcggtgatcccgggaatcgcgctgaactgcacttccaagggggtggccaccgacgaggccatggtttccgggctaccgccgggcaacaaggcgttgatctggatggtcgggaagtccgcctccggcaacggcgccacaccgagccggaggaacgccagcagccccagcagcagcgaggccagggtcagcagcgcggtggcgatcgggtgccgtatgcaccagccggaaatcccggcgcgcggcgtcacggctgccgctccgccgcctgagccaggctcgggcgcggctcctggatatcgaccagggcgccgggcatcagccgcgagtggccgtccaccaccacctggtcaccgctggccaggccttccaccacactga

SEQ ID NO: 7668 - DNA, 849 bp, Pseudomonas aeruginosa
cgacctgttgccggtgtacgccttcaatgccgagggcctctggctgcccggcgccgacggcggacgccggaccggcgacagcaagaagctgtcgcgctggcaggacctgctgaccaagatgcgcgccgaaggcctcgacctcgacgcacccaaggaggattgaatgtcactgctcaagcaattgttcctcgccatctgcctgttcctcgtcgtcgccttcagcggcagcttcgtcagcagcgtggagaactcccgcgagcagttgcgcggccagttgcgctcccacgcccaggacgccgccaccgccctcggcctgtccctgacgccacacgtggacgacccggcgatggtgcaactgatggtcagctcgatcttcgacagcggctacttcgccagcatccgggtgatcgacatcaagagcggcaagccgctggtcgagcgcgtgcaggcgcatgccgagcgtacggtgcccggctggttcgaacgcctggtggatctccagccccagggtggcgacgcgctgatcatgcgcggctgggaacaggcggcgcgggtcgaggtggtcagccatccgcaattcgccctggcgcgcctgtgggacagcgccctgggcagcctctactggttgctggcctgcggcgcggcgagcctgctgcttggcggctggctgctgcgccgccaactgcgcccgctcgaccagatggtgcgccaggcccatgccatcagccggcgggaattcctcagcctgcccaggctgccgcgcacgccggagctgcgccgcgtggtgcaggcgatgaaccagatggtggagaaacttcgcacgctgttcgccgaggaggctgcgcgtag

SEQ ID NO: 7669 - DNA, 642 bp, Pseudomonas aeruginosa
ccaggactggcacgactggatcgaccaggccctgacggagcgccgcctgctgctctatttccagccggtggtggactgcctggacacccagcgcgtcctccaccacaaggtcctcgcgcgtctgctcgacccgcaggccacggccatcgccgccgggcgcttcctgccctggatagaacgtttcggctgggccgcgcgcctggacctggcgatgctcgaacagagcctggagcacctgcggcgccatccacggccgctggcgctgagcctgtcggccgccagtgtccgcaatgcgcagacgtttgccccgctactggccctgctcaaggcgcatccgcaggaggcgcgccagctgaccctggaactggacgagcggcacctgccagccgcggccgaactggaacgcctcagccaggtcctgcgcgaactgggctgcggtctcggcctgcagcatttcggcggccgcttcagcctgatcggcaaccttacccatctggggttggcctacctcaagctggacggctgctacctgcacgccgtcgaccgggaaggcgacaagcggttgttcatcgaagcggtctatcgcaccacccacagcatcgatctaccgttgatcgcggaacaggtggaaaccctcggtga

SEQ ID NO: 7670 - DNA, 594 bp, Pseudomonas aeruginosa
accgcccttccctcgcgcacggcattggcgatggtggcgaaattgtcgtcggcgaggaccacctcggccgcctccttggccgcctcggtgcccttgttgcccatcgctacgccgacgtcggcgcgcttcagcgccggcgcatcgttgaccccgtcgccggtcatcgccaccacctcgccgctggcctgcagggcctgcaccaggcgcagcttgtgctcagggctggcgcgggcgaacacatcgacgcccggcagcacttcgcgcaggcgctggtcgtcgagcaactcgatctccgcgccggtcagcgccggccggtcgatgccgatcccgagcatggcgccgatcgcccgcgcggtgtcgacgtggtcgccggtgatcatcttcaccgcgatacccgccgcctggcattcggcgaccgcggccacggcttcctcgcgcggagggtcgatgatgcccaccagggccagcagggtgaagccatgttccacgtcggcgaaatccagcgtgcgctgctccgccggcatcgcccgtcgggcgatggccagcaggcgcaggccgcgagcggcggtgtcggtggccaggcgccgccagtag

SEQ ID NO: 7671 - DNA, 486 bp, Pseudomonas aeruginosa
ccggcgccgctgacctcgattacctggtcggcggtgacgatacgctgcacggtcatctcgttgcgggtcagggtgccggtcttgtccgagcagatcaccgtcaccgaacccagcgtctccaccgccggcaggcggctgacgatggcgttgcgccgggccatgcgctgtacgccgagggcgaggatcaccgtcatgatcgccggcagtccctcgggaatcgccgaggcggtcagcgccaccaccagcatgaacatgtccaccatcggctggccctgccagagggtgccgaggacgaaagtggcgccggccagcagcaggatcgccagggccagccagcgactgaagctggcgatctgtcgcagcagcggagtggccagggtgcggacttcgcgcaacagcgtaccgatccggcccagttcggtatccccggcggtggcgaccaccactccgcgcgcctggccgctggtcaccagggtgccggaatag

SEQ ID NO: 7672 - DNA, 468 bp, Pseudomonas aeruginosa
gccatgcaacggcggtcgccgagcagcgcgtcgatggccaccgcgacgcagcccttctccaccggcaccgactcaccggtcagggccgactcgtcgacatggaagttcttcgtttcgaacagccgcaggtcggccggcacccggtcgccggaggccagcagcaccacgtcgcccggtaccaggcgttcggcgtccagcgcctggcgctggccgtcgcgcaggaccagggcatgcagcgaaagcatgtcgcggatggcgtccagcgcgttggccgccttgccctcctggacgaaaccgatcagcgcgttgaccaccaccgccaggaggattaccgcactgtccacccagaagccgagcagcgcggtgaccagcgaggcgaacagcatcatgtacagcaggacgttgtggaactgccgcagcaagcgcagcagcggcccctggcgtttcggcgcgggcaatcggttgtag

SEQ ID NO: 7673 - DNA, 1686 bp, Pseudomonas aeruginosa
aagaaaacgaccggtcggaacagccgctcttcccatgcttttcccgaaacgacgaatgaacgacactgcgcccgactctttttcccggtatcgcccatgcccaactccccgcttccttccggccgcaggctgcccgcttgcgccttcgccgacatcggcgagccctacgccgtgttccaggctcccggcggcgcgctccttgcggtggccagcgcctttcatgggcaacacccgggccgacagctcgacgtctacgaacagagcctgcgcctgtaccgcagcggcgacctcgaatgcatcgccgtcctgccggacctgggctttccgctcaacgccatcgcctggcacccgagccggcccgtactggtgatcggcggcggacgctacgacggcggcgccttcttcgaaggcggtctgctggcctgggactacgcgagcggcaagacccaatcgctgctcgccgacaaccgcgaagtgctcgcctgcgacttcgaggacgacggccggcgcctgaccttcaccgtcgcccccagcgacgacctggaggaccgaccgttgttccgccagcgccattcgctagcctttccggtcgacgccccactggtgctggacgacctgcccggcacccgcctgcccttcgactgggccctctaccctgcctcgacacaacgcgaagcagcgctgccgatcctggaaaacctagccctgggcaaagatcggcggttcctgcatcgtccaccggtgtgggacctgtgctttctcgacggccaacgcctggccatcgcccgcgccaacccccggctcgagctctggaatctggccgacgacagcctgcgcagcttcgaactggccgaacggggccagtgcctgcaggtcttccataacgccacggacgacagcctgctggtcaatctgcaactcgggtatgccgcccagcgactgttcaaggtgccgctgacaccgggacaaccgctgctcctgagcgactgccgccatctgctggcgcaatccgcccaaggcggttttctcgcccgccagatcgccctcgagggcaaagacctggaagacctcgtgctcgacccggccggccggatcatccacaggcgccgtctcggacactacgacctgttcaaccaccatctgcgcatcgaccgtggcgaagccttcttctacctggccggcaatccgccggagcagcaccaggacaagggcctgttccgcctcgacccgcagaccttcaagacccgcgaagtgctacgcctggagcgccacccggagcacttcaacaacctgcacggctgcctgctgggcaatcgcctgctgctcaacgccaaggtctacaactcgccgcatcacgcctacggtacccagcgcctgacctgctacgacctggagagccgcggcacgctctggggcgcgaccctgtccgcccaggtcagcgccttcgcgccgttgcccggcggacaatggatcgcactggcgctggtcgatggtcaggtcgaggtacgcgacctcgccagcggcgaatgtcgctggcgctaccgcacggcagacgccataccgctgtgcctggcagtcagcgacaaactcctcgccatcggtttcagccacggcggagtcagcctcctgcaggtcgcggcggatggccagctcatcggtcctccaggcgccaacccgcggcagtag

SEQ ID NO: 7674 - DNA, 678 bp, Pseudomonas aeruginosa
gatggttgcgccgataggtgtcctcgcccatcgccgcgatctgcccctcgatcagggcatcgaagggtttcaacaaggcttcgtgggtacgcggcgcctccagttcgtcgagcgccgcagcgattgcttcgatggtcgacagcgcgccctctcccggcgccttgcgcaggcgataacgcgacgccatgccttcggccaggctcacccgcggcagggccgccagggccgggttcaggtgcaggagcttgcgcgccttgcgccaggtgccgtccggcaccaccagcaggaggggctcgccggcggcctcggcggccatctctgccagcgcacgcgcctgctcgccgggaaacagcaggcaggcccggtagcccggtacccgccaggtctcctcggcgaaacgctcgccaacccgcagctccgcattgcacaagccgaggacggccaatcctgcggtattcaacgcgtgcccgacctcgctggggtgctgcaggaccagcacccgcgtacgcgacggcaaggagggaatcagcgcgcagaggcaatggctggcggggcgagcgcaacgctcgcagcggatacgtggcatgggacgactcctggaaggggcccagtgtgccacaggcggagggggcttcctctcactcgcaaaaacgtcatatttccgacgaatggcggtaa

SEQ ID NO: 7675 - DNA, 1458 bp, Pseudomonas aeruginosa
tttgtttcacccattaagaataacgacgaatttttgtcgttcgatgaaaaaatacaatcgtcccaccctctcaactcccgcccatcggcgccgaagacagggatgagcccctctctctatccaaggatttttctcatgttcactcgcaagtaccgacagatgaacgccgacttgcaacagcaactcgccgccgagcgcctgcacatggcggccctggaccgctccatggcgcgcgtggagttcgatccggacggcaatatcaccgatgccaatgagaatttcctgaccctgctgggctaccgccgcgacgagatcctcggcaaaccgcatcgccagctttgcgacggcgcctacgcgcaatcggaagactaccggcgcttctgggaacgcctgcggcgcggcgaacacttttccggccgctgcaagcgcattacccgcgagggccggccactctggctggaagccacctacaatcccgtacgcgacgggcagggtcgactgctcaaggtggtcaagtacgccagcgacatagatgccatcgtccaccaggaacacgagatgcagagcaagctagatgccctgtcccgctcgatggcgatgatcgagttcgacctcgacggcaatgtcctcgcggccaacgacaacttcctcgccaccatgggctatggccgagccgagctggccagcgccaaccaccgtcagttctgcgaaccgggctaccgcgacggcccgcagtacgccgacctctggcgccgcctgaaccgcggcgagtacgtcaccgggcagttccgccgggtccaccgcaacggccagccggtctggctggaagccagctacaacccggtctacgacgccgacggcaagctctacaaggtggtcaagttcgccagcgatgtcagcgaccgcatgcgccgctaccaggccgaggcggacaacgcccaccaggcccataccctgtccaccgagacccgtacggtcgccgaacacggcgcgctgatcatccagagcgcggtggaggaaatgctcaagatcgcgaataccctggatgcttcctcgctgaacatcggcgaactgtcacagcactcgcaacagatcacctcgatcgtcaacaccatccgcgagatcgccgagcagaccaacctgctcgccctcaatgccgccatcgaggccgcccgcgccggcgaccagggtcgcggcttcgccgtggtggccgacgaggtgcggcaactggcggaacgcaccagcaagtcgaccaaggagatcgccgacatgatcggtcgcatccagaccggcacccgcagcgtcatcgacgacatgcagcacagccaggaacaggcgcggcgcggcgtggagctggccaacgaggccggcgcggcgatcctcggcatccgcgagagcacgcacaaggtggtagaagcggtgcagcagttctcgcgcaccctcaacgccgatctctag

SEQ ID NO: 7676 - DNA, 978 bp, Pseudomonas aeruginosa
ggctcaggccaggctcatctgcgtccgcaactggtcgcggaaggcctggatcagcggctcgcgcgagcggccgcgacggaggatcagggagaatggcgcctggtagccgaaggtcgccggcagcagggcgcgcaggcgcccctgctcgacccacgggtgagcgtagtgctccggcaggtaaccgatgtagccgccggaaaggatcaggatcagttgcgcctccatgctctccaccgttcccgcgctgtgcttgaatccgtgccgggccagctcggcctggctccagtagccgcggccgaccatgcgttgctgggtgatcagatcggcgggaattctccgcccgtcgaacagcggatgccggtcgctgcagtacagccagtgctgttcgcggtacagcggctggtagaccagtccgttcatgcgactggaaaaggcgccgatagccaggtcctggcggttctccagcacgctcagttgcagttcgtaggggctctgcaccagcaggtgcaggtgaaccgccgggtgttcgcggctgaaggcgccgatcacctcggccagcggcagcgccgggtcgctcaccgtggaatcgagcacgccgaggttcagggtgccgcgcagctcgcccttcaacgccagcgcgtagcgttcgaagccttccagttcgccgaggatgcgcaaggtttcctggtggaacagctcgcccttgctggtcaggctgaagccaccgcggccacggtggcagagcacgatgccgagctggttctccagttggctcatgtaggtgctgatcgccgaggtcgacaggttcaactcctgctgggcggcggcgaagccctggtggcgcaccaccgcggcgaagatgcgcaacaggcgcaggtcgggcaaggcgttggacacggcgactccggtttgcgggcgaggatttcggacagcaggccgaggcaaaggcctccgtccgggctcggcggcgaagtctag

SEQ ID NO: 7677 - DNA, 1563 bp, Pseudomonas aeruginosa
ccaacacgcaatcacacgcatcgaaaccttcggggtcgaacagattcccgaccacgaacgcaacgccacgccggtcgatctgttccgcatgatcttcggcggcgccaataccttcgccaccgccgtgctcggcagctttccggtgctcttcgggctgtccttccaggccgggctgtgggcgatcctgctgggcgtcacgctgggcgcgctgatcctcgccccgatgggcctgttcggcccgctcaacggcaccaacaacgcggtctcctccggcgcgcacttcggcgtgcacgggcgcatcgtcggctccttcctctcgctgctgaccgccatcgccttcttctcgctctcggtgtggagttccggcgatgccctggtcggcggcgcccggcgcctggtcggcctggaagagagcgaactgaacctgggcctggcctacggcctgttcgccgtgctggtgctgaccgtatgcatctacggcttccgcttcatgctgctggtcaacaggatcgccgtgtgggccgccagcctgctgttcctgctcggcctgttcgccttcgccggccccttcgacgccgcctacgccggcagcgtgcaactcggccagccgggcttctgggccgccttcatcggcgccaccctgctggccatgagcaacccgatctccttcggcgccttcctgggcgactgggcccgctacatcccgcgccagacctcgcaggcacggatcatgctggcggtgatcggcgcgcagctggcgaccctggttcccttcctgttcggcctcgccaccgcgaccatcgtcgccgtccgcgcgccggactacatcgctgccaacaactacgtcggcggcctgctggccatcgctcccggctggttcttcctgccggtatgcctgatcgcggtgatcggcggcatgtccaccggcaccacttcgctgtacggcaccgggctggacatgtccagcgtgttcccgcgcctgctctcgcgggtgcaggccacggtgctgatcggggtcgcctcgatcggcttcatcttcgtcggccgcttcgccttcaacctggtgcagagcgtctctaccttcgccgtgctgatcgtcacctgcaccaccccgtggatggtgatcatgctgatcggcctgctgacccgtcgcggcttctaccgcccggacgacctgcaggtgttcacccgcggccagcgcggcggcgcctactggttcgagcacggctggaactggcgcggaatgggtgcctggattcccagcgcggcagccggcctggccttcgtcaacctgccggggcaattcgtcggtccgctcggcgaactggccggcggcatcgacctcagcctgccggtcgccctcggcctggccgccctgctctacctggcactgctgcgcctgttcccggaaccgccttgcgtctatggcccgcgaggaccgcgctgggtgcgcgcgcacggcacgcggagggcaccggcgatagccaccgcctgaggtgggggacacacacggcgggacgccagcgtcccgcgcttccggcgcctcgccggatacaacaatga

SEQ ID NO: 7678 - DNA, 1455 bp, Pseudomonas aeruginosa
  unsure (604): Identity of nucleotide at the above locations are unknown.
tatggccctcgacatattcgtcgttctgatctacgccgcgggcatgatcgcgctgggctggtacggcatgcgccgcgccaagacccgcgacgactacctggtggccggccgcaacctcggccccggcttctacctgggaaccatggccgccaccgtcctcggcggcgcctccaccatcggcaccgtgcgcctgggctacgtccatggcatctccggcttctggctgtgcggcgcgatcggcctcggcatcgtcggcctcagcctgttcctggccaagccgctgctgaagctgaagatctacaccgtcacccaggtcctggagcgtcgctacaaccccgccgcgcgccacgccagcgccctgatcatgctggtctacgcactgatgatcggcgccacctcgaccatcgccatcggcaccgtcatgcaggtcctgttcggcctgccgttctgggtctcgatcctgatcggcggcggcgtcgtggtgctctactccaccatcggcggcatgtggtcgctgaccctgaccgacatcgtgcagttcctgatcatgaccgtcggcctggtgttcctgctgatgccgctgtcgatcaacgacgccggcggntgggacgccctggtagccaagctgccggccagctacttcgacttcaccgcgatcggctgggacaccatcgtcacctacttcctgatctacttcttcggcatcttcatcggccaggacatctggcagcgggtgttcaccgcccgcagcgagaccgtggccaaggtcgccggctccgccgccggtatctactgcgtgctctacggcatggccggggcgctgatcgggatggccgccaaggtcctgctgccggacctggagaacgtcaacaacgccttcgccagtgtggtcgagcacagcctgccgaacggcatccgcggcctggtcatcgccgccgccctggcggcgctgatgtccaccgccagcgccggcctgctggcggcgtccaccaccgtcacccaggacctgctgccgcgcctgcgccgcggccgcggccagtccgacaacggcgacgtgcacgagaaccgcatcgcgaccctgctgctgggcctggtagtgctcggcatcgccctggtggtcagcgacgtgatcagcgccctgaccgtggcctacaacctgctggtaggcggcatgctgatcccgctgatcggcgcgatctactggaagcgcgccaccaccgccggcgccatcaccagcatgaccctgggcttccttaccgtactggtgttcatgatcaaggacggcctcgacgccaatacgccgatctactacagcctggcggtcggcctgctcagcttcgtcctggtcagcctgttctcgcggcgcccgacgggtgtcgccagcgccgcctgaaccaggcacaaccccgacaggcgagggactttccctcgccttttccattcccgagaacatga

SEQ ID NO: 7679 - DNA, 1527 bp, Pseudomonas aeruginosa
gcaacgtctgccccttcaggccataccctgatgagcgccggggagttgctggcggtgctcgcccgcgccttcgccgtgttcgacagcgagcggccgcggccggtgcacatcgagctgccgctcgacgtcatcaccgcgcccgccgaacacctggccctgcgcccacgcaccctcgccagccgcccggcgccggccctcgcgcccttgcgcgaggccgcggcgcgcctgcgcaacgcgaaaaagccactgctgctgctcggcggcggctgcgtcgaggccgccgccgaagcgcgtgccctggccgccgcgctggacgcgccgaccgccctgacgatcaacgccaagggcctgctaccggccgaccacccgctgctgctgggcagcaaccagtcctgcgtgccggtacgcgagctggccgccgaggccgacgtggtgctggccatcggcaccgagctgggcgaaaccgactacgacgtggtgttcgacggcggcttcgccctcgatggcgagttgatccgcatcgacatcgacccgcagcaactgatgcgcaactacacgccgagcctggccatccacagcgacgcccggctggccatgcgcgtgctgctggccgaactgccgggcggcgaggcctcgccggacagccccggggcccggcgcgccgccgccgtgcgccagcgcctggccgaagacttcgccggctggtcgcactatcgccagctgttcgccgcgatcctcgccgagtggccggacgcccgcttcgtcggcgactcgacccagaccgtctacagcggcaaccacctggtcgatctcgacgagccgcgccgctggttcaacgcctccaccggctacggcaccctcggctatggcctgcccgccgccatcggcgccaagctcggtgagcccgggacgcccggtggtcagcctgatgggcgatggcggcctgcagttcaccctgccggaactggccagcgcggtggaagccaaggtcggcatcgtcgtgctgctgtggaacaaccacggctatggcgagatcaagcgctacatggagcggcgcgagatcactccgctcggggtcgatatatacaccccggacttcctcgccatcgcccgcggcttcggctgcgccgccgaacgcgcgcgcgatctcgaacacctgcgcgaactgatgcgcggcgccccggcggaccgtccgctgatcgtcgaggtgctgcaagccgcgcccttccatccctgacccggagcccgccatggacgattccgaactctaccgctccctctgcgagatcctcggcgcccgtggcgtgcgcgacagtgccgcgctcgccgggcaggaccccggctaccatccgcagaacctcgccggaagcttcctggtcctgccggaaagcaccgaccaggtcgccgccgtggtgcgtctgtgccgccaggcgggacgcgccctggtaccccagggcggactcaccggcctggtcggcggcggcgccgcgcaagccggcgacgtgctgctctcgctgcgcaggctga

SEQ ID NO: 7680 - DNA, 552 bp, Pseudomonas aeruginosa
agaacaccaccggctacgacctcaagcagttgttcgtcggcgccgaaggcaccctcggcatcgtcacccgtgcggtactgcgcctggagccgttgcagcgtcccggcgccaccgccctgctcggcctgcccgacgtcgacgcggcgatcaccatcgccgcgcgcctgcgccgcgagcacgccgaacgcctgttcgcctgcgagatcctctggcacgactacctgcaatgcaccgccgcacccatgggcgacagcgcgccgagcctggcgccctgccctctctacctgctggtggaactggccgaggaccgccacctggatgccggcgaggcgctcaccgccctgctggaagactgcttcgaggacgggctggtggaagacgccctgctcgccgccaacgaaacccagcgcctggccatctggcgcctgcgcgaagactccgacgcggccatccacgccggcgtcgacagcctgtccttcgacgtatcgctcccggtgccggccctggccggctacgtcgagcgcatccggcggcgcctggacgacctggtga

SEQ ID NO: 7681 - DNA, 1794 bp, Pseudomonas aeruginosa
ccagcaccatgcgctcctcgaacatcggcaggccctccagaccgtcgaagtccagcgggccgtccaccagcacggcatccaggcgcccgcccagcagcgactcgaccagctcgccgctgggcgcggtctgcaattgcaggttcaccgccggatagcgccggtggtattccgccaggcgcggcggcaggtggatcgccgcggtgctgtacatcgagccgagggcgaagtcgcccaccggttcgcccccctgcaccgccgcgcgcgcctcctcctgcagggcgaacagccgcgcggcgtagtccagcaggaccttgccggccggcgacagttgcaggcgctggcgttcgcggaggaacaggtcgacgccaagctgttcctccagttgccgcaggcgcgtcgacaggttcgacggcacccggtgcaggcgttcggcggcgcgggcgatggagccttcctcggcgaccgcctggaaaatcctcaactggccgaactccacgattaattctccaaaacagaacaagtaattcacgattattcatttttacagaattgccgcaagacctaacctgctgccattcatcccccggcaggaatccgcacatgtcccgtgattttcttcgttcgccgctggtcggcctgctcgcctgcctgctggcactggtggtcgccatgggggtcgggcgcttctccctgaccccgcaactgccgcacctgatccgcgaaggccagctcgacctgaccggcgccggcctgctggccgccgccaactacctcggctacctggtcggcgcgctggacgcgctgttcgcccgcgaagcgcggcaggcgcgcttacgcctgctggtcgggctatgggcctgcttcggcctgaccctggcctcggtctgggccgagggcttctggccgcacgcgctgctgcgcttcggtcttggcgtggccagcgcctgggtactgatcatggtcaccgccctcagccagcgcctcgccgcggaaagcggtcgggcccggctgggcgcgctggtgttcgccggccccggcatcggggtgatggtcaccggcctgctggcggcattgggcaacgccctgggccaggactcggtgttcatctggaagctcttcgccgacctcgcgctggtcctgatcctcatgctcctgccgctgctgccgcgcccggccgcacgcagcgccggccacgacgcgcctgccacggcaagcgagaacgccggcctcggccgcctgacctgggcctacggactggtcggcctcggctacatcatcccggccacctttctctcgcagatggccgcggcgcgtttccacgggcaatggcaggccgacctgttctggccctgcttcggcctggcctcggccaccggggtagtgctgatcagcctgcgccggcagcgcccggacggcacccgccgctggctggtcggcgcgctctggctacaggccctcggcgtgctcgcctgcctgctgccggggatcggcggactggccctgggggtagtgctgaccggcctgccgttcctcgccggcatgcaactggtgatgcaatacgcccgcgaactggcgccgcatacgccgcagcgcaacgccggccaactgaccaccggtttcgccctcggccagttgctcggcccgctgctggcggcgctcagcacgcatttcgccggcggcctgcaaccggcgctggcgctcgccgggctcggcctggtcttcgccggcctgctgttgcgccggccgcactcgctcagcgtcgcagcaggcgtcgcagccactgctcgccgctga

SEQ ID NO: 7682 - DNA, 633 bp, Pseudomonas aeruginosa
acgctcagcatggagagacctcgcaggtttcttgttcttggtggagggattctgcccagcgcgcggtcgcggcaaaacggcggcggcggccaaaaagggatcgatatggccaaaatccatgtccctttagcgccgcctggcgattatcgacgcggggaattactcggcgcccgcgccggtccatactgcttgagccagtcaggatcgaaagggggattcgatgaggcgcgccagcctgcatatgttgctctgccagttcgccatggccctgggcctgctcctgagcctgggcagcgaggcctgggccgccaggccggctccgcaggcggccgtcgacctggaagcgccggccgccctggccgaggacgccagcctcgaccagctcaacgcgcaactcgacctgatccgccagcgcgtcaccgccgacgccagcgacgacctcctcgccgagttgcgccagagcgcgctgcaagtccagcgccaggccgacgccctgctcgcgctgcgggtggccgacatcgagcggctcgacgatcagttgaaagtgatcggcccgccgcagcccgacgaggcggaaagcctcgccgcccagcgccaggccctgacccggcagaagaacgccctgctcgatga

SEQ ID NO: 7683 - DNA, 2868 bp, Pseudomonas aeruginosa
cgaacgccaggccacccagctcggccagtcgtcccgcgacctggcggcacagatcgtcaacctgcgccgcagcctgttcaactcgcagatcagcagccgcgcggcgacaccgttcagcccgagcttctggtcgaccctgatccgtcccaccgacgacgacctgcgccggctggacaagctgaaggcggaggccctggtcgccttcgacagcgccatcgcgcccggacaccgctgggccttcgccggaaccctgctggccaccgtgctggtctggagcttcggccgccgcctgctggagcgcatgcttacctgggcgatgatccgctggctgccggaaggccgcctgcggcgcagcgccctggccctggcggtcgggctggcgaccatcctgaccatcgtcggcgcggtgtcgctgatgcgctggggcctggaaagcaacgccagcctgagccccgacatggccagcctgaccgatcaactggtgagcctggcgaccttctgcgccttcatcgccggcctcggccgcgccctgctgatgctgccgcgaccatcctggcggctgccggcgatcccggacaggatcgccagcgccctcggcccgttcccggcgatcctcgcggtggcgctgatgctggtggccaccgaggaacggatcaacagcgtcaccggcaccagcctggccctgaccgtcgccctcaacggcctgaccgcgctggtcaccgcgctgatcttcgccgccgccctgctgcgctaccaccatgtgcggcgcaagcacgacctggagcggccaggcgggatcgccgggctgatccccttcgtcgcctcggtatggatcgcagcgatcctcctcgccctgttcaccggctacctgtcgctggcctacttcctcaccggcaagctgctgtggatcagcgtgatcgcggccaccacctacctgctgatcgctttcttcggcgacatctgcgaaaccctgctctcgcccaagcatcccagcggcctggcgctggccaatgcgctcggcctgtcgccgcgccaccaggcccaggccagcacggtgctggccggggtcggccgcaccctgctgctgctcaccgcgctgctgctggccttccttccggtcggctcgagccccagcgaactgctgcagggcttcgcccaactgggcgaaagcagcaggaccctgggcaacctgaacatcgtcccgcaggacatcctggtcgccctgctgctgttcgtcggcggcctgttcgccctgcgcatcgtcaagcgctggctgagcgagcggttgctgccggaaaccaacatggacgccggcatgcgcgcctcgctggtgaccctggtcggctacctcggcttcgtgctcctggcgatgctggtgatgtccaccctgcgcatcaacctgaccagcctgacctgggtggtcagcgccctctcggtaggcatcggcttcggcctgcaggccatcgtgcagaacttcatttccggcctgatcctgctgaccgagcggccggtgaaagtctgcgactgggtcagcctgggcggggtcgagggcgatatccggcggatcaacgtgcgcgccaccgagatccagatgggcgaccgctccacggtgatcgtgccgaactcgcagttcatctcccagaccgtgcgcaacgtgaccatgggcaatgccctcggggtggtcggggtgaacctgaccctgccgctggacaccgacgcgatgaaggtccgcgaactgctcttgcaggccttcgccgaacacccggcgatcctcgacgcgccggcgccctcggtgacgttcaaggatctcgccagcaacggcctggtgctcaacgccagcggcttcgtcaacagcccgcgttcggtggccggcgcgcgcagcgacctgctcttcaccatcctcgaccgcttgcgcagcgaaggcatcgcgctgtcctcgccgcagagcctgctgatgatccaggatggcggcccggccagcgccgcgcctgcgcccgcgacgcccgattgaagcgaaggggcggactgtccgtcacgcaacgggtagaatccgcccctttttcaacgccgaaccgccatgaatcgcgaagccctcgataccctcctccagcacctgctcgccgcgctgtccccggcgccggcggagacccgccgtctgttccatggtcgcggccgctgctggccgggcctggaacaattgaccgcggactggctgcagggcgtcctgctggtgactctgttcaaggagccgcagccggaggaactggaggccttgcgtcggaccctggagcaactgaccacggcgccggcctgggctgcgagccagggccggcacctggtcctgcagcaccgctaccgcccagacagcgcctgcgaatggctgtcgggcgagccgctggaaacctgggacatcgtggaaaacggactgcgcttccgcctcgacctgggacgcaaccagaacaccgggctattcctcgacatgcgcctgggccgccgctgggtgcaggagcaggccgccggccgccgcgtgctcaacctgttcgcctacacctgcggcttctcggtggcggccattgccggcggcgccagccaggtggtcaacctggacatggcccgcggcccgctcaaccgcggccgcgacaatcaccgcctgaacggccacgacctcggccgggtgagcttcctcggccacgaactgttcaagtcctggggcaagctgcgcaagctcggcccgtacgacctggtgatcgtcgatccgccgagcttccagaaaggcagcttcgtcctgacccaggactaccgcaggatcctccgccgcctgccggaactgctggtgcccggcggcaccctgctggcctgtatcaatga

SEQ ID NO: 7684 - DNA, 765 bp, Pseudomonas aeruginosa
gctgtcggcatggacatgcccgatggcttcatccccctgccgccacgcgtcgaaccgcaggcggcctttcgccccctgctcgacgacctgcgccgaaccctggcccggcctccgttcgagcgggccgtgcacagcgtctacctgtacggcagcgtcgcccgcggcgaggccatcacggggcgctccgacctcgacctgaccctggtcctgcgcgacccgcccagccccgaactggccgcgcaactggaaaccgcgcgcctggcattgcaggcgcgccacccggaagtcagcaagatcgatttcgatatcggccacctggaccaggcccgcgatccggccaaccgcgatagctggggctattggctcaagcaccgctgccgctgcctgtggggcgaagacctggccagcgacctgccgcccttgcgtccggcgaaagccatcgccctggccctcaacggcgactatgcgcaggtgctggaagactatgcgcgacgcctggaaagcgcgtcctcggaggaggagcgccgcctgcaacgagaagcggcgaagaagctgatccgctccagcgacatccttcgcggggagacggaaagcgtctggccggagaccctggagcattacctggcgctgtttcgcgcgcggcaccccggacaggcgccagccctggaatatttcaaggccgtgctggacggccaggtcaccgacccggcggtgttcatcgagcgcctgcgcgcattcagcgcctggatgcagcgccaggcgtag

SEQ ID NO: 7685 - DNA, 381 bp, Pseudomonas aeruginosa
acggctccagcggcgccttcggctgccgccgcgcgccctcttccggctccgccggcggcggcagttccagcagcttgtggatcttggcgcggaacgccgggctttgcgcgtaacactgctggtaggcctgcttcagcaggcgctgctgggccggacgcaggcgtccggcggcaagggggttgtccggctcggcggcggggtcgcggtcgtccagttgttcgaaccagcgcggattgccgagcacctcgcgggccaggctgccgagcgccgaatggaaagtgcgcacgcactgccgcgcctgggccgcgtcgaacgggtactgccagtgcgcgagcagccgcagcaattgttcgcgcaactgcgcacaggaggcgttggtga

SEQ ID NO: 7686 - DNA, 366 bp, Pseudomonas aeruginosa
atcataagtgttttccgccctcggccgacagtcggacgcggaccgcccatcgcgccagggcaacccttgcgcgaccgcgccggtctacccttcgggccctgccggcctgccaactcagcgaaaacaaggagcctacccatgagcgattgggcaatcacctacagcaaggacgaagccaccgagcgccaagtcctgccgttcccccacaagccgagccccgaagaggtcgccgagcacctgctggaatgggccgaggccaacctcaagccgggccactacagcaccggcaagctggaaagcgacgagccggcggaactgctgctgcgccgcttcggcatcgtcgtcactggcatcgccgaagcctga

SEQ ID NO: 7687 - DNA, 642 bp, Pseudomonas aeruginosa
ccgggtgcgctacaacgacgtgcagatcggactcgacggctacctgcggatgctcgaaggcgacttcctggcaatccccgacctgcgcttcgagatcgaacgcctgctcgtcgatcctccgggcgtcgcctgccgcctgcacttcgactgcacacccagcggccggctgttcggcatcccggtcaacggccagcgggtacgcttcgccgagaacgtcttctacgaattcgaagacgagcgcatcgccggcgtctggtcggtgatcgacaaggcggcggtcgccgcgcaggttcaggcgacgccgccgtcgtcctgaggcgccagggcactgcgggccgaccatctaccaggtatccacgaacggccgcttgcgccccgccctcggcgccggttctccggcgacggccaggccgcgcaggagccaggcgcgggtctccgccgggtcgatcaccgcgtcgatctccaggtagctggccatgttcagcgccttgccgttgcggtaggccttgtccaccatgccacggaacagcgcctcgcgccgctgggagtcttcctcggccgccagctccttggcgaagcccagccgcaccgcgccttccaggcccatggcgccgaactcgccgctgggccaggcgacggtga

SEQ ID NO: 7688 - DNA, 759 bp, Pseudomonas aeruginosa
  unsure (398): Identity of nucleotide at the above locations are unknown.
cgccctcgccggcctgcaccgcagcatgaatcgctgccagacgttcgaccctcggcgcgacgcgcggaccttccaactgaacatgccggagcaactggagccgctggtgctcccggcgatcctcgcccacctgcgccaggccgcgccacgcatcgagatacgctgcaacagcctgcactgggcggacctgaaggcggaactgggcgccggacgcatcgacctcgccatcgagatcgcccggcccaccgacgccgccctgcgccgccagcacctgctcgacgacagcctgtgcgtgatggccgggccgggcttcgccggcgacctgagtgcggaggagtacctggcggcggaccatgtcgcggtgacctcgcggcgacgcggcatctgcatcgaagacntggccctcggccacctcggcctgacccgccaggtgcgccagcgctgccagcactacctgtcggcggcgttgctggtggcccagggcggctacctgctgaccctgacccgaggctacgccgacctgatcaaccgcggcctgggcaaccgcctgctgccgatgccgctggccctgccagcggtgactctgaatctctactggtcgcgccaggccgacgacgaagccggcagcctctggctgcgcggcgaactggcggagctggcgacgcgcctgcgctgagcgcgggcgctgcgactagggcttcaccgccttggcgcgggccttctgcagccactgcccggccttcgccgaacactccgtga

SEQ ID NO: 7689 - DNA, 495 bp, Pseudomonas aeruginosa
ccaccagtaccgtcattcccttctacgcgcacctcctgctggagcgcacgcgcaaggccaccgaggaagcgttgcaggcgaaccaggagaaatcgcgcctgctggcccaggccagccacgacctgcgccagccgatccactccatcggcctgttcaccgcctgcctgcgcgacgcccgcctgggcgacgaggaacggcgcctggtggacaacatcgaccgctcgctgctcaacgtctcgcaactgttccgctccatcctcgatctctacaccctcgacaacggccggctccagcccaagcaggagaacgtccacctgggcgagttgctgcgcgacctggtccggcgcaacgctgaagcggcgcgctgggccggggtggaactgcgcctgcgcccttgccgcctgtggacgcgaaccgatccggggctgctgtcgaccatgctgcagaacctgctctccaacagcctcaagtacgccgccgagcgcccgctgctga

SEQ ID NO: 7690 - DNA, 492 bp, Pseudomonas aeruginosa
tccaggccgtgctgccctacatgcgtcggcgccgccgcggtcatatcctcaatgggcggctacatcaccatgcccggcatcgcctactactgcggcagcaagttcgccctggaagggggtttccgaagccttgggcaaggaggtggccggcctcggcatcgccgtcaccgcggtggcccccggctccttccgcaccgactgggccggccgttcgatggtccgcagcccgcgcaccatcgccgactacgacgcgctcttcgacccggtccgccaggctcgccaggaaaagagcggcaagcaaccgggcgacccgcgcaaggccgcgcgcgccatgctccaggccatcgacgcggaaaacccgccggcgcacctgctgctgggcagcgatgcactggggctggtgcggcagaagctgaaggcgctggaggaggaaatcgcggcgtgggaagaggtcacgcggtcgacggatggatgaggtttggaaagtcgtag

SEQ ID NO: 7691 - DNA, 795 bp, Pseudomonas aeruginosa
ggccttccacgtggcgttcgctgtagcgttcgaggcggatcgtcggcgattcggcggtcattgcggtcatccctgggctgtctggccacccagcataagcgtctgcgccgggctcgaccagccggtcggagatcgcgctttccctgccgcgcggctctggctaagctcgaccttcgaacaacgaaaggacgccagcatggtccagagcgccccagccagcgaaatcgccgccctcatcctgcgcggtttcgacgattaccgagagcagttccgcgagatcaccgacggcgcccgtgcccgcttcgagcaggcgcagtggcaggaagcgcagcgcgcctcggcgcagcggatcaacctctacgaggaaaaggtcgccgagaccggtggccgggctgcgcgcggggctggccgacagcgagctgctggacgtggagcgctggccgatcatcaagagcgcctacatcgcgcagatcgacctgcggctggacgacgagctggccgagacctggttcaactcgatcttctgcgggctgttcagccacgacaacatcagcgacggcacgatgttcgtgcacaccacccggccctcgctgcgcgcccacgcccgcgcgccctacacccgcacctaccggccgggcggcgacctgcgccaggcgctggagaagatcttcgacgactaccgcttcgacgtgccctacgacgaccgcgagcgcgacctcgaacggatcgacgcactgctgcacagcaacctgccggactgggtgtgcaaggacccggacctggccatcgagctga

SEQ ID NO: 7692 - DNA, 1263 bp, Pseudomonas aeruginosa
tcgacgtgtttccctatcggcggcaggagacgcctgagcagttgctcgggtaggtgcggagacaggaatcgacccagccgcacgctcctagaccaactgcgcccccagcgcccgcaccacccgctgcaactccgcccgtccaccggtggcgacgcgcaggccggtgatctcgcggcgcggcgggtagtgtttgcgcagggcgtcgaaggcggcgcggcgggtggcgctgtcgccggtcaggctgcggcggaaggcggcatcgtcgctgcgcgggtcgtataccgcgcggcacagcgtggccagcgcccaggccgggtcgcagccggggttgagttgcaggccggcgagccaggtttccggcagcacgtcttgcaggctcacacgttcggcgatgccgcgccaggcgcagtaggcctggtagatctgcgcggtgccgcgcagcttgccttccaggctgtagccggcgatgtgcggggtggcgatcaggcagtgcgcggccagctcggggtcggcctgcggttcgccttcccagacgtccagcgccacttccaggtcggcgccgccttcgagcaggcggcgcagggcctgattgtcgaccaccgcgccacggctggcgttgaccagccaggtgccgggacgcagggcggccaggcggggttcatccagcaggtggcgggtcgggtgttcgccgtcgcggttcagcggagtgtgcaggctgatcacgtcggcctcggccagcagccgttccagcgagacgaattcgccgtccggctcgcgtgcctggcgcggcggatcgcagaccagcactttccagcccagcccgcgcagcacctccaccagccgcccaccgacctgcccagcgccgaccaccccataggtgcgttcggccaggtcggcgccgcgcacctcggccatcgccagcaggcagccgagcacgtagtccaccaccccgcgggcgttgcagccgggcgcgctggaccaggcgatgccggcctcggcgaagtagtcgaggtcgaggtggtcggtgccgatggtgcaggtgccgacgaagcgcaccggcgagccggccagcgcggcgcggctgacctcggtgaccgagcgcaccagcagcacgtcgacctcggccagcgccgcgcggtcgatggcgcgcccgggcaagcggcgaatggagccctggtcggcgaagaaggcgtcgaccacgggaatgttttcatcggcgagaatacgcatgcagacctccgcgaacgaggctgcacactctag

SEQ ID NO: 7693 - DNA, 1347 bp, Pseudomonas aeruginosa
ttacgtccactgactgctattccaacggaacagaaggactcggaccctcatgagcaaacgtatcgtcgtcaccggcatgggcgcggtcagcccgctgggctgcggagtcgaacccatatggcaacgcctgctggccgggcaatcgggcatcgccacgctcccggcggagctgatcggcgacctgcccatcagcatcggcggccaggtccccgaccgtgcccaggacccgcaggccggcttcgatcccgacctgctgctggccgccaaggaacaacgcaagatggaccgcttcatcctcttcgccctggccgccgcgcaagaggccctggcccaggccggctgggcgccgcagagcgccgaggcgcaggagcgcacggcgaccgtcatcgcctccggggtgggcggcttccatgccatcgccgaagcggtgcggaccaccgacggcaagggaccgcggcgcctgtcgcccttcaccatcccgtcctttctctgcaacatggcggccgcccatgtgtcgatccgccatggcttcaagggaccgctgggcgccccggtgaccgcctgcgcggcgggcgtgcaggcatcggcgacgcggcgcggatgatccgcgcgggagaggtcgacgtggcgctctgcggcggcgcggaagcgaccgtccaccgggtcagcctggccggcttcgccgccgcgcgcgccctgtccagcgatttcaacgacagccccgaacgcgcctcgcgccccttcgaccaggcccgcgacggcttcgtcatgggcgaaggcgccggcctactggtcatcgaggaactggagcacgccctggcgcgcggcgccaggcccatcgccgagctggtgggctacggcaccagcgccgacgcctaccacatgaccgccgggccggaagatggcagcggtgcccgccgggccatgcagcaggcgctgcgccaggccggcgtggaagcggccgcggtgcaacacctgaatgcccacgccacctccacccaagtaggcgacaagggcgaactggccgccatcaaggccgtgttcggcgctggcagcgggctcgccatcagcgcgaccaaatccgccaccggccacctcctgggcgccgccggcggcatcgaggctatcttcacggtcctggcactgcgcgaccagctcgcccccgccacactcaacctggaaacgcccgacaccgacgccgagggcctcgacctggttcgcggcgaagcccggcgctggccgatggaacacgcgctgtccaatggcttcggcttcggcggggtgaatgccagctgttgttccggcgctgggtgtagggtgggcgacccctctgccagtcgttcctga

SEQ ID NO: 7694 - DNA, 432 bp, Pseudomonas aeruginosa
cgaatgaaaacctataccgcgaaaccggaaactgtacagcgcgactggttcgtcgtcgacgctgccggccagaccctgggtcgtctggcgaccgaaattgcccgccgcctgcgtggcaagcacaagcctgagtacactccgcacgttgacaccggcgactacatcgtcgtcatcaacgccgagcaggtgcgtgtgaccggtgccaagaccaccgacaagatgtactaccaccactccggcttcccgggcggcatcaagtcgatcaacttcgagaagctgatcgccaaggcccctgagcgcgtcatcgagaccgctgtaaaaggcatgctgccgaagaaccctctgggtcgcgatatgtatcgcaagctgaaggtgtacaagggtgccagccacccgcacaccgctcagcagccccaagaactgaagatttaa

SEQ ID NO: 7695 - DNA, 294 bp, Pseudomonas aeruginosa
ctcgcgatgcccgtgaagtcgagcgtaagaaagtcggtctgcgtaaagcgcgtaagcgtccgcagtactccaagcgttaattcgacgcttgctgaaaaacgcccacctcttcggagctgggcgtttttttatgtctacgctttaactctgcggcaaggtgtcgcatggccgaagggcgcgccctacaagggtttcgggcgttttgtgtcaggctattaccttgtcatcaaagggggttttctttaccatttggcgaattttttgcgcggctcgaatttttacttaaaggcctga

SEQ ID NO: 7696 - DNA, 1338 bp, Pseudomonas aeruginosa
catcaagaagaagaaggacgagaacggcgtaccgctggacggcatcgcgttccatccgtactacaccgtgaaggacatcgtcggcgtggtggtgttcctgttcatcttctgcaccgtgatcttcttcttcccggaaatgggcggctacttcctcgagaagcccaacttcgagatggccaaccagttcaagacccccgagcacatcgctccggtctggtacttcaccccgttctacgcgatcctccgcgcggttccggacaagctgatgggcgtggtggcgatgggtgcggcgatcgctgtgctgttcgtcctgccgtggctggatcgcagcccggttcgctcgatccgctacaagggctggctgagcaagctgtggctggtgatcttcgcggtgtccttcgtgatcctcggctactacggcgcccaggctccgagcccgctgggtactaccctgtcgcgcgtttgcaccgtcctgtatttcgccttcttcatcctgatgccgttctacacccggatggagaagaccaaaccggttccggaaagggtgactggctgatgaaaaagcaattcgctgcactgattctggcggtactgccagtcctgggtttcgccgctggcggccatgggccgcaactggatcatgtcgatatcgacctgaccgacaaggcggccatgcaggatggcgcgcgtaccttcgccaactactgcatgggctgccatagcgccaagttccagcgttacgagcgtgtcgccaccgacctgggcattcctgccgatctgatgatggagaagctggtgttcaccggcgccaagatcggcgaccacatggacatcggcatgaagccggccgacgccaagacctggttcggcgccgctccgccggatctgaccctggttgcccgcgtacgcggcaccgactggctgtacagctacctgcgctcgttctacgaggatcccaagcgtccgtggggcgtgaacaacgtgatcttccccaacgtcggcatgccgaacgtcctggcgcccctgcagggacgccaggtgatcggctgcaagcaggtacaggtggtcgaggatggcaagaagcagttcgatccgttgaccggtaccccgctgactcacgaagcttgtgaccagttgaccgtggtgccgaagaccggcgagctgaacgaagcccagttcgacgagaaggtcaagaacctggtgaccttcctggcctattcggccaacccgaacaagctggcctccgagcgtatcggtacctacgtcctgctctacctggccttcttcttcgtattcgcctatctcctcaagcgcgagtactggaaggacgtgcactaa

SEQ ID NO: 7697 - DNA, 435 bp, Pseudomonas aeruginosa
acgagatatgcgttaaggaacatgaagatgaattccagccgtccctatctggtccgcgcgctctatgaatggatcgtcgacaacgattgcacgccacatatcctggtgaacgcagagttcgccggggtaaaggtgcctccgggttatgccagcgatgggcagatcgtgctcaatgtctcgccctctgccgtgcggcatctgcacatggacaacgaggcggtcagcttcgaggggcgtttcggcggcgtggcgcagagcctgtacattccagcgctggcggtaatggccatctacgcccgggaaaacggccagggcatggtcttcgatctggagcagccgggtccggtggacgacgagccgggcgatgacgatggcggaccgtccgatgagccgccgcgtcccagtggcaggccatccctgaaggtggtcaagtaa

SEQ ID NO: 7698 - DNA, 615 bp, Pseudomonas aeruginosa
atccagtccagtcgcggtggtgattgtccgtcgctggtatcgacggtgaccacatcgaagcgacaggggcatttggcccagcgcgcctcctgttgcagaaaaagttcggcggagagaatcaggcgctgccgcttgcgcgcgtcgatgctctccagggctccgccccaggcgcgatgccggcgggagcggacttcgacgaatactactgtatcgccgtcgagcatgaccagatcgagctctccgcggcgacaggtccaattcttgccaagtgtggcaaggccctgtcgccgtagatgggcgcaggccagttcctcggcctggcgccccttgtcccgggagctttccctatcggtcaaaagctgctggtccccagcggctggacctggccattgcggaactcggcccattgcaactggcgttcgatacgttgggtcggattcaggctcagggtaccggtcaggccgtcgatctgcaggctcggcacggccttcagttcaggcagacgcggagcgaggcggtaggcgtcgacgcccatggcgtagaggcggcccatgctgccgttggcctggggccattgggcggcgacctgctggcgggtcgggtcgctggggttga

SEQ ID NO: 7699 - DNA, 966 bp, Pseudomonas aeruginosa
ctcccgaggtattttcgtgtcagcaggcactctgttcgtaatggcgaccccgatcggcaatctcgacgacatcagcccgcgcgccctgcgggtgctgcgggaggtggccctggtggctgcggaggatacccgccattcgatccggctgttccagcacttcggcatcgagacgccattggcggcctgccacgagcacaacgagcgcgaggagggcgggcgcttcatctcccggctgcagggtggggaagacgtcgcgctgatctcggacgccggtaccccgctgatttccgatcccggcttccacctggtgcgccaggcacaggcgctgggtatccgggtggtcccggtgccgggctcctgcgcgctgatcgcggcgctgtcggcggcgggattgccgtcggaccggttcatcttcgaaggtttcctgcccgccaaggctgcgggacgacgcagccgcctccaggcggtacaggaagagccgcgcacgctgattttctacgaggcgccccatcgtctgctggaaagcctggcggacatgcgcgacgtgttcggcggggagcgccgtgcggtgctggcgcgggagctgagcaagaccttcgagaccattcgcagcctgccgttggccgaactgcacgattgggtcgcgtcggacagcaaccagcagcgcggcgagtgcgttgtgctggtggcggggtggcaggcgccggaaggcgaggagtcgatcggtgcggaggcgctcagggtgctcgacctgctgcttgccgagctgccgttgaagaaagccgcggcgctggcggcggaaattaccggggtgcgaaaaaaccttttgtatcaacaggctttgcaacgccaagggaagagttgagcttgttcttcgcgcctgctcccgctaacctgtcggcggagagtcgattggacagtcgctgtcgcgcaatagcgcggtggaggaaagtccgggctccatag

SEQ ID NO: 7700 - DNA, 555 bp, Pseudomonas aeruginosa
cgccgcgctcgaatcgctggccgtcggcggccggctggtggtgatcagtttccattccctggaagaccgcatcgtcaagctgttcatgcgcaagcacgccaagggcgaggcggacaacctgccgcgcgacctgccgatccgttccaaggtcttcgagccgcgcctgaagctgctgggcaagccgcagtacgcttcggaagaagaactcaaggccaacccgcgctcgcgcagcgcggtcatgcgcgtggcggagaagctgagatgagccgtctcttcgtcaagcgcctgcctaccggcagcttcctcatgttgctgctttatataggtctgctgctctcggcgattgccgtggcctacagcacctactggaaccggcaactgctcaactcgctgtattccgagctgagcgtgcgcgacaaggcgcaggccgagtggggccggttgattctcgagcagagcacctggaccgcccatagccgcatcgaaagcctggcggtggaacagttgcgcatgcgcgttcccgacccggccgaggtcaggatggtggcgccatga

SEQ ID NO: 7701 - DNA, 1515 bp, Pseudomonas aeruginosa
tcgcttccgctgcggtggatgacgtggtgctcctggctggcaagggtcacgaggattatcaggagatcgacggcgtacgccatccgttctccgacatcgagcaggccgagcgcgccctggccgcctgggaggtgccgcatgcttgagcctcttcgcctcagccagttgacggtcgcgctggacgcccgcctgatcggcgaggacgccgtcttttcggcggtttccaccgacagtcgcgccatcgggcccggccaactgttcattgccctgagtgggccgcgtttcgacggccacgactatctcgccgaggttgccgccaagggcgcggtggctgcgctggtggagcgcgaagtcgccgacgcgcccctgccgcaattgctggtgcgcgatacccgtgcggccctggggcgactgggcgcgctgaaccggcgcaagttcaccggcccgctggcggccatgacgggctccagcggcaagaccacggtcaaggagatgctcgccagcatcctgtgtacccaggccggcgatgccgagtcggtgctggctacccgtggcaatctgaacaacgacctcggcgtaccgctgaccctgctgcaactggcgccgcagcaccgtagcgcagtgatcgaactgggcgcctcgcgcatcggcgagatcgcctacacggttgagctgacccgcccgcacgtggcgatcatcaccaatgccggaaccgcccatgtcggcgagttcggcggaccggagaagatcgtcgaggcgaagggcgagatactcgaagggctggccgccgacggcaccgccgtgctgaacctggacgacaaggccttcgacacctggaaggcccgtgccagcggccgtccgttgctgactttctccctcgaccggccccaggccgatttccgcgccgccgatctgcagcgcgatgcgcgtggctgcatgggcttcaggctgcagggcgtagcgggtgaagcgcaggtccagctcaacctgctggggcggcacaatgtcgccaatgccctggctgccgccgctgccgcccatgcactgggcgtgccgctggatgggatcgtcgccgggctgcaggcgctgcagccggtcaagggccgcgcggtagcgcaactgaccgccagcgggctgcgtgtgatagacgacagctacaacgccaaccccgcgtcaatgctggcggcgattgatatactgagcggcttttccgggcgcaccgtcctggtcctcggagacatgggcgaactcggttcctgggccgagcaggcccaccgcgaggtgggcgcctacgccgctggcaaggtgtccgcgctctatgcggtcggaccgctgatggcccacgccgtacaggcgttcggcgccacgggccggcacttcgccgaccaggccagcctgatcggggcgctggccaccgaacaaccgacaaccaccattttgatcaagggttcccgcagtgcggcgatggacaaagtcgtcgcggcgctgtgcggttcctccgaggagagtcactaa

SEQ ID NO: 7702 - DNA, 1371 bp, Pseudomonas aeruginosa
agctgcgttgaggacgaagagagcatgagcctgatcgcctccgaccacttccgcatcgttgtcggcctcggcaagagcggcatgtccctggtgcgctacctggcgcgccgcggcttgcctttcgccgttgtcgatacccgagagaacccgccggagctggccaccctgcgtgcccagtatccgcaggtggaagtgcgttgcggcgaactcgacgccgagttcctctgctccgcccgcgaactctacgtcagccccggcttgtcgctgcgcacccccgcgctggtacaggccgccgcgaaaggtgtgcgcatctccggtgacatcgatctcttcgcccgcgaggcgaaggccccgatcgtcgccatcaccggttccaacgcgaagagcaccgtgaccaccctggtgggcgaaatggcggtggccgcggacaagcgtgtcgccgtcggcggcaacctcggcaccccggcgctcgacctgctggccgacgacatcgagctgtacgtgttggagctgtcgagcttccagctggaaacctgcgatcgcctcaacgccgaggtggcgaccgtgctgaacgtcagcgaagaccatatggatcgctacgacggcatggctgactaccacctggccaagcaccggatcttccgcggtgcccgccaggtcgtggtgaatcgcgccgatgccctgacccgaccgctgatcgccgataccgtgccgtgctggtcgttcggcctgaacaagccggacttcaaggctttcggcctgatcgaggaagacggccagaagtggctggcgttccagttcgacaagctgctgccggttggcgaactgaagatccgtggcgcccacaactattccaacgcgctcgccgcgctggcgctgggccatgcggtcggcctgccgttcgacgccatgctcggcgcgctgaaggcgttttccggcctggctcatcgctgccagtgggtacgcgagcggcagggcgtgagctactacgacgattccaaggccaccaacgtcggcgccgccctggcggcgatcgaggggctgggtgccgacatcgacggcaagctggtgctgctcgccggcggagacggcaagggcgccgatttccatgacctgcgcgagccggtcgcgcgcttctgccgggcggtggtactgcttggccgtgacgccgggctgattgcccaggcactgggcaacgcggtaccgctggtgcgcgtcgcaacgctggacgaagcagtccggcaggccgccgagctggcccgcgaaggcgatgcggtgctgttgtcgccggcctgcgcgagcctggacatgttcaagaacttcgaagaacgcggacgcctgttcgccaaagccgtagaggagctagcgtga

SEQ ID NO: 7703 - DNA, 1161 bp, Pseudomonas aeruginosa
gccggcacggcatcgacctggacttcccgctgctggcgggttgcctggcgctgctcggcctcggccctggtgatggtgacttccgcgtcttccgaggtggcagcggcgcagtcgggcaacccgctgtatttctccgtccgtcacctgatctacctggtgatcggcctgatttcctgcggcctgaccatgatggtcccgatggccacctggcagcgttggggctggaagctgttgctggtcgccttcggcctgctggtgctggtgatcacccccggtatcggccgcgaggtgaacggctcgatgcgctggatcggcttcggcctgttcaacatccagccttcggagatcgccaaggtctgcgtggtgatcttcatggccggctacctgatccgccgccagcaggaggtccgggaaagctggatgggcttcttcaagcccttcgtggtgttgctgccgatggccggcctgctgctgcgcgagccggacttcggcgccaccgtggtaatgatgggcgctgccgcggccatgctgttcctcggcggggtggggctgttccgcttcggcctgatggtgctgctggcggtcggcgcggtggtcctgctgatccagacccagccctaccggatggcacgcctgaccaacttcaccgacccctgggccgaccagttcggcgccggctatcagttgagccaggcgctgatcgccttcggccgcggcggctggttgggcatgggactgggcaacagcatccagaagcagttctacctgccggaggcgcacaccgatttcgtcttcgccgtgcttgcagaggagctgggcatcgtcggcgccctggcgaccgtcgccctgttcgtgttcgtcagcctgcgcgcgctgtacatcggcatctgggccgagcaggccaagcagttcttctccgcctacgtggcctacggcctggccttcctctggatcggccagttcctgatcaacatcggggtgaacgtcggcctgctgccgaccaagggcctgaccctgccgttcctcagctacggcggcagttcgctggtgatctgctgtgcctgtctggggatgttgctgcgcatcgaatgggaacggcgaacccacctgggtagcgaggaatatgagttcaacgaagaggactttgccgatgaaaggtaa

SEQ ID NO: 7704 - DNA, 324 bp, Pseudomonas aeruginosa
cctggtacccaaggccggcctgccgttgcacctgattcaggtcagcgggctgcgcggcaagggcctgaagtcgctggtcaaggcgccgctggaactgctcaagtcgctgttccaggcgctgcgggtgatccgccagctgaggccggtctgcgtgctcggcctgggtggctatgtcaccggcccgggcggcctggctgcgcgcctcaacggcgtgccgctggtgatccacgagcagaacgccgtggccggcaccgccaaccgcagcctggcgccgatcgccaggcgcgtctgcgaggcattcccggataccttcccggccagtga

SEQ ID NO: 7705 - DNA, 543 bp, Pseudomonas aeruginosa
catcgcacaaaccgccgtcataaaagtgatcggtgtaggtggtggtggcggcaacgccgtcaatcacatggccaagaacaacgtcgagggcgtcgagttcatctgcgccaacaccgacgcacaagcgctgaagaacatcgcggcgcgcaccgttctgcaactcggcccgggcgtcaccaaggggctgggtgccggcgccaatccggaagtcggtcgtcaggcggctctggaagatcgcgagcgcatttccgaagtgctggaaggcgccgacatggtcttcatcaccaccggcatgggtggcggcaccggtaccggcgccgcgccgatcatcgccgaagtggcgaaggaaatgggcatcctcaccgtcgcggtggtgacccgcccgttcccgttcgaaggtcgcaagcgcatgcagatcgccgacgagggcatccgcgcgctggccgagagcgtcgattcgctgatcaccatcccgaacgagaagctgctgaccatcctcggcaaggacgccagcctgctggccgcctttgccaaggccgatga

SEQ ID NO: 7706 - DNA, 459 bp, Pseudomonas aeruginosa
tccagtccgccggattgcaagagcaggaagctgccaagaagttcatccgcatcaagcgcgaagtcagcgtggaagagggcgacaagcgcgccgtcttcgttccgttcgacggcttcaaggtcagcttcgagatcgatttcgatcatccggtcttccgtggtcgcacccagcaggcctcggtcgatttctccagtacttccttcgtcaaggaggtcagccgcgcccgtaccttcgggttcatgcgcgacatcgagtacctgcgttcgcagaacctggcactcggcggtagcgtggagaacgcgatcgtggtcgacgagaaccgcgtgctcaacgaagacggcctgcgttacgaggacgagttcgtcaagcacaagatcctggatgccatcggcgacctgtatctgctcggcaacagtcttatcggcgagttccgtggcttcaagtccggccatgccctga

SEQ ID NO: 7707 - DNA, 1128 bp, Pseudomonas aeruginosa
tctaccacatgcgcaataccctgctgtcggcagaggacgtgggcgagaccatcaaggaattccgcgaggaaaccctcagcgccaccatcaaccagcacattccgccgcagtcgctgcccgagcagtgggacatcgaaggcctggaggctgcgctgtacagcgacttcgccgtgcgcctgccgatccagcagtggctggacgaagacgacaagctgtacgaggaaaccctgcgtagcaagatcctcgagcagatcgtcgccgcctactacgagaaggaagagctggccggcgccgaagccctgcgcgccttcgagaagcagatgctgctgcgggtgctggacgacctgtggaaggaccacctgtcgaccatggaccacctgcggcacggcatccacctgcgtggctacgcgcagaagaatccgaagcaggaatacaagcgcgagtccttcaccctgttccaggagctgctggactcgatcaagcgcgacaccatccgcgtgctgtcccacgtccaggtccgtcgcgaagacccggccgaagaggaggcccgcctgcgtcgcgaggcggaggaactggccaagcgcatgcagttccagcacgccgaggctccctcgatggagcaggccgtggccggcgaggaagaagagcttcccgagggcccggctccggtcgtgccgctcgagcctgtgcgcaacgagcagaagatcggccgcaacgagccttgcccgtgcggttccggcaagaaatacaagcactgccacgggcagctggactaagcttcccgcctggttcaccaacgccgcgaccggtcctgccgctcgcggcgtttgttcgaattggcgccagcccggcgccgatgcgttttccgtcacgccgtcgcggacggcatcgagtccactgtttggtaaaggagcgcgttcccatggctgtcggtcttggccccctgtccaccctgcacccggtccccggtttcgaactcggcatcgcttccgccggcatcaagcgaccggggcgcaaagacgtggtggtcatgcgctgcgccgaaggctccagcgtggccggggtgttcaccctgaacgcgttctgtgccgcgccggtgaccctggccaaacagcgtttcctcggtga

SEQ ID NO: 7708 - DNA, 951 bp, Pseudomonas aeruginosa
tccgtgaaacgagtacatgtcgccgcggccgtgattcgtggctccgatggccgggtgctgatcgcccggcggccggaagacaagcaccagggcggcctgtgggagtttcccgggggcaaggtggaggacggcgagccggtgcgcgcggcgttggcccgtgagctggaagaggaactgggcatccgtgtcgagcgggcccggccgctgatccaggtccggcacgactatgccgacaagcacgtcctgctcgatgtctgggaggtcgacgggttttccggcgaagcccacggcgccgagggccaaccgctggcctgggtggagccgcgcgagctggccgactacgagttccccgccgccaacgcgccgatcgtccaggccgcgcgcctgccggcgcactacctgatcaccccggacggattggagccgggcgagctgatcagcggcgtacgcaaggcggtggaggcgggcatccgcctgatccagttgcgcgcgccgaacatgttcagtcccgaataccgcgatctcgccatcgatatccagggactctgcgccggcaaggcgcaactgatgctgaaaggcccgctggagtggctgggcgacttcccggctgccggttggcacctgacctccgctcaactgcgcaaatacgccagcgccggtcggccgttccccgaagggcgcctgctggccgcctcctgccacgacgcggaggaactggccctggctgcctcgatgggagtggagttcgtcaccctttcgccggtacagccgaccgagagccatcccggcgagccggcgctgggttgggacaaggccgccgaactgatcgccggcttcaaccagccggtctacctgctgggtggcctcggtccgcagcaagccgagcaggcttgggagcatggagcccagggcgtggcgggtatccgtgcgttctggccgggcggcctttga

SEQ ID NO: 7709 - DNA, 525 bp, Pseudomonas aeruginosa
aattcttcagcgggcccagctcgtcgttccagcggtcgatgcagctttccaggcgtgccacttccgtctcgtccagggcccgatactccggcatcgccagctccccgccgaggtcgaacaggcggtgttgcaccggcgccagcgcctggacgatctcctccaggccgggatgtgcgccacgcgcttccagcagctcggcaaggagcaggcccaactggctgttcaattcgtccaccgcgccgatcgcctcgatgcgtggatggctcttgggcacccggcgtccgccggccaggccggtctcgccgcggtcgccggtacgggtgtagatcttcgacaatcgattgcccatggattcaaccttcctcttcgtcgccccgccgcaggctgctaccgggttgcggcagagcgggcggcagggccttggcttgtgccggggcgaccgcttcggagctttccagcggcaggcggatgctgaagcaggtgccgcggcccagttccgagcgtacttccatctggcccttgtga

SEQ ID NO: 7710 - DNA, 531 bp, Pseudomonas aeruginosa
ttgttggtgatgatgaaatacgagacggacaggccgagaccggtgccctggccgacttccttggtggtgaagaacggctcgaagatacgcttgcgcaccagttcgggcatgccgctgccgttgtcttccacctggacttccgcccagggcggcgtcaggcgcgtgcgcaggacgatccggccctgttcgccttcctcttcgtcgtcgcgctggtggatggcctgggcggcgttcttcagcaggttgagcaggacctgctcgacctcgttggcgatcaccggcaccgggccgaggttggggtcgaactcgtggacgatctgcaacgacttgaagtcgaagccttcggccaggtcgaagtcgttaccggcgatttccaccgcctgttcgagcagtgcgggcagttcgcaagcggtcatctgccggtggctgcggcggctgaaggcgagcatgtgggtgacgatcttcgctgcccgcgagccggcgtgctggatgccttccagcaggcgcgggatgtcgcggccgtcgaggtag

SEQ ID NO: 7711 - DNA, 444 bp, Pseudomonas aeruginosa
acaggcagcggctgcgcggcaggcgggcggcgaccgcctgctggctgcccaggccgttctgcagcaacagcagttcggcgttgccggccaggcgatgggccacgctggaggcggcttcctccgcgtcgtaggccttgcaggccagcagcaggcgctggatgggttgcccgccgtccggggtttccgcggcgatcgggtagaggctggcctggccgtcttccaccaggctcagtccgccggcctgttggtagcggcgcaggcgctggcggtcgcgcaggatcaggcggacgggcaggccggcgcgcccgaggcgcgcggcccagaggctgccgaggctaccggcgccgaggatatgccaggtcatggtggctactgcgaatggctgacgatagggcgaagtctagcgcagtgccggtagccggcaggttgcgatcctgccgctag

SEQ ID NO: 7712 - DNA, 840 bp, Pseudomonas aeruginosa
tgcatggaattgaactacgaccgactggtgcagcagaccgagtcctggctgccgatcgtgctggagtacagcggcaaggtcgccctggcgctgctgaccctggcgatcggctggtggctgatcaacaccctgaccggccgggtcggcggcctgctcgccaggcgcagcgtcgaccgcaccctgcaaggcttcgtcggcagcctggtgagcatcgtcctgaagatcctgctggtggtcagcgtggcttccatgatcggcatccagaccaccagcttcgtcgccgccatcggcgccgccggcctggccatcggcctggccctgcagggcagcctggctaacttcgccggcggcgtgctgatcctgctgttccgcccgttcaaggtcggcgactggatcgaggcacagggcgtggccggtaccgtggattcgatcctgatcttccacaccgtgctgcgtagcggcgacaacaagcggatcatcgtgcccaacggggcgctgtccaacggaacggtgaccaactactccgccgagccgctgcgcaaggtgatcttcgacgtcggcatcgactacgacgccgatctgaagaatgcgcagaacattctcctggccatggccgacgatccgcgggttctgaaggacccggcaccggtggcggtggtttccaatctcggcgaaagcgcgattaccctgtccctgcgggtctgggtgaagaacgccgactactgggacgtgatgttcatgttcaacgaaaaggcccgcgacgcgctgggcaaggaaggtatcggcattcccttcccgcagcgggtggtcaaggttgtgcagggcgcgatggccgactga

SEQ ID NO: 7713 - DNA, 438 bp, Pseudomonas aeruginosa
cggtcaccgcaaggtccctgccacaagggcaggctgtcttacgcggctcgcgcgtcgagtcgcaacccggcaacgccggcttcaacaaaacccgccggacttcgatccggccgttggaaaccactgtttgggagagttacgactatgaagcttcgtcctctgcatgatcgcgtcgttatccgtcgcagcgaggaagagaccaagaccgcaggcggcatcgtgctgccgggttccgccgccgagaagccgaaccgcggtgaagtggtagccgtaggtaccggtcgtgtactggacaacggcgaagtgcgcgctctggcagtgaaggtgggcgacaaggtggtcttcgggccttactccggcagcaacgccatcaaggtcgatggcgaggaactgctggtgatgggcgagtccgaaatcctcgccgtcctggaagactga

SEQ ID NO: 7714 - DNA, 369 bp, Pseudomonas aeruginosa
actggatgctgggcaaatagcgcagcgggaggaccgaccatgcaaggctatcaactgaccttcatcacccagcaggggcgccgccaccagggccagccgatctgcgactggctgctggaagaggcgcgccgcctgggcgtgcgcggtgccaccgcgctggctgccagcgaaggcttcggccagagcggccggctgcattcgatgcacttcttcgagctggccgaccagccgcaggaaatcctcatggcggtcgatcccgagcagtcagaacggctgttcgagtcgatccgccaggccggcgtgcggctgttctacatgaaggtgcccatcgagttcggcgtgctgggagcggacgaatcgtcttcctga

SEQ ID NO: 7715 - DNA, 1353 bp, Pseudomonas aeruginosa
tcgacaagccattctccgtggccttgctgcatacggtgcatggcgtcggctaccgcctggcggaggagccgaatggagtataagcagagcctcgcccgccggatcgtcatcgccttcatgctgatgacggtcgccgtggggggactgttctccgccggcatcgtcggcgtggtccacatcatcgaggagcgcctgatttcccgcgacctgggcggcgaactggagcgcatcctgcgcgacgacctggcccagggacgcaacccggtgctcgatcccggcatgcgcttcttcatcagcgacggccagggctcctacgccatgccgccggcgctggaccaactggatgtcggtttccacgaagtgttcgagggcgacttgtcgttccatgcgctggtgcgcgacatcgatggtcgccgcttcgtcctgctgcaggaccagagcgatttcgaagcgcgcgagcaggtgctctacgcctcggtgctgaccggctacgtgctgagcatcgccctggccggcctgcttggctggatgctcgcgcgcaaggtgatggagccggtggtgcgcctggcgcgccaggtgcggcatcgcgaacagttgctcggtctggcgccgccgttggcgccggactacgccaacgacgaggtcggcgagctggccgcttccttcgacgagacccttggccgcctgcgcgacgcgctcaagcgcgagcaattgttcaccagcgacgtcagtcatgagttgcgtacgccgttgatggtcatcgccacctcatgcgaactgctggccgaagaacccagcctcggcccgcgcgcccgtggccaactggagcggatgaccaaggccaccgaggagatgcgcgacctggtgcaaaccttcctgttgctggcgcgtgcgcagaagggcgaggaaagcctggcgccccacggtagcctggagagcatcgccgacgacctggtccaggtctggcgcgaacaggtcgaagcgcgaggactgaccctgcactaccgcaacgaaggtgcctgcgccggccagttcaacgcgccactgctgcgcgcggtgatgggcaacctgttgcgcaacgcgacccactacaccgatgccgggagcatcacgctgaccctcgacgagcatggtttcagcgtcgaggacaccggggcgggcgtcccggaagaacaacgcgaacgcattttcatgcccttcgttcgcggcagttccagctccgggcgcggcgaaggccttggcctcgggctctcgctggtgaagcggatctgcgcggccgagggctggagcgtaaccctcagcgcggtggagccgcacggctgccggttcgaagttttactcgatgttgcttga

SEQ ID NO: 7716 - DNA, 885 bp, Pseudomonas aeruginosa
gcgcatggaggcacggcgggtagcgaacggggaacagaccggctaccagaaccgcttcgtgttaccagccgaaacggtcgagcgcgagttccgcgacgccggcttcgtcgtccagaagcatctcgatttcatcccgctgtatcacatgtggcgggtctatatcttgcgaaaggaataacaatggctcccgatctggcatccctgcaacgtatctccggcgactccgccatcgaccagtggttgcaggtacccggcagctgggtcgaggagcccaacgagcgccgcggcggggcgagcggcgtgcagcgggtgtacaccggcgatggacggctgctctatcgcaagcagcagaccggccacgtctaccgcgactggcagcgccctttcggctatcccaccgccatgcgcgagcgcgatgcgctacgggccttcgagtcgctcggtatacgcgtgccgcgcctgatctattccggctgccgcaaggtcgacgggcaatggcaggcgctgctggtgaccgaagccctggagggtttctccagcctcgacgagtgctatgcgcgcggtgaccaggaccgctggggcgaagcgaagcaccaaagaattctgcaacaaatcggcgctaccattgcccggatgaatctcgcccactggcagcacggttgtctctatccgaagcacatcttcgtccgcgtcgagggtgaggccatcgaagtagcgctgatcgacctggagaagagccgccgccgccttacggtgaacaaggcgtcccagcacgacctgaagcagttgaagcgccgttcgtcgtggactggcgcgcagtggcaagccttcatctatggttaccagacggcgtttggcagcgccatcaaagggttgcagacatga

SEQ ID NO: 7717 - DNA, 2523 bp, Pseudomonas aeruginosa
gatcgtcggaggcatgggccgaataaggaccaggcctcatgcgccaccttgccgcggcgcgccaggcttgccctaggcgacctggaacacgtgcttgaggtagtggatgaagtcagggtcccggcattgcgccttgccgggcgtatcggagatcttcgccaccggatggccgttgcaggcgctcatcttcaccacgatgttcatcggctcgacgcccggcaggtcgcaggtgaaatgcgtgcctatgccgaagctgacgttgatccggccctgcagcgcgcgatagatcttcagggcccgtggcaggtcgaggccgtcggagaacaccagggtcttggtcagcgggtcgatgcccagcttgaggtagtgggcgatggtcttttccgcccacagcaacgggtcgcccgagtcgtggcggaggccgtcgaagagcttggcgaaatagaggtcgaagtcgcgcaggaaggcatcggtggtgatgcagtcggtcagcgcgatgccgagcagcccacggtattcgcggacccagcagtccaacgcggcactctggctgtcgatcaggcgcggaccgagctgctggtgggccatcagccattcgtgggccatggtgccgaggggcttgaggtcgagcttgcgtgccaggtggacgttgctggtgccgacgaagcagcccggaaagtcctccttcagaccgctcaccaccgcctcgtggacccgataggagaagcggcggcgggtaccgaagtcggccatcttgaagccggccagttcctcggcgctggcctcccggcgcagccaatcgaacttttcctgcaggcgttcgcgcgcctgctcgacggtggcggccgggtagcgggcgcggttgcgcacctcgctgatcatcgccagcagcggcacttcgaagaggatcacgtgcagccagggacctttcaggcgcaggaagaattcgtcgttctcgatgccggtctgcacgtagcgcgggttgaagcggaacaacccgaggaagcggatgaagtccggcgccaggaagggaatccgttcgaggaaggccagttgctcgtcgctgatcgccaggcccgccaggtattccagctgttcgcggatggccggcaggtacaggcgccaggtcttcctggttgcggcagcggaactcccactccacctcggcgttgggatagttgtgcagcaccgcctgcatcatggtcagcttgtagaagtcggtatccagcaggttctgcacgatacgttcggaaaaagcgctctcggccatgctcgtctcaccactgcgtttcagcgggcaatctactggaggcggctgccggcggacataggatcgcgcccggagggctgtgggatggggcgacagcgccggcggacagcgctgttgtcgctgtccgccgtttccgatcagtgtgcgtttgccgcttgcgtcacgcctggcggggcatccggcctggccaccagggtgtagatgcacggcaggacgaacagggtgaagagggtgcccaccgacatgccggtcgcgatcacgatgccgatgtcgaagcgactgaccgccccggcgccggtggcgaggatcagcgggatcaccccgagcaccatcgccgcggtggtcatcagtactggccgcaggcggatcgcggcggcctgctcgatggcctcgcgacgccccagcccctgttcgtggcgcaactggttggcgaactcgacgatcaggatgccgtgtttgctgatcaggccgatcagtgtcaccaggccgacctgggtatagatgttcaggctcgacacgccgaggaacagcggtatcagcgcaccgcagatcgacagcggcacggtgaccatgatcaccagcggatcgcggaagctttcgaactgtgcggcgaggaccaggaagatgatcgccagggccagtccgaaggtgaccagcaatgcgctgccttcctgcacgtattgccgggaagcgccggcgtagtcgacggcgaagccacgcggggcttcctcgcgggcgatctgctgaaccgtctcgatggcctcgcccatgctgacgatggggaagccggagatgatcgccgagttgagctgctggaactggttcagttgccgtggccgtgcccgttcgtgggtctcgatcagggtcgagagggcgaccagttggccgttgcggctcttcacgtagtagctgccgagccagccgggattgtcgcgataggggcgttcgacctgggcgatgaccttgtagctgcgcccgtcgatggtgaagcggttgatctcgccctcgccgagcaggctggccagcgccacccccaggtcctgcatggagacgcccatctgcgcggccttctcgcggtcgatgtcgaccaccagctcgggtttgtcgaacgccaggtcgagatcgaggaaggcgaacttgccggactcgctggcgcgctgcttcacccgttgcgccacttgcagcagcgactcgtagtcgttggcggtgttgagcacgaactggaatggcagaccctcgccggtgcccggtag

SEQ ID NO: 7718 - DNA, 2229 bp, Pseudomonas aeruginosa
cgacggcaggttgaaggcgaagatttgcacgccgggaatctcgttgagcttcgcctgcaccgcatggagcaattccatctggctcttttcgcgttcgtcccagggcttgagcagcatgccgccgatgccggcctggacgccgttgtagccgttgatctggaacgccgagtaatactccgggaagctgcggaagataccttcgaactcggcggtgtagcgattcaggtagtcgaggttggcggtctgcggcgagttggtcatgaggaacacgatgccctggtcctcttccggcgccagctccttcttggtgaacatcagcagtaccgggatcagcgccagtaccagcacggcgaacaccaggaccaccggacgggtgtccagggtgccgtggagggcgcgctggtagcgttgcttcaggccctcgaagatcaggtcgaggcgatgcgccaggcccgagggattctcctcgtggcgcaacaggcgcgagcacatcatcggcgacagggtcagggcgacgatcccggaaatgatcaccgcgccggccagggtgaaggcgaactccttgaacagggcgccagtgaggccggtgaggaagccgatcggcgcgtagaccgcggcgagggtgatggtcatgctgaccaccggtacggcgatctcccgcgcgccctccagggcagcctcgaagggcggcttgccctcctcgatgtggcggtggatgttttccaccaccacgatcgcgtcgtccaccaccaggccgatggccaggaccatcgccagcagggtcagcaggttgatcgagtagcccatggcctgcatgaagaacaatacgccgatcatcgacagcggaatggtcaccaccgggatcagtaccgaacggaacgcgccgaggaacaggaacaccaccacgatgacgatcagcaccgcctcgccgagggtcttcaccacttcatcgatggaggcctgaatgaagcgcgtggcgtcgtaggcgatggacaccttgaggttgggcggcaattgctcttccagttcgggcatcttcgcccgcacttccttgatcacgtccagcgggttggcgctgggcgtgcccttgatgccgatgtagaccgagggaatcccattgaacgaactgatcgcgtcgtagctggcggcgcccagttcgacccgtgcgacatcacccatcagcacccggcggtcgccgtcggtcttcaccgggatggcggcgaaggcctggggcgacttgaggtcggtggaagcattgacgctggtgaccaccaactggcccttcacctcgccggcggcggcgaggaagttgtactgctgcaccgcctggttgatctcgccggcggtgacgccgaacgcggccatcttcaccgggtccagccacaggcgcatggcgaacacctggttgccgaggatctccgcctcggcgataccgggcagggtcgccagcttgggctggatcacccgcgacaggtagtcggtgatctgcgggttgttcatctgctcgctgtagaagctgatgtacatcagcgccgaggcgtccgcggcctccttctgcagcaccgggtcctcggcgtccggcggcagctggctcttcacttcgttggacttggccagcagctcggtgaccaggcgatcggtattggcgccgatccgcgcgtagatggagatggtcgaatagttctgccggctcaccgaggtcatgtagtcgatgccttcggcgctggccaggctctgctgcagcggctgggtgatgtagccctggatggtttccgcgttggctccggcgtagagcgtggtcaccgtgatcagcgcgttctccatttgcggatactcgcggatcaccagcttgctgaaggcctgcatgccgagcaggacgatcagcaggctgaccacgctcgccaggaccggacgacggatgaacggatcggtaaaagccatgtttcagtcccttggcaagccttccgccacggagtaggaaggcgcgcgactcagtgctcttgctggaggtcccgctcggcgacgatggccaccgcggcgccgttgtcgagcttcagttgcccggaagtcactacctgctcgccgccctccaggccttcgagcaccaccgccaggccttcgcggcgttcgccgatcctgacgaagcggcgctcgacgacctgttgcggctggcccttgtcatccttcgacacctggccctgctcgtccttcttctgcccgacgacgtag

SEQ ID NO: 7719 - DNA, 1362 bp, Pseudomonas aeruginosa
ccggcgagaatcgccaccacggcgatcaccgcggcgagcatgatcaacatgcggcggagcaacataatcctggtccctggtatgccgagagcgccccgtttcggggcgaatccgacacattacgtgcagctttcagggcttgtcaaagcacaggattggcgaaagatttcaagcgtgttgcaggtcgcttccgactttcgcggaccggtatggcgagaggttgatgccgcgctctcaggccaggtgcaggtggttgtcccagaggccggaaggcagctccagcggttgcgcggcgatgcgctcgccctggcagtcgtagaagcggcaacggccctgtccggacgtgacgacgaagccgttcttcaccgcgcccacgccggcgcagtccggcaacggcgcgtcgaggcgtacggcaccgctgtccaggtcccagatgaagaaacggttgccgcgcggggcggtcagggccaccaggcgcaggtcgtcgtggatcgccacgctggcggtgtactgggccatcgccaggcgctgctcctcggccaccgggaaggcttcgaagggacggccggggcgcttgatcgccagcaggtcggcatgttcgtgggcatcgcccatgaactgctggccggcgacgatggtgccgtcgcgaccgatcgccaggtggcggacgctgttcatctgctgcgccagggtttccttggacagcaggttgccgtcgcggcgcatcagcaccaggctgggctccatggcgtcgaggttcatctcgacccggctttccgcctcggtacgaatgccgccgttggccactaccagggtctcgccgtcgggcatccaggaaacctggtgcggcccgaggccgtgggtggagatctcgccgctgtgctgcagtcgctcgccgtcgaaacggtagacgccgagcacgccgcgaccgggatcggtagtgtcgttctcggtggcgtagagccactcgccgctctggtggaacacgccgtggccgtagaagtggcggtctttctgcgagaccagggtctgcagcaggcaaccgtcgttcaggtcgatcaggtagctttcggtgcctggccggcgggcgacgaacagcgccagcggcaggctcgggtgctggacgatgtcgtggcagcgctgggccacgcgggtggcgaactggcacttgccgtccaggcggtagcccaccgcgtaatgctggccatcggcgtcgtcgcgcgccgacagcaccagcggttggctacccaggcggctgaagctccagccgccgaaggacaaggcgccgagcagcaggctgcccaggccgatcacatgacgtcgcagcatggtgccgacctcagtcgccatcgttggcgttga

SEQ ID NO: 7720 - DNA, 489 bp, Pseudomonas aeruginosa
gcatgccgccgtcgttcttccagcgcgccaggatgtcctgggccagttgctgctggtgggtgccgatggcttccagcaacgggcaatagcgggccttggtggcggcgtcggcgaggtcgatcttgctgtcgaagaggatgtattcgtaggcggagagcccctgcaccaccacgctggccttggccagggccgcggcgtcgacctgcgggttgttcttcagcaactgttcgacctggcgcccgaccaggtccttcttgtccggccagaactgcacctgccaggcgcggttgccctcggccagcgggccgatcagcagcggttgcagctcggcccaggccttctgcgcggcgtggaacgcgtcgcgggccttggccaggtcttccttgccctggcagtaggccagggcgctgctggccagggcctggtcggcctccacccagcggctgtaggtcggcaggatcacctgttgcgccagggcggcactggtga

SEQ ID NO: 7721 - DNA, 639 bp, Pseudomonas aeruginosa
tcgccgtcgtgcctggacatgtcgggcgcagctagaatgccagcatcttcttccggagctccgtccatgagtctgaccgctatcgctttctgggttgtcctgctgctgctcgccggctacgcggtggtgctctacaacggcctggtacggctgaagcacgccgtgggcaaggcctgggccaacatcgacgtgctcctcaagcagcgccatgacgagctgccgaagctggtcgaggcctgcaagcaatacatgcagcacgagcgcgccaccctggagcgggtcatcgccgcccgcaacgccgtcgccagcgcccgcgagcgcgccgacgtgaatgccctgggcaaggccgagggcggcctgcgcgccggcctggggcagctcttcgcgctggccgagaactacccgcagctcaaggccaacgaaagtttccagttcctttcccagcgcatcagcggcctggagaacgggatcgccgatcgccgcgagctgtataacgaggcggtgaacctgaacaacgtgcgcatcgagcaatttcccgacctgctgatcgctcgtgtcgctggcttcaaggccgccgagctgttgcagttcagcgaggcggagaaggccgacgtcgatctcaaggccctgttcggctga

SEQ ID NO: 7722 - DNA, 285 bp, Pseudomonas aeruginosa
aggtgcgttcctggccgaggatcgggtcggtcagccagcgcgtcggcaggtccagcagcggcctggatttctccgccagcatcggctcgccgggatggccgatgctcgcctggcgcaccgcctcgtgctggaacaggccttcgaggacctgcatcgccatttcccggtcgaggctgtagaccgcctgggtggaagggtcgcggaccatcgcgaggatgcgttgggcgtcgctgctcaccgcctgcttggccttgtaggcgtcgaagacgatctgcgcgcaactga

SEQ ID NO: 7723 - DNA, 720 bp, Pseudomonas aeruginosa
aggcggtgccccggagcgcctgcgcatcgctgctcaacgccgatagcctggcgacctggtgggccgccgcggtgggcgatttctgcgccgagcggcgggtgctgctggaccttgtggtggaggaccaggaggtcgggctcaagcgcatgcgcgcgggcgaagtggccggctgcgtctgcggtagcgcgcggccggtggccggcgcgcgttcgctgctgctcggagccatgcgttatcgcggcctggccagcccggatttcattgcccggcactttccccgcggggtcgaggcggccgccctggccggcgtgccggcgatcgtgttcggcccggacgacctgctgcaacaccgctttctcaaggacctcggcgtcgagggcggtttcatccaccacctctgcccgtcctcggaaggtttcgtccgcctcaccgccggcggtctcggctggggcctggtgccggagcgccaggtgcaaggcgagctggcgcgcggtgaactggtcgagctgctgcccggccaggtcatcgacgtaccgttgtactggcactactggcgcaacggcggcgaactgctcgcgtcgctcaccgagcacctgctcgcccgcgccggcgacggcttggtgcgggtgtcaggctgatcagccgatgacggtgattcgtccggagccgggcaacgattcgacgcagcgcgcgccgagcaaccgcgatggcgtgaaatag

SEQ ID NO: 7724 - DNA, 792 bp, Pseudomonas aeruginosa
ccaccgatgctgccgaccgtgatgaattcggccaccacccgcggcacgtttacgaaccggagcagcgccgggtcgtcgacaccaaggagcgccgtccggcctctaccggccccgttctgggccctgctcggggcgatgctgatcgccctcgccggggtgggttggtggagccaccagcaaatcagcctgatggaacagcagttggtggcgacccaggaaagcttcgtaaggatcagcgaggaagccgccgggcgcctcgacgacattcgcggcaaggtggtcgccagcgagtccagcgtcaccagcgaacgcgaggcgctgcgcctgcaggtcaagcaactgcaggagaaactcggcagccaggaacgccagcaggccgatgtgagcaaccagttcggcggccagggcaaacgcctcgaccaactggccagcgatctcaaggcccagcaggaaagcgcggcgcaactggtcgcgcaactggacggcaagctgcagacactggccgccgaacaggagaagctgaaagccctgcaggtcgaactgggaaagaccaacgagcaactcaaggccctcggcggcgatgtcgcggcgctgaagaagcagggcaacccgagccagacgatcaagggtatccaggatgacctgctggtattgcgcagccagctcgacaaccgcccggcccagggcggcaataccgccgagttcgacgccttccgcacccaggtgatgcgcaacatcaacaccctccaggcccaggtgcagaacctgcagcagcagctcaatacccgctga

SEQ ID NO: 7725 - DNA, 1104 bp, Pseudomonas aeruginosa
ccagcgcatccgcatcgatatcgacggtctggcgcggcgtctcggctgcccggtggtgccgctggtatccacccgcgccgatggcatcgacgaactgaaggcggccatcgactccctacagctcccgcaggcggcgctggcggtggattacccaccggccatccaggcgcaggtcggctacctcctggaaacgcgcgctccggcggcctcggccatcgagccgcgctggctggcgttgcaggcgctggaaggcgacatcttcaacggcccggcgctgggcttgccgcccgccaccctggaacaggcgcgccggggctgcggcgaggagcccgagctggcgatcgtcgatgcgcgctaccagcttatcggcgagatctgcgcggcggtctgcgaccaccagcaggctcagccgcaccggctgacccaatggctcgaccgggtcgtcctgaatcgctggctgggtctgccgatcttcctgctggtgatgtacctgatgttcttcttcgccatcaacatcggcggggcgctacagccgatcttcgacaagggctcgtcggcgatcttcatcgacggcatccagtggctgggtatccgcttcggcctgcccgattggctcacggtgttcctcgcccagggcatcggtggcggggtcaacacggtgttgccgctggtgccgcagatcggcttgatgtacctgttcctctcgctgctcgaggattccggctacatggcacgcgcggccttcgtcatggaccgcctgatgcaggcgctgggcctgccgggcaagtcgttcgtgccgctgatcgtcggtttcggctgcaacgtaccgtcgatcatgggcgcgcggaccctggacgcgcagcgcgagcggctgattaccatcatgatggcgccgttcatgtcctgcggcgcgcgcctggcgattttcgccgtattcgccggggccttcttcggccagggcggcgcgctggtgatcttctccctgtacctgctcggcatcgtcgtggcgatcctcaccgggctgttgctcaagcacactttgatgcgcggcgaggcctcgccgttcgtcatggaactgccgctgtaccatgtgccacaccttaa

SEQ ID NO: 7726 - DNA, 681 bp, Pseudomonas aeruginosa
gagcctgctgctgcagacctggtcgcgcctgcgcggcttcgtggtgcgggccggcaaggtgatcatcctggtcagcctggtgatcggcggcctgaacagcatcaccctcgacggcaagccggtgcagggcgacatcggccattccgcgctggccagcgtcagccagcgtctcactccgctgctggcgccgctcggggtgcagccggacaactggcaggccaccgtcggcctggtcaccggggcgatggccaaggaagtggtggtcggcaccctgaacaccctctacaccgccgagcagatccagggcgaggccttcgactacgaaggctacgacctgcccgggcaactgcgcgacgccctggtcgaaacctgggacggcctggtcgataccttcagcctcagcgtgctggccaacccggtggaggcgagcatggccgacggcgacatggagaccggctcgatgggcaccatggcgagcaagttcggcagccccatcgcggcctacagctatctggtcttcgtcctgctctacgtgccctgcgtgaccgccatgggcgcgatcgctcgggaaagcagcaagggctggatggctttctcggtgctctgggggctgaacgtcgcctactcgctggcgaccctctgctaccaggtcgccaccttcgccgcgcaccccgagcgtag

SEQ ID NO: 7727 - DNA, 306 bp, Pseudomonas aeruginosa
gcaggtactgcaactgccaggccgaatggccgatgccccgagcgggcagggaggatgtcactgatggcgacactcatgcagatccgcgccgccctggaagacggccaggcgcgtgggctgaaacagctcagccgccaggtggacgcgccgccggcgctggtggaggcgatcctggagcggctgatcgcgctcggcaaggtcgagcgggtggctgcgcaaagctcgggcggttgcggcggcggttgcaagggctgcgcccagcgcgatccgtgcgcggagccggagccgtatttccgcctgcgctag

SEQ ID NO: 7728 - DNA, 1137 bp, Pseudomonas aeruginosa
acgggcaaagcacagagcccgccacggcaagcgtggcgggctctgtcctggctggcgcgatcaggccagggtcggatagtccaggtagccttcggtaccgccggtatagaaggtttccgggcgcggcgggttcagttcggcgccctggcgcaggcgttcgaccaggtccgggttggcgatgaaggggacgccgaaggccaccgcatcggcgtcgcccttggccaggatggcgttggcgctgtcgagggtgaacttttcgttggcgatgtagggtccgccgaaggctttcttcagggctacgccgatgctgtcgtcggcctgcgcttcgcgggcgcagatgaaggcgatgccgcgcttgcccagctcacgggcgacatggctgaaggtttccaggcggttggaatcgcccatgtcgtgggagtcggcacgcggcgccaggtgtacgccgacgcgctgggcgccccatacggagatcgccgcgtcggtgacttccagcagcaggcgcgcgcggttctcgatggagccgccgtagcggtcggtgcgcttgttggtgctgtcctggaggaactggtcgagcaggtagccgttggcgccgtggatctccacgccgtcgaagccggcggccttggcccgctcggcgccctggcggtaggcctcgacgatgtcggcgatctcctcggtgtccagcgcgcgcggggtgacgtagggacgcttcgggcgcaccaggctgacgtgcccctcggcggcgatggcgctcggcgccaccggcagctcgccattcaggtagagcggatcggaaatccgcccgacgtgccagagttgcaggaagatgcgcccgccggcggcgtgcaccgccttggtcacgttgctccagccacggacctggtcatcggaccagatgccgggggtgtcggggtagcccacgcccatcggcgtgaccgcggtggcctcgctgaggatcaggccggcaccggcgcgctgggcgtagtactcggccatcagggcgttgggcacgcggccttcatcggcgcggcagcgagtcagcggcgccatgacgatgcggttgggcagctcgaggtcgccgagcacgatgggatcgaacagagtagccatggaacatcctccactagggaatag

SEQ ID NO: 7729 - DNA, 1152 bp, Pseudomonas aeruginosa
acggacaggggatcaatcgaggaccggctgcgcctgggcgcggccgtttccggaaaaggcgatcagggtggccagcagcgccagcgcggccagcgcggcggcggccagcggcacgcgggtcaggcccaggccgtggtcgatgacgctgccgccgacccaggcgccgagcgcgttgccgacgttgaaggcgccgatgttcagggtcgccaccaggttcggcgcggcatgcccgacgcggaccacgttgacctgcagcgcgggcaccgcggcgaaggcggcggcggcccagaagaacagggtgatttccgccggcagcagggcctggctggtccagctgaacagcgccgagaccagcgccatggcggcgaacaccgcggccatggtggtgcccaggcgccagtcggcgaggcggccgccgatcacgttgccgacggtcaggccgacgccgatcagcagcagggtccaggtcacgccgcgcgggctgaccccggtgacttcgccgagcagcggcgcgacgtaggtgaacagggcgaacatcgaggcggcgaacagcacggtggtgcccagggccagccacagcgacgggttcttcagcgcggacatttcctggcgcaggtcgaccttctcttcctcgcggtcgtttggcagcaccctggccaggccgacgaaggcgaccacgccgatcagggtcaccacccagaaggtcgcgcgccagccggcttcctggccgagcgcggtacccagcggcacgccgagcacgttggccagggtcaggccggtgaacatcagggccacggcggaagcgctgcggttcggcgccaccaggctggcggcgaccaccgagccgatgccgaagaaggcgccatggcagagcgcggtgacgatccgcgccagcatcagcaggccgtagttggcggccaccgcgcagagcaggttgccgacgatgaagatgcccatcagcgcgagcagggctttcttgcgctccaggcgggcggtggccatggccatcagcggggcgccgaaggccacggcgaaggcgtagccgctgatcagccagccggcgctgggaatggatacccgcaggtcgccggcgacctgcggcagcaggcccatgatgacgaattcggtggtaccgatggcaaaggcggataa

SEQ ID NO: 7730 - DNA, 510 bp, Pseudomonas aeruginosa
actacctcgcgcatctccacctcggcggcccgcaaccggcccaactgctcggcagcctgtacggcgacttcgtcaagggccgcctgcagggacaatggccggacgagatcgagcgggccatccagttgcaccggcgcatcgacgccttcaccgacagccacccactggtgcatgcggccaagcggcgcttcccgctggagcgccggcgtttcgccggcgtcctgctggacgtgttcttcgaccactgcctggcgcgcgactggaacgactacgccgacgaaccgctgccgcagttcgtcgagcgggtctacggcaccctgcgcaccgcctcgccgctgccggagcgcctggcgcgcatcgcgccgcggatggcggcccaggactggttgggcagctaccgcgagttcgcggtcttgcgcgaagtgctgggcggtatgtcgcggaggctgtcgcgaccgcacctgctggacggctcctgggaagaactggcccagcgctacgatgacctga

SEQ ID NO: 7731 - DNA, 1740 bp, Pseudomonas aeruginosa
tgcacatcaaccggcagcggtcgcgtcgatcgttcaatggggccgacgttcaacgctctgccaatggaggtggaagatgaaacgaatcctggtggcgaccgacctgtcctcgcgttccgagctggcggtcatgcgcgccgcggcgctggccaaggcgaggaatgccgaactgaccgtgctgaacgtgctcgacgacgaccagccgccggtgctgatcgcgccgcaacggctggccatcgccaacctgctggaagtgaacggacaggccctgaaggagcgcctcggcgtcgagtccaaggcgatcgtgcgggtcggcgatccggtggtggtgatcaacgcggtggccgaggagatcggcgccgacctgctggtgatgggcgcgcaccggcacacgccgctgcgcgacctgttcatcggcaccaccctggagcgggtggtacgcaatgcgaagatcccggtgctgcgcgcggccggtgcgccggaagaggagtaccgccgggtgctgctggcgctggacttctcgccgacctcgacgcgcgcggtgcagatggccggccagctcggcttcctcgacgccgccagcctcaccgcgctgcatgccttcgagccgttcgccaaaggcatgatgcgttattcggggatcaaggaagaccgcgtcgagcattacgtcgaccaggaggaactcaaggccaacgtcgagctgcgcgactacgtcgccggcctggggctgggccgcgaggacatccagttgcgcgtcggcgaaggcttgccgatcaacgtgatcatgaccgaggtacgccgccaggcgccgcagttgacggtgctcggcacccagggcctgaccggcttccgccgcgcgctgatcggcagcgtggccgaggcggccctcggcgacctgccgtgcgacgtgctggcggtgccgcccaagcgcgactaggcggcgcgccgggtttgcgtaggggcggcagtgccgaacagcgccaggcgcaccgcctgctgggcctggcgggccagttcggcgcggtccaggccctggctggggatcggttccagcagctggatatgcacgctgccgcgctcgccgcgcagcaggcggccgaggtggctgagcaagtcgtcgtcgccgatgaacggcgcctgcgtatcgggcacgccgtcgcggcggtagctgatcgccaccggctgcaccgccacgccggcttccagggcgctggccatcaggcgaccgtggaaggtgcgcaggctttcgccgttggtggtggtgccttccgggaagatcagcaggttgcgcccacggtgcagttgttcggccaagcgctggttgatcagccggctgtcgcccgagccgcgacggatgtacagggtgccggccttttccgccagccagccggccagcggccaggcacgcacctcggccttggacaggaaggtcagcggtgccagggcgccgagcagcgggatatcggtccaggacacatggttggctacccacagcatgggttgccggggcgcttcgccgctgaccctgacctcgaagggcagggccgcgcagaggcgcgccagccaccagcgggtcaggcgctggcgcagcggcgtgacgtcggcgccgggcagccgctcgcgcaggctgacccaagcggccaggcccagtccgagcgcgaccagcccgagcaggcgtgcgctgcgcagcagcaggcgcagccgcgccatcagaccgctgccttgaagtggcgggcgtag

SEQ ID NO: 7732 - DNA, 996 bp, Pseudomonas aeruginosa
tgcttgtatgacattgtcgccggatgtaacgcgccgttgttcaacgctggcaccctcggcaggatgccggttccgacacattccacactggagtccgccatgtcctggcaacgcttgctcggcccgctcgaccgcctgcccaccgaaggctccctggaagactggcacgccgccgccctggcgcgcgccgacggtcttggcaccctggagcgggcggtgctcggcggacgattggccgcgagtccgggcctggccttcctcgccggctaccaggcggccctgcgcgcgctctggccggcggcgccggaaggtctcggcgcgctgtgcgtgaccgagaagcgcagcgtgcgcccggcggacctgcagacccgcctggaggggctggtcctgcatggacaaaaggatttcgtcaccgctggcgacagcgcctcctggtggctggtggccgcccgcgacgaggcaccggggcagccgccgcgactgtcgatgacggtggtcctggccggcgccccgggggcgcgcctggaggcgttgccggcgctgccgctgatgccggatgtgccgcattcccgcctgttgctcgacggtgcccattgcgagcgcctgcccggcgatggttgggacgactacgtcaggccgttccgcctgctggaggatgtccatgtgctggcggcgctggtcggctggctctatggggtcggccatgaatgcggctggccctcgccgctgctgctgcgcctggccggcatcctcggcggctgcgccgaggtcgcgcggcatccggtcgcctgcgtcggcacccaggcggtactggctgggctgttcgaacagttctcggcgctggaggggcaactggatgccgccttcgccgccaacgcctcgacctgggaggcattgtggcaacgcgatcgcggcttgctggcgattgccaacggggcccgcaaagttcgcctggagaaggccttgacccgcctcgggcttgacccaggtcagtga

SEQ ID NO: 7733 - DNA, 798 bp, Pseudomonas aeruginosa
atttcaccgaccatgcgacgcgaaccgatcgtgctgttcgacaacggcagccaccagtgcctgtgtttcgatgacctcgtcagcggcgaaggggtccagtccaaccagttcctgatcgtcgacaacggccagtacctgctgctcgatcccggcggcgacctgacctacacgccgctctcgctggaattgtcgaaacgctttccgctgcaggagctggactacatcttcgcttcgcaccaggacccggacatcatcgccgccctcgacaagtggctgctgcacacccgcgcccgggtgatctgctccaagctgtgggcgcgcttcctgccgcacctgacggccaactacctggcggtcagccatggcatcaacacctacgaccgggtcatgccgttgcccgaccgcggccaggcgatcgctctcggcgactgctcgttgaaggcgatccccgcgcatttcctgcattcggtgggcaacttccagctctacgacccggtgagcaagatccttttctcgggcgatatgggcgcctcgctggtggacgacgcggcgccggtcagcgatttcgccgcgcatatccagtacatggacggattccatcgccgctacatggcggcgaacaagatctgccgcctgtgggcgcggatggtccgggacatggatgtggagatgatcgtgccgcaacacgggcggcccttcgtcggcaaggaaatgatcagcgccttcctctactggatcgagaacctcgagtgcggcatcgacctgctcggcccggacgactaccgcatgccaggctga

SEQ ID NO: 7734 - DNA, 942 bp, Pseudomonas aeruginosa
cgacatggccggcttcgtcgccgaaaccccgcaggcccggccgccgggccggcgtttccgctactccagcggcgacagcaacgtgctggcggcggccctccacggcatgctcggcgcggactatgccgagtacccctggcgcgcgctgttcgagccgctgggcatccgttcggcggtatgggagcgagacgccgccggcacgttcgtcggctcgtcgtacgtctacatgagcgcccgcgacctggcgcgcgtcggcctgctgatgcagcgccacgggcgctggcgcgagcggcaactgctgccgctggcatgggtcgagttcaacctgacgcccttcgcccgctaccggccgagcgcggaagaggagggcgaggcggtgccgggcggccagtggtggttgaaccgtgcggtgaaaggcgcgccggcgccctggccggacgtcgccgagaccgccttcgccgcgctcggccactggggccaggcgctctacgtgctgcccgaggagaagctggtgatcgtgcgctacgccgacgaccgcgacgggcgtttccgccacaacgaattcctgcgcctggcacaggcggcgttcgccggggaggcgcggccatgatccgtcgccatcccttgctcttcctgttcgtcctggggctgctcgccgccctcgcgtgggcctggcagaaccgcatccacctggcggcctttcccgccatcatcggcgcctatacggccaaggagtactgctcctgccgctacgtgatggggaactccgcggactattgccgggcctatacccaacagtacgtgccgatcagcggcttcttcgacgacgaagcccgccgccgggtgaccgcccgcggcctcggcagtacgcagacggccgcctggctgggcccgcgcgagggatgccggctcatgcccgaggcggacaggctgccggactga

SEQ ID NO: 7735 - DNA, 651 bp, Pseudomonas aeruginosa
ccggcggcgcatgtcggggcgcggggcgagggacggcgccggcccgaagccggaggtggaatgcctgttgtattgtgtgtcctgttgttgctcctcagccctctgctgtcggcggcggaatggcaactggagccggattactcgcggatcagcttcgtttccgtgaaacgcgcgaagatggccgaggtgcagcgcttcgatcgtctcagcggccagatcgacaagcagggcgtcgcgcgcatcgtggtgccgctgggcaccctggacagcggcctggccctgcgcgacgagcgaatgaaggacaacttcttcgaaacctcgcgcttccccgaggccaccgtggagagccgcctggacatggccggcttcgacgacctgcgggtcggccagtcgcgggtcgagaagctcgacttcaccctcgacctgcacggccagcagcgccgcctgaaggccgacgtgctggtcacccgccagggcgaagggctggtccaggtggcgaccctggagccggtgctgctgaagctgctcgacttcgacctggaagagaagctcaagcccttgaaggagatggccaatattccctcgatcactcccgaggtaccggtgttcgccgtgctgaacttccgcgaagtgccgccggaacagttctga

SEQ ID NO: 7736 - DNA, 564 bp, Pseudomonas aeruginosa
cgtaccggcggagggcggcgcgggccttgggttccacccagtggaaccgccttccgttgtccttcgccgcgtgccgcgcttagctgtgaccacgcccggccggccttgcgtccgggcctcccgccaacaagaccggagcgcaatccggccagaggagagacggcatggctcgacatcgacacatcgtggcctggctcgaggaggtcgccgacgacctgcgtagcctgcgccaggacatccacgcccatcccgaactgggcttcgaggagcgacgcaccgccgcgctggtcgccgaatgcctgcgcggctggggctacgaagtgcacgaagggatcggccgcaccggcgtggtcggcgtcctccgccagggcgacggcacgcggcggctcggcctgcgggcggacatggatgcgttgccgatcgtcgaggccacggggctcggctacagcagctgccacggcgggcgcatgcacgcctgcggccacgacggacacaccgcgatgctgctcggcgcggcacgctacctggcggcgacgcggcgtttcgacggcaccctggtactga

SEQ ID NO: 7737 - DNA, 1383 bp, Pseudomonas aeruginosa
ctgccgccaataacggcgcggcatgagccgcgccggcattcccccggttaccaggagattcccatgcacgcttgcccgagcggtacctcgcgtacccgccaggtggcggctgccgtgatcggcaacgccctggagtggtacgacttcatcgtctacggcttcctttccagcctgatcgccaggctgttcttcccttccggcgacgagtacacctcgctgttgatggccctggccaccttcggtgtcggtttcttcatgcgtccggtcggtggggtcctgctcggcctgtatgccgaccgcaggggacgcaaggcggcgatgcaactgatcatcctgctgatgacgctgtccatcgcgatgatcgccttcgccccgacctacgcggcgatcggcgtcggcgcaccgttgctgatcgtgatcgcgcgaatgctgcagggtttcgccaccggcggcgagtacgccagcgccacggctttcctggtggaaagcgcgccgccgcaccggcgcggtctctacggttcctggcaattgttcggccagtgcctggcggtgttcgccggtgcggggatgggcgcgctggtcacccattgcctggacgccgagtccctggagagctggggctggcgggtgccgttcctgttcggtctgctgatcggtccggtgggattgtggatccgccgctacatgggcgagaccgaggccttcctcgaagccatccgggagcccggcgagcgccaggggctgctctgcgtgctgcgcgaataccggcgcagcgtgctggtgagcatgggcctgacggtgatcggcacggtgtccttctacggggtgctggtgaatatgccgaccttcgcccacaatcggttgggcctgccgctggacgaggtgttcatggtgcaaatggctgcggtggcgctgatgaccctggtgatcccgttggctgggggactctccgaccgggtcgggcggcgcccggtgctgctggtcgcgaccctggccttcatgctcatggtctatccgctgttcgcctgggtcgccgcggcgccgagcctggggcgcctgctgctgatgcaactgttgctgtgcacggcgatcggcggcttcttcggcccggcgccgaccgcggtggccgagcagtttccggtgcgggtgcgttccaccggcctggcggtggcgtataacctggcggtgatgctgttcggcggtttcgctccgttcatcgtcacctggctcaccgaggtcggcggctcgccagtggcgccggcgttctacgtgctcggcgcggccttcctcgggctgctcgccaccctctatctgcgggagggcgcgacgcccgccccgcgcccccgtgaaccggccctgggcaagccggcaaggagtctgtga

SEQ ID NO: 7738 - DNA, 1485 bp, Pseudomonas aeruginosa
atgagcgccacccgccatcgaagcgacggccacgaggaaatcgtcgcgcttgacgcgctgccgctgtccgcggcgatccgccgacgcgaactgtcctgccgcgaggtcatgcaggcctacctggcgcagatcgaacggttcaacccgcgggtcaacgccatcgtctcgctgcaggcggaaagccgcctgctcgcccaggccgacgagcgcgaccggcaactggcgcgcggcgaatggctgggctggatgcacggcatgccgcaggcgatcaaggacctcgccgccacctccggcattcctaccaccctgggttcgccgctgttcgccgggcaggtgccggagcacgacgccatcgtcgtcgagcgggtgaagagcagcggtgcgatcgtcatcggcaagaccaacgtaccggagttcgggctcggctcgcagacctacaacccgctgttcggcaccacccgcaatgcctacgatccggcgcggatcgccggcggcagcagcggtggggcggcggtggcgctggcgctgcgcatgctgccggtggccgacggcagcgacatgatgggttcgctgcgcaaccccgccgcctacaacaacgtctacggcttccgcccgtcccagggacgggtgccgcacggcccgcaagcggaactgttcgtccagcaactggccaccgaaggcccgatggggcgcagcgtggccgacctggcccggctgctggccacccaggccggctacgatccgcgctgtccgctgtcgttgcgcgacgatccgcgcaggttcgccgacgacctcgggcgcgatttccgcagagcccggctcggctggctcggcgactacgccggctacctgccgatggaggagggcgtgctggagctttgcgaagccgcgctgggcgatttcgccgagctgggctgcgacgtcgaggcgtgcctgccggactatcccctggagcgcctgtggcgcacctggctggtccatcgccagtggctggtgcagggctcgcttggcgagctttacgccgatcccgcacggcgcgtccggctcaagccggaggcgcagtgggaagtggagtccgggctcggcctcggcgccaccgaggtctatcgcgcctcgctggatcgcagcgactggtatcgggcgctggcgcgtctgttcgaacgttacgatttcctcttgctgcccagcgcccaggtgtttcctttcgatgcagaaacggcgtggccgcggcaggtcgccgggcggccgatggacacctatcaccgctggatggaggtggtgatcggcccgaccctggccggtttgccggcgatcagcgtaccgatcggcttcggcgcggcgggcctgccgatgggattgcagataatcggcccggcgcaggccgacctggcggtgctgcaactggcccatgcccacgagggcctgacccgttgggtcagccgccgtccgccggcgatgctcgaggctccagggggcatcgactag

SEQ ID NO: 7739 - DNA, 798 bp, Pseudomonas aeruginosa
cggtctgtcgacggtggaggtgtcgtcatgccggaaagagaagaggcgggaaccgtgcgttcggtggagcgggcgctggcgatcctcgatctgctgggccagcaccaggcgctggggctcgaggaactgcattacctgaccgaactgcccaaggccacggtgtcgcggctgctgcataccctgctggagcagggctggctgtaccgcggcttgaccgaccggcgctaccggctgcgttccacccgcctctacggtgacgccgccgagcgcttccgctgccagatggtggagcgttccgcgccgctgctggtggagttgagcgagcgcaccgggctggtcgccgatttgtcgattctcgacggcgaccgcctgctggtggcggaaagctcggtgcccggcgtcctgcgcaagcgctacccggccaaccggctggtggtcggccagcacgccagcctgttccattcggccatgggcaaggcctgcctgggcgaactggcagacagcgaggtgcgccgcctggcgcgccagcaccaggtagacgaggacctctggttgcgcacccgcgagcaggcccacggccagggctacggcgagcgtaccgagggacactgggagtatccggtgcgcctgccgttcctgatccgcgcggtggccttgccggtacgcgcccagggtcgcctgctcggcagcgtggcgctgcactggccgcgcgaccaggattgcgtcgaacgggtgcgccgccggcacctgggaaccctggccgataccgtcagtcagttgcagcacgcgctcgactga

SEQ ID NO: 7740 - DNA, 1755 bp, Pseudomonas aeruginosa
ggtggcgccggacgcaaagggagcccgcatgcacaagttgatctgcctcggcctggccctcctggccttgccggtccaggccgcctggtacctggactacgagtcgtcgcgactcagtttcatctccaccaagaacgctaccctttcggaagtcggccgcttcctggtcatgcacggcaaggtcgacgacaaggggcaggcgcgcctgcgcgtcgagctggactcggtgagcaccgacatcccgctgcgcgacgaacgcatccgcgagcatctgttcgagaccaagcgcttcgccgaggcggagatcaccgcccagctcgacctggcgccgatcgtcgagctggccgacggcgtgcaactggaaatgcgccagccggtgaccgtcagcctgcacggcaagcgcaagagctacgccagcgacctgttggtgacccgcctggacgagcatcgcttccaggtggtgaccctgtcgccgctggtgctggacgccgccgacttcgacctcgcccccggcatcgagaccctgcgcaagctggccggcgccggcagcatcgggctctcggtgccggtcggcgccgtgctgatcttcacttcgcggtgagcggcccggtctttccctggcgcagcgacaaccgcttcgccctgctcaatgacggcgtgcggttcttcccgcgcatgctgctggccatcgaggcggcgcagcggagcatcgagctggagctgtacctggtggaagacgggcattgcgccgaactgtttctcgtcgccctgctggatgcccgccgccggggcgtcgccgtgcgctgcctgttcgacggcttcggctgcctcggcctgggcagcgcctggatccagcgcctgcgcgaggccggcggcgaactgcggctgtacaacccgctgcgctggaagctgactggcggcaatctctaccgcgaccatcgcaagctgctgctggtggacgggcgcctcggttatgtcggcggcgccgggatcaccgacgaattctgggaaccggtcagcgacgtcagcgcctggcgcgaggtgatggtcgagatggacggcccggtggtggcggactgggcggcgctgttcgagcggcaatggctggcctgtctcgaagagaaagcctggaagccccgcgagggcatgacccttacccgccttccgccgcagccgggggcggcccgtgggttgggccgggtggcctacgccgacgcccgccagcaccgcgacatcctgcaatcgctggtccgcgcgctgaacggctcgcgccgacggatctggctggcgacgccgtacttcctgccgacctggaaggttcgccgggccctgcgcaaggccgcccagcgcggcgtggaggtgcgcctgctgctggccgggcggctcaccgaccacgccccggtgcgctatgccgggcagcgctactacccgcgcctgctgcgcgccggcgtgcgcatccacgaataccagccgcgcttcctgcacctgaagatggtcatggtcgacgattgggtgagcgtcggctcctgcaacttcgatcattggaatctacgcttcaacctcgacgccaatctcgaggccctcgacccggacttcaccaatgaggcggcggcgagcctgctggcggacttcgccgacagccgcgaggtgaccctggcgatgtggcgcgcgcgtcccctgtggatgcgcctgcaccagcgcctgtggggttggctggaccgggtagtggtgaatttcctcgaccgccggcgctag

SEQ ID NO: 7741 - DNA, 1344 bp, Pseudomonas aeruginosa
aacttgccggggagcttgcgggtctaccccggaccgcccattacaatgacaaaggagagatgcgtggcaacgcccgactccaaggaacgtttcatcggactggaatggttgcgcttcctgctcggcctgtacgtggtggtgtaccacaccctgcatacctatccgaaagagcagaagtttcctggtctcgacgaactgaccagcctggggttcttcgccaccagtaccttcttcgtgctttccggcttcctcctggcccatgtttacgcacgcagcggccggttgcgcgaaagcgcccgcagcttctggaccaagcgactgtccaatctctatccgctgcacctgttctccctgctgctgtcgatcctggtgttgctggccctcagccacctgggaatcggtcccgagctggacaaggccaccccgcgcttcgtcatctacgacaccaacgaagtgctcggccgcacccacccggaactcttcctgcactggatgagcaacaccgaactgttcgtcaacagcatcctgcagatcctcctgctgcaggcctggaatccctattacctgaccttcaacgcgccgttgtggtcgctgtcgacgctgatgttcttctacctggcgtttcccttcgtcgccccgcggctgatgcgcagccggcacaagtggaaggtgctggcgctggtctggctggtctacctgatcccgccggcgctggtagtggccagcgagagctacgggatcccctggaccggcctgctgcaccgcaatccgttgctgcgcctgccggaattccttggcggcatcctggcctacgggttgttccgcggctaccgcgaccgtggcatggtgccgggacgcggcctgctggccgcgctggtggcgctggtggtggcggccttcctggtggccgactacctgttcacccagggcgccaaacattggtacttcctgctgcacaacggcctgctgctgccggcccagttgctgctggtgtgcctttgcgcgctgcccgccgacccgaagagcgctttcgtccgccactggtcgccgcgcctgggggccgcctcgctgtcgctgttcgccctgcatgtgccgatgttcaccctgttctcccgtagcgagcgccttatcgccgtgccggggcgttgtctcgacgactggcgcgcctgcaccgaggcggcggccgcgttgccatcgtcgctgctctactacccgctgttcctggtcctgctggtggcgttctgcgtgctgttccaggagcgcggcgtggtgccggtgcgcaagtggctggtgcgccggctgatgccggcgccggcgctggccaaggtgccgcgcccggcctga

SEQ ID NO: 7742 - DNA, 627 bp, Pseudomonas aeruginosa
gaagagggatggagcatgctgcgcagcctgtcgctggccctgtcgatcgtcgcgagcctggtcggctgcagcacgcccggcgcgttcttcggtgcggtggacggaccggccttcgtcgcccattcgagcgccgatgccagccacgccaccgtctacctctaccgtccgcggagccagtgggcggacgaggaactcgaggcgccggggatcttcctcaacaacgaactgatcggcagcctgccgagcaacggctacctggcgttcgagttcgagaccggcagctacaagctggaaatgcgccggccgctggcgggcagcttctggaccctgttcgccgacggtccgatggatttcacccgcatcgccagcttcatgctcgaggccagggccggctcggtctactacctgcgctacgacgaactcaacccgccaccgaagagcgagcacccggcgggtgagggcgatggcccgctgcaattggtggcggccgatctcggcgctgcggaaatcggcgctacccaccaggttcaggagcccatgcagttcgccgccagcggctaccggaaacgcgtgcagcgctcgttctgggaaggcgtcgggcgggccctggacaagatcggcatctga

SEQ ID NO: 7743 - DNA, 591 bp, Pseudomonas aeruginosa
cttcgacgccgcgcgcaagccgatcgccgcggtctgccatggcgcccagctgctggccgccgccggcgtcctgcaagggcgggcgtgcagcgcctatccggcctgcgccccggaggtgcggctggccggcggcgaatacgtcgaccttccgccggaccaggcccacgtcgacggtcacctggttaccgcgccggcctggccggcgcatccggcgtggctggcgcgcttcctcgaggcgctcggcacccgcatcagccactgagacacaggagacccccgcgcatgtgcgaactctatgtgaaagccgatccgatcctctatgaatcgcgctcgcgttccttgcgcatccgcggggtggtgaccaccctgcgcctggagaaccagttctgggacatcctccgggaaatcgccgaaggcgagggcctgagcaccaaccagttgatcaccaatctctacgaggaagtgatggactatcgcggcgaggtgctcaacttcgcctccttcctgcgtgtcagttgtacccgctacctggcgcagcggcgcgagaaagtcgccgagctgagcctggtcggccagcgcgcccaggcctga

SEQ ID NO: 7744 - DNA, 1392 bp, Pseudomonas aeruginosa
ggcgagggaagacgcgaccggggtgaaacgtttaggctggtcgcacttcctcccccgatccggcgtcgcctcgtgaaatactccctgcccaccacggccaccgcgccgttctgtccctcctcggtcagccacagcgtggcggtgccggccgacgcctcgccgctgcgcaagctggcgctgttcatcggccccggcctgctggtctcggtcggctacatggaccccggcaactgggccaccgccatcgaggcgggctcgcgcttcggctacgcgctgctgttcgtagtggtgctggcgagcttttccgggatgctcctgcaaagcctctgttcgcgcctgggcatcgccaccggccgcgacctcgcgcagctctcccgggagcgctaccgccctggcgtggcgcgtggccaatggctgctggcggaactgtcgatcgtcgctaccgaccttgccgaggtgctcggcgcggcgctggccttccacctgctgctgggcgtctcgattaccaccggggtggtcctcaccgccttcgataccctgatcgtgctggccctgcagggcgccaacttccgccgcctggaggccatagtgctggggctgatcgcgaccatcggcgcgtgtttcttcgtcgaactggtgctgatcggcccctactggccggatgtcgccgccggcttgcggccgtcctgggacaccctgagcagccaggagccgctgtacctggcgatcggcatcctcggcgcgacggtgatgccgcacaacctctacctgcattcgtccgtggtgcagacccgggtcagcggcgacgacgcggcgagcaaacgctcggcgatccgcttttcccggctcgacaccatcggctcgctgtccctggcgctgctggtcaatgcggcgatcctgatcctcgccgccgcggctttccacggtagcggccataccgaggtggtggagatccaggacgcctaccacctgctcgacccgttggtgggcggcgccctggccagcttcctgttcggcttcgccctgctggcggcggggcaaagctcgaccttcaccggcaccattgccgggcaggtggtgatggagggtttcctccgggcgaagattccctgctggcagcggcgcctgatcacccgcggcctggccctggtgccggccttgatcggcgtgctctggctgggcgaagccgcggtaggcaagctgctggtgctcagccaggtggtgctcagcctgcaattgccgttcgccctgtggccgctgattcgcttcagcagcgaccggggcctcatgggggagttcgtcaacccgcgctgggtcagcgcgctggcctggtcgttgttcggcctgatctcggcggcgaacctgaccttgctgtatttctggttcggctga

SEQ ID NO: 7745 - DNA, 1467 bp, Pseudomonas aeruginosa
gagatgaactgcagggcatcggcgacgctctggatcaggtcgtcttgcttgatcacggccatggagcacggtcctcttcaggcgggtaattcggatgcggggcagggtcacggagccggccgcagccgaggagcgcgccggtcaggcaccggcgcaaaaaaggcgcgacagtatagccgttccggcgagacgggcgcacgcgccgacgatcagaccttggtcggccagccggctggtcggccgataaatccgcggtccgctagctggcagttcgttcgactaggcaacccgcagggggcagggtacattgcggccaggtgccattacgggacggagcccatgcgcacagacaagcctcctctgaaacagcgtgcgctgcaaaagctcttgctccgccggttcggcatggccgcaggcacctacctgctcggcctggtcctgctctggctggcgctactcagcggcttctaccgcgcagcgccgaccaccgcggcggccagcaccaccctggtggtggcttgccaactggccttcctctggctgttcgccagcggtcgcaacctgcgttacgccgatcccagcctgaccgagccgcaggtgctggtggcgatcgcctggctgacctatttcctctaccacgtcgacagcctgcgcggcaccttcatggtgttctacgtgctggccctgctgttcggtgtgttccaactgccgccgcgggtcttcgcccgctgtgcggcgctggcgttcatcgctttttccggcatctacctggtagaggccttgcagcagcgtctcgagctaccgggccgggctgcattgcatgtgctcgtgatgttcatcgtaatggtctggctgagcctgttcgccagctacatacaggcgatgcggcaacgcatgcgccagcgccgctatgccttgcaggcgcaccaggacacgctgcgcggcatgatgcgccaactggaagacctggtggccaccgacgaactcaccggtctgttcaaccgccggcatttcatgcgcatggccagccgggcgctggaagacctgctgccgaaccggcagcacggcctggcgctgatcgacctcgatcacttcaagcggatcaacgaccgccacggccacgccgccggcgatcgggtcctgcagaccttcgccgcggtggcgcgttcctgtctgcgcgatggcgacgtcctggcccgttacggcggcgaggagttcgtcctgctgctgccccacgccgacgcggaacagctggaaagctgttgcgagcgcctgcgcctggcgttccaacaggcggaaccggtcggggtcacggtggataccctgagcctttcggtgggcatgaccctgctgtatgccgacgacgatctcgacgaggccttgcagcgggccgaccaggcgctctaccgtgccaagcgcggcggacgaaaccgctgcgacgccacctgggaggtcaccagtgcctga

SEQ ID NO: 7746 - DNA, 228 bp, Pseudomonas aeruginosa
gggccaactcgtggtcgaatactgcctcatccatggcgcccgtgcagtcgtgcgctgttgcgccaacaagaccgatgcccgcagccgctggctgcaaggtctgctgcaacggcgtcctgccaatgtcgtcgccgttgccctggccaacaagaatgcccggatcctttgggccttactcagccgggagacatgctaccggcccggttgagcgttcctgccacaccgtag

SEQ ID NO: 7747 - DNA, 618 bp, Pseudomonas aeruginosa
ccgagcatgcgcggcaggatcaggctcgagccgaactccggtgtcaggccgaggttgacgaacggcatcttcaatcgcgcgttgcgaccgacgaagaccaggtcgcaatgcagcagcagggtggtgccgatacccaccgccggtccgttcaccgcggcgatcaccggcttggggaattccagcagggcgctcatgaagcggccgaccgggctgtcgcgcagggatggcggttgctcgaggaagtcgaggatgtcgttgccgctggtgaagcaggcatcgccgccagtgatcagcactacccgcacagccgtatcggcctgcgcctccagcagcgcctcggccatccgactgtacatcgcgcgggtcagcgcgttcttcttgtcctggcggtccaggcgcagggtcagcagccccgcttcgcgttcgacccgaatcagctcgctcatcgtcactccagggatgcggcgcagggccgcggcaatggctgcaaggcaccgccaccgcgccgcgtcaggcgtggggcaggaacaggtccgccagggtctggctacgcggtacgccggccaggtagagatgccgggcgaagcgttcgacgctggcgggttggccgcagagtaa

SEQ ID NO: 7748 - DNA, 816 bp, Pseudomonas aeruginosa
tcaactggttggtgctcaggccctcgccttcggcgatttcccggaggatgtcccagaactggttctccaggcgcagggtggtcaccaccccgcggatgcgcaaggaacgcgagcgcgattcatagaggatcggatcggctttcacatagagttcgcacatgcgcgggggtctcctgtgtctcagtggctgatgcgggtgccgagcgcctcgaggaagcgcgccagccacgccggatgcgccggccaggccggcgcggtaaccaggtgaccgtcgacgtgggcctggtccggcggaaggtcgacgtattcgccgccggccagccgcacctccggggcgcaggccggataggcgctgcacgcccgcccttgcaggacgccggcggcggccagcagctgggcgccatggcagaccgcggcgatcggcttgcgcgcggcgtcgaagtcacgcaccagagccagcacctgctcgttcaggcgcaggtattcgggggcgcggccgccggggatcagcagggcatcgtaatcctcggcgcgggcctgggcaaagtcggcattgagggtgaagttgtggcccggcttctcgctgtaggtctggtcgccttcgaaatcgtggatggcggtgcgcacgctttgcccggcccgcttgtccggacacaccgcatgcacctggtggcccaccatctgcagggcctggaacgggaccatggtttcgtagtcttcggcatagtcgccgaccagcatcaggatcttcttcgcagccatcacgcgcactccttcgggcagggcccggtcataccggggatgcacctaaggtag

SEQ ID NO: 7749 - DNA, 744 bp, Pseudomonas aeruginosa
cggtatcggccagggttcccaggtgccggcggcgcacccgttcgacgcaatcctggtcgcgcggccagtgcagcgccacgctgccgagcaggcgaccctgggcgcgtaccggcaaggccaccgcgcggatcaggaacggcaggcgcaccggatactcccagtgtccctcggtacgctcgccgtagccctggccgtgggcctgctcgcgggtgcgcaaccagaggtcctcgtctacctggtgctggcgcgccaggcggcgcacctcgctgtctgccagttcgcccaggcaggccttgcccatggccgaatggaacaggctggcgtgctggccgaccaccagccggttggccgggtagcgcttgcgcaggacgccgggcaccgagctttccgccaccagcaggcggtcgccgtcgagaatcgacaaatcggcgaccagcccggtgcgctcgctcaactccaccagcagcggcgcggaacgctccaccatctggcagcggaagcgctcggcggcgtcaccgtagaggcgggtggaacgcagccggtagcgccggtcggtcaagccgcggtacagccagccctgctccagcagggtatgcagcagccgcgacaccgtggccttgggcagttcggtcaggtaatgcagttcctcgagccccagcgcctggtgctggcccagcagatcgaggatcgccagcgcccgctccaccgaacgcacggttcccgcctcttctctttccggcatga

SEQ ID NO: 7750 - DNA, 657 bp, Pseudomonas aeruginosa
gccggacgcgccgtgcgggatcggcgtaaagctcgccaagcgagccctgcaccagccactggcgatggaccagccaggtgcgccacaggcgctccaggggatagtccggcaggcacgcctcgacgtcgcagcccagctcggcgaaatcgcccagcgcggcttcgcaaagctccagcacgccctcctccatcggcaggtagccggcgtagtcgccgagccagccgagccgggctctgcggaaatcgcgcccgaggtcgtcggcgaacctgcgcggatcgtcgcgcaacgacagcggacagcgcggatcgtagccggcctgggtggccagcagccgggccaggtcggccacgctgcgccccatcgggccttcggtggccagttgctggacgaacagttccgcttgcgggccgtgcggcacccgtccctgggacgggcggaagccgtagacgttgttgtaggcggcggggttgcgcagcgaacccatcatgtcgctgccgtcggccaccggcagcatgcgcagcgccagcgccaccgccgccccaccgctgctgccgccggcgatccgcgccggatcgtaggcattgcgggtggtgccgaacagcgggttgtaggtctgcgagccgagcccgaactccggtacgttggtcttgccgatga

SEQ ID NO: 7751 - DNA, 501 bp, Pseudomonas aeruginosa
ctggcggcctgcaactcgatgatctggcgaacccgctgcagcacctgctcgcgcacctggccgtcgagcgcccgcaggctcaggcgcagcacggcgcgctggggtatgacgttggccgcctcgccggcctgcaatgcgccgaccgtgaccaccgcggccttctgcggatcgacgttgcgcgccaccacgctctgcagggccatcaccgcgctcgacgcggcgagcaacggatcgacgctcaggtgcggcatcgaaccgtgtccaccgacgccctccagggtgacgctcagcaggtcctgggaagccatcatcggtcccgcgcggaagcccaggtgcccggcctccagtcccggcatgttgtgcatgccgaacagcgcatcgcagggaaagcgctccagcagcccgtcggcgagcatcgcctcggcgccgccctggccttcctcggcgggctggaagatcagtaccagggtgccgtcgaaacgccgcgtcgccgccaggtag

SEQ ID NO: 7752 - DNA, 1251 bp, Pseudomonas aeruginosa
tggcgggaaaggccgccaggtggatgcggttctgccaggcccacgcgagggcggcgagcagccccaggacgaacaggaagagcaagggatggcgacggatcatggccgcgcctccccggcgaacgccgcctgtgccaggcgcaggaattcgttgtggcggaaacgcccgtcgcggtcgtcggcgtagcgcacgatcaccagcttctcctcgggcagcacgtagagcgcctggccccagtggccgagcgcggcgaaggcggtctcggcgacgtccggccagggcgccggcgcgcctttcaccgcacggttcaaccaccactggccgcccggcaccgcctcgccctcctcttccgcgctcggccggtagcgggcgaagggcgtcaggttgaactcgacccatgccagcggcagcagttgccgctcgcgccagcgcccgtggcgctgcatcagcaggccgacgcgcgccaggtcgcgggcgctcatgtagacgtacgacgagccgacgaacgtgccggcggcgtctcgctcccataccgccgaacggatgcccagcggctcgaacagcgcgcgccaggggtactcggcatagtccgcgccgagcatgccgtggagggccgccgccagcacgttgctgtcgccgctggagtagcggaaacgccggcccggcggccgggcctgcggggtttcggcgacgaagccggccatgtcgtcacgcccacgggtgtagagcatcgccaccacggaggatttcaatggcgcgaactcgtagtcctcctgccagtccagcccggaagaccagttcagcaggtggcgcaacgtcacctcgggatgacgggcgaacggcgggtagtagcgcgccaccgggtcgtcgagctggaagcgcccttcgccctcggcgacgccaagcagcgtggcgagcaggctcttgctcaccgaccaggtaaggtgcggggtctctgcacggctcgggccggcgtagcgctcatagaccagacgaccgtcgcggatcaccactaccgcgtcggtgcggatgcctttgcgacgaacatcgtcgcgacgaccgaaggcatagcgctcgaatgcctccagcgccggccccgcgggctgttgggcacggggccagtcggtgtcgggccagtcttcggccagggcagggagggcgaataccagggccagcgcggcgagggcgcggcgggacaacggcaaagcgggcatcggcgggccctctcgacggtcgaggggcaaccctag

SEQ ID NO: 7753 - DNA, 381 bp, Pseudomonas aeruginosa
acggcgcccgcgccctgcgcgaggcccaggccctgcgctaccgcgtattcagcgccgagttcgacgccaagctcgaaggcgccgaagacggcctcgaccgcgacgactacgaccgtcactgcgcgcacatcggcgtccgcgacctcgacagcggcgccctggtggccaccacccggctgctcgaccatcgcgccgccgaacgcctcgggcgcttctacagcgaagaggagttccacctctccggcctcgacgccctgcacggcccggtcctggagatcggccgcacctgcgtcgctcccgaataccgcaacggcgccaccatcgcggtactctggggcgaactcgccgaggtcctcaacgagggcggctaccgctacctga

SEQ ID NO: 7754 - DNA, 1917 bp, Pseudomonas aeruginosa
tgcagcggctgcgcgaacgctacctgtgcaccgactacctgcaggccgagccgaagaacccgctgccgacgctggacgtcccggaaaacctcaccgccgagctgccgccgctgctcaaggcctacatgcgcctgggcgccaagatctgcggcgagccttgctgggacccggatttccaggtcgccgacgtgttcatcctgctcaagcgcgacgaactctgcccgcgctacgcccgccacttcaaggcagcggtctgatggcgcggctgcgcctgctgctgcgcagcgcacgcctgctcgggctggtcgcgctcggactgggcctggccgcttgggtcagcctgcgcgagcggctgcccggcgccgacgtcacgccgctgcgccagcgcctgacccgctggtggctggcgcgcctctgcgcggccctgcccttcgaggtcagggtcagcggcgaagcgccccggcaacccatgctgtgggtagccaaccatgtgtcctggaccgatatcccgctgctcggcgccctggcaccgctgaccttcctgtccaaggccgaggtgcgtgcctggccgctggccggctggctggcggaaaaggccggcaccctgtacatccgtcgcggctcgggcgacagccggctgatcaaccagcgcttggccgaacaactgcaccgtgggcgcaacctgctgatcttcccggaaggcaccaccaccaacggcgaaagcctgcgcaccttccacggtcgcctgatggccagcgccctggaagccggcgtggcggtgcagccggtggcgatcagctaccgccgcgacggcgtgcccgatacgcaggcgccgttcatcggcgacgacgacttgctcagccacctcggccgcctgctgcgcggcgagcgcggcagcgtgcatatccagctgctggaaccgatccccagccagggcctggaccgcgccgaactggcccgccaggcccagcaggcggtgcgcctggcgctgttcggcactgccgcccctacgcaaacccggcgcgccgcctagtcgcgcttgggcggcaccgccagcacgtcgcacggcaggtcgccgagggccgcctcggccacgctgccgatcagcgcgcggcggaagccggtcaggccctgggtgccgagcaccgtcaactgcggcgcctggcggcgtacctcggtcatgatcacgttgatcggcaagccttcgccgacgcgcaactggatgtcctcgcggcccagccccaggccggcgacgtagtcgcgcagctcgacgttggccttgagttcctcctggtcgacgtaatgctcgacgcggtcttccttgatccccgaataacgcatcatgcctttggcgaacggctcgaaggcatgcagcgcggtgaggctggcggcgtcgaggaagccgagctggccggccatctgcaccgcgcgcgtcgaggtcggcgagaagtccagcgccagcagcacccggcggtactcctcttccggcgcaccggccgcgcgcagcaccgggatcttcgcattgcgtaccacccgctccagggtggtgccgatgaacaggtcgcgcagcggcgtgtgccggtgcgcgcccatcaccagcaggtcggcgccgatctcctcggccaccgcgttgatcaccaccaccggatcgccgacccgcacgatcgccttggactcgacgccgaggcgctccttcagggcctgtccgttcacttccagcaggttggcgatggccagccgttgcggcgcgatcagcaccggcggctggtcgtcgtcgagcacgttcagcacggtcagttcggcattcctcgccttggccagcgccgcggcgcgcatgaccgccagctcggaacgcgaggacaggtcggtcgccaccaggattcgtttcatcttccacctccattggcagagcgttga

SEQ ID NO: 7755 - DNA, 1581 bp, Pseudomonas aeruginosa
ttcgtcccaacccgatatggacggccaacggaccaccgccatgccactggacatcgacgaaatcatcaaggctctctcccacccggtgcgacgcgacatgctgcgctggctgaaggaaccggagaagtacttcgtcgagcaggaccacccgttcgagatcggcgtctgcgccggcaagttcgaccagcgtaccggtctctcccagtccaccgtatcggtacacctcgccaccctgcaacgcgccggtctggtgaccagccgccgggtcggccagtggaacttcttcaagcgcaacgaggagaccatccaggccttcctcgaccaactcggcgacgagctgtaagcagcactcgcttccaccccaccacctcgcagtccaggagctcgaccgatgccggcgtctcttctcgtcctcgctttatccgcctttgccatcggtaccaccgaattcgtcatcatgggcctgctgccgcaggtcgccggcgacctgcgggtatccattcccagcgccggctggctgatcagcggctacgccttcgccgtggccttcggcgccccgctgatggccatggccaccgcccgcctggagcgcaagaaagccctgctcgcgctgatgggcatcttcatcgtcggcaacctgctctgcgcggtggccgccaactacggcctgctgatgctggcgcggatcgtcaccgcgctctgccatggcgccttcttcggcatcggctcggtggtcgccgccagcctggtggcgccgaaccgcagcgcttccgccgtggccctgatgttcaccggcctgaccctggccaacgtgctcggcgtgccgctgggtaccgcgctcggccaggaagccggctggcgcgcgaccttctgggtggtgaccctgatcggcgtggtcgccttcgtcggcctggccagggtgctgccaaacgaccgcgaggaagagaaggtcgacctgcgccaggaaatgtccgcgctgaagaacccgtcgctgtggctggccctgggcaccaccgtgctgttcgccgcctcgatgttcgccctgttcacctacgtcgcgccgctgctcggcgaagtcaccggggtcagcccgcgcggcgtgacctggaccctgctgctgatcggcgtcggcctgaccgtcggcaacgtgatcggcggccgcctcgccgactggcgcctgggcaccaccatggccgcggtgttcgccgccatggcgctggtctcggcgctgttcagctggaccagccaggccctgctgccggcggaaatcaccctgttcttctgggccgccgccgccttcgccgcggtgcccgcgctgcaggtcaacgtggtccgcgtcgggcatgccgcgccgaacctggtggcgaccctgaacatcggcgccttcaacgtcggcaacgcgctcggcgcctgggtcggcggcagcgtcatcgaccacggcctgggcctgacccgcgtgccgctggccgccgccgcgctggccgcgctggcgctgctggccaccctgatcgccttttccggaaacggccgcgcccaggcgcagccggtcctcgattgatcccctgtccgtctattccctag

SEQ ID NO: 7756 - DNA, 522 bp, Pseudomonas aeruginosa
ccaggtccgtggctggagcaacgtgaccaaggcggtgcacgccgccggcgggcgcatcttcctgcaactctggcacgtcgggcggatttccgatccgctctacctgaatggcgagctgccggtggcgccgagcgccatcgccgccgaggggcacgtcagcctggtgcgcccgaagcgtccctacgtcaccccgcgcgcgctggacaccgaggagatcgccgacatcgtcgaggcctaccgccagggcgccgagcgggccaaggccgccggcttcgacggcgtggagatccacggcgccaacggctacctgctcgaccagttcctccaggacagcaccaacaagcgcaccgaccgctacggcggctccatcgagaaccgcgcgcgcctgctgctggaagtcaccgacgcggcgatctccgtatggggcgcccagcgcgtcggcgtacacctggcgccgcgtgccgactcccacgacatgggcgattccaaccgcctggaaaccttcagccatgtcgcccgtga

SEQ ID NO: 7757 - DNA, 543 bp, Pseudomonas aeruginosa
gctgggcaagcgcggcatcgccttcatctgcgcccgcgaagcgcaggccgacgacagcatcggcgtagccctgaagaaagccttcggcggaccctacatcgccaacgaaaagttcaccctcgacagcgccaacgccatcctggccaagggcgacgccgatgcggtggccttcggcgtccccttcatcgccaacccggacctggtcgaacgcctgcgccagggcgccgaactgaacccgccgcgcccggaaaccttctataccggcggtaccgaaggctacctggactatccgaccctggcctgatcgcgccagccaggacagagcccgccacgcttgccgtggcgggctctgtgctttgcccgtctagcgcaggcggaaatacggctccggctccgcgcacggatcgcgctgggcgcagcccttgcaaccgccgccgcaaccgcccgagctttgcgcagccacccgctcgaccttgccgagcgcgatcagccgctccaggatcgcctccaccagcgccggcggcgcgtccacctggcggctga

SEQ ID NO: 7758 - DNA, 1404 bp, Pseudomonas aeruginosa
gtgtcgccatcagtgacatcctccctgcccgctcggggcatcggccattcggcctggcagttgcagtacctgctcacggccgaacagacgcaggcaggtcatcaggatcaggttgaagagcagcaccacggcgatggtcaggacgctacgctcggggtgcgcggcgaaggtggcgacctggtagcagagggtcgccagcgagtaggcgacgttcagcccccagagcaccgagaaagccatccagcccttgctgctttcccgagcgatcgcgcccatggcggtcacgcagggcacgtagagcaggacgaagaccagatagctgtaggccgcgatggggctgccgaacttgctcgccatggtgcccatcgagccggtctccatgtcgccgtcggccatgctcgcctccaccgggttggccagcacgctgaggctgaaggtatcgaccaggccgtcccaggtttcgaccagggcgtcgcgcagttgcccgggcaggtcgtagccttcgtagtcgaaggcctcgccctggatctgctcggcggtgtagagggtgttcagggtgccgaccaccacttccttggccatcgccccggtgaccaggccgacggtggcctgccagttgtccggctgcaccccgagcggcgccagcagcggagtgagacgctggctgacgctggccagcgcggaatggccgatgtcgccctgcaccggcttgccgtcgagggtgatgctgttcaggccgccgatcaccaggctgaccaggatgatcaccttgccggcccgcaccacgaagccgcgcaggcgcgaccaggtctgcagcagcaggctcttaaggtgtggcacatggtacagcggcagttccatgacgaacggcgaggcctcgccgcgcatcaaagtgtgcttgagcaacagcccggtgaggatcgccacgacgatgccgagcaggtacagggagaagatcaccagcgcgccgccctggccgaagaaggccccggcgaatacggcgaaaatcgccaggcgcgcgccgcaggacatgaacggcgccatcatgatggtaatcagccgctcgcgctgcgcgtccagggtccgcgcgcccatgatcgacggtacgttgcagccgaaaccgacgatcagcggcacgaacgacttgcccggcaggcccagcgcctgcatcaggcggtccatgacgaaggccgcgcgtgccatgtagccggaatcctcgagcagcgagaggaacaggtacatcaagccgatctgcggcaccagcggcaacaccgtgttgaccccgccaccgatgccctgggcgaggaacaccgtgagccaatcgggcaggccgaagcggatacccagccactggatgccgtcgatgaagatcgccgacgagcccttgtcgaagatcggctgtag

SEQ ID NO: 7759 - DNA, 411 bp, Pseudomonas aeruginosa
cgccccgccgatgttgatggcgaagaagaacatcaggtacatcaccagcaggaagatcggcagacccagccagcgattcaggacgacccggtcgagccattgggtcagccggtgcggctgagcctgctggtggtcgcagaccgccgcgcagatctcgccgataagctggtagcgcgcatcgacgatcgccagctcgggctcctcgccgcagccccggcgcgcctgttccagggtggcgggcggcaagcccagcgccgggccgttgaagatgtcgccttccagcgcctgcaacgccagccagcgcggctcgatggccgaggccgccggagcgcgcgtttccaggaggtagccgacctgcgcctggatggccggtgggtaatccaccgccagcgccgcctgcgggagctgtag

SEQ ID NO: 7760 - DNA, 675 bp, Pseudomonas aeruginosa
ggagtcgatggccgccttcagttcgtcgatgccatcggcgcgggtggataccagcggcaccaccgggcagccgagacgccgcgccagaccgtcgatatcgatgcggatgcgctggctacgggcgatgtcgagcatgttcagcgcgacgatgcaggggatgcccatctcccgcagttgcaccgtgaggtacaggttgcgctccaggttcgccgcatccaccacgttgaccagcacgtccatttcgccgctggcgatgtagcggcaggcgatctgctcgtccagcgaggcctaggcagaaacggtgttcaaagaataggtgccgggcaggttgaccaggcgtaccgcgtgacggacggtatggaacgcaccctccttgcggtccacggtgacgccggcccagttgccgacccgctggcgcgagccggtgagctggttgaacagggtggtcttgccggagttgggattgccgatcaggccgagggtcaatgcggtcatggggattccgggcggggtcagtcgagcgggacgagggtcagcagggcgaggtccttgcgccgcagcgccaggctggtctggcgggtctcgacctggatcgggtcgcccagcggggcgatgcgcaccacgcgcagcgccgcgccgggcagaagccccatggagaacaggcgttggcgatag

SEQ ID NO: 7761 - DNA, 954 bp, Pseudomonas aeruginosa
  unsure (875): Identity of nucleotide at the above locations are unknown.
cctgaaagccacctgcacgctgggagacgcaccatggccagtcactggatgatctacggcgccaacggctacaccggccggctggtcgctgaacaggcgcagcgcgagggcctgacgccgctcctcggcggacgcaacccggccgccctgcacgccctcggcagccagctcgggctggagtgccgggtcttcgacctgggggatccgcaggcctgccgcgaagccctggaccaggtgaaggtggtggcccattgcgccggtccgttctccgccaccagcacgccgatgatcgccgcctgccgcgccgccggcacccactacgtggatatcactggagagatcgcggtgttcgagcaggcccacgccggcgacgccgaggcccgcgaggccggcatcgtggtctgcccgggcgtcggcttcgatgtgatccccaccgattgcctggccgcctgcctgaaggaggcgctgccggacgcgcaacggctggcgctgggcttcgacaccggcagcgggctttcgacgggaaccgcgaagaccagcgtcgaaggcctcaagttcggcggcaagatccgcgagaatggccgcctgcgcgacgtgccgttgggctacaagcgccgcgacatcgatttcggccgcggcctgcggcacgccgtgacgattccctggggcgacgtggccaccgcctactacagcaccggcatcccggacatcgaggtctacctgccggcgccgccgctgctgggcctgggcatgcgcctgatcgatccgctggcgtccgctgctcggtcggcaacgggtccaggactggctcaaggggcaggtcgacaaacgcatcgccgggccccgaccaggcggcccgcgagcgcctgcgcacntgggtctggggcgaggcgcgcaacgcccgcggcgaacgccgcacggcgcgcctggagacggccaacgtgtacgacctga

SEQ ID NO: 7762 - DNA, 738 bp, Pseudomonas aeruginosa
gctccgagtcgcacccggcgccctttccggagcgctccgccgaacgtccccccggggatccaggacgggctcccggacaggcatcggaccggccccgtgaaccggtcgcgcgctagccgcgccagtcctgacctgaggaagaataggagagacaccatggctttcgaattgccgccgctgccttacgaaaagaacgcccttgagccgcacatttccgcagaaaccctggaataccaccacgacaagcaccacaacacctacgtggtgaacctgaacaacctgatcccgggcaccgagttcgaaggcaagagcctcgaagagatcgtcaagagctcctccggcggcatcttcaacaacgccgcccaggtgtggaaccacaccttctactggaactgcctgagcccgaacggcggtggccagcccaccggcgccctggccgacgccatcaacgccgccttcggctccttcgacaagttcaaggaagagttcaccaagacttccgtcggcaccttcggttccggctggggctggctggtgaagaaggccgacggctccctggccctggccagcaccatcggtgccggcaacccgctgaccagcggcgacaccccgctgctgacctgcgacgtctgggaacacgcctactacatcgactaccgcaacctgcgtccgaagtacgtcgaggcgttctggaacctggtcaactgggacttcgtagcgaagaatttcgctgcctga

SEQ ID NO: 7763 - DNA, 2124 bp, Pseudomonas aeruginosa
ggtaaacaagctcttcctaccggcttgtctttcgccctggcgacgaacaaggaaggccccttgaaactggactcccgacacagcctctcgctcaagctgctgcgtgtcgtgctactggcggcgctagccgttggcgtagtgctcagttgcgcgcagatcgtcttcgacgcctacaaggccaagcaggcggtgagcagcgacgcccaacgcatcctcgcgatggtccgcgacccttccacccaggcggtctacagcctcgaccgggaaatggcgatgcaggtcctcgaaggcctgttccagcacgaggcggtgcgccaggcgagcatcggccatcccggcgagccgatgctggcggagaaatccaggccgctgctggacctgccgacgcgctggctgaccgacccgatcctcggccaggaacgcaccttcagcattcgactgatcggccgcccgccctatagcgaatactacggcgacctgaagatcaccctggacaccgcgccctacggcgagaacttcgtcaccacttcggaaatcatcttcatctccggcattctccgcgccctggccatgggcctggtgctgttcctggtctaccactggatgctgaccaagccgctgtcgaagatcatcgaacacctggtcagcatcaatcccgaccgccccagccagcaccagttgccgctgctcaaggggcacgaacgcaacgagctggggctctgggtgaccaccgccaaccagttgctcgcctcgatcgaaagcaacagccacctgcgccgcgaggccgaggacaacctgctgcgcatttcccagtacgacttcctcaccggcctgccgaaccgccagttgctgcagcagcaactcgaccagatcctcgacggcgccggccgccagcagcgccgggtggcagtgctgtgcctgggcctcgacgatttcaaggggatcaacgagcagtacacctaccagctcggcgaccagctgctgatcgccctcgccgaccgcctgcgcgggcacagcgcgcggctcggttcgctggcgcgcctgggcggcgaccagttcgccctggtccaggccgacatcgagcaaccctacgaggcggccgaactggcgcagagcatcctcgacggcctggaagcgccgttcgagatcgaccagcacgaggtgcgcctgcgcgccaccatcggtatcaccctgttccccgaggacggcgagaccacggagaaactgctgcagaaggccgagcagaccatgaccctggccaagacccgctcgcgcaaccgctaccagttctacatcgccagcgtggacagcgagatgcgtcgccgccgggaactggaaaaggacctgcgcgacgccctgcagcgccacgagctgcacctcgtctaccagccgcaggtggactaccgcgaccaccgcgtggtcggcgtcgaggcgctgctgcgctggcaacatccgttgcacggcttcgtcccgccggacctgttcatcccgctggcggaacagaacggcagcatcttcagcatcggcgagtgggtgctcgaccaggcctgccggcagttgcgcgaatggcacgaccagggcttcgacgacctgcgcatggcggtcaatctttccaccgtgcagctccaccacaacgccctgccacgggtggtcagcaacctgctgcaggtctaccgcctgccggcgcgcagcctggagctggaagtcaccgaaaccggcctgatggaggacatctccactgccgcccagcacctcctcagcctgcgccgcgccggcgcgctgatcgccatcgacgatttcggcaccggctattcctcgctgagctacctgaagagcctgccgctggacaagatcaagatcgacaagagtttcgtccaggacctgctgcaggacgaggacgacgcgaccatcgttcgcgccatcatccagctcggcaagagcctgggcatgcaggtgatcgccgagggcgtggaaaccgccgagcaggaggcgtacatcatcgccgaaggttgcaacgaaggtcagggctacctgtacagcaagccgctgccggccagggaactgacccagtacctcaagcaggcgcgacgcctgagccaggccaccagcagcgaacggccctga

SEQ ID NO: 7764 - DNA, 1338 bp, Pseudomonas aeruginosa
ctcgtatgcccctggccaccgccagtctgctgggcctcgccatctccctcgccggctgcggcgacgacaagaaagccgaagcgcccgcaacaccggcggccaacatgcagcccgccgcgcccgccgccggccccggccgccaaggtcgacgaggccgccgccaaggcggtgatcaagaactacgcggaactcgccgaaaccaccttcgccgatgccctgagcaccgccaaggacctgcagaaagccatcgacgcgttcctcgccaagcctgacgcggagaccctgaaagccgccaaggaagcctggttcgccgctcgtaccccttactcccagagcgaagccttccgcttcggcaacgcgatcatcgacgactgggaaggacaggttaacgcctggccgctggacgaaggcctgatcgactatgtcgccaaggactaccagcacgccctggggaaccccggcgccaccgccaacatcgtcgccaacaccgagatccaggtcggcgaagacaagatcgacgtcaaggaaatcaccggcgagaaactggccagcctgaacgagctgggcggttccgaagccaacgtcgccaccggctaccacgccatcgagttcctcctctggggccaggacctgaacggcaccggtccgggcgccggcaaccgtcccgccaccgactatgcccagggcaaggactgcaccggcggccattgcgaccgtcgcgccgcctacctgaaggccgtcaccgacctgctggtcagcgacctcgaatacatggccggacagtggaaagccggcgtcgccgacaactaccgcgccaagctggaagccgaaccggtggataccggcctgcgcaagatgttcttcggcatgggcagcctgtccctcggcgaactggccggcgagcgcatgaaggtcgcgctggaggccaactccaccgaagacgagcacgactgcttcagcgacgacacccaccacaccctgttcttcaacggcaagagcatccgcaacatctacctcggcgagtacaagcgcatcgacggcagcgtggtcaagggcccgagcctggccgacctggtcgccaaggccgacgccgccgccaacgacaccctgaaggccgacctggccgacaccgaggccaagctgcaggccatcgtcgacagcgccgagaaggatggcgtgcacttcgaccagatgatcgctccggacaacaaggacggccagcagaagatccgcgacgccatcgccgccctggtcaagcagaccggcgccatcgagcaggccgctggcaagctgggtatccaggacctgaagccggacaacgccgaccacgagttctga

SEQ ID NO: 7765 - DNA, 1461 bp, Pseudomonas aeruginosa
gcttgcgggctgtttccacgcagtccgggatgttcgccgatgtcgttgccgtcaccttccatgccgctcgcctgtctcctgacggcgctccttctgggcggatgcggcgccgacgacgaaccgctgcgcgccgagcccggcgaacacctgtccgggggcgcgaccacggtgctgcaaagcgaccgcaacgccttctccctgccctccgccaacctcgccccgagccggcgcctggacttcagcgtgggcaacagtttcttccgcaacccctgggtcatcgccccttcctccaccaccgcgcgcgacggtctgggaccgctgttcaataccaacgcctgccagaactgccatgtgaaggacggccgcggccacccgccgggagcggacgcggtcagcgcggtgtcgatgctggtacgcctgtcgatcccggccggccctgcggacggcaagaccctgttgcaccagggggtgattcccgagccgacctacggcggccagttgcaggacgtcggcattcccggcgtcgccccggaaggcaaggtgcgggtggactacgagccgctgaaggtgaggttcgaggacggcaccgaggtcgaactgcgcaagccgatcctgcgtatcagccagctcggctatgggccgatgcatccgcagacgatgttttccgcccgcgtcgccccgccgatgatcgggctcggcctgctcgaggcgattcccgaagaggcgatcctggccaatgccgatccggacgaccgcaacggcgacggtatccgcgggcgcgccaaccaggtctgggatgccgcgcggcagcgcaccgcgctcggccgcttcggctggaaggccggccagccggatatcccgcagcagaacgcgcacgccttcgccaacgacatgggcctgaccagcagcctgctgccccacgacgactgcagcgccgcccaggtcgagtgccgccgggcgcccgacggcggcgagccggaagtcagcgacaacatcttcgcccaggtgctgttctacagccgcaacctggcggtcccggcgcggcgcaaggtggacgacccgcaggtgctggccggcaagcgtctgttcgcccaggccaactgcgtggcctgccacgttcccgccttcactaccggttccgacgccagcgagccggagctggccaaccagcggattcgtccctattccgacctgttgctgcatgacatgggcgacggcttggcggacaatcgcccggaatttctcgccagcgggcgggactggcgaaccccgccgctatggggcatcggcctgaccgaaacggtcaacggccacacccagttcctccacgacgggcgcgcccgcaatctgctggaggcgatcctctggcacggcggcgaagccgaagcggccaagcggcacgtgctcggcttcgacgccgaccagcgcagcgccctgctggccttcctgaattcactctga

SEQ ID NO: 7766 - DNA, 1074 bp, Pseudomonas aeruginosa
ggagcccacatgttccgcccacgactgctcttgaccagcctcgccatcgccctcggcgcctgctcgccgcaagacccgcaggccgtcaccagtgccgccctggcgcaacaggtgatcctgccgacctacagccgctgggtggaggccgaccaggccctggccagcagcgccctggcctactgccagggcaaggaagacctggccaaggcccgcgacgcgttccacgccgcgcagaaggcctgggccgagctgcaaccgctgctgatcggcccgctggccgagggcaaccgcgcctggcaggtgcagttctggccggacaagaaggacctggtcgggcgccaggtcgaacagttgctgaagaacaacccgcaggtcgacgccgcggccctggccaaggccagcgtggtggtgcaggggctctccgcctacgaatacatcctcttcgacagcaagatcgacctcgccgacgccgccaccaaggcccgctattgcccgttgctggaagccatcggcacccaccagcagcaactggcccaggacatcctggcgcgctggaagaacgacggcggcatgctcacccagatgagcaagttccccaacgaccgctacgccgacgcccacgaggcgatcgccgagctgctgcgggtccaggtcaccgccctggacatgctgaagaagaaactcggtactccgctgggccggcagagcaagggcattccccagccctaccaggccgaggcctggcgcagcaacgcctcgctggccagcctggacgccagcctgagcggcgcccaggcgctctgggaaggtatcgacggcaagggcctgaagaccctgctgccggccgaacagaaggacctggccggcaagatcgacgccgcctacgccgacagccacgcgaagctggcggcgctggaacagaaaccgctctccgaactgctcgccagcgaagacgggcgcaaccagctcaacgccctctatgacagcctgaacgtggtccaccgcctgcacgaaggcgacctggcccgcgccctcggcgtgcaactgggcttcaacgccaacgatggcgactga

SEQ ID NO: 7767 - DNA, 1101 bp, Pseudomonas aeruginosa
ccaaccgctggtgctgtcggcgcgcgacgacgccgatggccagcattacgcggtgggctaccgcctggacggcaagtgccagttcgccacccgcgtggcccagcgctgccacgacatcgtccagcacccgagcctgccgctggcgctgttcgtcgcccgccggccaggcaccgaaagctacctgatcgacctgaacgacggttgcctgctgcagaccctggtctcgcagaaagaccgccacttctacggccacggcgtgttccaccagagcggcgagtggctctacgccaccgagaacgacactaccgatcccggtcgcggcgtgctcggcgtctaccgtttcgacggcgagcgactgcagcacagcggcgagatctccacccacggcctcgggccgcaccaggtttcctggatgcccgacggcgagaccctggtagtggccaacggcggcattcgtaccgaggcggaaagccgggtcgagatgaacctcgacgccatggagcccagcctggtgctgatgcgccgcgacggcaacctgctgtccaaggaaaccctggcgcagcagatgaacagcgtccgccacctggcgatcggtcgcgacggcaccatcgtcgccggccagcagttcatgggcgatgcccacgaacatgccgacctgctggcgatcaagcgccccggccgtcccttcgaagccttcccggtggccgaggagcagcgcctggcgatggcccagtacaccgccagcgtggcgatccacgacgacctgcgcctggtggccctgaccgccccgcgcggcaaccgtttcttcatctgggacctggacagcggtgccgtacgcctcgacgcgccgttgccggactgcgccggcgtgggcgcggtgaagaacggcttcgtcgtcacgtccggacagggccgttgccgcttctacgactgccagggcgagcgcatcgccgcgcaaccgctggagctgccttccggcctctgggacaaccacctgcacctggcctgagagcgcggcatcaacctctcgccataccggtccgcgaaagtcggaagcgacctgcaacacgcttgaaatctttcgccaatcctgtgctttga

SEQ ID NO: 7768 - DNA, 882 bp, Pseudomonas aeruginosa
agctcgacaacggcgccgcggtggccatcgtcgccgagcgggacctccagcaagagcactgagtcgcgcgccttcctactccgtggcggaaggcttgccaagggactgaaacatggcttttaccgatccgttcatccgtcgtccggtcctggcgagcgtggtcagcctgctgatcgtcctgctcggcatgcaggccttcagcaagctggtgatccgcgagtatccgcaaatggagaacgcgctgatcacggtgaccacgctctacgccggagccaacgcggaaaccatccagggctacatcacccagccgctgcagcagagcctggccagcgccgaaggcatcgactacatgacctcggtgagccggcagaactattcgaccatctccatctacgcgcggatcggcgccaataccgatcgcctggtcaccgagctgctggccaagtccaacgaagtgaagagccagctgccgccggacgccgaggacccggtgctgcagaaggaggccgcggacgcctcggcgctgatgtacatcagcttctacagcgagcagatgaacaacccgcagatcaccgactacctgtcgcgggtgatccagcccaagctggcgaccctgcccggtatcgccgaggcggagatcctcggcaaccaggtgttcgccatgcgcctgtggctggacccggtgaagatggccgcgttcggcgtcaccgccggcgagatcaaccaggcggtgcagcagtacaacttcctcgccgccgccggcgaggtgaagggccagttggtggtcaccagcgtcaatgcttccaccgacctcaagtcgccccaggccttcgccgccatcccggtgaagaccgacggcgaccgccgggtgctgatgggtga

SEQ ID NO: 7769 - DNA, 3357 bp, Pseudomonas aeruginosa
agtggtgaagaccctcggcgaggcggtgctgatcgtcatcgtggtggtgttcctgttcctcggcgcgttccgttcggtactgatcccggtggtgaccattccgctgtcgatgatcggcgtattgttcttcatgcaggccatgggctactcgatcaacctgctgaccctgctggcgatggtcctggccatcggcctggtggtggacgacgcgatcgtggtggtggaaaacatccaccgccacatcgaggagggcaagccgcccttcgaggctgccctggagggcgcgcgggagatcgccgtaccggtggtcagcatgaccatcaccctcgccgcggtctacgcgccgatcggcttcctcaccggcctcactggcgccctgttcaaggagttcgccttcaccctggccggcgcggtgatcatttccgggatcgtcgccctgaccctgtcgccgatgatgtgctcgcgcctgttgcgccacgaggagaatccctcgggcctggcgcatcgcctcgacctgatcttcgagggcctgaagcaacgctaccagcgcgccctccacggcaccctggacacccgtccggtggtcctggtgttcgccgtgctggtactggcgctgatcccggtactgctgatgttcaccaagaaggagctggcgccggaagaggaccagggcatcgtgttcctcatgaccaactcgccgcagaccgccaacctcgactacctgaatcgctacaccgccgagttcgaaggtatcttccgcagcttcccggagtattactcggcgttccagatcaacggctacaacggcgtccaggccggcatcggcggcatgctgctcaagccctgggacgaacgcgaaaagagccagatggaattgctccatgcggtgcaggcgaagctcaacgagattcccggcgtgcaaatcttcgccttcaacctgccgtcgctaccgggcaccggcgagggtctgccattccagttcgtgctcaacaccgccaacgactacgagtcgctgctgcaagtggcgcaacgggtgaagcagcgcgccagcgagtccggcaagttcgccttcctcgatctcgacctggcgttcgacaaacccgagctggtggtcgacatcgaccgcgagaaggccgcgcagatgggcgtctccatgcaggacctgggggtggcgctggccagcctgctcggcgagggcgagatcaaccgcttcaccatcgacgggcgcagctacaaggtcatcgcccaggtcgaacgcccctatcgcgacaatcccggctggctcggcagctactacgtgaagagccgcaacggccaactggtcgccctctcgaccctgatcgagacccacgaacgggcacggccacggcaactgaaccagttccagcagctcaactcggcgatcatctccggcttccccatcgtcagcatgggcgaggccatcgagacggttcagcagatcgcccgcgaggaagccccgcgtggcttcgccgtcgactacgccggcgcttcccggcaatacgtgcaggaaggcagcgcattgctggtcaccttcggactggccctggcgatcatcttcctggtcctcgccgcacagttcgaaagcttccgcgatccgctggtgatcatggtcaccgtgccgctgtcgatctgcggtgcgctgataccgctgttcctcggcgtgtcgagcctgaacatctatacccaggtcggcctggtgacactgatcggcctgatcagcaaacacggcatcctgatcgtcgagttcgccaaccagttgcgccacgaacaggggctggggcgtcgcgaggccatcgagcaggccgccgcgatccgcctgcggccagtactgatgaccaccgcggcgatggtgctcggggtgatcccgctgatcctcgccaccggcgccggggcggtcagtcgcttcgacatcggcatcgtgatcgcgaccggcatgtcggtgggcaccctcttcaccctgttcgtcctgccgtgcatctacaccctggtggccaggccggatgccccgccaggcgtgacgcaagcggcaaacgcacactgatcggaaacggcggacagcgacaacagcgctgtccgccggcgctgtcgccccatcccacagccctccgggcgcgatcctatgtccgccggcagccgcctccagtagattgcccgctgaaacgcagtggtgagacgagcatggccgagagcgctttttccgaacgtatcgtgcagaacctgctggataccgacttctacaagctgaccatgatgcaggcggtgctgcacaactatcccaacgccgaggtggagtgggagttccgctgccgcaaccaggaagacctggcgcctgtacctgccggccatccgcgaacagctggaatacctggcgggcctggcgatcagcgacgagcaactggccttcctcgaacggattcccttcctggcgccggacttcatccgcttcctcgggttgttccgcttcaacccgcgctacgtgcagaccggcatcgagaacgacgaattcttcctgcgcctgaaaggtccctggctgcacgtgatcctcttcgaagtgccgctgctggcgatgatcagcgaggtgcgcaaccgcgcccgctacccggccgccaccgtcgagcaggcgcgcgaacgcctgcaggaaaagttcgattggctgcgccgggaggccagcgccgaggaactggccggcttcaagatggccgacttcggtacccgccgccgcttctcctatcgggtccacgaggcggtggtgagcggtctgaaggaggactttccgggctgcttcgtcggcaccagcaacgtccacctggcacgcaagctcgacctcaagcccctcggcaccatggcccacgaatggctgatggcccaccagcagctcggtccgcgcctgatcgacagccagagtgccgcgttggactgctgggtccgcgaataccgtgggctgctcggcatcgcgctgaccgactgcatcaccaccgatgccttcctgcgcgacttcgacctctatttcgccaagctcttcgacggcctccgccacgactcgggcgacccgttgctgtgggcggaaaagaccatcgcccactacctcaagctgggcatcgacccgctgaccaagaccctggtgttctccgacggcctcgacctgccacgggccctgaagatctatcgcgcgctgcagggccggatcaacgtcagcttcggcataggcacgcatttcacctgcgacctgccgggcgtcgagccgatgaacatcgtggtgaagatgagcgcctgcaacggccatccggtggcgaagatctccgatacgcccggcaaggcgcaatgccgggaccctga

SEQ ID NO: 7770 - DNA, 558 bp, Pseudomonas aeruginosa
cgccgatttgttgcagaattctttggtgcttcgcttcgccccagcggtcctggtcaccgcgcgcatagcactcgtcgaggctggagaaaccctccagggcttcggtcaccagcagcgcctgccattgcccgtcgaccttgcggcagccggaatagatcaggcgcggcacgcgtataccgagcgactcgaaggcccgtagcgcatcgcgctcgcgcatggcggtgggatagccgaaagggcgctgccagtcgcggtagacgtggccggtctgctgcttgcgatagagcagccgtccatcgccggtgtacacccgctgcacgccgctcgccccgccgcggcgctcgttgggctcctcgacccagctgccgggtacctgcaaccactggtcgatggcggagtcgccggagatacgttgcagggatgccagatcgggagccattgttattcctttcgcaagatatagacccgccacatgtgatacagcgggatgaaatcgagatgcttctggacgacgaagccggcgtcgcggaactcgcgctcgaccgtttcggctggtaa

SEQ ID NO: 7771 - DNA, 405 bp, Pseudomonas aeruginosa
gcgcgtcgcgcaggcggccaagggtctcgtcgaaggaagcggccagctcgccgacctcgtcgttggcgtagtccggcgccaacggcggcgccagaccgagcaactgttcgcgatgccgcacctggcgcgccaggcgcaccaccggctccatcaccttgcgcgcgagcatccagccaagcaggccggccagggcgatgctcagcacgtagccggtcagcaccgaggcgtagagcacctgctcgcgcgcttcgaaatcgctctggtcctgcagcaggacgaagcggcgaccatcgatgtcgcgcaccagcgcatggaacgacaagtcgccctcgaacacttcgtggaaaccgacatccagttggtccagcgccggcggcatggcgtaggagccctggccgtcgctga

SEQ ID NO: 7772 - DNA, 681 bp, Pseudomonas aeruginosa
cgcgctctggcgcctggacccgaaacagggcgtgccggtgaaggtgatcggccggctaccccaggccagcgacttctgggagaagatgcaggaaaaccactgggtctggctgcacgatgcgcgtggcgcggagatcccgcccgaggccctgccgaacgctctcgccgggcttggcgacgatccctaccgcgccctggccggctacgccgaggacgagaacgccttcgacaaggatcggcagagctatttcatcgaattccactgggcgcgctatttcggcgaacgcatgcactggcggccgatcagccgcgccactctgcccgacgacctgaagcaggcactgcacctggcctgcgaaccggcggcaagggagctgccgggctaccgccaggactgcccgcactgaggaataaaaaagccccgccgaagcggggctcttccaaccacaggagccggtcggcttacatcatgccgcccatgccgcccatgccgcccatgtcaggcatgccgcccatggccggcttgtcttccacgatctcggcaaccatggcttcggtggtgatcatcagaccgccgatggaggccgcagcctgcagagcggaacgagtgaccttggccgggtccaggatgcccatctcgatcatgtcgccgtacacgccggtagcagcgttgaagccgtag

SEQ ID NO: 7773 - DNA, 471 bp, Pseudomonas aeruginosa
tcggaagtggtttcctcgatctgcttgcggatctgcaggacgcgggcttcgatatcagcctgcacaccggcgccatcgatgatggtggtgttttccttgttgatcacgacgcgcttggcgttgcccaggtgctccagggtagcgccttccaggctcaggccgacttcttcgctgatcacggtaccgccggtgaggatggcgatgtcctgcagcatggccttgcggcgatcgccgaagcccggagccttgacagccgcgaccttgacgatgccacgcatgttgttcaccaccagggtggccagggcttcgccctcgacgtcctcggcgacgatcagcagcggacggccggccttggcgacggcttccagcaccggcagcatttcgcggatgttggagatcttcttgtcgaccagcagcagcagcgggctatccagctcggcagccatggtgtccggcttgttcacgaagtag

SEQ ID NO: 7774 - DNA, 609 bp, Pseudomonas aeruginosa
ccgcgatcgaactgcatgccttcgacgacggacagttcgttttccaggcccgagccttcctcgacggtgatcacgccttctttaccgactttttccatggcttcggcaatgatctggccgatggactcgtcggagttggcggagatggtgcctacctgggctatggccttggtgtcggcgcagggcttggccagctctttcagctgggcgacgatagccacggtggccttgtcgatgccacgcttcaggtccatcgggttcatgccggcggcaacggccttcaggccttcgttgacgatggcctgggccaggacggtcgcggtggtggtgccgtcaccggcagcgtcgttggccttggaggcaacgtctttcaccagttgcgcgcccatgttctcgaacttgtctttcagctcgatttccttggcgacggaaacgccgtccttggtgatggtcggagcgccgaaggacttgtccagaaccacgttgcggcctttcgggccgagggtggccttgacggcatcggccagcacgttcacgccgaccagcattttcttgcgagcggaatcgccgaacttaacttctttggcagccatgttctctttcctctaa

SEQ ID NO: 7775 - DNA, 441 bp, Pseudomonas aeruginosa
cgggcgttcaggtcgtcggcgaaggcgcgccggcgcagcgcctgctgttcgacgcggcggcgcaggccgccgagcatcaggcgacgggtgaaaggaatcaggcagaggatgccgaagatgtcgctgatgaaacccggcagcatcagcaggccgccgccgacggcgatcaacaggccttcgagcatttcctgctccggcagttcgccacgggccagtcgttcgcgggcgcgccaggcggtggccacgccggccacgcgcaacaatgcagcaccgatgaaggcgctggcgacgatcaggaacagggtccagccgaccccgatgacactgccgaccttgatcaggacggccagctcgaccagcgggaagagcaacagcagaaagaggaaagcgcgcatttcagagtccttggcggggcccgtttgcccccggtaccaccagtag

SEQ ID NO: 7776 - DNA, 1272 bp, Pseudomonas aeruginosa
ccgccggcatccccctcaagcgtatgggcaagccggtggagatcgcccactcggtggcctacatcttcgagaacgactactacaccggccgcgttctcgaactggacggcggcctgcgcctgtaggccccggccccgcaaggaaaaagccccgctatcgcggggctttttcgtgcaggccggcttaccagccgaccccgaggccgatggtatagcggcgctggttgacgttgccgtcgttgccgctgaacttgtcccattccgccttcatgctcagcgaagcccagctggtcagcttgtagcggatccccgcctcggtctgcagctcgtagtccaggccggattgcagcggcttgctgacctcgccgttggtgaacagctcgaactgcttggccagcaggtagcggttgtagtcccacttgaagctcgacgaatagaagtgctccttctcgccatcggcgaactcgtagtcgttgcggttgaccagggtggcgatggagaacgcgcccagctcgttgtcccagaactggtagccggggccggtaccgacggtacgcttcttcgccaggtcctcgatcatgtcgcgcttgtaggcgacctggccctgccagaaccagtggtcgtcgatgaagcggtccagcgcgtactggccggaataattgtcggtgctgacctggccgttcttcttctcgcggttgtactcgccctgcacgttgtggcgccagagtccgtggcgggcgttggtcttgaaatcgatgtcgtagtcggacacatcgttctcggcctgcttgcggtccagcgagaaatcgacgttgccgttccatacccagtcctggaggatcggcttgggcggcatcatctgctggatgctggccagctccacggtcttcggctcgccgttgaccagggtcacctggcccggcccggcggccttgatgcccttggagtgctcgccagtctcggcatcctgcttgaccagcaggttctgctcgctctcgaaggtggagatcttgtcccacttgagcgtgatgtcgccgccatagtcggtcttcagcagcagcttgccgccgtcgaacagggtgatcttgccggtaaggcggtcaccgttcttcatccagaccgtatcggcaagggcagaggtggaacttgcaagggcagcgaggcacagcaggattctcgacaacatgagcacaaatcaactgagttgggttcgaagaggccggcattatccaaatgccgggcggcagagcaaggaccggggcacgggcggtaa

SEQ ID NO: 7777 - DNA, 216 bp, Pseudomonas aeruginosa
gccgcgcccgcccgctgggtcggcaggacgctcagccagttgccggtggatacccgcctgccctggcatcgggttctcggcgccggcggtcgcatcagcctgccggcggacagtcccggcggtcgcgaacaacgcgcacgcttgcgcgaggaaggcgttctcctgcacaacgacagggtggacatacgtcggcatggctggcttacagcgaagtag

SEQ ID NO: 7778 - DNA, 1818 bp, Pseudomonas aeruginosa
agtgcgcgttattttttgcggaacggttaccccatgactcagcaatcctggcgagaggccctggtcgcctacaagtctcccgccagcctggccctcctgctgctcggcttcgccgccggcctgccgaccatgctggtgttcaacaccctgtcggtgtggctgcgcgaagccggcgtggcgcgggataccatcggtttcgccagttggctggggctggtgtacgccttcaagtgggtctggtcgccgatgctcgaccagtggcgcctgcccttcgtcggccgtctcggccggcgccgttcctggctggtgttctcgcaggtgctgatcgccctgggactgctcggcatggccctgtgcaatccgcagagccacctgccctggctgatcggcctggccctgctggtggcgttcgcctccgccacccaggacattgcgatcgacgcctaccgcctggaaatcgccgaggatagccgccaggccgccctcgctgcctgctacatgaccggctaccgcgcggcgatcctgctggccagcgccggcgcgctgattctcgccgaatggttcggctccaccagcctcaactacagccagtcggcctggggcctgacctatgcgttgttcgccctgctgatcctgcctgggctggtcaccagcctgctgatccgcgagccggcggtggacgtgccgatccacgtcaacccgtcgcgtttcgacttcaaccaccaactgctctcggtgctcctgctgctgatcctgctgatctcgctgccggcgatgatcaccgccctcctcgaccgcgcctggccgcgcgccggcctctacgcgctgctcatggggatctgcctgtcgccgtggggacgccagcagatccgcccggtccgcgaactgctcgccaccgtgcgcaggccgctgctggtggcggcgcgcggcaaggaagtgccgctgttcgatttcgtccaccaggcggtctcggtgatggtgctgatcatcctcctcgtcaccgtcaccgccatgtgccgcgcctactactccggcgcctggccgcgcggcacgctgttcctgctgatcgccgcgtcctgcctgtcggcacccggacgcctgctgatggccccggtgctgacgccgatcaccgagttcgtccagcgctatcgctggcaggccctgctgctgctcggcctgatctccacctatcgcctgtcggacacggtgatgggggtgatggccggggtcttctacatcgacatgggcttctccaaggaagtcatcgccagtgtcagcaaggtcttcggcgtactcatgaccctgatcggcgccgccgccggcggggtgctgatcgcccgcttcagcatcctctccatcctgttcatcggcggtgccgcttcggctgccaccaacctgctgttcgccatgctcgcccagctcggcccgctgcacgccgaggccctgcccagccatgacgtgatcagcctggtgatggcgctcgagccgcacgtgctgatgctggtgatgaccatcaccctcgacaacttcagcggcggcctcgccgcctcggccttcgtcgcctacctgtcgagcctgaccaacctgaagttctccgccacccagtacgccatgctcagctcgaccatgctcctgctgccgcgcttcatcggcggctactccggaaccatggtcgagagcctcggctacgagcacttcttctacgtcaccgcggtgatgggcattcccaccctgctgctgatcggctggttgtggctgcgccgcgcgccgtccagcgagacgccggcgccgggacaccagaacgccgagcagcactga

SEQ ID NO: 7779 - DNA, 588 bp, Pseudomonas aeruginosa
tcagccaccagccgatcgccagggtcagcagcgccagggcgaccttgccgctgtactccagcacgatcggcagccaggactcggtctgctgcaccagtcggtcgtagttcaattccatgcattacctccatttctcgaaaaaacacccctcccttccgcaacggaaacgggacgggcttgcagattcctgcccggacgccgtggggcgacgtttccgggcctggatacgaatcggcgcagcgcggacgaaccgacgctgcgccgacaggggcggacaacgcgggagaggtcgcggcggcgctactccctattgcgatgcccgggatggcgagaggttccgaaaaacctcgtcaatcgcggaagttggtgaactgcaacggcatgccgagcgattcgccgcgcagcagggcgatggcctcctgcagatcgtcacgcttcttgccggtgacgcgcacctgctcgccctggatggcggcctggaccttgagcttgcgctccttgatcagaccaacgatcttcttcgccaggtccttgtcgatgccctcgcggaagttgacgtcctgcttgaccaccttgcccgacgggtag

SEQ ID NO: 7780 - DNA, 1119 bp, Pseudomonas aeruginosa
ccgagccctcgcgagcgaatgcccgccggtgtggcggagaccgacgatttcttcccgatggcgcgcgcgaccgcggccgggacccggcctcccgcgacgaaccgggcccttgccggcagcgtaccggcgcccatcctcttctcgagtccgttcatgcccaaccccgatctcagcatcctggtcgtcgacgacgccaagttttccagcgccatgatcggccgcgccctcagccaggccggctaccaggacatccgcttcgccagcagcgccagcgaggccctgcagcagctcgaacaacgcccggtcagcgtgctcctggccgactggctgatgccggagatggacggcctggaactgaccgcccgggtccgccaactggacgaaagcatcaaccactacacctacatcgtcctgcttaccggcaaggagggcgagaacgtcctcggcgaggccttcgaccgcggcgtcgacgacttcgtcagcaaggccgcgatgaacgagcaactggtgccgcgcatctacgcagccgaccgcctgtgcaacaccctgcaacggttgctggtggaaaaccgcctgctcaccgaaaacatcgcgcggatggaagaacgcaacctggtggataccctcaccggcctcggcaatccccgctacctgcgacagaagctggccgacagcctgcgccaggtggaaacccgcggtggagcgctgtgctacctgctggtcggcatgcccgaggcaccggtcctgcgccagcggcacggcgaggccttccatcgcgagctgctgctcggcgtggccaggcgcctgcaacagctggtccggccgctggatgtgctggtgcgcctggacgagcagcatttcgccctgatcaccctggtggaggacctgcacgaatgctcgtcgagcagcttcaagcggctgcacgacgggctcaacctgaaggccttcaagaccagcgaaggcttcatcagcctgaaagccggcatcgccatgctcggcctcgacagcggggcattgccgctgggcatcgacgaactgctgcagcgcaccgaggccctgttgcccgatgcctatgctagcggcaggatcgcaacctgccggctaccggcactgcgctag

SEQ ID NO: 7781 - DNA, 948 bp, Pseudomonas aeruginosa
acttcgccctatcgtcagccattcgcagtagccaccatgacctggcatatcctcggcgccggtagcctcggcagcctctgggccgcgcgcctcgggcgcgccggcctgcccgtccgcctgatcctgcgcgaccgccagcgcctgcgccgctaccaacaggccggcggactgagcctggtggaagacggccaggccagcctctacccgatcgccgcggaaaccccggacggcgggcaacccatccagcgcctgctgctggcctgcaaggcctacgacgcggaggaagccgcctccagcgtggcccatcgcctggccggcaacgccgaactgctgttgctgcagaacggcctgggcagccagcaggcggtcgccgcccgcctgccgcgcagccgctgcctgttcacctccagcaccgaaggcgcgttccgcgatggcgatttccgcgtggtcttcgccggccgggggcacacctggctcggcgatccgcgcgacacaagcgcccccgcctggctggcgcagctgtcccaggccgggatcccgcacagctggagcgacgacatcctcgaacggctgtggcgcaagctggccctgaactgcgcgatcaacccgctgaccgtcctccacgattgccgcaacggcggcctgcggcagcacccggaagagatcgccgcgctttgcgacgaactcggccagttgctccacgccagcggctacgacgccgccgccaggagcctgctggaggatgtccgggcggtgatcgacgccaccgcggccaactattcctcgatgcatcaggacgtcacccgcggccggcgcacggaaatcggctacctgctcgactacgcctgccagcacgggcagcgcctgggactaccgctgccgcgcctgggaaccttgctcgcccgcctccaggcccatctgcgccagcgcggtttgcccgaccgctaa

SEQ ID NO: 7782 - DNA, 909 bp, Pseudomonas aeruginosa
cgccgccctgggcggaagtccaggtggaagacaacggcagcggcatgcccgaactggtgcgcaagcgtatcttcgagccgttcttcaccaccaaggaagtcggccagggcaccggtctcggcctgtccgtctcgtatttcatcatcaccaacaatcacaagggccagatggaagtacgctcggaactgggccgcggcacctgcttcagcatccgcctgccgctggaaagctccgaagcggtcgccccggcacaagccaaggccctgccgcccgctctgccgcaacccggtagcagcctgcggcggggcgacgaagaggaaggttgaatccatgggcaatcgattgtcgaagatctacacccgtaccggcgaccgcggcgagaccggcctggccggcggacgccgggtgcccaagagccatccacgcatcgaggcgatcggcgcggtggacgaattgaacagccagttgggcctgctccttgccgagctgctggaagcgcgtggcgcacatcccggcctggaggagatcgtccaggcgctggcgccggtgcaacaccgcctgttcgacctcggcggggagctggcgatgccggagtatcgggccctggacgagacggaagtggcacgcctggaaagctgcatcgaccgctggaacgacgagctgggcccgctgaagaatttcatcctccccggcggttcccgcccggtcgcccaggcccatgtctgccgcagcctggcgcgcagtgccgaacggcgctgccaggcgctggaccaggaggaaacgctggagggcgtcggcctgcgctacctgaaccggctctccgacctgctgttcgtcgccgcccgcgccatcgcccggcgccagggcgtggcggagattctctgggaggcggcggcaaaaccggactga

SEQ ID NO: 7783 - DNA, 1338 bp, Pseudomonas aeruginosa
gaggcgcacggaccgatggcaaattcccgattttcatccatcgatgaaggatcggaatgcctggcttcaggtgcggtactctgcgttgatcttcacgtattcgtgggacaggtcggtggtccagatggtctcgctgcaggtgccgcgtcccagttcgatgcggatgccgatctcggcctgggccatcaccgccgcgccctgttcctcggtgtaactggccgcccggccgccacggctggcgatacagacgtcgccaaggaacacgtcgatcttgctcacgtccagattggccacgccggcacgtccgaccgcggcgagaatgcgtccccagttcgggtcggaggcgaacagcgcggtcttgatcagcggcgagtgggccacggcatagccgacatccaggcactcctggtgggtggcgccgccgttgacctgaacagtgacgaacttggtcgcgccctcgccgtcgcgaacgatggcctgggccagctccatggaaacctccattaccgcttgcttcaacgcggcgaacagcgcgccgctggcctgggtgacttccggcagcgccgcgcgaccggtggcgatcagcatgcagcagtcgttggtggaggtatcgccgtcgatggtgatgcggttgaaggacttgttggcggcgtcgcgcaacagatcctgcagcacgccctgggcgaccttggcgtcggtggcgatataaccgagcatggtcgccatgttcggcttgatcatcccggcgcccttgctgattccggtgacggtcacggtcacgccatcgtgcacgaactggcggctggcgcccttgggcagggtatcggtggtcatgatccccgcagcagcttcggcccagcggtcctcagccaggtcggccagggccgcaggcaacgccgcctcgatcttggccaccggcaggggctcgccgatcaccccggtggaatatggcagcaccgaagtctcggcgaccccggccagttcggcgagcttggcgcaggtttgcgcggcggcggcgaggccggcctcgccggtaccggcgttggcgttgccggtattggtcagcaggtagcgcacctcaccgaggaaacgctgtttggccagggtcaccggcgcggcacagaacgcgttcagggtgaacaccccggccacgctggagccttcggcgcagcgcatgaccaccacgtctttgcgccccggtcgcttgatgccggcggaagcgatgccgagttcgaaaccggggaccgggtgcagggtggacagggggccaagaccgacagccatgggaacgcgctcctttaccaaacagtggactcgatgccgtccgcgacggcgtga

SEQ ID NO: 7784 - DNA, 1314 bp, Pseudomonas aeruginosa
ttaattacttcaatcggcctgacgacgcaggaacgccgggatatccaggtaatccaggtcatcctgcgggttcagcttggccgcggtcgccgcgctgccgtgagactggttgcgcatcacggtaggacggtcgaggtcgcggtagttcaccgactgctgctcgcgctgggccggtgcggctgcctgggttgcgctgccctgcacagtgttgtcgacgaccttcaccggtttctccaggcgcgcgcccaggccggtggcgactacggtgacgtgcagctcatcgcgcatgtccgcgtcgatcacggtgcccaccttcacagtggcgtgctcggaagcgaactgttcgatgatgttgccgacatcggagtactcgcccagggacaggtccggacccgcggtgatgttcaccaggatgccgcgcgcgccctgcaggttgacgtcttccagcagcgggttgcggattgccgcctcggtggcctcgcgggcacggttcggaccgctggcgcagccggtacccatcatcgccatgcccatttcgctcatgacggtcttcacgtcggcgaagtcgacgttgatcatgcccggacgcttgatgatgtcggagataccgcgcacggcaccggccagcacgtcatcggccttggcaaaggcggccagcaggctggcgtccttgccgaggatggtcagcagcttctcgttcgggatggtgatcagcgaatcgacgctctcggccagcgcgcggatgccctcgtcggcgatctgcatgcgcttgcgaccttcgaacgggaacgggcgggtcaccaccgcgacggtgaggatgcccatttccttcgccacttcggcgatgatcggcgcggcgccggtaccggtgccgccacccatgccggtggtgatgaagaccatgtcggcgccttccagcacttcggaaatgcgctcgcgatcttccagagccgcctgacgaccgacttccggattggcgccggcacccagccccttggtgacgcccgggccgagttgcagaacggtgcgcgccgcgatgttcttcagcgcttgtgcgtcggtgttggcgcagatgaactcgacgccctcgacgttgttcttggccatgtgattgacggcgttgccgccaccaccacctacaccgatcacttttatgacggcggtttgtgcgatgttatcgaccagttcaaacatttcccctctccttcctttctagttttgtcgcctactgttaccgcgttgaatcaaaaattgccctggacccagcgtttgagccgctccaggacaggtgccttgggttcgtcgctgctgtag

SEQ ID NO: 7785 - DNA, 2901 bp, Pseudomonas aeruginosa
cgaggctcgaccacttcggccagggcctggcgcgacagttcgcgcggcggccggtcgccgacgctgggcaccttgatggtctcgccggcaccggccagcttgggccagggcgcaggcgtagcggatcttgatctcttccgcgtactgggtcggcgtacgcagggccatggcgatgtcattggtgacctggtcgccggcgatcgggatcaccgcggtatggcggatcgcgccttcggtgaagatcgcgatatcggtggtgccgccgccgatatccaccaggcacacgcccagttccttctcgtcctcggtcagcaccgaataggccgaggccaactgctcgaggatgatgtcgtcgacctcgaggccgcagcggcgcacgcacttctcgatgttctgcgaagcattcaccgcgcaggtcaccacgtgcaccttggcttccaggcgcaccccggacatgcccagcggctcgcgcacgccttcctggttatcgatcacgtaatcctgggccagggtatgcagcacccgctggtccgccgggatcgccaccgcctgggcggcatccagtacccgttcgatatccgccgggttcacctcgcgatcgcggatcgccacgatgccgtgggaattgaggctgcggatgtggttgccggcgatgccgacgaacgccgagtggatacggcaaccggccatctgctgggcctcgtcgatggcgcgctggatcgactgcacggtggactcgatgttcaccaccacgcccttcttcaggccgcgggacggatgagtaccgatgccaacgacctccagctggccatcggccgtcacctcgcccaccagcgccaccaccttggaggtaccgatgtcgaggccgacgatcatcttgccgctctgcacgcttgccatggttattactgtctcctcaactcactgcacggcgctggccgtggccaccgtcgcgggcgtgaccggctcgcgccacgcaacggcgaggccgttggggtaacgcaggtcgatccgcgcaatgttcgaaatctgatctttgagtgccttgtcgtagatgcttacgaagcggcgaatcttgtctaccacgtggtcgcgcccgatctggatctcgacgccctgggccgtggtcagcgcccaaccgccgcgatcgctcatttccaggcgggcgatggagaacccgaggggacgcagcaactggctgagcaactggtattgctgcatcacctgctgttgcgcccgctgtggaccatgcaagcggggcagatgttcataattcgccagttcctttggcgtaaaagcctgtccctggttgttcagcagcgcttcgtcgccccaccgcgcgatcggcagttgctcgtccaggcggatcaccacctggtccggccacacccggcgcacctcggcgtgggcgatccagggcatctgttccagttgcccgcgcatgcccgccaggtcgatggtgaagaagctcgccgccaggtacggggagatccgctgctgcaccgcgcgctggctgatgtagctgaggtcgccctcgacactgaccttggcgatcggccggtcggcgtacggcaggatgtactcggcgccgcgataggcgccatagccgagaacggccagcaacagcggccaggccaggtacttgaggaaactgaagtcggctttcggcaggcgcacgctcagcggttccttggccaccagacggctggcgccgcgcggcatcggcttgcgcggagcgcggccgagtccaccgggttgctgatgacggagcagtacgccattcatggcttatcccctcgcctcgcggctatcggccaggatcgccagcaccagttgctggaaatccaggccggcggcccgcgcggccataggcaccaggctgtggtcggtcatgcccggtgcggtgttgacttcaagcagccagaaacgcccttcggcgtcctgcatcacgtccgcccgcccccagccctggatgcccagggcgtcgcaggcgcgcgcggtgagttccttcagctcgcgttccttggcctcgtcgagaccgcagggcacctggtagcgggtatcgctggccaggtacttggcgtcgtagtcgtagaaggtgtgcggcgtgcccaggcggatcgccggcagcacctgcccgcgcaaggtcgccacggtgaattccgggccgctgatccactgctcgaccagcacctgcgagtcgtagcgggccgcttcgcgccacgccgcgatcaattcgtcgagcccgccgaccttggccatgccgatgctcgagccttcgtgagccggcttgacgatcagcgggaaacccagtcgctgcgccgcttcgcggcagtcatcctcgctggccagcaccgcgtagtccggggtcggcaggccgaggctgagccagacccgcttggtccgcagcttgtccatcgccagcgccgaggccagcacgccgctgccggtgtagggaatgcccgcgcactcgagcaggccctgcatgctgccatcctcgccgccacgaccgtggagaatgatgaaggcacggtcgatcttctcctcgaccaggcgttgcagcaggtcttcgccgacatcgatgccgaaggcatcgaccccggcggccagcagggattgcaggaccatcgcgccggacttcagcgacacctcgcgctcggcgctcttgccgccgaacagcacggcgacacggccgaacgccttgggatcctgggtgccgttcagcaggctatcgaggcaaaggttcatgcgcccttccctcccttgccggcgaacagcgggttcttgatcagttgcggggccaggccgccgacatcgccagcgccctggcaaagcaggatgtcgccagcgcgcagcagcggcttgaccagcggcgccaggtcggcgtcgcgctcgaagtag

SEQ ID NO: 7786 - DNA, 516 bp, Pseudomonas aeruginosa
ctcgccgcgcaccggattgccggtggtcagacgcttgtcactggccgggaaggtatccgggaatgcctcgcagacgcgcctggcgatcggcgccaggctgcggttggcggtgccggccacggcgttctgctcgtggatcaccagcggcacgccgttgaggcgcgcagccaggccgcccgggccggtgacatagccacccaggccgagcacgcagaccggcctcagctggcggatcacccgcagcgcctggaacagcgacttgagcagttccagcggcgccttgaccagcgacttcaggcccttgccgcgcagcccgctgacctgaatcaggtgcaacggcaggccggccttgggtaccaggtcattctcgatgccgcgcggcgtccccagccagtgcacggcatagccgcgcgcctggaactcccgcgcacaggcgagcgccgggaacacgtgtccgccggtgccacccgccatgatcaggacattacctttcatcggcaaagtcctcttcgttga

SEQ ID NO: 7787 - DNA, 567 bp, Pseudomonas aeruginosa
acatgtccaggctcgcgcaggccggcgacaacagcaccgcatcgccttcgcgggccagctcggcggcctgccggactgcttcgtccagcgttgcgacgcgcaccagcggtaccgcgttgcccagtgcctgggcaatcagcccggcgtcacggccaagcagtaccaccgcccggcagaagcgcgcgaccggctcgcgcaggtcatggaaatcggcgcccttgccgtctccgccggcgagcagcaccagcttgccgtcgatgtcggcacccagcccctcgatcgccgccagggcggcgccgacgttggtggccttggaatcgtcgtagtagctcacgccctgccgctcgcgtacccactggcagcgatgagccaggccggaaaacgccttcagcgcgccgagcatggcgtcgaacggcaggccgaccgcatggcccagcgccagcgcggcgagcgcgttggaatagttgtgggcgccacggatcttcagttcgccaaccggcagcagcttgtcgaactggaacgccagccacttctggccgtcttcctcgatcaggccgaaagccttga

SEQ ID NO: 7788 - DNA, 1062 bp, Pseudomonas aeruginosa
cgaagagacggctcatctcagcttctccgccacgcgcatgaccgcgctgcgcgagcgcgggttggccttgagttcttcttccgaagcgtactgcggcttgcccagcagcttcaggcgcggctcgaagaccttggaacggatcggcaggtcgcgcggcaggttgtccgcctcgcccttggcgtgcttgcgcatgaacagcttgacgatgcggtcttccagggaatggaaactgatcaccaccagccggccgccgacggccagcgattcgagcgcggcgtcaaggccacgctcgagatcgcccagctcattgttcacatggatgcgcaggccctggaatgcgcgggtcgccggattcttgcccttctcccaggcggggttggcaaccgtgatcacttcggcgagatcggcagttcgttcgaacggccgctcctgacggcgctgcacgatggcgcgggccatccgcttggcgaagcgttcttcgccatattccttgaagacccgggcgatttcctcttcggtggcgttggcgatgaactccgctgcgctgatgccctggccgggattcatgcgcatgtccagcggaccatcgttgaggaagctgaagccgcgctcgggatcgtcgagttgcggcgacgacacgccaaggtcgagcaggacgccatcgacccgcccttcgagaccgcgtgcgcgcacctcatcgcccagttcggcgaacgagcgctgcacaatgacgaagcggccgtcttcggccgccaatgcttttcctgtctggatggcctggggatctttgtcgaatccgagcaggcgtcccccggcgcccagtttctcgagcaaggctcgactatggccccctcttccgaaggtaccgtccagatagcagccgtcctcccgcggggccagtgcggaaacggcctcctcgagcagaacggtgatatggcggtaggtggcattcatagtcaaaggatcaggtcgcgtagttcgtccggcagcccaccgggttgtttgattgccgccaggtcggcttcagccatggcgttccaggcatcctcatcccacaactga

SEQ ID NO: 7789 - DNA, 870 bp, Pseudomonas aeruginosa
cgggagcaggcgcgaagaacaagctcaactcttcccttggcgttgcaaagcctgttgatacaaaaggttttttcgcaccccggtaatttccgccgccagcgccgcggctttcttcaacggcagctcggcaagcagcaggtcgagcaccctgagcgcctccgcaccgatcgactcctcgccttccggcgcctgccaccccgccaccagcacaacgcactcgccgcgctgctggttgctgtccgacgcgacccaatcgtgcagttcggccaacggcaggctgcgaatggtctcgaaggtcttgctcagctcccgcgccagcaccgcacggcgctccccgccgaacacgtcgcgcatgtccgccaggctttccagcagacgatggggcgcctcgtagaaaatcagcgtgcgcggctcttcctgtaccgcctggaggcggctgcgtcgtcccgcagccttggcgggcaggaaaccttcgaagatgaaccggtccgacggcaatcccgccgccgacagcgccgcgatcagcgcgcaggagcccggcaccgggaccacccggatacccagcgcctgtgcctggcgcaccaggtggaagccgggatcggaaatcagcggggtaccggcgtccgagatcagcgcgacgtcttccccaccctgcagccgggagatgaagcgcccgccctcctcgcgctcgttgtgctcgtggcaggccgccaatggcgtctcgatgccgaagtgctggaacagccggatcgaatggcgggtatcctccgcagccaccagggccacctcccgcagcacccgcagggcgcgcgggctgatgtcgtcgagattgccgatcggggtcgccattacgaacagagtgcctgctga

SEQ ID NO: 7790 - DNA, 1836 bp, Pseudomonas aeruginosa
atgcgccatgagaagccctatatgatcgcttgcctgcgtccgctttctgctctgatcctggccggtctgctgaccgcctgcgcgacctcgtccaattccggactgggcgaacttccccgtacgccgaatgccagcatcgagcagttgttgcaacaggccagccagagcaagcccgaggaagcggcgctgctgcgcctctcggcagcggaccttgcctaccagcagaaggacctcgccaggtccaccgccatcctgggacagattccgctggaaagcctgaagccggcccagcaggtcttcgccagcaccctgaacgccgaactggccctcgcccgcagcaagcccaaggccgccctgcaggcattgcagcatccgagcatgcagcatctcagcgaactgccggtgacccagcaggttcgtacccagcgcgccaaggcccaggccctcgccgccgacggccaggtccttgccgcagccaaggagcgcatctacttcgcaccgctgctcgagggcccggcggtgatcgagaaccaggaaaagatctggaccctggtcagcagcctgccggtcgaccagttgcaaccgagcgccaacgaaggcgacctcagcggctggctgaccctggcacgcatcaccaagacctcgccgaccctgcagcaacagcaggccagcatcgagagctggcaacagcagaaccccgagcacccggcggccaagcacttgccggcggcgctggagaaactcaagacgctgtcccagcagccgctgacccgcatcgccctcctgctaccccagcaggggcagttggccaacgtcgcccgggccctgcaggacggcttcctcgccgcccacttccaggcccagcaggccggccagaatcctccttcgatcaagctctacgacagtacccaggtgcgctcgctagatgacttctaccgccaggcccaggccgatggcgtcgaactggtcgtcggtccactggagaagccgctggtcaagcaactcgccagccgcgagcaactgccgatcaccaccctcgcactcaactacagcgacaacagccaggaaggcccggcgcagctgttccagttcggcctcgccgccgaggacgaagcgcgcgcggtggccagccgggcctggggcgacggcatgcgccgggccgtggcgctggtgccgcgcggcgaatggggcgaccgcgtgttggccgccttcagccagagctggcagtccgcgggcggcagcctgatcgccgccgagcatgtcgaccagccggtacaactggcgcaacagatcgccgacctgctgcaactgcgccagagcgaaggccgcgcccagcgcctgcagggcgccctcggcagccagatcgccacccagccgtcgcgccgccaggacatcgacttcgtgttcctcgccgccaccccgcagcaggcccgccagatcaagccgaccctggccttccagtacgccggcgaccttccggtctacgccacttcgcacctctacaccgggaccaacaacccgacccaggaccaggatctcaacggcatccgcttctgcgagaccccgtggctgctcaaccccagcgacccgacccgccagcaggtcgccgcccaatggccccaggccaacggcagcatgggccgcctctacgccatgggcgtcgacgcctaccgcctcgctccgcgtctgcctgaactgaaggccgtgccgagcctgcagatcgacggcctgaccggtaccctgagcctgaatccgacccaacgtatcgaacgccagttgcaatgggccgagttccgcaatggccaggtccagccgctggggaccagcagcttttga

SEQ ID NO: 7791 - DNA, 762 bp, Pseudomonas aeruginosa
ttctctccgccgaactttttctgcaacaggaggcgcgctgggccaaatgcccctgtcgcttcgatgtggtcaccgtcgataccagcgacggacaatcaccaccgcgactggactggattcagaacgcattcgacgcctgatcagccgccccaccgaaggtcattaccgatggacatgcaacaccgtatccgccagctcttccaggccagcatcgagaccaagcagcaggcgctggaagtactgcctccctatatcgagcaagccagcctggtgatggtcaatgcgctgctcaacgagggcaagatcctctcctgcggcaatggcggctcggccggcgatgcccagcacttctcctccgaactgctcaaccgcttcgagcgcgaacgtccgagcctgccggccgtggccctgaccaccgacagctcgaccatcacctcgatcgccaacgactacagctacaacgaagtcttctccaagcagatccgcgccctgggccagccgggcgacgtcctgctggcgatttccaccagcggcaattcggccaacgtgatccaggccatccaggcggcccacgaccgcgagatgctggtggtcgccctgaccggccgcgacggtggcggcatggcttcgctgctgctgccggaagacgtggagatccgcgttccttccaagatcaccgcacgcatccaggaagtccacctgctggccatccactgcctctgcgacctgatcgaccgccaactgttcgggagtgaagaatga

SEQ ID NO: 7792 - DNA, 765 bp, Pseudomonas aeruginosa
gcacgatctgcccatcgctggcataacccggaggcacctttaccccggcgaactctgcgttcaccaggatatgtggcgtgcaatcgttgtcgacgatccattcatagagcgcgcggaccagatagggacggctggaattcatcttcatgttccttaacgcatatctcgttcaacggaagacaggctggcccggaagctttcccgggcgaatccgcgctccatgtagtcgagcaacggcttggcctgccgcggcaactcgatgcccagcaacggcagacgccagaggatcggcaacaggcagcaatccaccaggctgaaatcctcgctgaggaaatatgccttgtcggcgaacagcggggaaaccccggtcaggctctcgcgcaactccttgcgcgcctggacccgctcggcctccttgctgcgcgcatccaggatccggtccaccagggaacaccagtcccgctggatacgatggatcaacaggcggctgttggcacgcttcaccggataatcgggcagcagcggcggatgcggatagcgttcgtcgaggtattccatgaccaccgtcggctcgtacagcgccaggtcgcgatcgaccagggtcggtacgctgccgtaggggttgacctccgccagcatcggcggacagcggcccgcctcgatatcgatcacctctaccgccacgttcttctcggccaggaccaggcggatgcgatggcagtaatgatcggcagggtcggaatagcaggtcagcttgttgattga

SEQ ID NO: 7793 - DNA, 1512 bp, Pseudomonas aeruginosa
acaccagcttctccatcatcagatcggcaggaatgcccaggtcggtggcgacacgctcgtaacgctggaacttggcgctatggcagcccatgcagtagttggcgaaggtacgcgcgccatcctgcatggccgccttgtcggtcaggtcgatatcgacatgatccagttgcggcccatggccgccagcggcgaaacccaggactggcagtaccgccagaatcagtgcagcgaattgctttttcatcagccagtcaccctttccggaaccggtttggtcttctccatccgggtgtagaacggcatcaggatgaagaaggcgaaatacaggacggtgcaaacgcgcgacagggtagtacccagcgggctcggagcctgggcgccgtagtagccgaggatcacgaaggacaccgcgaagatcaccagccacagcttgctcagccagcccttgtagcggatcgagcgaaccgggctgcgatccagccacggcaggacgaacagcacagcgatcgccgcacccatcgccaccacgcccatcagcttgtccggaaccgcgcggaggatcgcgtagaacggggtgaagtaccagaccggagcgatgtgctcgggggtcttgaactggttggccatctcgaagttgggcttctcgaggaagtagccgcccatttccgggaagaagaagatcacggtgcagaagatgaacaggaacaccaccacgccgacgatgtccttcacggtgtagtacggatggaacgcgatgccgtccagcggtacgccgttctcgtccttcttcttcttgatgtcaacgccgtccgggttgttcgaaccgacttcgtgcagcgccaggatatgcagcacgaccaggccgagcaggacgatcggcagggcgatcacatgcaaggcgaagaagcggttcagggtgatgccggagatcaggaagtcaccgcggatccactgggccaggtcttcgccgaccaccggaatcgcgccgaacagggaaatgatcacctgggcgccccagtaggacatctgaccccaaggcagcaggtagcccatgaaggcctcggccatcagcgccaagtagatcagcatgccgaagatccacaccagctcgcgcggcttctgataggagccgtagagcaggccgcggaacatgtgcaggtagaccacgatgaagaacgccgatgcaccggtggagtgcatgtagcgaatgatccagccgtagtcgacatcgcgcatgatgtattcgacggaagcgaacgcctcttcggccgacggcgtgaagctcatggtcagccagatgccggtgaggatctggttgaccagcaccagcagcgccagggagccgaagaaataccagaagttgaagttcttcggtgcgtagtacttgctcagatggtcttcccacatcttggtcgcgggaaaacgcgcatcgacccaagccatgaacttgttcatcaggctttctcctggtccacgccgatggtgatgacgtcgtcagcatcgaacgtataa

SEQ ID NO: 7794 - DNA, 1074 bp, Pseudomonas aeruginosa
tttcacgaggacacccgcatggagtatcgcccgctcggccgcaccgatctgaaagtcagcgccctctgcctcggcaccatgacctggggcgagcagaacagcgagcaggacgccttcgcccagatcgccagggccaaggccgccgggatcaatttcatggataccgccgaaatgtatccggtgccgccccgcgccgagacctacgccagcaccgagcgcatcatcggcaactggttccgccgcagcagcgaccgcgccgactggatcctcgccagcaagatcgccggccccggcaacggcatcagccatgtgcgcgacggcaacctcaagttcaaccgccagcacatcgtcgccgccctcgatgccagcctggagcgcctgcagacagactggctggacctctaccagttgcactggccggagcggcggaccaacttcttcggccagctcggctaccagcaccaggaagagagcttcacaccgctggaggaaaccctggaagtgctcgacgagcaggtgcgcgccggcaagatccgccacatcggcctgtccaacgagacgccctggggcaccatgaccttcctcaggctcgccgaggagcgcggctggccgcgcgcggtatcgatccagaacccctacaacctgctcaaccgcagcttcgaggtgggcctggcggaaatcgccatccgcgagcagtgcggcctgctggcctactcgccgatggccttcggcatgctttccggcaagtacacggacggcgcccgcccggccaacgcgcgcatcagtctgtacagccgcttcacccgctacaccaacccgcaggcggaagcggcctgcgcgcgctacgtagcgctggcccgcgaacatggaatggaaccggcgcagatggcactggcctacgtcacctcgcggcccagaccgtgtaaaaacgcagcaagcgatggcgatcaactgctgagtgattttcttagtcccaggaggccgtgggaggctcaatcaggcgcaatcggtgattctgattgtatgggcacttccggcttcggcgcgcctgttgagagggggcaagagtcgtaa

SEQ ID NO: 7795 - DNA, 648 bp, Pseudomonas aeruginosa
cccggtggacggtcgcttccgcgccgccgcagagcgccacgtcgacctctcccgcgcggatcatccgcgccgcgtcgccgatgcctgcacgcccgccgcgcaggcggtcaccggggcgcccagcggtcccttgaagccatggcggatcgacacatgggcggccgccatgttgcagagaaaggacgggatggtgaagggcgacaggcgccgcggtcccttgccgtcggtggtccgcaccgcttcggcgatggcatggaagccgcccaccccggaggcgatgacggtcgccgtgcgctcctgcgcctcggcgctctgcggcgcccagccggcctgggccagggcctcttgcgcggcggccagggcgaagaggatgaagcggtccatcttgcgttgttccttggcggccagcagcaggtcgggatcgaagccggcctgcgggtcctgggcacggtcggggacctggccgccgatgctgatgggcaggtcgccgatcagctccgccgggagcgtggcgatgcccgattgcccggccagcaggcgttgccatatgggttcgactccgcagcccagcgggctgaccgcgcccatgccggtgacgacgatacgtttgctcatgagggtccgagtccttctgttccgttggaatag

SEQ ID NO: 7796 - DNA, 582 bp, Pseudomonas aeruginosa
cagtcagtggacgtaactatcatcatgaaagtaacatgcggaccagcactttgtgagcctcgccaaggaagaaccatgcaacgcaagaccttcgccgatgccgaatgccccatcgcccgcagcctggaacgggtcggcgaatggtggagcatcctgatcatgcgcgatgcgctacagggcctgcgccgcttcgacgaattttcccgcagcctggatatcgcgccgaacatgctcacccggcgcctgaacgcgctggtggaggcgggcctgctcgaacgccagccctacagccagcgcccgctgcgctatcagtacgtgcccacggccaagggcgaggattttcgcgtcgtgctcatggctttcgtcgcctggggcaatcgccactacgcagaggaagggcagagcgtgcagctcgtcgagcgaacaagcgggcggccggtgcgctcgttcatggcggctctcgccgatggccgaacggtaccgctggagcaatgcaccgtgcaggccgggcctgccgccagcgaggaaatgcgccagcgcctggcggccatgccggagcggagcgagctaccggctcgatga

SEQ ID NO: 7797 - DNA, 645 bp, Pseudomonas aeruginosa
accccgcctggccgccctgcgtcccggcacctggctggtcaacgccagccgtggcgcggtggtcgacaatcaggccctgcgccgcctgctcgaaggcggcgccgacctggaagtggcgctggacgtctgggaaggcgaaccgcaggccgaccccgagctggccgcgcactgcctgatcgccaccccgcacatcgccggctacagcctggaaggcaagctgcgcggcaccgcgcagatctaccaggcctactgcgcctggcgcggcatcgccgaacgtgtgagcctgcaagacgtgctgccggaaacctggctcgccggcctgcaactcaaccccggctgcgacccggcctgggcgctggccacgctgtgccgcgcggtatacgacccgcgcagcgacgatgccgccttccgccgcagcctgaccggcgacagcgccacccgccgcgccgccttcgacgccctgcgcaaacactacccgccgcgccgcgagatcaccggcctgcgcgtcgccaccggtggacgggcggagttgcagcgggtggtgcgggcgctgggggcgcagttggtctaggagcgtgcggctgggtcgattcctgtctccgcacctacccgagcaactgctcaggcgtctcctgccgccgatag

SEQ ID NO: 7798 - DNA, 633 bp, Pseudomonas aeruginosa
ccagagccgcgcggcagggaaagcgcgatctccgaccggctggtcgagcccggcgcagacgcttatgctgggtggccagacagcccagggatgaccgcaatgaccgccgaatcgccgacgatccgcctcgaacgctacagcgaacgccacgtggaaggcctcaccaccctgtacaacgaccccgccgtggcccgccaggtcctgcagatgccctaccagtcggtggagcagcgccgcaagcgcctgcacgacagcgcggacgacgaccgcctgctgatcctcgtcgccttgcaccagggggacgtcatcggcagcgccagcctcgaacagcacccgcgcatccgccgcagccacagcggcagcatcggcatgggcgtcgccgtcgcctggcagggcaagggcgtcggcagccgcctgctcggcgaactgctggacatcgccgacaactggatgaacctgcgccgcgtcgaactcaccgtctacaccgacaacgccccggcgctggcgctgtatcgcaagttcggcttcgagaccgaaggagagatgcgcgactacgcggtgcgggatgggcgcttcgtggatgtgtacagcatggcgcgcttgcggagggtcgaggggcgggtgggggaatga

SEQ ID NO: 7799 - DNA, 1050 bp, Pseudomonas aeruginosa
ctccgttacgggggaatgagtgcacaatacgcagaaatttccctatctcagagatcggaatctctcgtttcattgcctgattctatgagcgcatcactgcctgattcagaagccatccgctccgccgaccgacagcgcatggtcgcgttgctcgaaaacctggcgccccaggagggctacaacctcaccgggctcgactgcgtccgcctgctgcgttcggatcgtccgctggcgcggacgccggtgctctacgatccggggatcgtcatcgtttgccaggggcgaaagcgcggctatttcggcgagcagatctacctgtacgacgagcagcactacctggccgtggcggtgccggtgccgttcaccatggagaccgatgccacgccagagcgaccgctgctggcgatctacctgcacctggatttcccgctggcggccgggctggcggtggagatcgaccgtcagcgcgcgcttgcgcaggtcgaagcgccgcgcagtctgatgtccagccctatggacgcgccgctgcgggcatcggtgttgcgcttcctggaggcgctgggcgatccgctggagacagcgatcctcgcgcctgcgctactgcgcgagctgtacttccgcgtgctcaccggccctcagggcggcgccatgcgcgcggcactggccatgcgcgggcgcttcggcaacattgcccgggcgctgcgccgcatccacgcgcaatacgccgagccgctcgagctggcgcaactggcgggcgaggcggggatgagcgtgccgtcgttccacagccacttcaaggcgatcacccagacctcgccgatgcagtacctgaagtgcacacgcctgcaccaggcgcgtctgctgatggtgcgccagggcatgagcgcccaggccgcctgccatgcggtcggctacgccagcgcttcgcagttcaaccgcgagttcaagcgtctgttcggccgttcgccactggtcgaggcccggcgcctgcgcgcgggattctcgctgccgccggcgcaggggggagaggagtacgtgtcgtcgcattag

SEQ ID NO: 7800 - DNA, 651 bp, Pseudomonas aeruginosa
tcatccgctgtttcgcgagggcatgctgagtatcctccagcgcctgctgcccgaggccaggatcgaggaggccggcgatctcgccggggtcctgcgcctggctggcgaaggcgagcagcccgattcgctgatcctcgacctgcgtttccccggcctgacccgcatcgagatgctcgccgacctgcgccgccagttcccgcgcaccaccctgatcgtcgtctcgatggtcgacgacccgcagctcatcggcgaagtgatgaacgcaggggccgacggcttcctcggcaagagcatcgcgcccgaggaactcggccaggcgattctggccatccgcgccggggaagtgctggtgcggtacgaaccctccggcctcctgccgctgcagcccagcccgggcctggaggggctcaccgagcgccaactggatgtcctgcgcctgctggcccagggcaagagcaacaaggagatcggccgcgccctggacatctcccactacacggtgcgcatccatgtgtcgtcgctgctgcgggcgctggacgtgccgtcgcggaccgcggcggcggtgaagtatcgggcgctgctggggcagggggatgcggagtagcaccatgggcacgccgcgggtgcgccgaggcgccggggctgttttaa

SEQ ID NO: 7801 - DNA, 375 bp, Pseudomonas aeruginosa
tggcgcactctccatggccaaggaaacggacacatgcgtagcccgcttgccacgatcgcctgcgcctgcctgctgctcggcggctgctccaagtccgccgaggacagcgccaacccattgctgggcaaggatgccgagtgcctcgaactgttcgcccgcagcaatgcgctgtactgcgacatccgcgaggacgaacgcgaatcccaggcgaacggtacgccgcgccggcacaccgactacgaggtagccgatgccgcctacctgctcaaggccaccggggagcgctgcgcgatcgatacgacctatgtcacggagtgttcggcgaaggccgggcagtggctgcagaaggcccgcgccaaggcggtgaagccctag

SEQ ID NO: 7802 - DNA, 1023 bp, Pseudomonas aeruginosa
  unsure (294): Identity of nucleotide at the above locations are unknown.
tcgcagcgcccgcgctcagcgcaggcgcgtcgccagctccgccagttcgccgcgcagccagaggctgccggcttcgtcgtcggcctggcgcgaccagtagagattcagagtcaccgctggcagggccagcggcatcggcagcaggcggttgcccaggccgcggttgatcaggtcggcgtagcctcgggtcagggtcagcaggtagccgccctgggccaccagcaacgccgccgacaggtagtgctggcagcgctggcgcacctggcgggtcaggccgaggtggccgagggccangtcttcgatgcagatgccgcgtcgccgcgaggtcaccgcgacatggtccgccgccaggtactcctccgcactcaggtcgccggcgaagcccggcccggccatcacgcacaggctgtcgtcgagcaggtgctggcggcgcagggcggcgtcggtgggccgggcgatctcgatggcgaggtcgatgcgtccggcgcccagttccgccttcaggtccgcccagtgcaggctgttgcagcgtatctcgatgcgtggcgcggcctggcgcaggtgggcgaggatcgccgggagcaccagcggctccagttgctccggcatgttcagttggaaggtccgcgcgtcgcgccgagggtcgaacgtctggcagcgattcatgctgcggtgcaggccggcgagggcgtcatggatgcccggcgccagtcgctcggccagcggcgtcggcgcaaccccgcgcccctggcggacgaacagcgggtcgccgagctggtcgcgcaggcgcgccagggcgtggctgacggccgactggctgagatgcaggaggcccgccgcgcgggtcaggttgcgttctcgatagaccacttcgaagacccggaacaggttcagatcgaaacggctgaggggcgaccattcatgtggctgattcatgtttgcgcgcgcctgtctggggaaggcgccagcctagcaggcatgctcgccgatagaaccatgcataggcttcatggatggcgatga

SEQ ID NO: 7803 - DNA, 3351 bp, Pseudomonas aeruginosa
ccaacgcgccgccgggccagctcctttcgccggccgcctgacccgctccccggagaacctgccgtgaccgctcccttcaacgccttgctgatcgccaaccgcggcgagatcgccattcgcatcgcccgcgcctgcgccgacctgggtatccgctcggtggcggtgttcgcggaagacgatgccgcgtccctgcacgtgcgcaaggccgatgtcgcgctgccgctggccggccgtggcgtggcggcctatctcgacatggatcggctggtcgcgctggccctggagcagggctgcgaggcgatccatccgggctacggttttctcgccgagaacggcgaattcgcccgtcgctgccagcgcgcgggcatccacttcgtcgggccgcaagcggaagtgctcgacctgttcggcgacaaggctgccgcgcgcgccctggccgagcgcctggaggtgccgctggtggccgggatcaaccgtgcggtcagcgtcgaagaggccgaggcgttcctggaagggctgggcgatggcgccgcggtgatgctcaaggcccttgccggcggcggcggacgtggcatgcgcgcggtggaggaggttgcgcaactggccgatgcctaccgccgctgccgtgccgaggcgcaggcggcgttcggccgggacgagttatacgtcgagcaacgggtagcgcgggcgcggcacatcgaggtgcaggtgctcggcgacggcagcggtgcggtcagccacctctgggagcgcgattgcagcctgcaacggtgccagcagaagctgctggagatagcccccagcccggacctgccggaggccactcgcgaggcgctgatcgattgcgccctgcgcatggccggcgcggtgcgctatcgggggatcggtaccttcgagttcctggtcgacgacgagcgccccgggcgcttctatttcatggaagccaatccgcgcatccaggtggagcacaccgtcaccgaggaagtcaccggggtcgacctgctgcacgcccagttgcgtctcgccgccggcatggagcttgccgccctcggcctggagcgaccgccggcgatcggcggctgcgcggtgcaactgcggatcaacctggagaccctggcggccgacggcagcgcccgtccggcggtgggcactatcggcgcctacgaaccgcccagcggtcccggcctgcgggtggacggctacggctatgccggctatcgggtcagccccagctacgattcgctgctggccaagctcgtcgtgcgtggtgcggattatcccgccgcgttgcgccgggcataccgggcgctctgcgaattccgcctggagggcgtggcgagcaacctggatctgctgcgcaaccttctgctgcatccggcggtacaggccaaccgggtcgacacccgcttcgtcgaaagccacctggagacactgctggcgcctatcccggcgagccatccgcggctccgcgccgagtgcccgctcgccgaggacgccgcgcctgcgcgggtcgaggcgccactcggcagcctgccgctgtctgcgccgagcagcggggtgctggtggccctggaagtgggcgatggcgaacgggtgcgtgccggccagcgggtcgcgatcctggaagcgatgaagatggaattcgaggtcaaggcacccggcggcggtatcgtccggcgactcgcggcgagcctcggggagcctctggaggagggcgcgacgctgctgttcctcgaaccgacggaggatgacgacgagcaggcaccgaccgaacaggcgctggacctggcgcatatccgcgccgatctcgccgaggtactcgagcgccaggcagcgctgggcgacgagcgtcgtccgcaggcgctggccaggcggcgcaagaccggacagcgtaccgcgcgggagaacgtgctcgacctgctggacgagggcagcttcagcgaatatggcggtttcgccctggccgcccagcgtcgccggcgctccgccgaggagttgctggagctgagccccgccgatggcctggtcgccggcaccggtacggtgggggccgccagcttcggcgcgcaggccgcgcgttgcctggtgctggcctacgactacacggtgttcgccggcacccagggggtgatgaaccacaagaagaccgaccgcctgctcggcctggccgaacagtggcgcttgccgctggtgctgttcgccgagggtggcggcgggcgcccgggcgataccgatttcgtcggcgtcgccggtctcgattgccataccttcgtcggcatggcccggctctctgggctggtgccgctggtgggagtggtctccggtcgctgcttcgccggcaatgccgcgttgctgggctgctgcgatgtgatcatcgccacccgcgacgccaccatcggcatggccggcccggcgatgatcgagggcggcggcctgggccgtttcgccgccgaggaggtcggtccgacgggcgtgcaggggcccaacggagtgatcgacgtactggtggaggacgaggccgaagcggtcgcggtggccaggcgctacctcggctatttccagggcctgctgcccgactggagttgcgccgaccagcgcgagttgcgccacctggtgccggagaaccgcctgcgtgcctacgacatccgccaggcgatcgaggtcctggccgaccgggacagcgtgctggaactgcggcgccagttcgctcccggcctggtcaccgcgctgctgcgcatcgagggccgggcgttcggcctgatcgccaacaaccctggccatctcggcggcgccatcgatgccgcggccggcgacaaggccgcgcgcttcatgcagttgtgcgacgccttcgacattccgatcgtctcgctctgcgacacccctggcttcatggttggcccggaggcggaaaaacaggccacggtgcgccacgtctcgcggatgttcgtcagcgccgccagcctgacggtgccgttcttcaccgtggtcctgcgcaagggctacggactgggtgcccaggccatggcggcgggcagcttccattcgccgctgttcaccgtcgcctggcccagcggcgagttcggcgccatgggcctggaaggcgcggtgcggctgggcttcgccaaggagctggcggccgaggaagactcccagcggcgcgaggcgctgttccgtggcatggtggacaaggcctaccgcaacggcaaggcgctgaacatggccagctacctggagatcgacgcggtgatcgacccggcggagacccgcgcctggctcctgcgcggcctggccgtcgccggagaaccggcgccgagggcggggcgcaagcggccgttcgtggatacctggtag

SEQ ID NO: 7804 - DNA, 702 bp, Pseudomonas aeruginosa
gcgcgtaagtgcgtggacctagaatgcgacggattcatcgcattccgccattcgcattccggagccttccatgagcgacaagcgaaacccgctatttcctcgcgcaagcagccgcagcaggcccgttccagcgagttggtggcgagcatcctggaggcggctgttcaggttctggccagcgaaggcgcgcaacgtttcaccaccgcgcgggtggcggagcgcgccggggtgagcatcggttcgctgtaccagtatttcccgaacaaggcggcgatcctcttccgcctgcaaagcgacgagtggcggcgcaccacgcgtctgctcggcgagatcctcgaggacaccgcccggccgccgctggagcgcttgcgccggctggtgctggcattcgtgcgctcggagtgcgaagaggcggcgatacgcgtggcgctgagcgacgcggcgccgctgtatcgcgacgccgacgaggcgcgggaggtgaaggcggagggcgcgcgggtgttccaggtgtttctccgggaggccttgccggaggtcgccgaggccgagcgcagcctggccggcgacttgctcaccaccaccctcggcgcggtcggcaagcagttctccgaacagccgcgcagcgaggcggagatcgagcgttacgctgaggccctggccgatatgctctgcgcctatctcgccgcccttgacgagcgctga

SEQ ID NO: 7805 - DNA, 1989 bp, Pseudomonas aeruginosa
ttcagccacatgctttgtctggaccggaccccgatgctgtctgccgtacggcgctacaagtcgatgctctccagcgccctggcgcgttgtttcccgcgtaccaccgcctacctgcaggccgagcgcgaggctcgcgaagccttgttgcagccggccaaggcccgctccaggaagaacgccgcgaaggctccggccaaggccgccggcaagcctgcgaagggcgccgttcggggggccccacgcaagcccgctgccgcctcgcggcgcgcgccgcagggaatctatccggctgccgcactgaaggtcgacgaatcccaggagcgcgccatgcgcgagcaggtggcgcaggccgtgacgctcggtgtggtcagcccgccgtccgaggaacagtgggcgatgatcctctgccgccagccgctggcgcggatcttcgccggtgccggctcgggcaagtcgaccaccctggtcctgcgggtggtgttcatgctctgccacctgggcgtcgagccgcagcggctgacagtgatttccttcaccaacgcctcctgtgcgcagttgcgcgaacaattgctgcggctgctcgcgcactggcagtacccgttcgacgcggcccaggcgcggcagtgcgtgcgcactttccattcggcgctcggcagcctggcccgcgaggtgctcggcaatccgcgctggttcgaacaactggacgaccgcgaccccgccgccgagccggacaacccccttgccgccggacgcctgcgtccggcccagcagcgcctgctgaagcaggcctaccagcagtgttacgcgcaaagcccggcgttccgcgccaagatccacaagctgctggaactgccgccgccggcggagccggaagagggcgcgcggcggcagccgaaggcgccgctggagccgttcaagctggccggcgagttccaggcgctgccgctgtacgaagccttccatgcccaggccgggttcgccgagagcctgggcctgcgcgtcgaacgcctggacagcggcaagctggaatgcgggttgcgcgagaagatcttcgtcgaagccatggcactgttctgggcgaggttccaggcgctgttgcgcgaggagggcctgatgaccttcgacgccgcgttccagcagctcggcgagcggatggccggcggggccctggcggaaacggcgctggcgccgttcacccatctgctgatcgacgagttccaggatgtctcgccgcagatcgtcctctggctacaggcgttgcaccgtcgcctggcgacccagggcaccgcgccgagcctgatggccatcggcgacgactggcagtcgatctacggctggcgcggcagttcgccggagctgttcatcgacttcgaccggcacttcccctcgcgtgggcggggacgcaagagcgcgctgctggtgctggaaaccaactaccgctccgtcgaaccgatcattcgcgacggcgagaaggtgctggccggggtgcgtttcaagcaggacaagacctgccgcgcgttccgcccgatccagccgggcgaccatggcgtgaagctggtgcagcgtttcgacctgcgtgcgcaactgccgaagctactggcggaaatccgcgcccagagcgagcacgccgccgctcgcgagagcagcgagcgcaccgcggtgctgttgctgagccggcgcaacgagccgttgcaggcgatccaggcggagttggatcgcgcgctgccggtgaagggcatgaccatccatcgcgccaagggcctccaggccgaagtggcgatcgtcgtcgacgactgcctgccgggcgagaagcatccgttgcgcaacgcgctgtacgcggcttcgggtttcttccgcaacagctacgaccaggccatggaggacgaaagcctgcgcctggcctacgtggcgatcacccgtggcgtcagccgggtgctctggtacacgcgcaaggcccagggcgccacggccctgttggcccgacgctga

SEQ ID NO: 7806 - DNA, 606 bp, Pseudomonas aeruginosa
agccatcgggcatgtccatgccgacagcctagcgacacgccgcccgcgcgtcgatcagcctgcgttgcggaacagcagcgccttgaggcccgccgcggggtcgacatcggggaactccggcggattctccaggcgttcgacgaagtgcagcgacggcgcctcgcgggcggtttcctcgaggaggaagtcggggccgatggccgggtcattgatacaggccagcagggtgccgccgggcaccagcagttccggcaggcggcggaggatcctgcggtagtcctgggtcaggacgaagctgcctttctggaagctcggcggatcgacgatcaccaggtcgtacgggccgagcttgcgcagcttgccccaggacttgaacagttcgtggccgaggaagctcacccggccgaggtcgtggccgttcaggcggtgattgtcgcggccgcggttgagcgggccgcgggccatgtccaggttgaccacctggctggcgccgccggcaatggccgccaccgagaagccgcaggtgtaggcgaacaggttgagcacgcggcggccggcggcctgctcctgcacccagcggcggcccaggcgcatgtcgaggaatag

SEQ ID NO: 7807 - DNA, 2661 bp, Pseudomonas aeruginosa
cggacagtccgccccttcgcttcaatcgggcgtcgcgggcgcaggcgcggcgctggccgggccgccatcctggatcatcagcaggctctgcggcgaggacagcgcgatgccttcgctgcgcaagcggtcgaggatggtgaagagcaggtcgctgcgcgcgccggccaccgaacgcgggctgttgacgaagccgctggcgttgagcaccaggccgttgctggcgagatccttgaacgtcaccgagggcgccggcgcgtcgaggatcgccgggtgttcggcgaaggcctgcaagagcagttcgcggaccttcatcgcgtcggtgtccagcggcagggtcaggttcaccccgaccaccccgagggcattgcccatggtcacgttgcgcacggtctgggagatgaactgcgagttcggcacgatcaccgtggagcggtcgcccatctggatctcggtggcgcgcacgttgatccgccggatatcgccctcgaccccgcccaggctgacccagtcgcagactttcaccggccgctcggtcagcaggatcaggccggaaatgaagttctgcacgatggcctgcaggccgaagccgatgcctaccgagagggcgctgaccacccaggtcaggctggtcaggttgatgcgcagggtggacatcaccagcatcgccaggagcacgaagccgaggtagccgaccagggtcaccagcgaggcgcgcatgccggcgtccatgttggtttccggcagcaaccgctcgctcagccagcgcttgacgatgcgcagggcgaacaggccgccgacgaacagcagcagggcgaccaggatgtcctgcgggacgatgttcaggttgcccagggtcctgctgctttcgcccagttgggcgaagccctgcagcagttcgctggggctcgagccgaccggaaggaaggccagcagcagcgcggtgagcagcagcagggtgcggccgaccccggccagcaccgtgctggcctgggcctggtggcgcggcgacaggccgagcgcattggccagcgccaggccgctgggatgcttgggcgagagcagggtttcgcagatgtcgccgaagaaagcgatcagcaggtaggtggtggccgcgatcacgctgatccacagcagcttgccggtgaggaagtaggccagcgacaggtagccggtgaacagggcgaggaggatcgctgcgatccataccgaggcgacgaaggggatcagcccggcgatcccgcctggccgctccaggtcgtgcttgcgccgcacatggtggtagcgcagcagggcggcggcgaagatcagcgcggtgaccagcgcggtcaggccgttgagggcgacggtcagggccaggctggtgccggtgacgctgttgatccgttcctcggtggccaccagcatcagcgccaccgcgaggatcgccgggaacgggccgagggcgctggcgatcctgtccgggatcgccggcagccgccaggatggtcgcggcagcatcagcagggcgcggccgaggccggcgatgaaggcgcagaaggtcgccaggctcaccagttgatcggtcaggctggccatgtcggggctcaggctggcgttgctttccaggccccagcgcatcagcgacaccgcgccgacgatggtcaggatggtcgccagcccgaccgccagggccagggcgctgcgccgcaggcggccttccggcagccagcggatcatcgcccaggtaagcatgcgctccagcaggcggcggccgaagctccagaccagcacggtggccagcagggttccggcgaaggcccagcggtgtccgggcgcgatggcgctgtcgaaggcgaccagggcctccgccttcagcttgtccagccggcgcaggtcgtcgtcggtgggacggatcagggtcgaccagaagctcgggctgaacggtgtcgccgcgcggctgctgatctgcgagttgaacaggctgcggcgcaggttgacgatctgtgccgccaggtcgcgggacgactggccgagctgggtggcctggcgttcgtcatcgagcagggcgttcttctgccgggtcagggcctggcgctgggcggcgaggctttccgcctcgtcgggctgcggcgggccgatcactttcaactgatcgtcgagccgctcgatgtcggccacccgcagcgcgagcagggcgtcggcctggcgctggacttgcagcgcgctctggcgcaactcggcgaggaggtcgtcgctggcgtcggcggtgacgcgctggcggatcaggtcgagttgcgcgttgagctggtcgaggctggcgtcctcggccagggcggccggcgcttccaggtcgacggccgcctgcggagccggcctggcggcccaggcctcgctgcccaggctcaggagcaggcccagggccatggcgaactggcagagcaacatatgcaggctggcgcgcctcatcgaatccccctttcgatcctgactggctcaagcagtatggaccggcgcgggcgccgagtaattccccgcgtcgataatcgccaggcggcgctaaagggacatggattttggccatatcgatccctttttggccgccgccgccgttttgccgcgaccgcgcgctgggcagaatccctccaccaagaacaagaaacctgcgaggtctctccatgctga

SEQ ID NO: 7808 - DNA, 426 bp, Pseudomonas aeruginosa
ccgcccaggaacatatgcgccagggcgcccgcagcgccttcgccctctgccgtccgccgggccatcacgccggtggcgacttcatgggcggctactgcttcctcaacaatgccgccatcgccacccaggcgttcctcgaccagggtgcccggcgcgtggcgatcctcgatgtcgactatcaccatggcaacggcacccaggatatcttctaccgccgcgacgatgtgctgttcgcctcgatccatggcgatccgctggtcgaatacccgtacttcctcggctacgcagacgagcgcggcgaaggcgccggcgagggctgcaaccacaactatccgctggcccatggcagcggctgggacctctggtcggcggcgctcgacgacgcctgcgtgcggatcgccggctacgccccggatgccctggtga

SEQ ID NO: 7809 - DNA, 1302 bp, Pseudomonas aeruginosa
tttcccttggcgtggacacctacaaggaagacccgatctcccagttcaagctggattcgccggactacctgcggatgggcgagcgcatcgcccggctgggcctgccgaccctgttcatcatggaaggcggctatgcggtggaagccatcggcatcaacgcggtcaacgtgctgcagggctacgaaggcgcggcccgctgaggagcgaagcatgcaatcgactcgcaagctgctggccggcctcgcgctggccgtttccgccgggctggttcaggccgcgccggaagtacggatctacaactggttcgactacatcgccccggacaccctgaagaacttccaggcgcagaccggcatcgcgccgaagtacgacgtctacgacagcaacgaggtgctcgaggccaagctgctgtccgggcattccggctacgacctggtggtgcccagcgacagcttcctgcccaactacctgaaggccgaggtgttccagccgctggacaagagcaagctgccgaactggaagaacctcaacccggccctgctcaaggtgctcgccggcaaggaccccggcaaccgctacgtgatgccctacatgtggggcaccaacggcatcgcctacaacctcgacaaggtccgcgcggtgctcggcgacgatgcgccgctggactcctgggacctggtgttcaagccggagaacctggcgaagctgcaacagtgcggcgtggccttcctcgactcgcccaccgaggtgatccccgaggtgctgcactatctcggcctgtcgcccaacagccaccagccggaagactaccgccgagccgaggagcacctggcgaagctgcgcccgtacatcacctacttcagttcctcgaagttcgtcagcgacctggccaacggtaacgtctgcgtggccatcgcctggtccggcggagcgatgcaggcggccaaccgggccagggaagcgaagaacggcatacgcatcgagtaccgcatcccgaaggagggcgccgcggcctggttcgacgtgctggcgattccgcgcgacgcgaagaacgtcgagcaggcgcacgccttcctcgactacctgctgcgcccggaggtagtggcgccgatctccgactacgtggcctacgccaacccgaacaaggcggcggacggcctgatctcggcggagttgcgcgacaacccgaacgtctacccgccggaagaagtgcaggccaggctgtattcggtggaaatgctgccgccgaagctggagcggctgcgcacgcggacctggagcaagatcaagaccggcaagtga

SEQ ID NO: 7810 - DNA, 1122 bp, Pseudomonas aeruginosa
gcggccgcggccagatggcgggttcgcaggacggatagcgtcccccaggccaggccaggccaggccaggcaagcaggccggaaccgccgcccacggcccgctggaggtcgcttccaggcttcgaccgggcgcgccggcttgtccataatggcgctgcccgacggtcgccgctggcggccgcttccttccatgcctgcctgtgagtccgccatgcgtaagtccgccgatgccttcgccttccagaccatgctgttgctctgcgtgatctggggcatccagcaggtgaccatcaagtgggcggcgacggacatcgcgccggtcatgcaggcggccatccgttccggcatcgccgccgccctggtcggcctgctgatgtgctggcgcggcggctgggagggcttgcgccagggcaccctgggcgccggcctgctgaccggcacgctgttcgccctggagttcctgttcatcgccctcggcctgcaatacaccacggcttcgcacatgtcggtgttcctctataccgcgccgatcttctctgccctcgggctgcacttcctgcttcccagcgaacgcctgcggcccttgcagtggctgggcgtggcggtgtgcttcggcggcatagcggtggccttcggcggaggcctgtcgtgggcggaaatggatgggcggatgctgctcggcgacgctttcggcctgctcgccgggatgtcctggggcgcgaccacggtggcagtgcgcggcacccggctgtccgaggcaccgccaagcctgacgctgttctaccaattgttcgtggcatgcgccgggttattgctgatcgctcttttcagcggccagttcggcgaggtccgctggaccccggtgagcaccgccagcgtgctgttccagggcgtggtggtgtcgttcgccagctacttctgctggttctggctactgcgtcgctaccaggcgaacaacctggcgatcttctccttcatgacccccctgttcggcgtcaccttcggtgtattgctgctgggcgagccgctcagcctgaacttcgtcgccggcgcggcgctggtcctcgccggcatcaccctggtcagcggcgagcagtggctgcgacgcctgctgcgacgctga

SEQ ID NO: 7811 - DNA, 912 bp, Pseudomonas aeruginosa
ataatcgtgaattacttgttctgttttggagaattaatcgtggagttcggccagttgaggattttccaggcggtcgccgaggaaggctccatcgcccgcgccgccgaacgcctgcaccgggtgccgtcgaacctgtcgacgcgcctgcggcaactggaggaacagcttggcgtcgacctgttcctccgcgaacgccagcgcctgcaactgtcgccggccggcaaggtcctgctggactacgccgcgcggctgttcgccctgcaggaggaggcgcgcgcggcggtgcaggggggcgaaccggtgggcgacttcgccctcggctcgatgtacagcaccgcggcgatccacctgccgccgcgcctggcggaataccaccggcgctatccggcggtgaacctgcaattgcagaccgcgcccagcggcgagctggtcgagtcgctgctgggcgggcgcctggatgccgtgctggtggacggcccgctggacttcgacggtctggagggcctgccgatgttcgaggagcgcatggtgctggtcaccgagaatggccacccgccggtgcgcggtcccgaggacgtggccggcagcgcggtgatcgccttccgcccgcgctgctcctatcgcctgctgctggagtcctggttcgccagcgcgcgggtgagcatgggccgggtgatggagatcgagtcctaccacagcatgctggcctgcgtggtggccggcggcggggtggcgctgatgccggtgtcgatgctgcaaagcctgccggggcgggagtcggtggcggtgcatgcgctggccgaaccgttcgcccgggcgaatacctggctggtctggcgcaagggcatggtcggcgccaacctgaaggcctggatcggtctcctgcaagggcgggaatcggcgttggcttga

SEQ ID NO: 7812 - DNA, 429 bp, Pseudomonas aeruginosa
acgctgccgtcggcgagtaccgcttccaggccgagcacgcgctggcgcatggtgccgaagcggaaggcgcggatgccgccggcgttggtcgcgaccagcccgccgacgctggcgctgccgcgcgcggcgagatcgatgccggggtcgagtccggcctcggcggccagcgcctgggcctgttcgagggtgacgccggcgtcgaggtcgagggtctggctggccgcatccagccgatgtatgcggttcagcctgcgcagcgagagcagcacgtcgccggcttgcgcggcgccgccgccgaccaggccggtgagtccgccctggggtaccagggcgcgtcccgcctggcggcacagacgcaccacggcggcgacctggtcggtgctttccggcaggaccaggaagcttccggcgaggttctgcggatggtag

SEQ ID NO: 7813 - DNA, 498 bp, Pseudomonas aeruginosa
accagcggcgcggctcgtcgagatcgaccaggtggttgccgctgtagacggtctgggtcgagtcgccgacgaagcgggcgtccggccactcggcgaggatcgcggcgaacagctggcgatagtgcgaccagccggcgaagtcttcggccaggcgctggcgcacggcggcggcgcgccgggccccggggctgtccggcgaggcctcgccgcccggcagttcggccagcagcacgcgcatggccagccgggcgtcgctgtggatggccaggctcggcgtgtagttgcgcatcagttgctgcgggtcgatgtcgatgcggatcaactcgccatcgagggcgaagccgccgtcgaacaccacgtcgtagtcggtttcgcccagctcggtgccgatggccagcaccacgtcggcctcggcggccagctcgcgtaccggcacgcaggactggttgctgcccagcagcagcgggtggtcggccggtagcaggcccttggcgttga

SEQ ID NO: 7814 - DNA, 3342 bp, Pseudomonas aeruginosa
  unsure (1036): Identity of nucleotide at the above locations are unknown.
ccgtccgccatgaagccggcgcccctgctcgtggcgcggggtgacatggcggatacggctgccgggcaggccgcgatagagctctacggtatgcacgccggggatgccgaagacggtctcgacgccccaggcttcgagttgcttgacgaggaattcgccgcaggtggtcatggccgttcctttttcatgttctcgggaatggaaaaggcgagggaaagtccctcgcctgtcggggttgtgcctggttcaggcggcgctggcgacacccgtcgggcgccgcgagaacaggctgaccaggacgaagctgagcaggccgaccgccaggctgtagtagatcggcgtattggcgtcgaggccgtccttgatcatgaacaccagtacggtaaggaagcccagggtcatgctggtgatggcgccggcggtggtggcgcgcttccagtagatcgcgccgatcagcgggatcagcatgccgcctaccagcaggttgtaggccacggtcagggcgctgatcacgtcgctgaccaccagggcgatgccgagcactaccaggcccagcagcagggtcgcgatgcggttctcgtgcacgtcgccgttgtcggactggccgcggccgcggcgcaggcgcggcagcaggtcctgggtgacggtggtggacgccgccagcaggccggcgctggcggtggacatcagcgccgccagggcggcggcgatgaccaggccgcggatgccgttcggcaggctgtgctcgaccacactggcgaaggcgttgttgacgttctccaggtccggcagcaggaccttggcggccatcccgatcagcgccccggccatgccgtagagcacgcagtagataccggcggcggagccggcgaccttggccacggtctcgctgcgggcggtgaacacccgctgccagatgtcctggccgatgaagatgccgaagaagtagatcaggaagtaggtgacgatggtgtcccagccgatcgcggtgaagtcgaagtagctggccggcagcttggctaccagggcgtcccanccgccggcgtcgttgatcgacagcggcatcagcaggaacaccaggccgacggtcatgatcaggaactgcacgatgtcggtcagggtcagcgaccacatgccgccgatggtggagtagagcaccacgacgccgccgccgatcaggatcgagacccagaacggcaggccgaacaggacctgcatgacggtgccgatggcgatggtcgaggtggcgccgatcatcagtgcgtagaccagcatgatcagggcgctggcgtggcgcgcggcggggttgtagcgacgctccaggacctgggtgacggtgtagatcttcagcttcagcagcggcttggccaggaacaggctgaggccgacgatgccgaggccgatcgcgccgcacagccagaagccggagatgccatggacgtagcccaggcgcacggtgccgatggtggaggcgccgccgaggacggtggcggccatggttcccaggtagaagccggggccgaggttgcggccggccaccaggtagtcgtcgcgggtcttggcgcggcgcatgccgtaccagcccagcgcgatcatgcccgcggcgtagatcagaacgacgaatatgtcgagggccatatcaggtctcccaagtttctcattgtcattgttgtatccggcgaggcgccggaagcgcgggacgctggcgtcccgccgtgtgtgtcccccacctcaggcggtggctatcgccggtgccctccgcgtgccgtgcgcgcgcacccagcgcggtcctcgcgggccatagacgcaaggcggttccgggaacaggcgcagcagtgccaggtagagcagggcggccaggccgagggcgaccggcaggctgaggtcgatgccgccggccagttcgccgagcggaccgacgaattgccccggcaggttgacgaaggccaggccggctgccgcgctgggaatccaggcacccattccgcgccagttccagccgtgctcgaaccagtaggcgccgccgcgctggccgcgggtgaacacctgcaggtcgtccgggcggtagaagccgcgacgggtcagcaggccgatcagcatgatcaccatccacggggtggtgcaggtgacgatcagcacggcgaaggtagagacgctctgcaccaggttgaaggcgaagcggccgacgaagatgaagccgatcgaggcgaccccgatcagcaccgtggcctgcacccgcgagagcaggcgcgggaacacgctggacatgtccagcccggtgccgtacagcgaagtggtgccggtggacatgccgccgatcaccgcgatcaggcataccggcaggaagaaccagccgggagcgatggccagcaggccgccgacgtagttgttggcagcgatgtagtccggcgcgcggacggcgacgatggtcgcggtggcgaggccgaacaggaagggaaccagggtcgccagctgcgcgccgatcaccgccagcatgatccgtgcctgcgaggtctggcgcgggatgtagcgggcccagtcgcccaggaaggcgccgaaggagatcgggttgctcatggccagcagggtggcgccgatgaaggcggcccagaagcccggctggccgagttgcacgctgccggcgtaggcggcgtcgaaggggccggcgaaggcgaacaggccgagcaggaacagcaggctggcggcccacacggcgatcctgttgaccagcagcatgaagcggaagccgtagatgcatacggtcagcaccagcacggcgaacaggccgtaggccaggcccaggttcagttcgctctcttccaggccgaccaggcgccgggcgccgccgaccagggcatcgccggaactccacaccgagagcgagaagaaggcgatggcggtcagcagcgagaggaaggagccgacgatgcgcccgtgcacgccgaagtgcgcgccggaggagaccgcgttgttggtgccgttgagcgggccgaacaggcccatcggggcgaggatcagcgcgcccagcgtgacgcccagcaggatcgcccacagcccggcctggaaggacagcccgaagagcaccggaaagctgccgagcacggcggtggcgaaggtattggcgccgccgaagatcatgcggaacagatcgaccggcgtggcgttgcgttcgtggtcgggaatctgttcgaccccgaaggtttcgatgcgtgtgattgcgtgttggttattgttgttatccatgacgttctcccgggagagctagctagtcgatggcaggtactccggcatcgccgacaagtgctcatggcaggccagccaacggccttcttgttgttctag

SEQ ID NO: 7815 - DNA, 717 bp, Pseudomonas aeruginosa
tgggtgaaacaaattaccgccattcgtcggaaatatgacgtttttgcgagtgagaggaagccccctccgcctgtggcacactgggccccttccaggagtcgtcccatgccacgtatccgctgcgagcgttgcgctcgccccgccagccattgcctctgcgcgctgattccctccttgccgtcgcgtacgcgggtgctggtcctgcagcaccccagcgaggtcgggcacgcgttgaataccgcaggattggccgtcctcggcttgtgcaatgcggagctgcgggttggcgagcgtttcgccgaggagacctggcgggtaccgggctaccgggcctgcctgctgtttcccggcgagcaggcgcgtgcgctggcagagatggccgccgaggccgccggcgagcccctcctgctggtggtgccggacggcacctggcgcaaggcgcgcaagctcctgcacctgaacccggccctggcggccctgccgcgggtgagcctggccgaaggcatggcgtcgcgttatcgcctgcgcaaggcgccgggagagggcgcgctgtcgaccatcgaagcaatcgctgcggcgctcgacgaactggaggcgccgcgtacccacgaagccttgttgaaacccttcgatgccctgatcgaggggcagatcgcggcgatgggcgaggacacctatcggcgcaaccatctcagccaggagcgccgccgccgatag

SEQ ID NO: 7816 - DNA, 1695 bp, Pseudomonas aeruginosa
tgctgccgtgtctgcacggccggttttccgtccctggcccgagggcccgggggaatgcatggcatcaagggggtatccatgacgaatacgtcgaccctgacgctcgatggcgtctctttccagctgccggacggcagccttctgttttccgatctcgacgaaacgttcgacacccggcacaccgggctggtgggacgcaacggcgttggcaagtcgctgctcgcgcgcctgctcgccggacacttgcagccgtccagcggcagcgtccggcgccaggggcgcgtgcgctacctggcgcagcagctcgaaccggccgactacccgaccgtcgccgatctggccggcgtccgcccatggctggaggcgctggcgcggatcgaggcgggtagcctcgacgccgccgactacgaatgcctgggcgagcgctgggacatccgccaacgcctggccgacgccctggccgccgaggggctcggccatctccgcgcggataccccgagcgaacgcctgagcggcggcgaatgcatgcgcgtagcgctgctcggcgcattcctcgacgacgccgactttctcatcctcgacgaaccgagcaaccctctcgacgggccggcacgcgctttgctgcgggcgcgcctggcggcatgggacggcggcctgctgctggtcagccatgaccgcgaactgctggagggcatgcagcggatcgtcgagctgtcgaccctcggcctgcgcagctatggcggcggctattccttctacgcgcagagccgggaggaggcgcgcgaggccgccgaacgtcgcctggaccagcgtcgtctggagcgcaagcggcagaccctggccatgcgcgaacagcagcagcgccaggagcggtgccaggccagcggccggcgcgaaggcaagacggcgaaccaggcgaagatcctgctcggtgggttcagggaacgtagcgaggtcagcgccggcaagatgcgcaacgcccaccaggcggagcgcgagcgtctcgaccgcgaggtgcgcgaggctgcccgggaggtcgaggaggcgtcgccgctgctgctcgattcgcccgatgccgaactggcggcacagcgccggatcgtcgagttgaagggcgcggtcctgccgcatttgcgcgggccgttgcgcgaaatcgacctgctcctgagcggtccgcgacggctggcgctggtcggcccgaacggcagcggcaagtcgaccctgctgcggctgctggccgggcaacgggcgccgctggcgggaacctgcgcggtgacggtgggcgccgcctatctcgaccagcggctgagcgtgctggaccacgggcgaggcgtgctggagcagttgctggaggtcaatcgcagtcgcggcgaaagctggctgcgcacgcgcctggcgcaactcggcttgccggctgaacggctcgcccagccgtgcgcgacgctgagcggcggcgaacgcctgaaggcggccctggccctggtgctctacgccgaccggccggcgcagctgctactgctcgacgaaccggacaaccacctcgacctggctgcgcggcaggccctggaaagcatgctcgggcagtaccgtggggccttgctggtggtgtcccacgacccggtgtttctccggcgactggcgctggatggcgaactgcgggctactgccgcgggttggcgcctggaggaccgatga

SEQ ID NO: 7817 - DNA, 1509 bp, Pseudomonas aeruginosa
tttcgccgcgcccagctcgccgtagcgctgctcggcacggctcagtatcgactccaggtcccactgcgccagcgccgcgccgactgccagcagcaatgtcgccgccagcgacagcagccagggggcgtaggccctggggcagggccggcgggcgccgggggttggggacatcgagcgggctccggaaggactcagcgaagtctacgagagcgccgggcggcctgccagcgcggggtgtccggcgaaactgacaggattgtcattcaggggtcagggtggggtcccgctgcgctgcttataaagaagaacgaagtcggccgcgcgaggccggccactgggaaaggtggacagatgcaggcgttgcgcagtggtgggggacgggtcctggtgggcgtgctggcggcgggcctggtcgccttcggcggttgggcatggctcggcggcgacgccggggcgaaggcggcgcccgcgccggccagggtcccggtgaacgtggcgcgggtggagcggcgcgacgtcgagcaacaggtcagcggcatcggcacggtgacttcgttgcacaacgtggtgatccgcacccagatcgacggccagttgacccgcctgctggtgagcgaagggcagatggtcgaggcgggcgagttgctggcgaccatcgatgaccgcgccgtcgtcgccgcgctggagcaggctcaggcctccagggcgagcaaccaggcccagctgaaatccgccgagcaggacctgcaacgctaccgcagcctgtatgccgagcgtgcggtgtcgcgccaactgctggaccagcagcaggcgacggtcgaccagttgcgcgcgaccctgaaggccaacgatgccaccatcaacgccgagcgggtgcgcctgtcctacacccggatcacctcgccggtatccggcaaggtcggtatccgcaacgtcgatgtcggcaacctggtgcgggtcggcgacagtctcggcctgttcagcgtgacccagatcgcaccgatctccgtagtcttctccctgcaacaggaacagttgccccagttgcaggcgctgctcggcggcgaggcggcggtgcgcgcctacagccgcgacggcgggagcgcgctgggcgagggccggttgctgaccatcgacaaccagatcgacagttccaccggtaccatccgcgtgcgcgcctccttcgataaccgccaggcccggctctggcccgggcagttcgtcgcggtgagcctgcacaccggggtccggcgcgaccagttggtgctgtcgagcaaagcggtgcgccgcggcctggagggcaatttcgtctaccgggtcgccgccgaccgggtcgaggcggtgccagtgcgggtgctccaggacatcgacggcctcagtgtggtggaaggcctggccagcggtgaccaggtggtggtggacggccactcgcggctgatgcccggcgccctggtcgatatccaggagccgcgcccgagcctggctcaggcggcggagcggcagccgtga

SEQ ID NO: 7818 - DNA, 690 bp, Pseudomonas aeruginosa
atgcgggtactgattgtcgaggacgaggcgaagacggcggactacctgaaccgtggcctcagcgaacaggggttcaccgtggacctggcggacaacggcatcgacggtcgccacctggcgctccatggcgagtacgacgtgatcgtgctcgacgtgatgctgccgggcgtcgacggctacggcgttctgcgggcgttgcgcgagcggcggcagaccccggtgatcatgctcaccgcgcgcgagcgcgtggaagaccgggtgcgcgggctgcgcgagggcgccgacgactacctgatcaagccgttctccttcctcgaactggtcgcccgcctgcaggccctgacccggcgcggcggcaaccatgaaagccattcgcagatgcgcatcgccgacctgtccatcgacctgctcagccgcaaggtcttccgtggcaacacccgtctggagctgactgccaaggagtacgcgctgctctgcgtgctggcccagcgcagcggcgagatcctgtcgaagacggcgatcgccgaactggtctgggacatcaacttcgataccgacaccaatgtcgtggaggtggcgatcaagcgcctgcgcgccaagctcgacggtccgttcgagaacaagctgctgcataccatccggggcatgggctacgtcctggagaaccgtgcgctggcggagtcgggctga

SEQ ID NO: 7819 - DNA, 1314 bp, Pseudomonas aeruginosa
ggcgcggacctccaccctgaaatggctgctcggcctgtccgccctcggtgtgctgctggcctcgttgcttggccactggatcgcccgcctgggcctgtggccggtgcatcggctgtccgaggaggcccggcggatcagcccgcggcagttgtcgcagcgcttgcagctctcgccgctgccggccgagctgcgcgagctggtgggagcgttcaacggcgccctggaccgcctggagcaggcctacgtgcgcctggagtcgttcaatgccgacgtcgcccacgagctgcgcacgccattgaccaacctgatcggccagacccaggtggcgttgtcccgcgaacgcagcggcgaacattacgaagaggtcctgcaatccaacctggaggagctggagcggctgcgggcgatcgtcaacgacatgctgttcctcgcccgcgccgaccagggacgcctggcctgcgagcgcgaggaaacctcgctggccggcgagatcgccaccacggtggatttcctcgaggtgatcttcgacgaggccggggtcggtatcgaggtgcgcggcgaggcccgcgcgctggtcgagcgcgccctgttccagcgggcggtgaccaacctgctgtacaacgccgcccagcacaccgccgccggcggcacgctgcgggtcggcgtcgagcggcgcggcgacgaagtgcgggtggcggtgagcaaccccggcgtgccgatcgccgacgagcaccgcaggcacctgttcgaacgcttctatcgggtcgacgcggcgcgcagcaacagcgaggccaaccacggcctcggcctgtccatcgtcaaggcggtggcgagcatgcacggcggttcggtgttcgtcgacagcgcggacggctggaacaccttcggcttcaccgtgctgagccccgagcggcgcgggcccggcgaccgcttgccgctgggcgagggcgatccggcgctgtcctgagcgggccatcaggcgtcgtgcggcgggcgggtcttctggcggaggatatagatgctgaccagtaccgcgctggtcagcatgaagccctgggcccaggggcgtcggaccaggtagcaggaaagggcgatgctggcccacatcaggccgatggcgtagaccttgcccttgagcgggatgccttcgccgtcgagatagtcgcggatccacgggccgagccgtggatggccgaccagccagtggtagaagcgcggcgagctgcgcatgaagcaggccgccgcgaggagcaggaaaggcgtggtcggcagcaccggcaggaagatgccgatcacgcccagggctacgcttag

SEQ ID NO: 7820 - DNA, 411 bp, Pseudomonas aeruginosa
tgcgtgcgcggcttgagcagggcgggcttttcttccggcgcctggcagagcaggaacaggttggtcagcaggtcgggaatctgcgcgaccatgtcgtccaccaggtggcggtcgcgggcgatctcgtcgaactcgggctgctcgtcgaacaggccggagccgaccatgataggcagcagcagctcgctgacttcctcctcggcctgctcgaaccagacttcctcgcgaaggaacacgccttccatgaagccgatgcaccagccgcgcaggtcggagtcgtccggctcgtcgccgaggtcgaggtcgcagggcagctcgaggtcttcgtcgctggccagcacgcgggtgatgtgcgccttgagctgctcgagggaagtctcgatctcctggcgctcctcatcgctgcggtag

SEQ ID NO: 7821 - DNA, 1431 bp, Pseudomonas aeruginosa
tccagacgggacctgcgggcaaagcgagcgtgcctgctgcggcgccctggcgagcgtttcacggacgctctcggcgaagttggcccggaccttgctccatcccttgcgcaagccacgatgcaatcccttcgcaaatggagaattcccatggccgtcgcccctggtgtgttgttgccgccgacgcctgatgtaaagcccaaggccgctgcgccgaagagccagcagaaaacgcctgagcctagtaacgacaagacttccagcttctccgacatgtatgccaaggagaccgcgaagaagcccgccgagcgcgccgacggtccctccaagggttcgcgggacaagccgcgggacgccggcaaggaggctgccgaggcgcagccgacggatgccgccgggcaaccggccgttgccgaagacggcaagcctttgccggccgacggccaggccaaggccgacggcgaagataaagtcgaaacgccggtcgatccgctgcaactgctcggcctcggcggcgccgtgccgatgctcgacgagaatacccaggcgactttgctgccgccggccgtgccgacggctagcagtgctccggccagcctgaccgaagccagcagcgacccgaccctggtcaagctcaacggcgttccggcggtgaacatggccttggagcagggtgcccaggacgccgcgcaggcggcgaaaggcgggccggcgaagagcgccgatccgcgccaggcgaacctcggcgatgcccttgccagcctgacttccgactccttgcccaaggccgtcgacggcaaggcgctcgaggcccagttgcagcagaccgccgagccggccatcgccagcgccgcctccgagagcctgctggagagcaaggcggagccgcgcggcgagcctttcgcggccaagctcaacgggctgacccaggccatggcgcagcaggccctgaccaaccgtccggtgaacggtacggtgcccggccagccggtggcgatacagcagaacggctggagcgaggcggtggtggaccgggtgatgtggatgtccagccagaacctgaagtcggcggagatccagctcgacccggccgagctgggacgcctggacgtgcgcatccacatgaccgccgaccagacccaggtgaccttcgccagtcccaacgccggcgttcgcgacgccctggaaagccagatgcaccggctgcgcgacatgttcagccagcagggcatgaaccagctcgacgtgaacgtctccgaccagtcgctggcgcggggctggcagggccagcagcagggcgagggcggatcggcgcgcggacgcggcttggccggcgaggcctcgggcgatgaggaaaccctcgccggagtcagcgagatccgcagccggccgggtgcgtcggcggcgcgcggtctggtcgactactacgcctga

SEQ ID NO: 7822 - DNA, 537 bp, Pseudomonas aeruginosa
cgacggatttttggcatggctaagaaagaggcgacacccgccgacgcgggggctccgagcggcggcaagagcaagctgaagctgatcctgctgatcgtggtcggcctgctgctggcgatcggcctgtcggtgggcggcacctggttcttcctcagcaagtcgctgaaggccgagaagaccgaggaagtcgccagcgaggcggcgaagccgggcaagcagccggcgctctacgagatcctggcgccggccttcgtcgtcaacttcaaccagaacggccggcagcgctacatgcaggtcggcgtcgcgttgatggggcgcgacaaggcgcagatggacgcattgcgcgagcacatgccgctggttcgcaataaactggtgatgctgttctcgagtcagagtttcgactcgctggtgactccggtgggcaaggaaatgctccgccagcaggcgaccgccggattgcaggaactggccaagaaggaaaccggccaactggctatcgaacaagtgttgttcaccaatttcgtgctgcagtag

SEQ ID NO: 7823 - DNA, 1407 bp, Pseudomonas aeruginosa
cctgaccagccaggaccgcatcgtccggggccgcatgccgaccctggagatgatcaacgagcgtttcgcccgctacacccgcatcagcatgttcaacctgctgcgccgttcggccgacgtcgcggtcggcggcgtgcaggtgatgaagttcggcgagtacgtgcactcgctgtacgttcccaccagcctcaacctggtgaagatgaagccgctgcgcggcaccgcgctgttcatcctcgacgccaagctggtgttcaagctggtggacaacttcttcggcggcgacggccgccacgccaagatcgagggccgcgagttcaccccgaccgaactgcgggtggtgcggatggtgctggagcaggccttcgtcgatctgaaggaagcctggcaggcggtgctggagatgaacttcgagtacgtcaactcggaggtcaacccggccatggccaacatcgtcagtcccagcgaggtggtggtggtctccaccttccacatcgaactggacggcggtggcggcgacctgcacatcaccatgccctattcgatgatcgagccgatccgcgagatgctcgacgccggtttccagtccgaccacgacgaccaggacgagcgctggatcaaggccctgcgcgaggacgtgctggacgtccaggtaccgctcggcgccaccgtggtccgccgccagctcaagctgcgcgacatcctgcacatgcagccgggcgacgtgatcccggtggagatgccggaacacatggtgatgcgcgccaacggcgtgcccgccttcaaggtcaagctgggcgcccacaagggcaacctggcgctacagattctcgaagcggtcgagcgctcgcgctgaccgcttcccccggaggaaagacgaaccatggcagacgaagaaaaagtgaccaccgaggaacaggcactggccgacgagtgggcggcggcgctggccgaggcgggcgacgccagccaggacgacatcgatgcgctgatggcccagggcggcgcgactcccgtggcggagtcgagtaccccgcgggcgccgatggaagagttcggcgcttcgccgaaggcaccgaccatttccggcctggaggggcccaacctggatgtgatcctggacatcccggtgaccatttccatggaggtcgggcataccgacatcagcatccgcaacctgctgcagctcaaccaggggtcggtgatcgaactcgatcgcctggccggcgagccgctggacgtactggtcaacggcaccctgatcgcccacggcgaggtggtggtagtgaacgagaagttcggcatccgcctgaccgacgtgatcagtcccagcgaacgcatcaagaagctgcgctgacatgcgtcgctacctgttcgccggcttcctgccggcactcgcctcgctga

SEQ ID NO: 7824 - DNA, 297 bp, Pseudomonas aeruginosa
cgcgccgctggcgcgctggagagagacatgacccctgaggtggcactcgacctgttccgcgaggcgttgtggctgacggcgatgatcgtcggcgtgctggtggttccgagcctgctggtcggtctcgtggtggcgatgttccaggccgctacccagatcaacgaacagaccctgagcttcctgccgcgcctgatggtgatcctgctcaccctgatcgtgctgggcccctggctgctgcggcagctgatggaatacacccagacgctgatcggcaacatcccgctgctgatcggctga

SEQ ID NO: 7825 - DNA, 1326 bp, Pseudomonas aeruginosa
tcctctggatcggcaccgccgacctgctcagccagtaccaggtgctggccggcgagaccctgcaattcctccgtgaactggtgcgggcgaaatagccatggccgagagcgagagcgggcaggacaagacagaggaacccacggagaaacgccgccgcgaggcgcgcgagaaagggcagttgccgcgttcgcgggagctgaacaccctggccatcctcatggccggcgccggcggcctgctgatctacggcgccgacctggcgggcgccctgttgcgcctgatgcgcagcaatttcgagctgtcccgggaaaccgcgatgaataccgagagcatgctgcagttgctcggcgcttcggcctacctggctgcccaggggctctggccgatcctgctgatgctgctggtggcggcgatcgtcgggccgatcgccctcggcggctggctgttctcgatggacgccctgcaacccaagttcagccggctcaacccgctgtcggggctgaagcggatgttttccgccaagtcgctgctcgaactgagcaaggcgctgatcaagttcctggtggtgctggcggtggccctgctggtgctctccgccgaccgcgacgccctcctggcgctggcgcaccagccgctcgagcaggcgatcctgcacagcgtgcgggtggtcggctggagcgccttctggatggcttgcagcctgctgctgatcgccgcggtggacgtgccctaccagatctgggacaaccgccagaagctgctgatgaccaagcaggaagtccgcgacgaatacaaggactccgagggcaagcccgaggtcaagtcgaagatccgccagatgcagcgcgagatggcgcagagacggatgatggcggcggtgccggaggccgacgtggtgatcaccaacccgacccacttcgccgtagccctgaagtacgacccggcgggcggcggggcgccgctgctgctggccaaaggcaacgatttcctggccctgaagatccgcgaggtggcccaggagcacaaggtgatggtcatggagtcgccggcgctggcgcgagcggtgtactactccaccgagctggaccaggagattcccgccgggctctatctcgccgtggcccaggtgctggcctatgtctaccagctcaagcagtaccaggccggcaagggcaagcggccgagcccgttgaaggacctgccgatcccgccggacctgcgtcgcgacgagtgacctggctggagctacgcgccgcgctgtggcagccttggccgatacccgctcgggatgagagctttgccgttcatggatcgaaccttgtctga

SEQ ID NO: 7826 - DNA, 210 bp, Pseudomonas aeruginosa
gtgggccaactcgtggtcgaatactgcctcatccatggcgcccgtgcagtcgtgcgctgttgcgccaacaagaccgatgcccgcagccgctggctgcaaggtctgctgcaacggcgtcctgccaatgtcgtcgccgttgccctggccaacaagaatgcccggatcctttgggccttactcagccgggagacatgctaccggcccggttga

SEQ ID NO: 7827 - DNA, 876 bp, Pseudomonas aeruginosa
caggccagccgccagcccgcttcgcgccgtgccggatcgagcgcctccgggagggtgtcgtccacctcgccctgcaggcaatgcaccaggcaggcgtggcaacttccggcgcggcagctatggggcacggcgatgccaccggcgagcagcgcatccagcaggttgctgccggcggcgacggcaaggcgtcgctcgccgacccgtatgtcaggcactggtgacctcccaggtggcgtcgcagcggtttcgtccgccgcgcttggcacggtagagcgcctggtcggcccgctgcaaggcctcgtcgagatcgtcgtcggcatacagcagggtcatgcccaccgaaaggctcagggtatccaccgtgaccccgaccggttccgcctgttggaacgccaggcgcaggcgctcgcaacagctttccagctgttccgcgtcggcgtggggcagcagcaggacgaactcctcgccgccgtaacgggccaggacgtcgccatcgcgcagacaggaacgcgccaccgcggcgaaggtctgcaggacccgatcgccggcggcgtggccgtggcggtcgttgatccgcttgaagtgatcgaggtcgatcagcgccaggccgtgctgccggttcggcagcaggtcttccagcgcccggctggccatgcgcatgaaatgccggcggttgaacagaccggtgagttcgtcggtggccaccaggtcttccagttggcgcatcatgccgcgcagcgtgtcctggtgcgcctgcaaggcatagcggcgctggcgcatgcgttgccgcatcgcctgtatgtagctggcgaacaggctcagccagaccattacgatgaacatcacgagcacatgcaatgcagcccggcccggtag

SEQ ID NO: 7828 - DNA, 1422 bp, Pseudomonas aeruginosa
ggcctacctgcgcgaagaatcgccggctgcccgcgactccatggcgcagatcctgatcaactcgcgcatgtgcgccaccggccaccgcccgatctgccaggacaccgggatcgtcaccgtgttcgtccgggtcggcatggacgtgcgctgggacggcgctaccatgagcgtcgacgatatgatcaacgaaggcgtgcgtcgcgcctacaacctgccggagaacgtcctgcgcgcctcgatcctggccgacccggccggcgcgcggaagaacaccaaggacaacacgccggcggtgatccactactccatcgttcccggcgacaaggtcgaggtcgatgtcgcggccaagggcggcggctcggagaacaagtcgaagatggccatgctcaacccgtccgactcgatcgtcgactgggtgctgaagaccgtaccgaccatgggcgccggctggtgcccgccgggcatgctcggcatcggcatcggcggtaccgcggagaaagcagcggtgatggcgaaggaggtcctcatggacccgatcgacatccacgaactgaaggcccgcggcccgcagaaccgcatcgaggaactgcgcctggagctgttcgagaaggtcaaccagctgggcatcggtgcccagggcctgggcggcctgaccaccgtgctcgacgtcaagatcatggactacccgacccacgccgcctcgctgccggtgtgcatgatccccaactgcgccgcgacccgccacgcccacttcgtgctcgacggctccggccccgccgaactggaagcgccgtcgctcgacgcctacccggagatcgtctgggaagccggcccgtccgcgcgccgcgtcgacctggacaagatcaccccggaagaggtgcaaagctggaaaccgggcgagaccctgctgctcaacggcaagatgctcaccggccgcgacgccgcgcacaagcgcatggtcgacatgctgaacaagggcgaaacgctgccggtggacctgaaaggccgcttcatctattacgtcggcccggtcgatccggtcggcgacgaggtggtcggcccggccggtcccaccaccgccacccggatggacaagttcacccgccagatcctcgaacagaccggcctgctgggcatgatcggcaagtccgagcgcggtcccatcgccatcgaggcgatcaaggacaacaaggcggtatacctgatggccgtcggcggcgccgcctatctggtcgcccaggcgatcaagaatccaaggtgctggccttcgccgaactgggcatggaagcgatctacgagttcgaggtaaaggacatgccggtcaccgtcgcggtcgataccaacggcgagtcggtgcacatcaccggcccggcggtctggcaaaaaaaaatcgccgaaagcctggcggtcgaggtcaagtaa

SEQ ID NO: 7829 - DNA, 1905 bp, Pseudomonas aeruginosa
gcctgctccgtccctgaaaaagcccggccccgcgccgggctttttcgtacggccactggccggagcctgggctggcagcgccgcaggcgccttggttcagccgaaccagaaatacagcaaggtcaggttcgccgccgagatcaggccgaacaacgaccaggccagcgcgctgacccagcgcgggttgacgaactcccccatgaggccccggtcgctgctgaagcgaatcagcggccacagggcgaacggcaattgcaggctgagcaccacctggctgagcaccagcagcttgcctaccgcggcttcgcccagccagagcacgccgatcaaggccggcaccagggccaggccgcgggtgatcaggcgccgctgccagcagggaatcttcgcccggaggaaaccctccatcaccacctgcccggcaatggtgccggtgaaggtcgagctttgccccgccgccagcagggcgaagccgaacaggaagctggccagggcgccgcccaccaacgggtcgagcaggtggtaggcgtcctggatctccaccacctcggtatggccgctaccgtggaaagccgcggcggcgaggatcaggatcgccgcattgaccagcagcgccagggacagcgagccgatggtgtcgagccgggaaaagcggatcgccgagcgtttgctcgccgcgtcgtcgccgctgacccgggtctgcaccacggacgaatgcaggtagaggttgtgcggcatcaccgtcgcgccgaggatgccgatcgccaggtacagcggctcctggctgctcagggtgtcccaggacggccgcaagccggcggcgacatccggccagtaggggccgatcagcaccagttcgacgaagaaacacgcgccgatggtcgcgatcagccccagcactatggcctccaggcggcggaagttggcgccctgcagggccagcacgatcagggtatcgaaggcggtgaggaccaccccggtggtaatcgagacgcccagcagcaggtggaaggccagcgccgcgccgagcacctcggcaaggtcggtagcgacgatcgacagttccgccagcagccattggccacgcgccacgccagggcggtagcgctcccgggagagctgcgcgaggtcgcggccggtggcgatgcccaggcgcgaacagaggctttgcaggagcatcccggaaaagctcgccagcaccactacgaacagcagcgcgtagccgaagcgcgagcccgcctcgatggcggtggcccagttgccggggtccatgtagccgaccgagaccagcaggccggggccgatgaacagcgccagcttgcgcagcggcgaggcgtcggccggcaccgccacgctgtggctgaccgaggagggacagaacggcgcggtggccgtggtgggcagggagtatttcacgaggcgacgccggatcgggggaggaagtgcgaccagcctaaacgtttcaccccggtcgcgtcttccctcgcctcaggcctgggcgcgctggccgaccaggctcagctcggcgactttctcgcgccgctgcgccaggtagcgggtacaactgacacgcaggaaggaggcgaagttgagcacctcgccgcgatagtccatcacttcctcgtagagattggtgatcaactggttggtgctcaggccctcgccttcggcgatttcccggaggatgtcccagaactggttctccaggcgcagggtggtcaccaccccgcggatgcgcaaggaacgcgagcgcgattcatagaggatcggatcggctttcacatagagttcgcacatgcgcgggggtctcctgtgtctcagtggctgatgcgggtgccgagcgcctcgaggaagcgcgccagccacgccggatgcgccggccaggccggcgcggtaaccaggtga

SEQ ID NO: 7830 - DNA, 2316 bp, Pseudomonas aeruginosa
acggttactacacgcgtgccgggttcagatgccgatcttgtccagggcccgcccgacgccttcccagaacgagcgctgcacgcgtttccggtagccgctggcggcgaactgcatgggctcctgaacctggtgggtagcgccgatttccgcagcgccgagatcggccgccaccaattgcagcgggccatcgccctcacccgccgggtgctcgctcttcggtggcgggttgagttcgtcgtagcgcaggtagtagaccgagccggccctggcctcgagcatgaagctggcgatgcgggtgaaatccatcggaccgtcggcgaacagggtccagaagctgcccgccagcggccggcgcatttccagcttgtagctgccggtctcgaactcgaacgccaggtagccgttgctcggcaggctgccgatcagttcgttgttgaggaagatccccggcgcctcgagttcctcgtccgcccactggctccgcggacggtagaggtagacggtggcgtggctggcatcggcgctcgaatgggcgacgaaggccggtccgtccaccgcaccgaagaacgcgccgggcgtgctgcagccgaccaggctcgcgacgatcgacagggccagcgacaggctgcgcagcatgctccatccctcttcttatggttatccgcgcagcataaccagccgggtcgggcctgccacccgtcgaaagtccggttctccgggagaacggcctcaggccgggcgcggcaccttggccagcgccggcgccggcatcagccggcgcaccagccacttgcgcaccggcaccacgccgcgctcctggaacagcacgcagaacgccaccagcaggaccaggaacagcgggtagtagagcagcgacgatggcaacgcggccgccgcctcggtgcaggcgcgccagtcgtcgagacaacgccccggcacggcgataaggcgctcgctacgggagaacagggtgaacatcggcacatgcagggcgaacagcgacagcgaggcggcccccaggcgcggcgaccagtggcggacgaaagcgctcttcgggtcggcgggcagcgcgcaaaggcacaccagcagcaactgggccggcagcagcaggccgttgtgcagcaggaagtaccaatgtttggcgccctgggtgaacaggtagtcggccaccaggaaggccgccaccaccagcgccaccagcgcggccagcaggccgcgtcccggcaccatgccacggtcgcggtagccgcggaacaacccgtaggccaggatgccgccaaggaattccggcaggcgcagcaacggattgcggtgcagcaggccggtccaggggatcccgtagctctcgctggccactaccagcgccggcgggatcaggtagaccagccagaccagcgccagcaccttccacttgtgccggctgcgcatcagccgcggggcgacgaagggaaacgccaggtagaagaacatcagcgtcgacagcgaccacaacggcgcgttgaaggtcaggtaatagggattccaggcctgcagcaggaggatctgcaggatgctgttgacgaacagttcggtgttgctcatccagtgcaggaagagttccgggtgggtgcggccgagcacttcgttggtgtcgtagatgacgaagcgcggggtggccttgtccagctcgggaccgattcccaggtggctgagggccagcaacaccaggatcgacagcagcagggagaacaggtgcagcggatagagattggacagtcgcttggtccagaagctgcgggcgctttcgcgcaaccggccgctgcgtgcgtaaacatgggccaggaggaagccggaaagcacgaagaaggtactggtggcgaagaaccccaggctggtcagttcgtcgagaccaggaaacttctgctctttcggataggtatgcagggtgtggtacaccaccacgtacaggccgagcaggaagcgcaaccattccagtccgatgaaacgttccttggagtcgggcgttgccacgcatctctcctttgtcattgtaatgggcggtccggggtagacccgcaagctccccggcaagtttcaccgggccggccagcggctacgaacggccgctccctagcgccggcggtcgaggaaattcaccactacccggtccagccaaccccacaggcgctggtgcaggcgcatccacaggggacgcgcgcgccacatcgccagggtcacctcgcggctgtcggcgaagtccgccagcaggctcgccgccgcctcattggtgaagtccgggtcgagggcctcgagattggcgtcgaggttgaagcgtag

SEQ ID NO: 7831 - DNA, 2997 bp, Pseudomonas aeruginosa
gaagaatctgcgaatacgccagcattgctccgcggcctagtcgatgccccctggagcctcgagcatcgccggcggacggcggctgacccaacgggtcaggccctcgtgggcatgggccagttgcagcaccgccaggtcggcctgcgccgggccgattatctgcaatcccatcggcaggcccgccgcgccgaagccgatcggtacgctgatcgccggcaaaccggccagggtcgggccgatcaccacctccatccagcggtgataggtgtccatcggccgcccggcgacctgccgcggccacgccgtttctgcatcgaaaggaaacacctgggcgctgggcagcaagaggaaatcgtaacgttcgaacagacgcgccagcgcccgataccagtcgctgcgatccagcgaggcgcgatagacctcggtggcgccgaggccgagcccggactccacttcccactgcgcctccggcttgagccggacgcgccgtgcgggatcggcgtaaagctcgccaagcgagccctgcaccagccactggcgatggaccagccaggtgcgccacaggcgctccaggggatagtccggcaggcacgcctcgacgtcgcagcccagctcggcgaaatcgcccagcgcggcttcgcaaagctccagcacgccctcctccatcggcaggtagccggcgtagtcgccgagccagccgagccgggctctgcggaaatcgcgcccgaggtcgtcggcgaacctgcgcggatcgtcgcgcaacgacagcggacagcgcggatcgtagccggcctgggtggccagcagccgggccaggtcggccacgctgcgccccatcgggccttcggtggccagttgctggacgaacagttccgcttgcgggccgtgcggcacccgtccctgggacgggcggaagccgtagacgttgttgtaggcggcggggttgcgcagcgaacccatcatgtcgctgccgtcggccaccggcagcatgcgcagcgccagcgccaccgccgccccaccgctgctgccgccggcgatccgcgccggatcgtaggcattgcgggtggtgccgaacagcgggttgtaggtctgcgagccgagcccgaactccggtacgttggtcttgccgatgacgatcgcaccgctgctcttcacccgctcgacgacgatggcgtcgtgctccggcacctgcccggcgaacagcggcgaacccagggtggtaggaatgccggaggtggcggcgaggtccttgatcgcctgcggcatgccgtgcatccagcccagccattcgccgcgcgccagttgccggtcgcgctcgtcggcctgggcgagcaggcggctttccgcctgcagcgagacgatggcgttgacccgcgggttgaaccgttcgatctgcgccaggtaggcctgcatgacctcgcggcaggacagttcgcgtcggcggatcgccgcggacagcggcagcgcgtcaagcgcgacgatttcctcgtggccgtcgcttcgatggcgggtggcgctcattcacagactccttgccggcttgcccagggccggttcacgggggcgcggggcgggcgtcgcgccctcccgcagatagagggtggcgagcagcccgaggaaggccgcgccgagcacgtagaacgccggcgccactggcgagccgccgacctcggtgagccaggtgacgatgaacggagcgaaaccgccgaacagcatcaccgccaggttatacgccaccgccaggccggtggaacgcacccgcaccggaaactgctcggccaccgcggtcggcgccgggccgaagaagccgccgatcgccgtgcacagcaacagttgcatcagcagcaggcgccccaggctcggcgccgcggcgacccaggcgaacagcggatagaccatgagcatgaaggccagggtcgcgaccagcagcaccgggcgccgcccgacccggtcggagagtcccccagccaacgggatcaccagggtcatcagcgccaccgcagccatttgcaccatgaacacctcgtccagcggcaggcccaaccgattgtgggcgaaggtcggcatattcaccagcaccccgtagaaggacaccgtgccgatcaccgtcaggcccatgctcaccagcacgctgcgccggtattcgcgcagcacgcagagcagcccctggcgctcgccgggctcccggatggcttcgaggaaggcctcggtctcgcccatgtagcggcggatccacaatcccaccggaccgatcagcagaccgaacaggaacggcacccgccagccccagctctccagggactcggcgtccaggcaatgggtgaccagcgcgcccatccccgcaccggcgaacaccgccaggcactggccgaacaattgccaggaaccgtagagaccgcgccggtgcggcggcgcgctttccaccaggaaagccgtggcgctggcgtactcgccgccggtggcgaaaccctgcagcattcgcgcgatcacgatcagcaacggtgcgccgacgccgatcgccgcgtaggtcggggcgaaggcgatcatcgcgatggacagcgtcatcagcaggatgatcagttgcatcgccgccttgcgtcccctgcggtcggcatacaggccgagcaggaccccaccgaccggacgcatgaagaaaccgacaccgaaggtggccagggccatcaacagcgaggtgtactcgtcgccggaagggaagaacagcctggcgatcaggctggaaaggaagccgtagacgatgaagtcgtaccactccagggcgttgccgatcacggcagccgccacctggcgggtacgcgaggtaccgctcgggcaagcgtgcatgggaatctcctggtaaccgggggaatgccggcgcggctcatgccgcgccgttattggcggcagtcagtcgaaggccggacgccgcgggggcggccagccaggtctcggcgagcgcgccccaataggccgcgccccggaccaggatgtcgtcgttga

SEQ ID NO: 7832 - DNA, 1809 bp, Pseudomonas aeruginosa
cgctcagcaggtcctgggaagccatcatcggtcccgcgcggaagcccaggtgcccggcctccagtcccggcatgttgtgcatgccgaacagcgcatcgcagggaaagcgctccagcagcccgtcggcgagcatcgcctcggcgccgccctggccttcctcggcgggctggaagatcagtaccagggtgccgtcgaaacgccgcgtcgccgccaggtagcgtgccgcgccgagcagcatcgcggtgtgtccgtcgtggccgcaggcgtgcatgcgcccgccgtggcagctgctgtagccgagccccgtggcctcgacgatcggcaacgcatccatgtccgcccgcaggccgagccgccgcgtgccgtcgccctggcggaggacgccgaccacgccggtgcggccgatcccttcgtgcacttcgtagccccagccgcgcaggcattcggcgaccagcgcggcggtgcgtcgctcctcgaagcccagttcgggatgggcgtggatgtcctggcgcaggctacgcaggtcgtcggcgacctcctcgagccaggccacgatgtgtcgatgtcgagccatgccgtctctcctctggccggattgcgctccggtcttgttggcgggaggcccggacgcaaggccggccgggcgtggtcacagctaagcgcggcacgcggcgaaggacaacggaaggcggttccactgggtggaacccaaggcccgcgccgccctccgccggtacgtcagaactgttccggcggcacttcgcggaagttcagcacggcgaacaccggtacctcgggagtgatcgagggaatattggccatctccttcaagggcttgagcttctcttccaggtcgaagtcgagcagcttcagcagcaccggctccagggtcgccacctggaccagcccttcgccctggcgggtgaccagcacgtcggccttcaggcggcgctgctggccgtgcaggtcgagggtgaagtcgagcttctcgacccgcgactggccgacccgcaggtcgtcgaagccggccatgtccaggcggctctccacggtggcctcggggaagcgcgaggtttcgaagaagttgtccttcattcgctcgtcgcgcagggccaggccgctgtccagggtgcccagcggcaccacgatgcgcgcgacgccctgcttgtcgatctggccgctgagacgatcgaagcgctgcacctcggccatcttcgcgcgtttcacggaaacgaagctgatccgcgagtaatccggctccagttgccattccgccgccgacagcagagggctgaggagcaacaacaggacacacaatacaacaggcattccacctccggcttcgggccggcgccgtccctcgccccgcgccccgacatgcgccgccggtcagtccggcagcctgtccgcctcgggcatgagccggcatccctcgcgcgggcccagccaggcggccgtctgcgtactgccgaggccgcgggcggtcacccggcggcgggcttcgtcgtcgaagaagccgctgatcggcacgtactgttgggtataggcccggcaatagtccgcggagttccccatcacgtagcggcaggagcagtactccttggccgtataggcgccgatgatggcgggaaaggccgccaggtggatgcggttctgccaggcccacgcgagggcggcgagcagccccaggacgaacaggaagagcaagggatggcgacggatcatggccgcgcctccccggcgaacgccgcctgtgccaggcgcaggaattcgttgtggcggaaacgcccgtcgcggtcgtcggcgtag

SEQ ID NO: 7833 - DNA, 1596 bp, Pseudomonas aeruginosa
cctgagcttgcacaacaaagccgagcggccgcaacccgcggcgccggcccaaggaggcccaggcatgacccagaccgccattacccgcgaacccgtcgccggacgccgcctgaaggccgagcgcctgaacggcgcccgcgccctgcgcgaggcccaggccctgcgctaccgcgtattcagcgccgagttcgacgccaagctcgaaggcgccgaagacggcctcgaccgcgacgactacgaccgtcactgcgcgcacatcggcgtccgcgacctcgacagcggcgccctggtggccaccacccggctgctcgaccatcgcgccgccgaacgcctcgggcgcttctacagcgaagaggagttccacctctccggcctcgacgccctgcacggcccggtcctggagatcggccgcacctgcgtcgctcccgaataccgcaacggcgccaccatcgcggtactctggggcgaactcgccgaggtcctcaacgagggcggctaccgctacctgatgggctgcgccagcattcccatgcgcgacggcggtatgcaggccaaggcggtgatgcagcggctgcgcgaacgctacctgtgcaccgactacctgcaggccgagccgaagaacccgctgccgacgctggacgtcccggaaaacctcaccgccgagctgccgccgctgctcaaggcctacatgcgcctgggcgccaagatctgcggcgagccttgctgggacccggatttccaggtcgccgacgtgttcatcctgctcaagcgcgacgaactctgcccgcgctacgcccgccacttcaaggcagcggtctgatggcgcggctgcgcctgctgctgcgcagcgcacgcctgctcgggctggtcgcgctcggactgggcctggccgcttgggtcagcctgcgcgagcggctgcccggcgccgacgtcacgccgctgcgccagcgcctgacccgctggtggctggcgcgcctctgcgcggccctgcccttcgaggtcagggtcagcggcgaagcgccccggcaacccatgctgtgggtagccaaccatgtgtcctggaccgatatcccgctgctcggcgccctggcaccgctgaccttcctgtccaaggccgaggtgcgtgcctggccgctggccggctggctggcggaaaaggccggcaccctgtacatccgtcgcggctcgggcgacagccggctgatcaaccagcgcttggccgaacaactgcaccgtgggcgcaacctgctgatcttcccggaaggcaccaccaccaacggcgaaagcctgcgcaccttccacggtcgcctgatggccagcgccctggaagccggcgtggcggtgcagccggtggcgatcagctaccgccgcgacggcgtgcccgatacgcaggcgccgttcatcggcgacgacgacttgctcagccacctcggccgcctgctgcgcggcgagcgcggcagcgtgcatatccagctgctggaaccgatccccagccagggcctggaccgcgccgaactggcccgccaggcccagcaggcggtgcgcctggcgctgttcggcactgccgcccctacgcaaacccggcgcgccgcctag

SEQ ID NO: 7834 - DNA, 597 bp, Pseudomonas aeruginosa
cgcatcatgcctttggcgaacggctcgaaggcatgcagcgcggtgaggctggcggcgtcgaggaagccgagctggccggccatctgcaccgcgcgcgtcgaggtcggcgagaagtccagcgccagcagcacccggcggtactcctcttccggcgcaccggccgcgcgcagcaccgggatcttcgcattgcgtaccacccgctccagggtggtgccgatgaacaggtcgcgcagcggcgtgtgccggtgcgcgcccatcaccagcaggtcggcgccgatctcctcggccaccgcgttgatcaccaccaccggatcgccgacccgcacgatcgccttggactcgacgccgaggcgctccttcagggcctgtccgttcacttccagcaggttggcgatggccagccgttgcggcgcgatcagcaccggcggctggtcgtcgtcgagcacgttcagcacggtcagttcggcattcctcgccttggccagcgccgcggcgcgcatgaccgccagctcggaacgcgaggacaggtcggtcgccaccaggattcgtttcatcttccacctccattggcagagcgttgaacgtcggccccattga

SEQ ID NO: 7835 - DNA, 501 bp, Pseudomonas aeruginosa
tgtgcatcaagcggatgcttcggactgaaacaattgataggtgattccgccggccgggccaatggccgctgcgccaggctcagcgctggctcagggcgaaagcctggagttgcgggtagaaggcgcggaaatccgcgctcaggtcatcgtagcgctgggccagttcttcccaggagccgtccagcaggtgcggtcgcgacagcctccgcgacataccgcccagcacttcgcgcaagaccgcgaactcgcggtagctgcccaaccagtcctgggccgccatccgcggcgcgatgcgcgccaggcgctccggcagcggcgaggcggtgcgcagggtgccgtagacccgctcgacgaactgcggcagcggttcgtcggcgtagtcgttccagtcgcgcgccaggcagtggtcgaagaacacgtccagcaggacgccggcgaaacgccggcgctccagcgggaagcgccgcttggccgcatgcaccagtgggtggctgtcggtga

SEQ ID NO: 7836 - DNA, 531 bp, Pseudomonas aeruginosa
cgaagtcgccgtacaggctgccgagcagttgggccggttgcgggccgccgaggtggagatgcgcgaggtagttcatgcgggctagcttaccccagggacggaaccgtcgtttcgatcatcgtcatcagccctgtcgatagcgactatcgtcgcaatcgatccccatatcgtcccacaccgatatatagttcgtcccaacccgatatggacggccaacggaccaccgccatgccactggacatcgacgaaatcatcaaggctctctcccacccggtgcgacgcgacatgctgcgctggctgaaggaaccggagaagtacttcgtcgagcaggaccacccgttcgagatcggcgtctgcgccggcaagttcgaccagcgtaccggtctctcccagtccaccgtatcggtacacctcgccaccctgcaacgcgccggtctggtgaccagccgccgggtcggccagtggaacttcttcaagcgcaacgaggagaccatccaggccttcctcgaccaactcggcgacgagctgtaa

SEQ ID NO: 7837 - DNA, 1215 bp, Pseudomonas aeruginosa
gcagcactcgcttccaccccaccacctcgcagtccaggagctcgaccgatgccggcgtctcttctcgtcctcgctttatccgcctttgccatcggtaccaccgaattcgtcatcatgggcctgctgccgcaggtcgccggcgacctgcgggtatccattcccagcgccggctggctgatcagcggctacgccttcgccgtggccttcggcgccccgctgatggccatggccaccgcccgcctggagcgcaagaaagccctgctcgcgctgatgggcatcttcatcgtcggcaacctgctctgcgcggtggccgccaactacggcctgctgatgctggcgcggatcgtcaccgcgctctgccatggcgccttcttcggcatcggctcggtggtcgccgccagcctggtggcgccgaaccgcagcgcttccgccgtggccctgatgttcaccggcctgaccctggccaacgtgctcggcgtgccgctgggtaccgcgctcggccaggaagccggctggcgcgcgaccttctgggtggtgaccctgatcggcgtggtcgccttcgtcggcctggccagggtgctgccaaacgaccgcgaggaagagaaggtcgacctgcgccaggaaatgtccgcgctgaagaacccgtcgctgtggctggccctgggcaccaccgtgctgttcgccgcctcgatgttcgccctgttcacctacgtcgcgccgctgctcggcgaagtcaccggggtcagcccgcgcggcgtgacctggaccctgctgctgatcggcgtcggcctgaccgtcggcaacgtgatcggcggccgcctcgccgactggcgcctgggcaccaccatggccgcggtgttcgccgccatggcgctggtctcggcgctgttcagctggaccagccaggccctgctgccggcggaaatcaccctgttcttctgggccgccgccgccttcgccgcggtgcccgcgctgcaggtcaacgtggtccgcgtcgggcatgccgcgccgaacctggtggcgaccctgaacatcggcgccttcaacgtcggcaacgcgctcggcgcctgggtcggcggcagcgtcatcgaccacggcctgggcctgacccgcgtgccgctggccgccgccgcgctggccgcgctggcgctgctggccaccctgatcgccttttccggaaacggccgcgcccaggcgcagccggtcctcgattga

SEQ ID NO: 7838 - DNA, 1089 bp, Pseudomonas aeruginosa
tcccctgtccgtctattccctagtggaggatgttccatggctactctgttcgatcccatcgtgctcggcgacctcgagctgcccaaccgcatcgtcatggcgccgctgactcgctgccgcgccgatgaaggccgcgtgcccaacgccctgatggccgagtactacgcccagcgcgccggtgccggcctgatcctcagcgaggccaccgcggtcacgccgatgggcgtgggctaccccgacacccccggcatctggtccgatgaccaggtccgtggctggagcaacgtgaccaaggcggtgcacgccgccggcgggcgcatcttcctgcaactctggcacgtcgggcggatttccgatccgctctacctgaatggcgagctgccggtggcgccgagcgccatcgccgccgaggggcacgtcagcctggtgcgcccgaagcgtccctacgtcaccccgcgcgcgctggacaccgaggagatcgccgacatcgtcgaggcctaccgccagggcgccgagcgggccaaggccgccggcttcgacggcgtggagatccacggcgccaacggctacctgctcgaccagttcctccaggacagcaccaacaagcgcaccgaccgctacggcggctccatcgagaaccgcgcgcgcctgctgctggaagtcaccgacgcggcgatctccgtatggggcgcccagcgcgtcggcgtacacctggcgccgcgtgccgactcccacgacatgggcgattccaaccgcctggaaaccttcagccatgtcgcccgtgagctgggcaagcgcggcatcgccttcatctgcgcccgcgaagcgcaggccgacgacagcatcggcgtagccctgaagaaagccttcggcggaccctacatcgccaacgaaaagttcaccctcgacagcgccaacgccatcctggccaagggcgacgccgatgcggtggccttcggcgtccccttcatcgccaacccggacctggtcgaacgcctgcgccagggcgccgaactgaacccgccgcgcccggaaaccttctataccggcggtaccgaaggctacctggactatccgaccctggcctga

SEQ ID NO: 7839 - DNA, 663 bp, Pseudomonas aeruginosa
agggtgttcagggtgccgaccaccacttccttggccatcgccccggtgaccaggccgacggtggcctgccagttgtccggctgcaccccgagcggcgccagcagcggagtgagacgctggctgacgctggccagcgcggaatggccgatgtcgccctgcaccggcttgccgtcgagggtgatgctgttcaggccgccgatcaccaggctgaccaggatgatcaccttgccggcccgcaccacgaagccgcgcaggcgcgaccaggtctgcagcagcaggctcttaaggtgtggcacatggtacagcggcagttccatgacgaacggcgaggcctcgccgcgcatcaaagtgtgcttgagcaacagcccggtgaggatcgccacgacgatgccgagcaggtacagggagaagatcaccagcgcgccgccctggccgaagaaggccccggcgaatacggcgaaaatcgccaggcgcgcgccgcaggacatgaacggcgccatcatgatggtaatcagccgctcgcgctgcgcgtccagggtccgcgcgcccatgatcgacggtacgttgcagccgaaaccgacgatcagcggcacgaacgacttgcccggcaggcccagcgcctgcatcaggcggtccatgacgaaggccgcgcgtgccatgtag

SEQ ID NO: 7840 - DNA, 513 bp, Pseudomonas aeruginosa
tcgaacaaaatcagttttcctaatgagagatcagcaggattcgttttccttataaaccgcccgcggccacactcgccagcacttttccgatccacccgacgcggaccgaccatggctggcgaaacctcgctgcgcaccctgctgcgcacgctcactcccgaactcaatcccggcgactatgtgttctgtacctgcgccgctggcgcgctgccgaacggcgccgagccgctcgccagcttccgcgagcgcgagggcctgaccctggtgctcgaacgccggcaggccgaacgcctgggcctgccctacgaatacgtggcggcctggatcaccctgacggtgcactcatcgctggcggcggtgggcctgaccgccgccttcgccacgacgctggccgaagccgggatcagttgcaacgtgatggccggctatttccacgaccacctgttcgtcgcccgcgacgagggccggcgcgccctcgccgtgctccagcggctggcggcggaggcacactga

SEQ ID NO: 7841 - DNA, 894 bp, Pseudomonas aeruginosa
catgtggcagagctatctcaacggcatcctggtggctgccggcctgatcatcgccatcggcgcgcagaatgccttcgtcctcgcgcagagcctgcgccgcgagcatcacctctcggtggccgcgctctgcgtgttctgcgacgcggtgctggtcagcctcggcgtgttcggcctggccaagctgctgctggaaaacccgacgctgctggccatcgcccgctggggcgggatcgccttcctgacctggtacgggctcaaggcgctgcttcgcgcgttgcgcccggacgccctcggcaacgccgcggaaaccgggccacgctcgcgcaaggcggtgcttctggcggcactggcggtcaccctgctcaacccccacgtctatctcgataccgtacttctgatcggttcgctcggcgcccagcaggccgcgccgggcgcctatgccctcggcgcggccagcgcctcgctgatgtggttcttcgccctcgccctcggcgcggcatggctggccccctggctggcgcgcccggccacctggcgcctgctcgacctgatggtggcggccatgatgctgggcatggccgcgcaactgctgttccggggataacgcagtttccgtcttcccgagcgaaccctcgcgccgccaggcagtccagagagaatgcggcggtgttcgccggcgagcttgcagaagcccgtcgcagcgcgccgccgccggcctttgcccctacagttgctgcgtggatatgccccgacacgggtgctatgatccggagttcgcggcactgggagcctaggctccgagtcgcacccggcgccctttccggagcgctccgccgaacgtccccccggggatccaggacgggctcccggacaggcatcggaccggccccgtga

SEQ ID NO: 7842 - DNA, 471 bp, Pseudomonas aeruginosa
ccctggccaagacccgctcgcgcaaccgctaccagttctacatcgccagcgtggacagcgagatgcgtcgccgccgggaactggaaaaggacctgcgcgacgccctgcagcgccacgagctgcacctcgtctaccagccgcaggtggactaccgcgaccaccgcgtggtcggcgtcgaggcgctgctgcgctggcaacatccgttgcacggcttcgtcccgccggacctgttcatcccgctggcggaacagaacggcagcatcttcagcatcggcgagtgggtgctcgaccaggcctgccggcagttgcgcgaatggcacgaccagggcttcgacgacctgcgcatggcggtcaatctttccaccgtgcagctccaccacaacgccctgccacgggtggtcagcaacctgctgcaggtctaccgcctgccggcgcgcagcctggagctggaagtcaccgaaaccggcctga

SEQ ID NO: 7843 - DNA, 420 bp, Pseudomonas aeruginosa
gccaggccaccagcagcgaacggccctgatcagaacaggcggctgaacagccagcccgccaatagcgcgctgcccaggcagagcaacgcagcccccgccgcctggcggcgcagttgcacggcgagatcgtcctcgccctggctggagagaatgaagggatgcgcctcccccggcttgccgagccggtggcgggtcggcgcggcgctgcttgcccgatgccgatcctcggcctccagccgtgccgccaggcgcacccggttccattcgcgctcgtccagctcgccgttgccgtcgctgtcgaagcgcgccagcagcccgtggaaatcgcccttccattcacggatcaccgcaccctgcgcccgttcggcatcgagtccctggcgaccgccaccgctgctgcggaattcgcccagcgcatag

SEQ ID NO: 7844 - DNA, 1188 bp, Pseudomonas aeruginosa
acgtggtccaccgcctgcacgaaggcgacctggcccgcgccctcggcgtgcaactgggcttcaacgccaacgatggcgactgaggtcggcaccatgctgcgacgtcatgtgatcggcctgggcagcctgctgctcggcgccttgtccttcggcggctggagcttcagccgcctgggtagccaaccgctggtgctgtcggcgcgcgacgacgccgatggccagcattacgcggtgggctaccgcctggacggcaagtgccagttcgccacccgcgtggcccagcgctgccacgacatcgtccagcacccgagcctgccgctggcgctgttcgtcgcccgccggccaggcaccgaaagctacctgatcgacctgaacgacggttgcctgctgcagaccctggtctcgcagaaagaccgccacttctacggccacggcgtgttccaccagagcggcgagtggctctacgccaccgagaacgacactaccgatcccggtcgcggcgtgctcggcgtctaccgtttcgacggcgagcgactgcagcacagcggcgagatctccacccacggcctcgggccgcaccaggtttcctggatgcccgacggcgagaccctggtagtggccaacggcggcattcgtaccgaggcggaaagccgggtcgagatgaacctcgacgccatggagcccagcctggtgctgatgcgccgcgacggcaacctgctgtccaaggaaaccctggcgcagcagatgaacagcgtccgccacctggcgatcggtcgcgacggcaccatcgtcgccggccagcagttcatgggcgatgcccacgaacatgccgacctgctggcgatcaagcgccccggccgtcccttcgaagccttcccggtggccgaggagcagcgcctggcgatggcccagtacaccgccagcgtggcgatccacgacgacctgcgcctggtggccctgaccgccccgcgcggcaaccgtttcttcatctgggacctggacagcggtgccgtacgcctcgacgcgccgttgccggactgcgccggcgtgggcgcggtgaagaacggcttcgtcgtcacgtccggacagggccgttgccgcttctacgactgccagggcgagcgcatcgccgcgcaaccgctggagctgccttccggcctctgggacaaccacctgcacctggcctga

SEQ ID NO: 7845 - DNA, 1011 bp, Pseudomonas aeruginosa
aagctgcacgtaatgtgtcggattcgccccgaaacggggcgctctcggcataccagggaccaggattatgttgctccgccgcatgttgatcatgctcgccgcggtgatcgccgtggtggcgattctcgccggctacaaggtctactccatccgtcagcagatcgcccttttcagcgcaccgaaaccgccgatcagcgtgaccgccagcctggccgaaaagcgtccctggcagagccgcctgccagccatcggcagcctcaaggcattccagggcgtgaccctcaccgccgaagtctccggcacggtacgcgacgtactgttcctttccggcgaccaggtgaagctggaccaaccgctgatccagttggaaagcgacgtcgaggaagccaccctgcgcactgccgaggccgatctcggcctggccagggccgagtaccagcgcggccgcgaactgatcggcagcaaggccatctcgaaaagcgaattcgatcgtctcgccgcgcagtgggccaagaccagcgccaccgtcgccgagctgaaggcggcgctggcgaagaagcgcgtgctcgcgcccttcgccgggaccatcggcatccgccaggtggacgtcggcgactacgtctcgcccgggacgccgatcgccaccttgcaggacctttccaccctgctcctggatttccacctgcccgagcaggacttccccctgctcagccgcggccagctggtgaaggtccgggtcgccgcctaccccggccaggtgttcgacgccgagatcgccgccatcaaccccaaggtcgacaacgagacccgcaacctgcaggtccgcgctgccctggagaacccggacggcaagctgctgccgggcatgttcgccaacctcgaggtgatgttgcctggcgaggaacaacgcgtcgtggtgccggagacggcgatcaccttcaccctctacggcgactcgatctacgtcgtcgggcagaagaaggacgagcagggccaggtgtcgaaggatga

SEQ ID NO: 7846 - DNA, 3060 bp, Pseudomonas aeruginosa
aacatggcttttaccgatccgttcatccgtcgtccggtcctggcgagcgtggtcagcctgctgatcgtcctgctcggcatgcaggccttcagcaagctggtgatccgcgagtatccgcaaatggagaacgcgctgatcacggtgaccacgctctacgccggagccaacgcggaaaccatccagggctacatcacccagccgctgcagcagagcctggccagcgccgaaggcatcgactacatgacctcggtgagccggcagaactattcgaccatctccatctacgcgcggatcggcgccaataccgatcgcctggtcaccgagctgctggccaagtccaacgaagtgaagagccagctgccgccggacgccgaggacccggtgctgcagaaggaggccgcggacgcctcggcgctgatgtacatcagcttctacagcgagcagatgaacaacccgcagatcaccgactacctgtcgcgggtgatccagcccaagctggcgaccctgcccggtatcgccgaggcggagatcctcggcaaccaggtgttcgccatgcgcctgtggctggacccggtgaagatggccgcgttcggcgtcaccgccggcgagatcaaccaggcggtgcagcagtacaacttcctcgccgccgccggcgaggtgaagggccagttggtggtcaccagcgtcaatgcttccaccgacctcaagtcgccccaggccttcgccgccatcccggtgaagaccgacggcgaccgccgggtgctgatgggtgatgtcgcacgggtcgaactgggcgccgccagctacgacgcgatcagttcgttcaatgggattccctcggtctacatcggcatcaagggcacgcccagcgccaacccgctggacgtgatcaaggaagtgcgggcgaagatgcccgaactggaagagcaattgccgcccaacctcaaggtgtccatcgcctacgacgccacgcgcttcattcaggcctccatcgatgaagtggtgaagaccctcggcgaggcggtgctgatcgtcatcgtggtggtgttcctgttcctcggcgcgttccgttcggtactgatcccggtggtgaccattccgctgtcgatgatcggcgtattgttcttcatgcaggccatgggctactcgatcaacctgctgaccctgctggcgatggtcctggccatcggcctggtggtggacgacgcgatcgtggtggtggaaaacatccaccgccacatcgaggagggcaagccgcccttcgaggctgccctggagggcgcgcgggagatcgccgtaccggtggtcagcatgaccatcaccctcgccgcggtctacgcgccgatcggcttcctcaccggcctcactggcgccctgttcaaggagttcgccttcaccctggccggcgcggtgatcatttccgggatcgtcgccctgaccctgtcgccgatgatgtgctcgcgcctgttgcgccacgaggagaatccctcgggcctggcgcatcgcctcgacctgatcttcgagggcctgaagcaacgctaccagcgcgccctccacggcaccctggacacccgtccggtggtcctggtgttcgccgtgctggtactggcgctgatcccggtactgctgatgttcaccaagaaggagctggcgccggaagaggaccagggcatcgtgttcctcatgaccaactcgccgcagaccgccaacctcgactacctgaatcgctacaccgccgagttcgaaggtatcttccgcagcttcccggagtattactcggcgttccagatcaacggctacaacggcgtccaggccggcatcggcggcatgctgctcaagccctgggacgaacgcgaaaagagccagatggaattgctccatgcggtgcaggcgaagctcaacgagattcccggcgtgcaaatcttcgccttcaacctgccgtcgctaccgggcaccggcgagggtctgccattccagttcgtgctcaacaccgccaacgactacgagtcgctgctgcaagtggcgcaacgggtgaagcagcgcgccagcgagtccggcaagttcgccttcctcgatctcgacctggcgttcgacaaacccgagctggtggtcgacatcgaccgcgagaaggccgcgcagatgggcgtctccatgcaggacctgggggtggcgctggccagcctgctcggcgagggcgagatcaaccgcttcaccatcgacgggcgcagctacaaggtcatcgcccaggtcgaacgcccctatcgcgacaatcccggctggctcggcagctactacgtgaagagccgcaacggccaactggtcgccctctcgaccctgatcgagacccacgaacgggcacggccacggcaactgaaccagttccagcagctcaactcggcgatcatctccggcttccccatcgtcagcatgggcgaggccatcgagacggttcagcagatcgcccgcgaggaagccccgcgtggcttcgccgtcgactacgccggcgcttcccggcaatacgtgcaggaaggcagcgcattgctggtcaccttcggactggccctggcgatcatcttcctggtcctcgccgcacagttcgaaagcttccgcgatccgctggtgatcatggtcaccgtgccgctgtcgatctgcggtgcgctgataccgctgttcctcggcgtgtcgagcctgaacatctatacccaggtcggcctggtgacactgatcggcctgatcagcaaacacggcatcctgatcgtcgagttcgccaaccagttgcgccacgaacaggggctggggcgtcgcgaggccatcgagcaggccgccgcgatccgcctgcggccagtactgatgaccaccgcggcgatggtgctcggggtgatcccgctgatcctcgccaccggcgccggggcggtcagtcgcttcgacatcggcatcgtgatcgcgaccggcatgtcggtgggcaccctcttcaccctgttcgtcctgccgtgcatctacaccctggtggccaggccggatgccccgccaggcgtgacgcaagcggcaaacgcacactga

SEQ ID NO: 7847 - DNA, 1125 bp, Pseudomonas aeruginosa
tgcaggcggtgctgcacaactatcccaacgccgaggtggagtgggagttccgctgccgcaaccaggaagacctggcgcctgtacctgccggccatccgcgaacagctggaatacctggcgggcctggcgatcagcgacgagcaactggccttcctcgaacggattcccttcctggcgccggacttcatccgcttcctcgggttgttccgcttcaacccgcgctacgtgcagaccggcatcgagaacgacgaattcttcctgcgcctgaaaggtccctggctgcacgtgatcctcttcgaagtgccgctgctggcgatgatcagcgaggtgcgcaaccgcgcccgctacccggccgccaccgtcgagcaggcgcgcgaacgcctgcaggaaaagttcgattggctgcgccgggaggccagcgccgaggaactggccggcttcaagatggccgacttcggtacccgccgccgcttctcctatcgggtccacgaggcggtggtgagcggtctgaaggaggactttccgggctgcttcgtcggcaccagcaacgtccacctggcacgcaagctcgacctcaagcccctcggcaccatggcccacgaatggctgatggcccaccagcagctcggtccgcgcctgatcgacagccagagtgccgcgttggactgctgggtccgcgaataccgtgggctgctcggcatcgcgctgaccgactgcatcaccaccgatgccttcctgcgcgacttcgacctctatttcgccaagctcttcgacggcctccgccacgactcgggcgacccgttgctgtgggcggaaaagaccatcgcccactacctcaagctgggcatcgacccgctgaccaagaccctggtgttctccgacggcctcgacctgccacgggccctgaagatctatcgcgcgctgcagggccggatcaacgtcagcttcggcataggcacgcatttcacctgcgacctgccgggcgtcgagccgatgaacatcgtggtgaagatgagcgcctgcaacggccatccggtggcgaagatctccgatacgcccggcaaggcgcaatgccgggaccctgacttcatccactacctcaagcacgtgttccaggtcgcctag

SEQ ID NO: 7848 - DNA, 840 bp, Pseudomonas aeruginosa
gcatcatcagccccaggggcggttgaaggaggaatgccatctcctgtcggcaagattggcacaaagcgaggcacctatcaaaggccggagtacgccggatcgcccgaagcgtgccagtctagggaacctttccccttccttcgccggagccccatgcgcccagtcctgctgctttgttgcctgttcctgtccgccaccgcccaggccgaggattgctcgccgcaaacctccgtcggtagctggtgcgagctgccgctcgcggctctccacccgacccagcagaatgtcggcctgctgcaggtcgaggatgaccaggccaagctcgccgggaagaagcccaaggctctcgagcgctacttgcgcaagaaggagattccggtggtgatcggccccggcggccgcttctacctcaccgatcgccatcacctgagtagcgcgctctggcgcctggacccgaaacagggcgtgccggtgaaggtgatcggccggctaccccaggccagcgacttctgggagaagatgcaggaaaaccactgggtctggctgcacgatgcgcgtggcgcggagatcccgcccgaggccctgccgaacgctctcgccgggcttggcgacgatccctaccgcgccctggccggctacgccgaggacgagaacgccttcgacaaggatcggcagagctatttcatcgaattccactgggcgcgctatttcggcgaacgcatgcactggcggccgatcagccgcgccactctgcccgacgacctgaagcaggcactgcacctggcctgcgaaccggcggcaagggagctgccgggctaccgccaggactgcccgcactga

SEQ ID NO: 7849 - DNA, 996 bp, Pseudomonas aeruginosa
gcagcaattctcgggcattctttgcagcttcaacgctcaatttatgactccttgcatagaatccgtcgtaaacggacgggcatatcaaagtacgttcgcaggtgccggcaaggtccgcttccagaaactgctcgtggggttccaagcaatgcaattgaaagacaaggtcatcatcatcaccggcggctgccaggggctcggccgggcaatgggcgaatatctcgccggcaagggcgccaggctggccctggtcgatctcaaccgcgaacgtctcgacgaagccgtcgctgcctgcaaggccgccggcggcgacgctcgcgcctacgtgtgcaacgtggcggacgaggaacaggttacccacatggtggcccaggtcgccagcgacttcggcgcgatcaacggcctggtcaacaacgccggcatcctccgcgacggcctgaccatcaaggtcaaggacggccagttgagcaagatgagcctggcccaatggcaatcggtgatcgacgtcaacctcaccggtgtgttcctctgcacccgcgaagtggcggcgaagatgatcgagctgaagaacgaaggcgcgatcgtcaacatttcctcgatctcccgcgccggcaacatgggccaggccaactactcggcagccaaggccggggtggccgcggataccgtggtctgggcgaaggaactggcgcgctacggcatccgcgtggccggcgtggcgccgggcttcatcgagaccgagatgaccgccgggatgaaacccgaggcgctggagaagatgaccgccggcatccccctcaagcgtatgggcaagccggtggagatcgcccactcggtggcctacatcttcgagaacgactactacaccggccgcgttctcgaactggacggcggcctgcgcctgtaggccccggccccgcaaggaaaaagccccgctatcgcggggctttttcgtgcaggccggcttaccagccgaccccgaggccgatggtatag

SEQ ID NO: 7850 - DNA, 1221 bp, Pseudomonas aeruginosa
tcggctggttgtggctgcgccgcgcgccgtccagcgagacgccggcgccgggacaccagaacgccgagcagcactgaggcgagaatgaaaaaggccggcattcgccggcctttttcgtggatcgcacggacctcagtcggccatcgcgccctgcacaaccttgaccacccgctgcgggaagggaatgccgataccttccttgcccagcgcgtcgcgggccttttcgttgaacatgaacatcacgtcccagtagtcggcgttcttcacccagacccgcagggacagggtaatcgcgctttcgccgagattggaaaccaccgccaccggtgccgggtccttcagaacccgcggatcgtcggccatggccaggagaatgttctgcgcattcttcagatcggcgtcgtagtcgatgccgacgtcgaagatcaccttgcgcagcggctcggcggagtagttggtcaccgttccgttggacagcgccccgttgggcacgatgatccgcttgttgtcgccgctacgcagcacggtgtggaagatcaggatcgaatccacggtaccggccacgccctgtgcctcgatccagtcgccgaccttgaacgggcggaacagcaggatcagcacgccgccggcgaagttagccaggctgccctgcagggccaggccgatggccaggccggcggcgccgatggcggcgacgaagctggtggtctggatgccgatcatggaagccacgctgaccaccagcaggatcttcaggacgatgctcaccaggctgccgacgaagccttgcagggtgcggtcgacgctgcgcctggcgagcaggccgccgacccggccggtcagggtgttgatcagccaccagccgatcgccagggtcagcagcgccagggcgaccttgccgctgtactccagcacgatcggcagccaggactcggtctgctgcaccagtcggtcgtagttcaattccatgcattacctccatttctcgaaaaaacacccctcccttccgcaacggaaacgggacgggcttgcagattcctgcccggacgccgtggggcgacgtttccgggcctggatacgaatcggcgcagcgcggacgaaccgacgctgcgccgacaggggcggacaacgcgggagaggtcgcggcggcgctactccctattgcgatgcccgggatggcgagaggttccgaaaaacctcgtcaatcgcggaagttggtga

SEQ ID NO: 7851 - DNA, 420 bp, Pseudomonas aeruginosa
gcctggtggaagacggccaggccagcctctacccgatcgccgcggaaaccccggacggcgggcaacccatccagcgcctgctgctggcctgcaaggcctacgacgcggaggaagccgcctccagcgtggcccatcgcctggccggcaacgccgaactgctgttgctgcagaacggcctgggcagccagcaggcggtcgccgcccgcctgccgcgcagccgctgcctgttcacctccagcaccgaaggcgcgttccgcgatggcgatttccgcgtggtcttcgccggccgggggcacacctggctcggcgatccgcgcgacacaagcgcccccgcctggctggcgcagctgtcccaggccgggatcccgcacagctggagcgacgacatcctcgaacggctgtggcgcaagctggccctga

SEQ ID NO: 7852 - DNA, 1110 bp, Pseudomonas aeruginosa
actgccgagcgcgttctacaccggaaccctcaccgccagcctggcgatcctcggcgtcagcgtgctgctctggctgctggtggcgcagcagatacgccgcctgatcacccggccgatccgcgatctcgaggaactgtcgcggcaggtcacccgcgaggagaactacgccctccgcgcccagcgcggcaacggcgacgagatcggccgcctggccgacgcgttcaacaccatgctgacccgcatcgaggcccgcgagcagcagctcaagcgcgcccgcgacgatgcccaggaagcggtcgagcaggcccagagcctggccgaggaaacccgccgctcgaaccgcaagctggaactggaagtgcaggtgcgcagcaagatcgagaagaagctcaccggtttccagcactacctcaacagcatcatcgactccatgccttcggcgctgatcgcggtggacgagcaactctacgtcacgcagtggaaccaggaggccagccagctttccggcaccagcctggacgatgcggtcaaccagccggtgttcctcgcctttccctcgctcaagccgttccttccgcagctcacccgggctgccgagaagcacagcgtggagcgtgtcgaacgggtcacctgggcgctgatcgacacgccacgccactacgccctgaccttctacccgctgatgggcggcaccggccgcggcgcggtgatccgcatcgacgacatcacccagcggctgagcctggaagaagtgatggtgcaatcggagaagatgctctcggtcggcagcctcgccgccggcatggcccacgagatcaacaacccgctcggcgcgatcctgcacaacgtgcagaacatcaagcggcgcctgtccccggagctggcgaagaacgtcgagctggcggccgaggtcggagtgccgctggaagacatcaatcactacctcgacggccgcgacatcccgcgcctgctggaaggcatccagcacgccggctcgcgggcagcgaagatcgtcacccacatgctcgccttcagccgccgcagccaccggcagatgaccgcttgcgaactgcccgcactgctcgaacaggcggtggaaatcgccggtaa

SEQ ID NO: 7853 - DNA, 1227 bp, Pseudomonas aeruginosa
accggctctccgacctgctgttcgtcgccgcccgcgccatcgcccggcgccagggcgtggcggagattctctgggaggcggcggcaaaaccggactgacggcgagcgagggctcggcatcgagacgaaaaaaaggaggccgaagcctccttttttcttcattccaccgtcaaaggccgcccggccagaacgcacggatacccgccacgccctgggctccatgctcccaagcctgctcggcttgctgcggaccgaggccacccagcaggtagaccggctggttgaagccggcgatcagttcggcggccttgtcccaacccagcgccggctcgccgggatggctctcggtcggctgtaccggcgaaagggtgacgaactccactcccatcgaggcagccagggccagttcctccgcgtcgtggcaggaggcggccagcaggcgcccttcggggaacggccgaccggcgctggcgtatttgcgcagttgagcggaggtcaggtgccaaccggcagccgggaagtcgcccagccactccagcgggcctttcagcatcagttgcgccttgccggcgcagagtccctggatatcgatggcgagatcgcggtattcgggactgaacatgttcggcgcgcgcaactggatcaggcggatgcccgcctccaccgccttgcgtacgccgctgatcagctcgcccggctccaatccgtccggggtgatcaggtagtgcgccggcaggcgcgcggcctggacgatcggcgcgttggcggcggggaactcgtagtcggccagctcgcgcggctccacccaggccagcggttggccctcggcgccgtgggcttcgccggaaaacccgtcgacctcccagacatcgagcaggacgtgcttgtcggcatagtcgtgccggacctggatcagcggccgggcccgctcgacacggatgcccagttcctcttccagctcacgggccaacgccgcgcgcaccggctcgccgtcctccaccttgcccccgggaaactcccacaggccgccctggtgcttgtcttccggccgccgggcgatcagcacccggccatcggagccacgaatcacggccgcggcgacatgtactcgtttcacggatcatctcctcgctactgccgtcacgcaccgcaagcggcggacggccatcaactaccggcctgctcgcgcaatgccgcgtcgtaccaggcgcggaacgcaggccactga

SEQ ID NO: 7854 - DNA, 657 bp, Pseudomonas aeruginosa
cgcacctcaccgaggaaacgctgtttggccagggtcaccggcgcggcacagaacgcgttcagggtgaacaccccggccacgctggagccttcggcgcagcgcatgaccaccacgtctttgcgccccggtcgcttgatgccggcggaagcgatgccgagttcgaaaccggggaccgggtgcagggtggacagggggccaagaccgacagccatgggaacgcgctcctttaccaaacagtggactcgatgccgtccgcgacggcgtgacggaaaacgcatcggcgccgggctggcgccaattcgaacaaacgccgcgagcggcaggaccggtcgcggcgttggtgaaccaggcgggaagcttagtccagctgcccgtggcagtgcttgtatttcttgccggaaccgcacgggcaaggctcgttgcggccgatcttctgctcgttgcgcacaggctcgagcggcacgaccggagccgggccctcgggaagctcttcttcctcgccggccacggcctgctccatcgagggagcctcggcgtgctggaactgcatgcgcttggccagttcctccgcctcgcgacgcaggcgggcctcctcttcggccgggtcttcgcgacggacctggacgtgggacagcacgcggatggtgtcgcgcttga

SEQ ID NO: 7855 - DNA, 426 bp, Pseudomonas aeruginosa
agtccttgcgcgcgatcggccggtgggtcgggatcaccaccacgtcgagaccgtagatctggcggaactcgaaggcctcggtatcggcggtgccggtcatgccggccagcttgttgtacaggcggaagtagttctggaaggtggtggaggccagggtctggctctcggcctggatcggcaggccttccttcgcctcgatggcctggtgcaggccctcggacaggcgacggccaggcatggtgcggccggtgtgctcgtcgatcaggaggatctggtcgccctggacgatgtactcgacgttgcggtggaacagggtgtgcgcgcgcagcgctgcgtagacgtgggtcagcaggctcaggttgtgcgccgagtagaggctctcgccttcgccgagcaggccgttctggctcagcaggtcctcgatga

SEQ ID NO: 7856 - DNA, 1155 bp, Pseudomonas aeruginosa
gtcgactggctgatgtgcttgtcggcgagcagttgctccagcacctcgagctgctgctcgcgggtatccaggcgtgccgccagttcgtccagcgtcgccatgaacgacggcggggcatatgcgctgccctccagcggttcgtcgacgccaccctggccgacgctcagggagaagtcgaactcgtcggggtcgacgtcggccagctcggtgagacgttcgccgagggcatccagccgaaccaggcgcgcctgcagttcgccgagatgcacgctcagtgcgtccatctgccgctgcgcgtcctcgcgggcgctgctgatctcggcactctgcgcctgcagcgcggcatcgacttcgatgccggccaccggagccggcgcgcggaacagccaggcgcccatgaagcccccggccaacaggctggcaccgaccacgcaggccccggccagcatcagcaaccgcggctgcagatggacggagcgagcggccccatggtgccggctcagaaaaatgatgtgcatgacttatccttcatacgggccggcagtagcgaaacgctttctgctaccattccgactcagtaacccccaggcttcccgccatgtcttttcgtcccttgcccgcccaggcatcgacccagttgctgcgccaggccaggccgctgcagatgctgttcgccgaagcccagcgcatctgccgcctgcagcaactgctggaaagccagttgcaaccggcggcgcgcccgtactgccatgtggcttcgtggcgcggcggttgcctgctgctgatcgtcaccgatggccactgggccacacgcctgcgctatcagcagcggcgcctgcagcggcagctgcaggctttcgaagaattcgcgaacttagcgaaaatccttttcaaggtgcaacccaccacgtccacacaacgtgcggcacgtcgcagcttgaccctgtctgccgtcgcggcggaaaaccttcgcgaatccgccgagatcgtcggcaatccacgcctgcgggaagcgctcgagcggttggcaagccgcgccgagaaaagccggcaagaataaatcccgaaataaaaagaggccaccctgaggtggcctccaaatatggaaaggagagttttcctacactgccgccgccgggcgcatataggaaatag

SEQ ID NO: 7857 - DNA, 813 bp, Pseudomonas aeruginosa
ttcaccgactgctgctcgcgctgggccggtgcggctgcctgggttgcgctgccctgcacagtgttgtcgacgaccttcaccggtttctccaggcgcgcgcccaggccggtggcgactacggtgacgtgcagctcatcgcgcatgtccgcgtcgatcacggtgcccaccttcacagtggcgtgctcggaagcgaactgttcgatgatgttgccgacatcggagtactcgcccagggacaggtccggacccgcggtgatgttcaccaggatgccgcgcgcgccctgcaggttgacgtcttccagcagcgggttgcggattgccgcctcggtggcctcgcgggcacggttcggaccgctggcgcagccggtacccatcatcgccatgcccatttcgctcatgacggtcttcacgtcggcgaagtcgacgttgatcatgcccggacgcttgatgatgtcggagataccgcgcacggcaccggccagcacgtcatcggccttggcaaaggcggccagcaggctggcgtccttgccgaggatggtcagcagcttctcgttcgggatggtgatcagcgaatcgacgctctcggccagcgcgcggatgccctcgtcggcgatctgcatgcgcttgcgaccttcgaacgggaacgggcgggtcaccaccgcgacggtgaggatgcccatttccttcgccacttcggcgatgatcggcgcggcgccggtaccggtgccgccacccatgccggtggtgatgaagaccatgtcggcgccttccagcacttcggaaatgcgctcgcgatcttccagagccgcctga

SEQ ID NO: 7858 - DNA, 333 bp, Pseudomonas aeruginosa
ggaatgcccgcgcactcgagcaggccctgcatgctgccatcctcgccgccacgaccgtggagaatgatgaaggcacggtcgatcttctcctcgaccaggcgttgcagcaggtcttcgccgacatcgatgccgaaggcatcgaccccggcggccagcagggattgcaggaccatcgcgccggacttcagcgacacctcgcgctcggcgctcttgccgccgaacagcacggcgacacggccgaacgccttgggatcctgggtgccgttcagcaggctatcgaggcaaaggttcatgcgcccttccctcccttgccggcgaacagcgggttcttga

SEQ ID NO: 7859 - DNA, 345 bp, Pseudomonas aeruginosa
tggcggattgccggacggatttccagcggcacctgcgccagggcctctggcaacagcttgttcagcggttccgcgccaaggctgccgccgagcaccagcagattgacccgacggccggtcagcggcgcgcgggcgtgcgcgtcgaggaatagctcgccgcgcaccggattgccggtggtcagacgcttgtcactggccgggaaggtatccgggaatgcctcgcagacgcgcctggcgatcggcgccaggctgcggttggcggtgccggccacggcgttctgctcgtggatcaccagcggcacgccgttgaggcgcgcagccaggccgcccgggccggtgacatag

SEQ ID NO: 7860 - DNA, 1287 bp, Pseudomonas aeruginosa
ccgcgcgcctggaactcccgcgcacaggcgagcgccgggaacacgtgtccgccggtgccacccgccatgatcaggacattacctttcatcggcaaagtcctcttcgttgaactcatattcctcgctacccaggtgggttcgccgttcccattcgatgcgcagcaacatccccagacaggcacagcagatcaccagcgaactgccgccgtagctgaggaacggcagggtcaggcccttggtcggcagcaggccgacgttcaccccgatgttgatcaggaactggccgatccagaggaaggccaggccgtaggccacgtaggcggagaagaactgcttggcctgctcggcccagatgccgatgtacagcgcgcgcaggctgacgaacacgaacagggcgacggtcgccagggcgccgacgatgcccagctcctctgcaagcacggcgaagacgaaatcggtgtgcgcctccggcaggtagaactgcttctggatgctgttgcccagtcccatgcccaaccagccgccgcggccgaaggcgatcagcgcctggctcaactgatagccggcgccgaactggtcggcccaggggtcggtgaagttggtcaggcgtgccatccggtagggctgggtctggatcagcaggaccaccgcgccgaccgccagcagcaccatcaggccgaagcggaacagccccaccccgccgaggaacagcatggccgcggcagcgcccatcattaccacggtggcgccgaagtccggctcgcgcagcagcaggccggccatcggcagcaacaccacgaagggcttgaagaagcccatccagctttcccggacctcctgctggcggcggatcaggtagccggccatgaagatcaccacgcagaccttggcgatctccgaaggctggatgttgaacaggccgaagccgatccagcgcatcgagccgttcacctcgcggccgataccgggggtgatcaccagcaccagcaggccgaaggcgaccagcaacagcttccagccccaacgctgccaggtggccatcgggaccatcatggtcaggccgcaggaaatcaggccgatcaccaggtagatcaggtgacggacggagaaatacagcgggttgcccgactgcgccgctgccacctcggaagacgcggaagtcaccatcaccagggccgaggccgagcagcgccaggcaacccgccagcagcgggaagtccaggtcgatgccgtgccggctcaacagcggcgacgggaaggggcgcaacaccgacagcatcacgctag

SEQ ID NO: 7861 - DNA, 1401 bp, Pseudomonas aeruginosa
ctcctctacggctttggcgaacaggcgtccgcgttcttcgaagttcttgaacatgtccaggctcgcgcaggccggcgacaacagcaccgcatcgccttcgcgggccagctcggcggcctgccggactgcttcgtccagcgttgcgacgcgcaccagcggtaccgcgttgcccagtgcctgggcaatcagcccggcgtcacggccaagcagtaccaccgcccggcagaagcgcgcgaccggctcgcgcaggtcatggaaatcggcgcccttgccgtctccgccggcgagcagcaccagcttgccgtcgatgtcggcacccagcccctcgatcgccgccagggcggcgccgacgttggtggccttggaatcgtcgtagtagctcacgccctgccgctcgcgtacccactggcagcgatgagccaggccggaaaacgccttcagcgcgccgagcatggcgtcgaacggcaggccgaccgcatggcccagcgccagcgcggcgagcgcgttggaatagttgtgggcgccacggatcttcagttcgccaaccggcagcagcttgtcgaactggaacgccagccacttctggccgtcttcctcgatcaggccgaaagccttgaagtccggcttgttcaggccgaacgaccagcacggcacggtatcggcgatcagcggtcgggtcagggcatcggcgcgattcaccacgacctggcgggcaccgcggaagatccggtgcttggccaggtggtagtcagccatgccgtcgtagcgatccatatggtcttcgctgacgttcagcacggtcgccacctcggcgttgaggcgatcgcaggtttccagctggaagctcgacagctccaacacgtacagctcgatgtcgtcggccagcaggtcgagcgccggggtgccgaggttgccgccgacggcgacacgcttgtccgcggccaccgccatttcgcccaccagggtggtcacggtgctcttcgcgttggaaccggtgatggcgacgatcggggccttcgcctcgcgggcgaagagatcgatgtcaccggagatgcgcacacctttcgcggcggcctgtaccagcgcgggggtgcgcagcgacaagccggggctgacgtagagttcgcgggcggagcagaggaactcggcgtcgagttcgccgcaacgcacttccacctgcggatactgggcacgcagggtggccagctccggcgggttctctcgggtatcgacaacggcgaaaggcaagccgcggcgcgccaggtagcgcaccagggacatgccgctcttgccgaggccgacaacgatgcggaagtggtcggaggcgatcaggctcatgctctcttcgtcctcaacgcagcttcaaggtggcgaggccgatcagcaccaggatcacggtga

SEQ ID NO: 7862 - DNA, 1215 bp, Pseudomonas aeruginosa
cgcggggttggcgttgtagctgtcgtctatcacacgcagcccgctggcggtcagttgcgctaccgcgcggcccttgaccggctgcagcgcctgcagcccggcgacgatcccatccagcggcacgcccagtgcatgggcggcagcggcggcagccagggcattggcgacattgtgccgccccagcaggttgagctggacctgcgcttcacccgctacgccctgcagcctgaagcccatgcagccacgcgcatcgcgctgcagatcggcggcgcggaaatcggcctggggccggtcgagggagaaagtcagcaacggacggccgctggcacgggccttccaggtgtcgaaggccttgtcgtccaggttcagcacggcggtgccgtcggcggccagcccttcgagtatctcgcccttcgcctcgacgatcttctccggtccgccgaactcgccgacatgggcggttccggcattggtgatgatcgccacgtgcgggcgggtcagctcaaccgtgtaggcgatctcgccgatgcgcgaggcgcccagttcgatcactgcgctacggtgctgcggcgccagttgcagcagggtcagcggtacgccgaggtcgttgttcagattgccacgggtagccagcaccgactcggcatcgccggcctgggtacacaggatgctggcgagcatctccttgaccgtggtcttgccgctggagcccgtcatggccgccagcgggccggtgaacttgcgccggttcagcgcgcccagtcgccccagggccgcacgggtatcgcgcaccagcaattgcggcaggggcgcgtcggcgacttcgcgctccaccagcgcagccaccgcgcccttggcggcaacctcggcgagatagtcgtggccgtcgaaacgcggcccactcagggcaatgaacagttggccgggcccgatggcgcgactgtcggtggaaaccgccgaaaagacggcgtcctcgccgatcaggcgggcgtccagcgcgaccgtcaactggctgaggcgaagaggctcaagcatgcggcacctcccaggcggccagggcgcgctcggcctgctcgatgtcggagaacggatggcgtacgccgtcgatctcctgataatcctcgtgacccttgccagccaggagcaccacgtcatccaccgcagcggaagcgatcagatgggcgatcgcctcaccgcgcgacggcaggaaggtaa

SEQ ID NO: 7863 - DNA, 837 bp, Pseudomonas aeruginosa
ggaagtcatggtcgatcacgtgcaggtcgacgattcgccagacgatggcgccgaccatcgccagcagcaggccgacgatcacgcagaaccgccatgggtagagggcgccctggaaataattcagtttcatggcgccaccatcctgacctcggccgggtcgggaacgcgcatgcgcaactgttccaccgccaggctttcgatgcggctatgggcggtccaggtgctctgctcgagaatcaaccggccccactcggcctgcgccttgtcgcgcacgctcagctcggaatacagcgagttgagcagttgccggttccagtaggtgctgtaggccacggcaatcgccgagagcagcagacctatataaagcagcaacatgaggaagctgccggtaggcaggcgcttgacgaagagacggctcatctcagcttctccgccacgcgcatgaccgcgctgcgcgagcgcgggttggccttgagttcttcttccgaagcgtactgcggcttgcccagcagcttcaggcgcggctcgaagaccttggaacggatcggcaggtcgcgcggcaggttgtccgcctcgcccttggcgtgcttgcgcatgaacagcttgacgatgcggtcttccagggaatggaaactgatcaccaccagccggccgccgacggccagcgattcgagcgcggcgtcaaggccacgctcgagatcgcccagctcattgttcacatggatgcgcaggccctggaatgcgcgggtcgccggattcttgcccttctcccaggcggggttggcaaccgtgatcacttcggcgagatcggcagttcgttcgaacggccgctcctga

SEQ ID NO: 7864 - DNA, 444 bp, Pseudomonas aeruginosa
cggcgctgcacgatggcgcgggccatccgcttggcgaagcgttcttcgccatattccttgaagacccgggcgatttcctcttcggtggcgttggcgatgaactccgctgcgctgatgccctggccgggattcatgcgcatgtccagcggaccatcgttgaggaagctgaagccgcgctcgggatcgtcgagttgcggcgacgacacgccaaggtcgagcaggacgccatcgacccgcccttcgagaccgcgtgcgcgcacctcatcgcccagttcggcgaacgagcgctgcacaatgacgaagcggccgtcttcggccgccaatgcttttcctgtctggatggcctggggatctttgtcgaatccgagcaggcgtcccccggcgcccagtttctcgagcaaggctcgactatggccccctcttccgaaggtaccgtccagatag

SEQ ID NO: 7865 - DNA, 453 bp, Pseudomonas aeruginosa
tcgccgccgagcatgtcgaccagccggtacaactggcgcaacagatcgccgacctgctgcaactgcgccagagcgaaggccgcgcccagcgcctgcagggcgccctcggcagccagatcgccacccagccgtcgcgccgccaggacatcgacttcgtgttcctcgccgccaccccgcagcaggcccgccagatcaagccgaccctggccttccagtacgccggcgaccttccggtctacgccacttcgcacctctacaccgggaccaacaacccgacccaggaccaggatctcaacggcatccgcttctgcgagaccccgtggctgctcaaccccagcgacccgacccgccagcaggtcgccgcccaatggccccaggccaacggcagcatgggccgcctctacgccatgggcgtcgacgcctaccgcctcgctccgcgtctgcctgaactga

SEQ ID NO: 7866 - DNA, 729 bp, Pseudomonas aeruginosa
cgaactgcaggtgacctcgccctcctccctgctcgcccgcaacaacgacgcctggatcaccaccaagctgaagacccagatgctcagcgaccccaacgtgccctcgtcgcggatcaaggtggtcaccgagaacggcatcgtctacatgatgggcctggtcaaccagcaggaagccgcccaggctgtccgcgtcgcccagggcgtcgacggggtgcagaagatcgtcaagctgttcgaatacataaactgaagaacagcgaacgaaaaaaaggcgatccttcgatcgcctttttcattgctcgccgtttacttgaccaccttcagggatggcctgccactgggacgcggcggctcatcggacggtccgccatcgtcatcgcccggctcgtcgtccaccggacccggctgctccagatcgaagaccatgccctggccgttttcccgggcgtagatggccattaccgccagcgctggaatgtacaggctctgcgccacgccgccgaaacgcccctcgaagctgaccgcctcgttgtccatgtgcagatgccgcacggcagagggcgagacattgagcacgatctgcccatcgctggcataacccggaggcacctttaccccggcgaactctgcgttcaccaggatatgtggcgtgcaatcgttgtcgacgatccattcatagagcgcgcggaccagatagggacggctggaattcatcttcatgttccttaa

SEQ ID NO: 7867 - DNA, 447 bp, Pseudomonas aeruginosa
gctatcccgttaaatcttcagttcttggggctgctgagcggtgtgcgggtggctggcacccttgtacaccttcagcttgcgatacatatcgcgacccagagggttcttcggcagcatgccttttacagcggtctcgatgacgcgctcaggggccttggcgatcagcttctcgaagttgatcgacttgatgccgcccgggaagccggagtggtggtagtacatcttgtcggtggtcttggcaccggtcacacgcacctgctcggcgttgatgacgacgatgtagtcgccggtgtcaacgtgcggagtgtactcaggcttgtgcttgccacgcaggcggcgggcaatttcggtcgccagacgacccagggtctggccggcagcgtcgacgacgaaccagtcgcgctgtacagtttccggtttcgcggtataggttttcattcgttatag

SEQ ID NO: 7868 - DNA, 495 bp, Pseudomonas aeruginosa
cctggggcgagcagaacagcgagcaggacgccttcgcccagatcgccagggccaaggccgccgggatcaatttcatggataccgccgaaatgtatccggtgccgccccgcgccgagacctacgccagcaccgagcgcatcatcggcaactggttccgccgcagcagcgaccgcgccgactggatcctcgccagcaagatcgccggccccggcaacggcatcagccatgtgcgcgacggcaacctcaagttcaaccgccagcacatcgtcgccgccctcgatgccagcctggagcgcctgcagacagactggctggacctctaccagttgcactggccggagcggcggaccaacttcttcggccagctcggctaccagcaccaggaagagagcttcacaccgctggaggaaaccctggaagtgctcgacgagcaggtgcgcgccggcaagatccgccacatcggcctgtccaacgagacgccctggggcaccatga

SEQ ID NO: 7869 - DNA, 1353 bp, Pseudomonas aeruginosa
tatcccgaatcggctttgcaaatcgggctgaacagatattcgcgcgaaggaatgaagatggcgacaccaaaggaagtcagaattgatttttctccaagtacaaaactcgaaatttttaagcgggtaaatggtcgctgctccttcccccgctgcaccaatgttacagttggtccatttttaggatttgatggtgcaataaatatgggtgtagcttgccatatttacagcgctgctgaggatgggccacgtggccggggcgggcagacggacgcattcattggtagcgaaaaaaatggtatctggtgctgttctgctcatgcatctttaattgataagaaaaaagggaatgaattcccctccactgtattgttcgcatggaaagaattggcagaggcccgaatcaggaagctacttgatgacgtgccttctccgctcggctgggtggatgctatagaattttcagagtacgaaaatctaattaatccgcctcgtattaccctgtcgagaaacacgctgatttttggcagaaactgtagtggcaagacttctctaatggaagcagctgcatcagttagtaattcaatatatgccgagaatttttgtggaacttataaggatggcgcttaccttaaatacaaagtgcaaattaaatactcaactgttgacacgctcaacaaaaccctggagttggagatgagcaatggcagccttgtacgcagggaaggcaaaacaccttatctgcttccccccggggatttggaagtcatcttatgctcagagcgagagacacggcgtagagcgcatgaggatgatgtcgacttcctgatgcgctatctgaatatagataaagctgctttattttacttggccgaaatggggggcggagagttactgcctggagatataaaattcgagcaggccgtcgacagaaagtatgacgaattcgatgaggagatattgacggatatatgtaagccagatggcgaaccctatatgaatcttttgtttcggagtcgcggcggccagtattgggtatctctagcgcgcttggcgacgagcgagtacggcctgcttctggtgagttttgctgtaaccaaagcgcgtgaaacatgcaagcaaaagcttacgcttttcttggtggatggtttaatctataactttgatagttataactttgaaaagcttcttggtgtgttgtcgaaaagtgattttcagtcagccctagtattgccgccttatcaggaatctaacattctagataaagatgaaggagttgttgcattaaaggagttagactatcttgtgcagtggcagttgagagtacttgagcggtcagagtggggagagtgctag

SEQ ID NO: 7870 - DNA, 585 bp, Pseudomonas aeruginosa
gtggcttcccctccgccagcgcgctcaggaacgactggcagaggggtcgcccaccctacacccagcgccggaacaacagctggcattcaccccgccgaagccgaagccattggacagcgcgtgttccatcggccagcgccgggcttcgccgcgaaccaggtcgaggccctcggcgtcggtgtcgggcgtttccaggttgagtgtggcgggggcgagctggtcgcgcagtgccaggaccgtgaagatagcctcgatgccgccggcggcgcccaggaggtggccggtggcggatttggtcgcgctgatggcgagcccgctgccagcgccgaacacggccttgatggcggccagttcgcccttgtcgcctacttgggtggaggtggcgtgggcattcaggtgttgcaccgcggccgcttccacgccggcctggcgcagcgcctgctgcatggcccggcgggcaccgctgccatcttccggcccggcggtcatgtggtaggcgtcggcgctggtgccgtagcccaccagctcggcgatgggcctggcgccgcgcgccagggcgtgctccagttcctcgatgaccagtag

SEQ ID NO: 7871 - DNA, 786 bp, Pseudomonas aeruginosa
gccggcgccttcgcccatgacgaagccgtcgcgggcctggtcgaaggggcgcgaggcgcgttcggggctgtcgttgaaatcgctggacagggcgcgcgcggcggcgaagccggccaggctgacccggtggacggtcgcttccgcgccgccgcagagcgccacgtcgacctctcccgcgcggatcatccgcgccgcgtcgccgatgcctgcacgcccgccgcgcaggcggtcaccggggcgcccagcggtcccttgaagccatggcggatcgacacatgggcggccgccatgttgcagagaaaggacgggatggtgaagggcgacaggcgccgcggtcccttgccgtcggtggtccgcaccgcttcggcgatggcatggaagccgcccaccccggaggcgatgacggtcgccgtgcgctcctgcgcctcggcgctctgcggcgcccagccggcctgggccagggcctcttgcgcggcggccagggcgaagaggatgaagcggtccatcttgcgttgttccttggcggccagcagcaggtcgggatcgaagccggcctgcgggtcctgggcacggtcggggacctggccgccgatgctgatgggcaggtcgccgatcagctccgccgggagcgtggcgatgcccgattgcccggccagcaggcgttgccatatgggttcgactccgcagcccagcgggctgaccgcgcccatgccggtgacgacgatacgtttgctcatgagggtccgagtccttctgttccgttggaatagcagtcagtggacgtaa

SEQ ID NO: 7872 - DNA, 1692 bp, Pseudomonas aeruginosa
acgcgctggtggaggcgggcctgctcgaacgccagccctacagccagcgcccgctgcgctatcagtacgtgcccacggccaagggcgaggattttcgcgtcgtgctcatggctttcgtcgcctggggcaatcgccactacgcagaggaagggcagagcgtgcagctcgtcgagcgaacaagcgggcggccggtgcgctcgttcatggcggctctcgccgatggccgaacggtaccgctggagcaatgcaccgtgcaggccgggcctgccgccagcgaggaaatgcgccagcgcctggcggccatgccggagcggagcgagctaccggctcgatgaacgggctccctggcgtccgccgcctggtcgaggagacggacgaggcgttcgcggttctgttccttgtagctggccatcgttcgcggtcgtggttgggaaaaacgcgatcgtcgaggcttgcgcatggcgctggcaggtccgcctcgcgagccgttcggcaacaccgcgagccctcggcctgctagagtgtgcagcctcgttcgcggaggtctgcatgcgtattctcgccgatgaaaacattcccgtggtcgacgccttcttcgccgaccagggctccattcgccgcttgcccgggcgcgccatcgaccgcgcggcgctggccgaggtcgacgtgctgctggtgcgctcggtcaccgaggtcagccgcgccgcgctggccggctcgccggtgcgcttcgtcggcacctgcaccatcggcaccgaccacctcgacctcgactacttcgccgaggccggcatcgcctggtccagcgcgcccggctgcaacgcccgcggggtggtggactacgtgctcggctgcctgctggcgatggccgaggtgcgcggcgccgacctggccgaacgcacctatggggtggtcggcgctgggcaggtcggtgggcggctggtggaggtgctgcgcgggctgggctggaaagtgctggtctgcgatccgccgcgccaggcacgcgagccggacggcgaattcgtctcgctggaacggctgctggccgaggccgacgtgatcagcctgcacactccgctgaaccgcgacggcgaacacccgacccgccacctgctggatgaaccccgcctggccgccctgcgtcccggcacctggctggtcaacgccagccgtggcgcggtggtcgacaatcaggccctgcgccgcctgctcgaaggcggcgccgacctggaagtggcgctggacgtctgggaaggcgaaccgcaggccgaccccgagctggccgcgcactgcctgatcgccaccccgcacatcgccggctacagcctggaaggcaagctgcgcggcaccgcgcagatctaccaggcctactgcgcctggcgcggcatcgccgaacgtgtgagcctgcaagacgtgctgccggaaacctggctcgccggcctgcaactcaaccccggctgcgacccggcctgggcgctggccacgctgtgccgcgcggtatacgacccgcgcagcgacgatgccgccttccgccgcagcctgaccggcgacagcgccacccgccgcgccgccttcgacgccctgcgcaaacactacccgccgcgccgcgagatcaccggcctgcgcgtcgccaccggtggacgggcggagttgcagcgggtggtgcgggcgctgggggcgcagttggtctag

SEQ ID NO: 7873 - DNA, 684 bp, Pseudomonas aeruginosa
acctgcgccgcgtcgaactcaccgtctacaccgacaacgccccggcgctggcgctgtatcgcaagttcggcttcgagaccgaaggagagatgcgcgactacgcggtgcgggatgggcgcttcgtggatgtgtacagcatggcgcgcttgcggagggtcgaggggcgggtgggggaatgaggggcgggcgcgacgagaggctgcggaccggcgcgacctcctggctcgccgggcttccgttccacgacaggttcgtcctgggcttcgggcatacggtgacagtggacaagcagcgcggctgttatctgggaggcgagggcgcgtgacgaaggatcctgcgacggacagcggcctgaacgtgcgcctggtcgccgcgttcgccggctggaaaggcattccctggctgtgctgggcccacagcgacctgtccccgcggctggtcctgcatgcggaccgtgtcgagttccgcgtcatccgcacgcgctcgaagccgtattccagcatttcccgggtggactaccggaaatggcactacaccgagaacatcgtgctggagttcaccgactcgctgacgaccttcatcggcaatacgatgaatcccgccatggcacggcaggcgattcggtacttgcaggaaaagggctgtccgttgtcggagcgggccagcaacctggccatggcgtag

SEQ ID NO: 7874 - DNA, 363 bp, Pseudomonas aeruginosa
tacctctgtgctattcgagcttcttcgccgcgacgctatagtcccgcccttgatccccgcgtttcgcggaaaccggttgtgcaggacgcacgcgacttggaaggaaccatgactcggcaatccgtactcgccaccggcccggaggccagcgattggtggtgcttcggcagcggcgacgagccggcgcgcgagtcgttctctgccggtgggcgttcgcttgcggcgtcgaggaaacccgtcggcgcacagagcggaatggccgtggccgagcaggcgaaccgcgcgcaagcgtccgggcaggacgccgcgccgggcctgcgaaccttcgacctgctgcctggcaacccgccgaagaacccctag

SEQ ID NO: 7875 - DNA, 432 bp, Pseudomonas aeruginosa
acacggagtcaacccatgcgccggatattcatcgcgccgttactggcgtcgctttccctgggcggctgtatccagatggacacgctgcccgaggtctacgcccgcagccagtggaagggccgttccgccgaggaagcgatagccttcttcggtacgccgcagaacatggagcgcaccgccgacggctcgcaggtggtgatgcagtggtacaccgacaccagctattcccgctatgaagtggtgggctccagctcggagatgcagggcaacgtgatggtgaacaccaactactgggataccgtcaaccaccccaatcgttgcatcatttccgtcaccgtcgacaagagcaagcggatcacccagttcgaggccgacgacggcgagttgctgctgtcccacggctgcgccggcatcaagtacggcccgccgtag

SEQ ID NO: 7876 - DNA, 417 bp, Pseudomonas aeruginosa
tccagaccatcaccgcgtacagcggcagcgctgcctcgccgcccacgatcaggccgaacgaggtgccggcgtagtcgtgcagcatgcagaagatccgccgcgccgggtagtgccccggccagcgcacgatggcctggcgcagcagtatggaggcgatcaggaacaggccgtactaggcaacgatcggcaggtaggtctcgaccttcaggccgggcagcaggccgatcagcaccacgtagaggatcgcgcaggtggccacaatcagtcgcaggttggcctggtccagctcggtattcttctcgaacttcatgtgcacctccgtgtgcatgggagcgccgcgcgccttttcctctgtttcgcccccttcgtcacgaagacggacgaagggtgggcccggccggtagcgggctaaggtag

SEQ ID NO: 7877 - DNA, 672 bp, Pseudomonas aeruginosa
catgcgcggcggaaactgcgactcctggagactacaagaatgactggccgcatcatcgtcgccgatgatcatccgctgtttcgcgagggcatgctgagtatcctccagcgcctgctgcccgaggccaggatcgaggaggccggcgatctcgccggggtcctgcgcctggctggcgaaggcgagcagcccgattcgctgatcctcgacctgcgtttccccggcctgacccgcatcgagatgctcgccgacctgcgccgccagttcccgcgcaccaccctgatcgtcgtctcgatggtcgacgacccgcagctcatcggcgaagtgatgaacgcaggggccgacggcttcctcggcaagagcatcgcgcccgaggaactcggccaggcgattctggccatccgcgccggggaagtgctggtgcggtacgaaccctccggcctcctgccgctgcagcccagcccgggcctggaggggctcaccgagcgccaactggatgtcctgcgcctgctggcccagggcaagagcaacaaggagatcggccgcgccctggacatctcccactacacggtgcgcatccatgtgtcgtcgctgctgcgggcgctggacgtgccgtcgcggaccgcggcggcggtgaagtatcgggcgctgctggggcagggggatgcggagtag

SEQ ID NO: 7878 - DNA, 624 bp, Pseudomonas aeruginosa
  unsure (53): Identity of nucleotide at the above locations are unknown.
tgctggcagcgctggcgcacctggcgggtcaggccgaggtggccgagggccangtcttcgatgcagatgccgcgtcgccgcgaggtcaccgcgacatggtccgccgccaggtactcctccgcactcaggtcgccggcgaagcccggcccggccatcacgcacaggctgtcgtcgagcaggtgctggcggcgcagggcggcgtcggtgggccgggcgatctcgatggcgaggtcgatgcgtccggcgcccagttccgccttcaggtccgcccagtgcaggctgttgcagcgtatctcgatgcgtggcgcggcctggcgcaggtgggcgaggatcgccgggagcaccagcggctccagttgctccggcatgttcagttggaaggtccgcgcgtcgcgccgagggtcgaacgtctggcagcgattcatgctgcggtgcaggccggcgagggcgtcatggatgcccggcgccagtcgctcggccagcggcgtcggcgcaaccccgcgcccctggcggacgaacagcgggtcgccgagctggtcgcgcaggcgcgccagggcgtggctgacggccgactggctgagatgcaggaggcccgccgcgcgggtcaggttgcgttctcgatag

SEQ ID NO: 7879 - DNA, 1281 bp, Pseudomonas aeruginosa
ccatccatcgcgccaagggcctccaggccgaagtggcgatcgtcgtcgacgactgcctgccgggcgagaagcatccgttgcgcaacgcgctgtacgcggcttcgggtttcttccgcaacagctacgaccaggccatggaggacgaaagcctgcgcctggcctacgtggcgatcacccgtggcgtcagccgggtgctctggtacacgcgcaaggcccagggcgccacggccctgttggcccgacgctgaggacgaccgtctcggcgggctacgcctggcgctgcatccaggcgctgaatgcgcgcaggcgctcgatgaacaccgccgggtcggtgacctggccgtccagcacggccttgaaatattccagggctggcgcctgtccggggtgccgcgcgcgaaacagcgccaggtaatgctccagggtctccggccagacgctttccgtctccccgcgaaggatgtcgctggagcggatcagcttcttcgccgcttctcgttgcaggcggcgctcctcctccgaggacgcgctttccaggcgtcgcgcatagtcttccagcacctgcgcatagtcgccgttgagggccagggcgatggctttcgccggacgcaagggcggcaggtcgctggccaggtcttcgccccacaggcagcggcagcggtgcttgagccaatagccccagctatcgcggttggccggatcgcgggcctggtccaggtggccgatatcgaaatcgatcttgctgacttccgggtggcgcgcctgcaatgccaggcgcgcggtttccagttgcgcggccagttcggggctgggcgggtcgcgcaggaccagggtcaggtcgaggtcggagcgccccgtgatggcctcgccgcgggcgacgctgccgtacaggtagacgctgtgcacggcccgctcgaacggaggccgggccagggttcggcgcaggtcgtcgagcagggggcgaaaggccgcctgcggttcgacgcgtggcggcagggggatgaagccatcgggcatgtccatgccgacagcctagcgacacgccgcccgcgcgtcgatcagcctgcgttgcggaacagcagcgccttgaggcccgccgcggggtcgacatcggggaactccggcggattctccaggcgttcgacgaagtgcagcgacggcgcctcgcgggcggtttcctcgaggaggaagtcggggccgatggccgggtcattgatacaggccagcagggtgccgccgggcaccagcagttccggcaggcggcggaggatcctgcggtag

SEQ ID NO: 7880 - DNA, 717 bp, Pseudomonas aeruginosa
aaaaggggcggattctacccgttgcgtgacggacagtccgccccttcgcttcaatcgggcgtcgcgggcgcaggcgcggcgctggccgggccgccatcctggatcatcagcaggctctgcggcgaggacagcgcgatgccttcgctgcgcaagcggtcgaggatggtgaagagcaggtcgctgcgcgcgccggccaccgaacgcgggctgttgacgaagccgctggcgttgagcaccaggccgttgctggcgagatccttgaacgtcaccgagggcgccggcgcgtcgaggatcgccgggtgttcggcgaaggcctgcaagagcagttcgcggaccttcatcgcgtcggtgtccagcggcagggtcaggttcaccccgaccaccccgagggcattgcccatggtcacgttgcgcacggtctgggagatgaactgcgagttcggcacgatcaccgtggagcggtcgcccatctggatctcggtggcgcgcacgttgatccgccggatatcgccctcgaccccgcccaggctgacccagtcgcagactttcaccggccgctcggtcagcaggatcaggccggaaatgaagttctgcacgatggcctgcaggccgaagccgatgcctaccgagagggcgctgaccacccaggtcaggctggtcaggttgatgcgcagggtggacatcaccagcatcgccaggagcacgaagccgaggtag

SEQ ID NO: 7881 - DNA, 1287 bp, Pseudomonas aeruginosa
agggacatggattttggccatatcgatccctttttggccgccgccgccgttttgccgcgaccgcgcgctgggcagaatccctccaccaagaacaagaaacctgcgaggtctctccatgctgagcgtctacagcgacgatcatcgtctgcacttcggccagtcggaactggtcgacggcaagctgcaaccctgtttcgaaatgcccagccgggccgacaccgtgctggcccgggtgaagtcgcagaaccttggcgaggtgatcgcgccgaaggatttcggccgcgagccgctgctgcgcatccacgacgccgcctacctggacttcctccagggcgcctgggcccgctggaccgccgaaggccacagcggcgacgtggtgtccaccaccttccccggccgccgcctgcgccgcgacgggccgatccccacggcgctgatgggcgaactgggctactacagcttcgacaccgaggcgccgatcaccgccggcacctggcaggccatctacagctccgcccaggtcgcgctgaccgcccaggaacatatgcgccagggcgcccgcagcgccttcgccctctgccgtccgccgggccatcacgccggtggcgacttcatgggcggctactgcttcctcaacaatgccgccatcgccacccaggcgttcctcgaccagggtgcccggcgcgtggcgatcctcgatgtcgactatcaccatggcaacggcacccaggatatcttctaccgccgcgacgatgtgctgttcgcctcgatccatggcgatccgctggtcgaatacccgtacttcctcggctacgcagacgagcgcggcgaaggcgccggcgagggctgcaaccacaactatccgctggcccatggcagcggctgggacctctggtcggcggcgctcgacgacgcctgcgtgcggatcgccggctacgccccggatgccctggtgatttcccttggcgtggacacctacaaggaagacccgatctcccagttcaagctggattcgccggactacctgcggatgggcgagcgcatcgcccggctgggcctgccgaccctgttcatcatggaaggcggctatgcggtggaagccatcggcatcaacgcggtcaacgtgctgcagggctacgaaggcgcggcccgctgaggagcgaagcatgcaatcgactcgcaagctgctggccggcctcgcgctggccgtttccgccgggctggttcaggccgcgccggaagtacggatctacaactggttcgactacatcgccccggacaccctga

SEQ ID NO: 7882 - DNA, 393 bp, Pseudomonas aeruginosa
acttcgtcgccggcgcggcgctggtcctcgccggcatcaccctggtcagcggcgagcagtggctgcgacgcctgctgcgacgctgagcgagtgcggccggcgcaacagcaggccggcgaagaccaggccgagcccggcgagcgccagcgccggttgcaggccgccggcgaaatgcgtgctgagcgccgccagcagcgggccgagcaactggccgagggcgaaaccggtggtcagttggccggcgttgcgctgcggcgtatgcggcgccagttcgcgggcgtattgcatcaccagttgcatgccggcgaggaacggcaggccggtcagcactacccccagggccagtccgccgatccccggcagcaggcaggcgagcacgccgagggcctgtag

SEQ ID NO: 7883 - DNA, 336 bp, Pseudomonas aeruginosa
aggcctggatcggtctcctgcaagggcgggaatcggcgttggcttgattcaggtcagggtccggggccggtttcccgcagtaaagttgtttccaaggacggagtggaacgtgcggagagtgggacgccggtctactctttcctagggcgacctgacttgtcaggtcgcccgattctccttcccttggacaaggggcctgtcatgaaactctggctgcaaaacctggcgtggcaactcggtgtcgcccttggcctgatcgagcccccgcgcatgcaacccatcccggtggaaaacgacgagcaacgccggcgcctcgccgcgcggcaacgtcgctga

SEQ ID NO: 7884 - DNA, 420 bp, Pseudomonas aeruginosa
gtccgccctggggtaccagggcgcgtcccgcctggcggcacagacgcaccacggcggcgacctggtcggtgctttccggcaggaccaggaagcttccggcgaggttctgcggatggtagccggggtcctgcccggcgagcgcggcactgtcgcgcacgccacgggcgccgaggatctcgcagagggagcggtagagttcggaatcgtccatggcgggctccgggtcagggatggaagggcgcggcttgcagcacctcgacgatcagcggacggtccgccggggcgccgcgcatcagttcgcgcaggtgttcgagatcgcgcgcgcgttcggcggcgcagccgaagccgcgggcgatggcgaggaagtccggggtgtatatatcgaccccgagcggagtgatctcgcgccgctccatgtag

SEQ ID NO: 7885 - DNA, 1386 bp, Pseudomonas aeruginosa
tcgcgacgtcgccgatgtccgccacgttcagcgagtcgaagggggcggcgccggtggccatgttgtagggacggatcatcaccgactcggcgcggatctcgcgggggccgaagcgggtaccggagcgcagggaggtgccgatgtcgaggggcacgccgacgaaggcggcatcgagggcgtcgagttcggcgggggactggacatggggcaggcgcatcatggtggcgatgccgccgaagcggggcatttcattgccgcccaggggctggtggagattcttgtccacggggtggcctcacggtcgttgtggttgttttaggggtcggacggattctcttcacagccggtagcgagtcaaatcgctggctacaaataatcagttcagagatttctaaactaacggcgaagcggctagacttcgccgccgagcccggacggaggcctttgcctcggcctgctgtccgaaatcctcgcccgcaaaccggagtcgccgtgtccaacgccttgcccgacctgcgcctgttgcgcatcttcgccgcggtggtgcgccaccagggcttcgccgccgcccagcaggagttgaacctgtcgacctcggcgatcagcacctacatgagccaactggagaaccagctcggcatcgtgctctgccaccgtggccgcggtggcttcagcctgaccagcaagggcgagctgttccaccaggaaaccttgcgcatcctcggcgaactggaaggcttcgaacgctacgcgctggcgttgaagggcgagctgcgcggcaccctgaacctcggcgtgctcgattccacggtgagcgacccggcgctgccgctggccgaggtgatcggcgccttcagccgcgaacacccggcggttcacctgcacctgctggtgcagagcccctacgaactgcaactgagcgtgctggagaaccgccaggacctggctatcggcgccttttccagtcgcatgaacggactggtctaccagccgctgtaccgcgaacagcactggctgtactgcagcgaccggcatccgctgttcgacgggcggagaattcccgccgatctgatcacccagcaacgcatggtcggccgcggctactggagccaggccgagctggcccggcacggattcaagcacagcgcgggaacggtggagagcatggaggcgcaactgatcctgatcctttccggcggctacatcggttacctgccggagcactacgctcacccgtgggtcgagcaggggcgcctgcgcgccctgctgccggcgaccttcggctaccaggcgccattctccctgatcctccgtcgcggccgctcgcgcgagccgctgatccaggccttccgcgaccagttgcggacgcagatgagcctggcctga

SEQ ID NO: 7886 - DNA, 576 bp, Pseudomonas aeruginosa
cgctgctcggcgcattcctcgacgacgccgactttctcatcctcgacgaaccgagcaaccctctcgacgggccggcacgcgctttgctgcgggcgcgcctggcggcatgggacggcggcctgctgctggtcagccatgaccgcgaactgctggagggcatgcagcggatcgtcgagctgtcgaccctcggcctgcgcagctatggcggcggctattccttctacgcgcagagccgggaggaggcgcgcgaggccgccgaacgtcgcctggaccagcgtcgtctggagcgcaagcggcagaccctggccatgcgcgaacagcagcagcgccaggagcggtgccaggccagcggccggcgcgaaggcaagacggcgaaccaggcgaagatcctgctcggtgggttcagggaacgtagcgaggtcagcgccggcaagatgcgcaacgcccaccaggcggagcgcgagcgtctcgaccgcgaggtgcgcgaggctgcccgggaggtcgaggaggcgtcgccgctgctgctcgattcgcccgatgccgaactggcggcacagcgccggatcgtcgagttga

SEQ ID NO: 7887 - DNA, 1032 bp, Pseudomonas aeruginosa
agcggacatcgtcgagctttacccacaggtccgcgacctgtacctgccggccgtcgaggtctgggtgctggtcgacgacgacggcgtggcccagggcttcatcggcctgaaccaggcgcatgtcgagatgctcttcgtcgaacccgggctgcgcggccggggtatcggccgacgcctgctcgatcatgcgcgggcgacctggccgcgcctgagcgtcgatgtcaacgagcagaacccgcaggcctgcggcttctatcgacactatgggttccgccagaccggccgctccgcgaccgactcggcggggcggccgttcccgctgctgcacatgagcctgtaggaggacgcggcacctcgccctgtggagcgaggtgccgcgcaacatccggaaaagttttccccggccagatgctttcaactgcaagcatccgtttgagacaggtcaaacgttgcggcgcaggcctgcccgatagttctgttcatcagaacgaggcgcaggaatcccatgaacggcatcccacccctgtcttcccgcgacgcccatgccagcccgccgcaacgggtgctggaacgattgcacagctccgccgccggcctggacgcggacgaagccgcccgccgcctggcggcgcacggctacaaccgattgcccgcgccgaaacgccaggggccgctgctgcgcttgctgcggcagttccacaacgtcctgctgtacatgatgctgttcgcctcgctggtcaccgcgctgctcggcttctgggtggacagtgcggtaatcctcctggcggtggtggtcaacgcgctgatcggtttcgtccaggagggcaaggcggccaacgcgctggacgccatccgcgacatgctttcgctgcatgccctggtcctgcgcgacggccagcgccaggcgctggacgccgaacgcctggtaccgggcgacgtggtgctgctggcctccggcgaccgggtgccggccgacctgcggctgttcgaaacgaagaacttccatgtcgacgagtcggccctgaccggtga

SEQ ID NO: 7888 - DNA, 909 bp, Pseudomonas aeruginosa
gtcggtgccggtggagaagggctgcgtcgcggtggccatcgacgcgctgctcggcgaccgccgttgcatggcctattccggcaccctggtgaccagcggccaggcgcgcggagtggtggtcgccaccgccggggataccgaactgggccggatcggtacgctgttgcgcgaagtccgcaccctggccactccgctgctgcgacagatcgccagcttcagtcgctggctggccctggcgatcctgctgctggccggcgccactttcgtcctcggcaccctctggcagggccagccgatggtggacatgttcatgctggtggtggcgctgaccgcctcggcgattcccgagggactgccggcgatcatgacggtgatcctcgccctcggcgtacagcgcatggcccggcgcaacgccatcgtcagccgcctgccggcggtggagacgctgggttcggtgacggtgatctgctcggacaagaccggcaccctgacccgcaacgagatgaccgtgcagcgtatcgtcaccgccgaccaggtaatcgaggtcagcggcgccggttacgcccccctgggtggtttcagccacaacggcgaaggcctcgatcccgccggacgcgacgatctgcaggagatcggtcgcgcggcgctgttgtgcaacgaggcgcgcctgcaccaggagggcgaggcatggcaactggagggcgaccccaccgaaggcgcgctgctcagcctcggcctcaagctgggcctcgatccgcaggcgctggcggcggaacggccacgcagcgatgcgattccgttcgagtccgagcatcgcttcatggccaccctgcaccacgaccacgcaggccaggcgatggtctacctgaagggcgcgccggagcgcatcctcgacatgtgcgaggctga

SEQ ID NO: 7889 - DNA, 414 bp, Pseudomonas aeruginosa
acgggtgggcgactcggtgcggccgctggacccggactactggcggcgcctggccaccgacaccgccgctcgcggcctgcgcctgctggccatcgcccgacgggcgatgccggcggagcagcgcacgctggatttcgccgacgtggaacatggcttcaccctgctggccctggtgggcatcatcgaccctccgcgcgaggaagccgtggccgcggtcgccgaatgccaggcggcgggtatcgcggtgaagatgatcaccggcgaccacgtcgacaccgcgcgggcgatcggcgccatgctcgggatcggcatcgaccggccggcgctgaccggcgcggagatcgagttgctcgacgaccagcgcctgcgcgaagtgctgccgggcgtcgatgtgttcgcccgcgccagccctga

SEQ ID NO: 7890 - DNA, 981 bp, Pseudomonas aeruginosa
gcacaagctgcgcctggtgcaggccctgcaggccagcggcgaggtggtggcgatgaccggcgacggggtcaacgatgcgccggcgctgaagcgcgccgacgtcggcgtagcgatgggcaacaagggcaccgaggcggccaaggaggcggccgaggtggtcctcgccgacgacaatttcgccaccatcgccaatgccgtgcgcgagggaagggcggtctacgacaacctgaagaaattcatcctcttcatgctgccgaccaacggtggcgaggcgctgatcgtgatcgccgcgatcctgttccagttgaccctgccgatgacgccggcgcagatcctctggatcaacatggtcacctccagcaccctgggcctggcgctggccttcgatccggccgagcgcggcctgatgcagcgtccgccgcgtccgccggcggagcccctgttgtcgctgttcttcgtctggcgggtgctgctggtctcgctgctgatgatggcgggcgccctgggcgtgttcctctgggagctggagcatggcaccgggctggagagcgcgcggaccatggcggtgaacagcgtggtggtgtgcgagatgttctacctgctcaacagccggcatatctacgattcggtgctcagccgcgagggcctgttcggcaaccgccaggtcttgctggcgatcgccgcctgcgtggtgctgcaactgctctatacctacgcgccgccgttgcaggcgctgttcggctcggtcggcctggccccgggcgagtgggcgcgggtgctgctggccgggctcggcctgttctgcgtcgccgaactggaaaagtggctatgtcgccgggtccgtgcccggcaggcctgacgccgcgaggtcgcccccttggccgcggcgctgtgcctttgcgcgtgcgccgcgcacagacgtctgcgcctcggatcgcccggccgagagcggtcgcacgcgtggcgatgggccgacagtga

SEQ ID NO: 7891 - DNA, 561 bp, Pseudomonas aeruginosa
cccggaaaccatggcctcgtcggtggccacccccttggaagtgcagttcagcgcgattcccgggatcaccgagatgacttccagcagcgccctgggcaccaccaccctgaccctgcagttcagcctcgacaagagcatcgacgtcgccgcccaggaggtccaggcggcgatcaacgccgcggccgggcggctgccggtggacatgccgaacctgccgacctggcgcaaggtcaacccggcggacagcccgatcatgatcctgcgggtcaactcggagatgatgccgctgatcgaactcagcgattacgccgagaccatcctcgcccgccagctcagccaggtgaacggcgtggggcagatcttcgtggtcggccagcagcgcccggcgatccgcatccaggcccagccggagaagctcgccgcctaccagctgaccctggccgacctgcgccagtcgttgcagtcggccagcgtcaacctggccaagggcgcgctctacggcgaggggcgggtgtcgacccttgcggccaacgaccagttgttcaacgccagcgactatga

SEQ ID NO: 7892 - DNA, 1077 bp, Pseudomonas aeruginosa
cgacctggtggtcgcctaccgccagggcgcgccggtgttcctcaaggacgtggcgcggatcgtctcggcgcccgaggacgactacgtgcaggcctggccgaacggtgtgcccggggtggcactggtgatcctccgccagcctggggcgaacatcgtcgataccgccgacgcgatccaggccgcattgccgcgcctgcgcgagatgctcccggcgaccatcgaggtagacgtgctcaacgatcgtacccggaccatccgctcgtcgctgcacgaggtcgaactgaccctgctgctgaccattggcctggtggtgctggtgatgggcctgttcctccgccagctgtcggcgaccctgatcgtcgccacggtgctggcggtgtccctgagcgccagcttcgcggcgatgtacgtgctcggcttcaccctcaacaacctgaccctggtggcgctgatcatcgccgtcggcttcatcgtcgacgacgccatcgtggtcgtggagaacatccaccgacacctggaagcgggcgcctcgaaggtcgaggcggcgctcaagggcgcggcggagatcggctttaccgtgatttccatcagcttctcgctgatcgccgcgttcattcccctgctgttcatgggcgggatcgtcggccggctgttccgcgaattcgcggtcagcgtgacggtggcgatcctgatctcggtgctcgcttcgctgaccctggcgccgatgctggcttcgcgcttcatgccggcattgcggcatgccgacgcgccgagaaagggcttcgccgaatggctgaccggcggatacgagcgcggcctgcgctgggcgctcgggcaccagcggctgatgctggtcggcttcgcctttaccgtgctggtggcggtggccggctacgtcgggattcccaagggtttcttccccttgcaggacaccgccttcgtcttcggcacgagccaggctgccgaggatatctcctacgacgacatggtcgccaagcaccggcaactggccgagatcatcgccagcgacccggcggtgcagagctacaaccatgcggtgggcgtcaccggcggtag

SEQ ID NO: 7893 - DNA, 1413 bp, Pseudomonas aeruginosa
ccagagcctggccaacggacgtttctggatcgtcctcaaggaccgtggcgagcgcgatgtctcggtcggcgagttcatcgaccggctgcgcccgcaactggcgaaggtgccgggaatcatgctctacctgcgcgcggcgcaggacatcaacctcagttccggaccctcgcggacccagtaccagtacgccctgcgcagcagcgacagcacccagctggcgctctgggcgcaacgcctcaccgagcgcctgaagcaggtgccggggctgatggatgtgtccaacgacctgcaggtcggcgccagcgtcaccgcgctggacatcgaccgggtggccgcggcgcgtttcggcctcagcgccgaggatgtcagccagaccctctacgacgccttcggccagcgccaggtcggcgagtaccagaccgaggtcaaccagtacaaggtggtcctcgaactcgatgcgcgccagcgcggccgcgcggaaagcctggactggttctacctgcgctcgccgctgagcggcgagatggtcccgctgtcggccatcgccaaggtcgcggcgccgcgctccgggccgctgcagatcaaccacaacggcatgttcccggcggtcaacctgtccttcaacctggctgccggggtgtccctcggcgaggcggtgcaggcggtgcagcgcgcccaggaggagatcggcatgccctcgaccattatcggcgtgttccagggcgcggcgcaggccttccagagctcgctggcctcgcaaccgctgctgatcctcgccgcgctgatcgcggtgtacatcatcctcggcgtgctctacgagagtttcgtacatccgctgacgatcctctcgaccctgccctcggcggggatcggcgcggtgttcgtgctctgggcctggggccaggacttctcgatcatggcgctgatcggcatcgtgctgctgatcggcatcgtcaagaagaacggcatcctcatggtcgacttcgccatcgtcgcccagcgcgagcagggcatgagcgcggagcaggcgatataccaggcctgcctgacccgtttccggccgatcatgatgaccaccctggccgcgctgctgggcgcgatacccctgatgatcggcttcggcaccggttccgagctgcgccagcctctgggcatcgcggtggtcggcgggctgctggtgagccaggtgctgaccctgttcagcacgccggtggtatacctggccctggagcggctgttccaccggcgcgggaccacgacctcggacggcggaaccgctggggcgacggcgacatgaggcgtaacggacgcggctttcctggacggcggcgcgtggctaggatgcaggcaggcatgcgtcccgcccgggatgcgaaggcgaacagaggatcgggcgatagatgcgggtactga

SEQ ID NO: 7894 - DNA, 1662 bp, Pseudomonas aeruginosa
ctgccaaggagtacgcgctgctctgcgtgctggcccagcgcagcggcgagatcctgtcgaagacggcgatcgccgaactggtctgggacatcaacttcgataccgacaccaatgtcgtggaggtggcgatcaagcgcctgcgcgccaagctcgacggtccgttcgagaacaagctgctgcataccatccggggcatgggctacgtcctggagaaccgtgcgctggcggagtcgggctgaggtgggcatgtccttgtcgacccgcctggcgggaatgttcgccggcgccgcggtggtgatcttcgccctcatcggcaccatgctctattgcatcctcgaccgccagaccgagcgcctgcagcagggcgaggtggacgtgcgcttcaacatggtctcgcggatgctcgaccatcccgacctggccgagcgctggccgcacctgcagggcaagctggacaacctgagccaggagtacgagctgatccgtttctggatcgacagcgacgacccgcgctatcactacgggcgcttcagcgaaccggtgcagcggctgatcgccgatggcgccggccgctacgaactggagttgccggagcaccggtacgcgctgactgcgcgggtcggcgtgttgccggcgcgcgaggggcggccgcggctgacctacgtcaccgccatcgacagcgcggcgttccatgaggcgcggacctccaccctgaaatggctgctcggcctgtccgccctcggtgtgctgctggcctcgttgcttggccactggatcgcccgcctgggcctgtggccggtgcatcggctgtccgaggaggcccggcggatcagcccgcggcagttgtcgcagcgcttgcagctctcgccgctgccggccgagctgcgcgagctggtgggagcgttcaacggcgccctggaccgcctggagcaggcctacgtgcgcctggagtcgttcaatgccgacgtcgcccacgagctgcgcacgccattgaccaacctgatcggccagacccaggtggcgttgtcccgcgaacgcagcggcgaacattacgaagaggtcctgcaatccaacctggaggagctggagcggctgcgggcgatcgtcaacgacatgctgttcctcgcccgcgccgaccagggacgcctggcctgcgagcgcgaggaaacctcgctggccggcgagatcgccaccacggtggatttcctcgaggtgatcttcgacgaggccggggtcggtatcgaggtgcgcggcgaggcccgcgcgctggtcgagcgcgccctgttccagcgggcggtgaccaacctgctgtacaacgccgcccagcacaccgccgccggcggcacgctgcgggtcggcgtcgagcggcgcggcgacgaagtgcgggtggcggtgagcaaccccggcgtgccgatcgccgacgagcaccgcaggcacctgttcgaacgcttctatcgggtcgacgcggcgcgcagcaacagcgaggccaaccacggcctcggcctgtccatcgtcaaggcggtggcgagcatgcacggcggttcggtgttcgtcgacagcgcggacggctggaacaccttcggcttcaccgtgctgagccccgagcggcgcgggcccggcgaccgcttgccgctgggcgagggcgatccggcgctgtcctga

SEQ ID NO: 7895 - DNA, 1101 bp, Pseudomonas aeruginosa
ctccggtgggcaaggaaatgctccgccagcaggcgaccgccggattgcaggaactggccaagaaggaaaccggccaactggctatcgaacaagtgttgttcaccaatttcgtgctgcagtaggtatcccatggccgtgcaagatctgctttcccaggatgaaatcgacgcgctgttgcacggcgtcgacgatggcctggtggaaaccgaagtcgaggcgacgccgggatcggtcaagtcctatgacctgaccagccaggaccgcatcgtccggggccgcatgccgaccctggagatgatcaacgagcgtttcgcccgctacacccgcatcagcatgttcaacctgctgcgccgttcggccgacgtcgcggtcggcggcgtgcaggtgatgaagttcggcgagtacgtgcactcgctgtacgttcccaccagcctcaacctggtgaagatgaagccgctgcgcggcaccgcgctgttcatcctcgacgccaagctggtgttcaagctggtggacaacttcttcggcggcgacggccgccacgccaagatcgagggccgcgagttcaccccgaccgaactgcgggtggtgcggatggtgctggagcaggccttcgtcgatctgaaggaagcctggcaggcggtgctggagatgaacttcgagtacgtcaactcggaggtcaacccggccatggccaacatcgtcagtcccagcgaggtggtggtggtctccaccttccacatcgaactggacggcggtggcggcgacctgcacatcaccatgccctattcgatgatcgagccgatccgcgagatgctcgacgccggtttccagtccgaccacgacgaccaggacgagcgctggatcaaggccctgcgcgaggacgtgctggacgtccaggtaccgctcggcgccaccgtggtccgccgccagctcaagctgcgcgacatcctgcacatgcagccgggcgacgtgatcccggtggagatgccggaacacatggtgatgcgcgccaacggcgtgcccgccttcaaggtcaagctgggcgcccacaagggcaacctggcgctacagattctcgaagcggtcgagcgctcgcgctga

SEQ ID NO: 7896 - DNA, 501 bp, Pseudomonas aeruginosa
ccgcttcccccggaggaaagacgaaccatggcagacgaagaaaaagtgaccaccgaggaacaggcactggccgacgagtgggcggcggcgctggccgaggcgggcgacgccagccaggacgacatcgatgcgctgatggcccagggcggcgcgactcccgtggcggagtcgagtaccccgcgggcgccgatggaagagttcggcgcttcgccgaaggcaccgaccatttccggcctggaggggcccaacctggatgtgatcctggacatcccggtgaccatttccatggaggtcgggcataccgacatcagcatccgcaacctgctgcagctcaaccaggggtcggtgatcgaactcgatcgcctggccggcgagccgctggacgtactggtcaacggcaccctgatcgcccacggcgaggtggtggtagtgaacgagaagttcggcatccgcctgaccgacgtgatcagtcccagcgaacgcatcaagaagctgcgctga

SEQ ID NO: 7897 - DNA, 918 bp, Pseudomonas aeruginosa
ggagcagatcctgctcggcctgacgcccggccggatcacgccgttgcacgtgctcaaggagccggtacacctgccggacggcgagccggccacgccggaattcgcccagcgcctgctggagctgctgaacaaggaccccaagggcaagccatgactccgcgcatctccctggccggcgcgctcgccgcgctctgccttctgctgctggcgccgtggccggcgctggccgccgacccgacatcgatctcggcgatcaccgtgaccaccaacggccagggccagcaggagtattcggtcagcctgcagatcctgctgatcatgaccgcgctgagcttcatcccggcgttcgtcatgctgatgaccagcttcacccggatcatcatcgtcttctccatcctgcgccaggcgctgggcctgcaatcgacgccgtcgaaccaggtgctggtggggctggcgctgttcctgaccatgttcgtcatggccccggtgttcgacaagatcaacagccaggccctgcagccctacctgaacgagcagattcccgcccaggaagccctgcaaaaggccgaggtaccgctgaaggcgttcatgctggcgcagactcgcacctccgacctggagctgttcgtccgcctgtccaagcgcaccgacatcggcagcccggaggcgacgccgctgaccatcctggtcccggccttcgtcacgtccgagctgaagaccgcgttccagatcggcttcatgatcttcatcccgttcctgatcatcgacctggtggtgtccagcgtgctgatggcgatgggcatgatgatgctgtcgccgctgatcatttccctgccgttcaagatcatgctgttcgtcctggtggatggctgggcgctgatcatcgggacgctggcgggcagtttcggcaccgtctag

SEQ ID NO: 7898 - DNA, 1158 bp, Pseudomonas aeruginosa
actggtgcgggcgaaatagccatggccgagagcgagagcgggcaggacaagacagaggaacccacggagaaacgccgccgcgaggcgcgcgagaaagggcagttgccgcgttcgcgggagctgaacaccctggccatcctcatggccggcgccggcggcctgctgatctacggcgccgacctggcgggcgccctgttgcgcctgatgcgcagcaatttcgagctgtcccgggaaaccgcgatgaataccgagagcatgctgcagttgctcggcgcttcggcctacctggctgcccaggggctctggccgatcctgctgatgctgctggtggcggcgatcgtcgggccgatcgccctcggcggctggctgttctcgatggacgccctgcaacccaagttcagccggctcaacccgctgtcggggctgaagcggatgttttccgccaagtcgctgctcgaactgagcaaggcgctgatcaagttcctggtggtgctggcggtggccctgctggtgctctccgccgaccgcgacgccctcctggcgctggcgcaccagccgctcgagcaggcgatcctgcacagcgtgcgggtggtcggctggagcgccttctggatggcttgcagcctgctgctgatcgccgcggtggacgtgccctaccagatctgggacaaccgccagaagctgctgatgaccaagcaggaagtccgcgacgaatacaaggactccgagggcaagcccgaggtcaagtcgaagatccgccagatgcagcgcgagatggcgcagagacggatgatggcggcggtgccggaggccgacgtggtgatcaccaacccgacccacttcgccgtagccctgaagtacgacccggcgggcggcggggcgccgctgctgctggccaaaggcaacgatttcctggccctgaagatccgcgaggtggcccaggagcacaaggtgatggtcatggagtcgccggcgctggcgcgagcggtgtactactccaccgagctggaccaggagattcccgccgggctctatctcgccgtggcccaggtgctggcctatgtctaccagctcaagcagtaccaggccggcaagggcaagcggccgagcccgttgaaggacctgccgatcccgccggacctgcgtcgcgacgagtga

SEQ ID NO: 7899 - DNA, 966 bp, Pseudomonas aeruginosa
cctggctggagctacgcgccgcgctgtggcagccttggccgatacccgctcgggatgagagctttgccgttcatggatcgaaccttgtctgatcgtattttcccgcctgtcctcctgttgctcgccctggcctggctgctgccctggatgcctgcgcacgccgaagcgccggcggaatgggtcgccttgcccctgtcggagcgggtggtggatgccacccacacgctggacgaggcgacgcgccaacgcctggtggagaagctcgaggcgctggagcggcgacgcggtgcgcagatcgcggtggtgatgctgccgactaccggtaccctcgatatcgaagccttctccgacaagttgttccaggcctggaagctcggccgcaaggcggtcgacgacggtctgctgctggtggtggccaaggatgaccggcgcatgcgcatcgaggtcggctacggcctggagggtgcggtgcccgatgtggtcgccggacggatcattcgcgagcggatggccccggcatttcgcgagggtgactacgccggcgggatcgaggccgcggtggacgagctgatccgcctggtcgacggcgaaacgctgccggcggccgcgtcgtcgggtgcgccgaaagtctcgctggggcaattgccggcggaagcctgggcgctgctggtcgccttcatctatggatcgttggccggagtgctgttgagtgcccgggcgctgcgctggccctggctgctcggcggggcgctgctctgctggctgctgggcacgctggccggcgcttccggcgaatggatgagcgtgctgctggtcgctccgctgtgcatgctggtcggcggcgcgaccttcggcgcgctgtggacggtgcgcccggccttctacctggtgatcggcgtactggtctatgtagccctgctccggctggcggcgcattggtcaaccgcgccgtcgtcttcaccacat

SEQ ID NO: 7900 - DNA, 1170 bp, Pseudomonas aeruginosa
aatcaagacaaacactggcaaaccgggaggagtccatatacgaataaccgctacgcggttatccgccgtttcagacgcctcacggcgaataacgcctatggcgttatccgccctacggaccggcgccccgctggcccaacagcggtgtgctcaggcgaacctggagaaatccggctggcgccggtgcatgaaggcgctgagcgcctcgatcgcctcgggcgagcgcagtcgggtactgaagatatcgccttcctcggcgatcacccggcgaagctcctcgataaacggcgctttcatcaggcgcttgctctccactaccgccgagggcgccaggtgcaggaagcgccgggccgcatcgcgggcgtgctccagcaccgtggcgccatcctccagcgccgcattggccaggccccaggccgccgcctgctcgccgctgaagtcctggccgagcatcagcaattccgcagccctggcatgaccgagcatgcgcggcaggatcaggctcgagccgaactccggtgtcaggccgaggttgacgaacggcatcttcaatcgcgcgttgcgaccgacgaagaccaggtcgcaatgcagcagcagggtggtgccgatacccaccgccggtccgttcaccgcggcgatcaccggcttggggaattccagcagggcgctcatgaagcggccgaccgggctgtcgcgcagggatggcggttgctcgaggaagtcgaggatgtcgttgccgctggtgaagcaggcatcgccgccagtgatcagcactacccgcacagccgtatcggcctgcgcctccagcagcgcctcggccatccgactgtacatcgcgcgggtcagcgcgttcttcttgtcctggcggtccaggcgcagggtcagcagccccgcttcgcgttcgacccgaatcagctcgctcatcgtcactccagggatgcggcgcagggccgcggcaatggctgcaaggcaccgccaccgcgccgcgtcaggcgtggggcaggaacaggtccgccagggtctggctacgcggtacgccggccaggtagagatgccgggcgaagcgttcgacgctggcgggttggccgcagagtaaggccatgctgcgccgcggaacaaggcggagatcggccaaggcagagggcaactgcgccgccgacaccaggttga

SEQ ID NO: 7901 - DNA, 465 bp, Pseudomonas aeruginosa
cgcgcacttgcggatgacgcccggccaactccgccaactcgctcgccaggtagtggtcgcgcgccaggtgcagcaactggatcggcgcctggtgttccgcgcgcaaggcctcgcgaagtatcccccagagcggcgccagcccggtgccggcggccatcagcaacagcggtcgctcctgccagtccggctcgtagcgcaacgccccgccgcgcaactcgcccagacgcaggagcgcgccaggcgccaggcgccgggcgcggtcgcagaacgcgccgggagcgctacagtcgatgtggaactccagccatgggtcctcgtgaggcaggctggccagcgaatagggacgcgccacgccatcgtcgctccacagcagcaggtgctgcccggcgcgatagcgcaagggccgctccggctccaggcgcaggcgcagcacatcgcccagccagtggcaggctacgaccctag

SEQ ID NO: 7902 - DNA, 1425 bp, Pseudomonas aeruginosa
agaggaccgtgctccatggccgtgatcaagcaagacgacctgatccagagcgtcgccgatgccctgcagttcatctcctactaccacccggtcgatttcatccaggccatgcatgaggcctacctgcgcgaagaatcgccggctgcccgcgactccatggcgcagatcctgatcaactcgcgcatgtgcgccaccggccaccgcccgatctgccaggacaccgggatcgtcaccgtgttcgtccgggtcggcatggacgtgcgctgggacggcgctaccatgagcgtcgacgatatgatcaacgaaggcgtgcgtcgcgcctacaacctgccggagaacgtcctgcgcgcctcgatcctggccgacccggccggcgcgcggaagaacaccaaggacaacacgccggcggtgatccactactccatcgttcccggcgacaaggtcgaggtcgatgtcgcggccaagggcggcggctcggagaacaagtcgaagatggccatgctcaacccgtccgactcgatcgtcgactgggtgctgaagaccgtaccgaccatgggcgccggctggtgcccgccgggcatgctcggcatcggcatcggcggtaccgcggagaaagcagcggtgatggcgaaggaggtcctcatggacccgatcgacatccacgaactgaaggcccgcggcccgcagaaccgcatcgaggaactgcgcctggagctgttcgagaaggtcaaccagctgggcatcggtgcccagggcctgggcggcctgaccaccgtgctcgacgtcaagatcatggactacccgacccacgccgcctcgctgccggtgtgcatgatccccaactgcgccgcgacccgccacgcccacttcgtgctcgacggctccggccccgccgaactggaagcgccgtcgctcgacgcctacccggagatcgtctgggaagccggcccgtccgcgcgccgcgtcgacctggacaagatcaccccggaagaggtgcaaagctggaaaccgggcgagaccctgctgctcaacggcaagatgctcaccggccgcgacgccgcgcacaagcgcatggtcgacatgctgaacaagggcgaaacgctgccggtggacctgaaaggccgcttcatctattacgtcggcccggtcgatccggtcggcgacgaggtggtcggcccggccggtcccaccaccgccacccggatggacaagttcacccgccagatcctcgaacagaccggcctgctgggcatgatcggcaagtccgagcgcggtcccatcgccatcgaggcgatcaaggacaacaaggcggtatacctgatggccgtcggcggcgccgcctatctggtcgcccaggcgatcaagaatccaaggtgctggccttcgccgaactgggcatggaagcgatctacgagttcgaggtaa

SEQ ID NO: 7903 - DNA, 1920 bp, Pseudomonas aeruginosa
ccgggggaatgccggcgcggctcatgccgcgccgttattggcggcagtcagtcgaaggccggacgccgcgggggcggccagccaggtctcggcgagcgcgccccaataggccgcgccccggaccaggatgtcgtcgttgaagtcataggccgggttgtgcaccatcggccgtcctctgccgttgccgatgaacaggtagctgccggggcagcgctgtatcatccaggcgaagtcctcgctgcccatcagcttcggcgtgtcgccgtcgacctgctccgcgccggccagctcgaccccgacctggcgggcgaactcggtttcctcgacgctgttgaccagcaccggataggccgggtagtgctcgatgctggcctggcacccatagctggcggcctgcaactcgatgatctggcgaacccgctgcagcacctgctcgcgcacctggccgtcgagcgcccgcaggctcaggcgcagcacggcgcgctggggtatgacgttggccgcctcgccggcctgcaatgcgccgaccgtgaccaccgcggccttctgcggatcgacgttgcgcgccaccacgctctgcagggccatcaccgcgctcgacgcggcgagcaacggatcgacgctcaggtgcggcatcgaaccgtgtccaccgacgccctccagggtgacgctcagcaggtcctgggaagccatcatcggtcccgcgcggaagcccaggtgcccggcctccagtcccggcatgttgtgcatgccgaacagcgcatcgcagggaaagcgctccagcagcccgtcggcgagcatcgcctcggcgccgccctggccttcctcggcgggctggaagatcagtaccagggtgccgtcgaaacgccgcgtcgccgccaggtagcgtgccgcgccgagcagcatcgcggtgtgtccgtcgtggccgcaggcgtgcatgcgcccgccgtggcagctgctgtagccgagccccgtggcctcgacgatcggcaacgcatccatgtccgcccgcaggccgagccgccgcgtgccgtcgccctggcggaggacgccgaccacgccggtgcggccgatcccttcgtgcacttcgtagccccagccgcgcaggcattcggcgaccagcgcggcggtgcgtcgctcctcgaagcccagttcgggatgggcgtggatgtcctggcgcaggctacgcaggtcgtcggcgacctcctcgagccaggccacgatgtgtcgatgtcgagccatgccgtctctcctctggccggattgcgctccggtcttgttggcgggaggcccggacgcaaggccggccgggcgtggtcacagctaagcgcggcacgcggcgaaggacaacggaaggcggttccactgggtggaacccaaggcccgcgccgccctccgccggtacgtcagaactgttccggcggcacttcgcggaagttcagcacggcgaacaccggtacctcgggagtgatcgagggaatattggccatctccttcaagggcttgagcttctcttccaggtcgaagtcgagcagcttcagcagcaccggctccagggtcgccacctggaccagcccttcgccctggcgggtgaccagcacgtcggccttcaggcggcgctgctggccgtgcaggtcgagggtgaagtcgagcttctcgacccgcgactggccgacccgcaggtcgtcgaagccggccatgtccaggcggctctccacggtggcctcggggaagcgcgaggtttcgaagaagttgtccttcattcgctcgtcgcgcagggccaggccgctgtccagggtgcccagcggcaccacgatgcgcgcgacgccctgcttgtcgatctggccgctgagacgatcgaagcgctgcacctcggccatcttcgcgcgtttcacggaaacgaagctgatccgcgagtaa

SEQ ID NO: 7904 - DNA, 1125 bp, Pseudomonas aeruginosa
ccggcgaggaaggccaggcccggactcgcggccaatcgtccgccgagcaccgcccgctccagggtgccaagaccgtcggcgcgcgccagggcggcggcgtgccagtcttccagggagccttcggtgggcaggcggtcgagcgggccgagcaagcgttgccaggacatggcggactccagtgtggaatgtgtcggaaccggcatcctgccgagggtgccagcgttgaacaacggcgcgttacatccggcgacaatgtcatacaagcatcacgcccctgtcacaggggtgacaccgcgccttcctagcctgagcttgcacaacaaagccgagcggccgcaacccgcggcgccggcccaaggaggcccaggcatgacccagaccgccattacccgcgaacccgtcgccggacgccgcctgaaggccgagcgcctgaacggcgcccgcgccctgcgcgaggcccaggccctgcgctaccgcgtattcagcgccgagttcgacgccaagctcgaaggcgccgaagacggcctcgaccgcgacgactacgaccgtcactgcgcgcacatcggcgtccgcgacctcgacagcggcgccctggtggccaccacccggctgctcgaccatcgcgccgccgaacgcctcgggcgcttctacagcgaagaggagttccacctctccggcctcgacgccctgcacggcccggtcctggagatcggccgcacctgcgtcgctcccgaataccgcaacggcgccaccatcgcggtactctggggcgaactcgccgaggtcctcaacgagggcggctaccgctacctgatgggctgcgccagcattcccatgcgcgacggcggtatgcaggccaaggcggtgatgcagcggctgcgcgaacgctacctgtgcaccgactacctgcaggccgagccgaagaacccgctgccgacgctggacgtcccggaaaacctcaccgccgagctgccgccgctgctcaaggcctacatgcgcctgggcgccaagatctgcggcgagccttgctgggacccggatttccaggtcgccgacgtgttcatcctgctcaagcgcgacgaactctgcccgcgctacgcccgccacttcaaggcagcggtctga

SEQ ID NO: 7905 - DNA, 435 bp, Pseudomonas aeruginosa
tggccagcgccctggaagccggcgtggcggtgcagccggtggcgatcagctaccgccgcgacggcgtgcccgatacgcaggcgccgttcatcggcgacgacgacttgctcagccacctcggccgcctgctgcgcggcgagcgcggcagcgtgcatatccagctgctggaaccgatccccagccagggcctggaccgcgccgaactggcccgccaggcccagcaggcggtgcgcctggcgctgttcggcactgccgcccctacgcaaacccggcgcgccgcctagtcgcgcttgggcggcaccgccagcacgtcgcacggcaggtcgccgagggccgcctcggccacgctgccgatcagcgcgcggcggaagccggtcaggccctgggtgccgagcaccgtcaactgcggcgcctggcggcgtacctcggtcatga

SEQ ID NO: 7906 - DNA, 483 bp, Pseudomonas aeruginosa
atggcgagctgccggtggcgccgagcgccatcgccgccgaggggcacgtcagcctggtgcgcccgaagcgtccctacgtcaccccgcgcgcgctggacaccgaggagatcgccgacatcgtcgaggcctaccgccagggcgccgagcgggccaaggccgccggcttcgacggcgtggagatccacggcgccaacggctacctgctcgaccagttcctccaggacagcaccaacaagcgcaccgaccgctacggcggctccatcgagaaccgcgcgcgcctgctgctggaagtcaccgacgcggcgatctccgtatggggcgcccagcgcgtcggcgtacacctggcgccgcgtgccgactcccacgacatgggcgattccaaccgcctggaaaccttcagccatgtcgcccgtgagctgggcaagcgcggcatcgccttcatctgcgcccgcgaagcgcaggccgacgacagcatcggcgtag

SEQ ID NO: 7907 - DNA, 1002 bp, Pseudomonas aeruginosa
  unsure (783): Identity of nucleotide at the above locations are unknown.
acaggcgcagcgcgagggcctgacgccgctcctcggcggacgcaacccggccgccctgcacgccctcggcagccagctcgggctggagtgccgggtcttcgacctgggggatccgcaggcctgccgcgaagccctggaccaggtgaaggtggtggcccattgcgccggtccgttctccgccaccagcacgccgatgatcgccgcctgccgcgccgccggcacccactacgtggatatcactggagagatcgcggtgttcgagcaggcccacgccggcgacgccgaggcccgcgaggccggcatcgtggtctgcccgggcgtcggcttcgatgtgatccccaccgattgcctggccgcctgcctgaaggaggcgctgccggacgcgcaacggctggcgctgggcttcgacaccggcagcgggctttcgacgggaaccgcgaagaccagcgtcgaaggcctcaagttcggcggcaagatccgcgagaatggccgcctgcgcgacgtgccgttgggctacaagcgccgcgacatcgatttcggccgcggcctgcggcacgccgtgacgattccctggggcgacgtggccaccgcctactacagcaccggcatcccggacatcgaggtctacctgccggcgccgccgctgctgggcctgggcatgcgcctgatcgatccgctggcgtccgctgctcggtcggcaacgggtccaggactggctcaaggggcaggtcgacaaacgcatcgccgggccccgaccaggcggcccgcgagcgcctgcgcacntgggtctggggcgaggcgcgcaacgcccgcggcgaacgccgcacggcgcgcctggagacggccaacgtgtacgacctgaccctgcacggcgtgctcctggcagtgcgccacctgctggactaccagggtcccggcggctatttcacgccatcgcggttgctcggcgcgcgctgcgtcgaatcgttgcccggctccggacgaatcaccgtcatcggctga

SEQ ID NO: 7908 - DNA, 699 bp, Pseudomonas aeruginosa
tggccggctatttccacgaccacctgttcgtcgcccgcgacgagggccggcgcgccctcgccgtgctccagcggctggcggcggaggcacactgacatgtggcagagctatctcaacggcatcctggtggctgccggcctgatcatcgccatcggcgcgcagaatgccttcgtcctcgcgcagagcctgcgccgcgagcatcacctctcggtggccgcgctctgcgtgttctgcgacgcggtgctggtcagcctcggcgtgttcggcctggccaagctgctgctggaaaacccgacgctgctggccatcgcccgctggggcgggatcgccttcctgacctggtacgggctcaaggcgctgcttcgcgcgttgcgcccggacgccctcggcaacgccgcggaaaccgggccacgctcgcgcaaggcggtgcttctggcggcactggcggtcaccctgctcaacccccacgtctatctcgataccgtacttctgatcggttcgctcggcgcccagcaggccgcgccgggcgcctatgccctcggcgcggccagcgcctcgctgatgtggttcttcgccctcgccctcggcgcggcatggctggccccctggctggcgcgcccggccacctggcgcctgctcgacctgatggtggcggccatgatgctgggcatggccgcgcaactgctgttccggggataa

SEQ ID NO: 7909 - DNA, 1680 bp, Pseudomonas aeruginosa
cgaatactacggcgacctgaagatcaccctggacaccgcgccctacggcgagaacttcgtcaccacttcggaaatcatcttcatctccggcattctccgcgccctggccatgggcctggtgctgttcctggtctaccactggatgctgaccaagccgctgtcgaagatcatcgaacacctggtcagcatcaatcccgaccgccccagccagcaccagttgccgctgctcaaggggcacgaacgcaacgagctggggctctgggtgaccaccgccaaccagttgctcgcctcgatcgaaagcaacagccacctgcgccgcgaggccgaggacaacctgctgcgcatttcccagtacgacttcctcaccggcctgccgaaccgccagttgctgcagcagcaactcgaccagatcctcgacggcgccggccgccagcagcgccgggtggcagtgctgtgcctgggcctcgacgatttcaaggggatcaacgagcagtacacctaccagctcggcgaccagctgctgatcgccctcgccgaccgcctgcgcgggcacagcgcgcggctcggttcgctggcgcgcctgggcggcgaccagttcgccctggtccaggccgacatcgagcaaccctacgaggcggccgaactggcgcagagcatcctcgacggcctggaagcgccgttcgagatcgaccagcacgaggtgcgcctgcgcgccaccatcggtatcaccctgttccccgaggacggcgagaccacggagaaactgctgcagaaggccgagcagaccatgaccctggccaagacccgctcgcgcaaccgctaccagttctacatcgccagcgtggacagcgagatgcgtcgccgccgggaactggaaaaggacctgcgcgacgccctgcagcgccacgagctgcacctcgtctaccagccgcaggtggactaccgcgaccaccgcgtggtcggcgtcgaggcgctgctgcgctggcaacatccgttgcacggcttcgtcccgccggacctgttcatcccgctggcggaacagaacggcagcatcttcagcatcggcgagtgggtgctcgaccaggcctgccggcagttgcgcgaatggcacgaccagggcttcgacgacctgcgcatggcggtcaatctttccaccgtgcagctccaccacaacgccctgccacgggtggtcagcaacctgctgcaggtctaccgcctgccggcgcgcagcctggagctggaagtcaccgaaaccggcctgatggaggacatctccactgccgcccagcacctcctcagcctgcgccgcgccggcgcgctgatcgccatcgacgatttcggcaccggctattcctcgctgagctacctgaagagcctgccgctggacaagatcaagatcgacaagagtttcgtccaggacctgctgcaggacgaggacgacgcgaccatcgttcgcgccatcatccagctcggcaagagcctgggcatgcaggtgatcgccgagggcgtggaaaccgccgagcaggaggcgtacatcatcgccgaaggttgcaacgaaggtcagggctacctgtacagcaagccgctgccggccagggaactgacccagtacctcaagcaggcgcgacgcctgagccaggccaccagcagcgaacggccctgatcagaacaggcggctga

SEQ ID NO: 7910 - DNA, 519 bp, Pseudomonas aeruginosa
ccggcgagcagcagcaggacaacccagaaagcgatagcggtcagactcatggacggagctccggaagaagatgctggcattctagctgcgcccgacatgtccaggcacgacggcgatcacgctgcgcccttttcaaaaatgcaaatctttcgcattatgtggcagttttttaacgccctcgcgggtgtttccgacaagcgcgcgccgcttcggcacgccaccaataaagcaaaggaatccgccatgactcgtatgcccctggccaccgccagtctgctgggcctcgccatctccctcgccggctgcggcgacgacaagaaagccgaagcgcccgcaacaccggcggccaacatgcagcccgccgcgcccgccgccggccccggccgccaaggtcgacgaggccgccgccaaggcggtgatcaagaactacgcggaactcgccgaaaccaccttcgccgatgccctgagcaccgccaaggacctgcagaaagccatcgacgcgttcctcgccaagcctga

SEQ ID NO: 7911 - DNA, 1059 bp, Pseudomonas aeruginosa
cgcctggccgctggacgaaggcctgatcgactatgtcgccaaggactaccagcacgccctggggaaccccggcgccaccgccaacatcgtcgccaacaccgagatccaggtcggcgaagacaagatcgacgtcaaggaaatcaccggcgagaaactggccagcctgaacgagctgggcggttccgaagccaacgtcgccaccggctaccacgccatcgagttcctcctctggggccaggacctgaacggcaccggtccgggcgccggcaaccgtcccgccaccgactatgcccagggcaaggactgcaccggcggccattgcgaccgtcgcgccgcctacctgaaggccgtcaccgacctgctggtcagcgacctcgaatacatggccggacagtggaaagccggcgtcgccgacaactaccgcgccaagctggaagccgaaccggtggataccggcctgcgcaagatgttcttcggcatgggcagcctgtccctcggcgaactggccggcgagcgcatgaaggtcgcgctggaggccaactccaccgaagacgagcacgactgcttcagcgacgacacccaccacaccctgttcttcaacggcaagagcatccgcaacatctacctcggcgagtacaagcgcatcgacggcagcgtggtcaagggcccgagcctggccgacctggtcgccaaggccgacgccgccgccaacgacaccctgaaggccgacctggccgacaccgaggccaagctgcaggccatcgtcgacagcgccgagaaggatggcgtgcacttcgaccagatgatcgctccggacaacaaggacggccagcagaagatccgcgacgccatcgccgccctggtcaagcagaccggcgccatcgagcaggccgctggcaagctgggtatccaggacctgaagccggacaacgccgaccacgagttctgattccttcctgtgccaacagcgtgcggcccatggccgcacgctgcgtttcagggcctcgaaagcggtcttcgcgggcctttacaaacgcaaatccctcttattttgattag

SEQ ID NO: 7912 - DNA, 1218 bp, Pseudomonas aeruginosa
ccccaactggtaagcttgcgggctgtttccacgcagtccgggatgttcgccgatgtcgttgccgtcaccttccatgccgctcgcctgtctcctgacggcgctccttctgggcggatgcggcgccgacgacgaaccgctgcgcgccgagcccggcgaacacctgtccgggggcgcgaccacggtgctgcaaagcgaccgcaacgccttctccctgccctccgccaacctcgccccgagccggcgcctggacttcagcgtgggcaacagtttcttccgcaacccctgggtcatcgccccttcctccaccaccgcgcgcgacggtctgggaccgctgttcaataccaacgcctgccagaactgccatgtgaaggacggccgcggccacccgccgggagcggacgcggtcagcgcggtgtcgatgctggtacgcctgtcgatcccggccggccctgcggacggcaagaccctgttgcaccagggggtgattcccgagccgacctacggcggccagttgcaggacgtcggcattcccggcgtcgccccggaaggcaaggtgcgggtggactacgagccgctgaaggtgaggttcgaggacggcaccgaggtcgaactgcgcaagccgatcctgcgtatcagccagctcggctatgggccgatgcatccgcagacgatgttttccgcccgcgtcgccccgccgatgatcgggctcggcctgctcgaggcgattcccgaagaggcgatcctggccaatgccgatccggacgaccgcaacggcgacggtatccgcgggcgcgccaaccaggtctgggatgccgcgcggcagcgcaccgcgctcggccgcttcggctggaaggccggccagccggatatcccgcagcagaacgcgcacgccttcgccaacgacatgggcctgaccagcagcctgctgccccacgacgactgcagcgccgcccaggtcgagtgccgccgggcgcccgacggcggcgagccggaagtcagcgacaacatcttcgcccaggtgctgttctacagccgcaacctggcggtcccggcgcggcgcaaggtggacgacccgcaggtgctggccggcaagcgtctgttcgcccaggccaactgcgtggcctgccacgttcccgccttcactaccggttccgacgccagcgagccggagctggccaaccagcggattcgtccctattccgacctgttgctgcatga

SEQ ID NO: 7913 - DNA, 1239 bp, Pseudomonas aeruginosa
catgggcgacggcttggcggacaatcgcccggaatttctcgccagcgggcgggactggcgaaccccgccgctatggggcatcggcctgaccgaaacggtcaacggccacacccagttcctccacgacgggcgcgcccgcaatctgctggaggcgatcctctggcacggcggcgaagccgaagcggccaagcggcacgtgctcggcttcgacgccgaccagcgcagcgccctgctggccttcctgaattcactctgaggagcccacatgttccgcccacgactgctcttgaccagcctcgccatcgccctcggcgcctgctcgccgcaagacccgcaggccgtcaccagtgccgccctggcgcaacaggtgatcctgccgacctacagccgctgggtggaggccgaccaggccctggccagcagcgccctggcctactgccagggcaaggaagacctggccaaggcccgcgacgcgttccacgccgcgcagaaggcctgggccgagctgcaaccgctgctgatcggcccgctggccgagggcaaccgcgcctggcaggtgcagttctggccggacaagaaggacctggtcgggcgccaggtcgaacagttgctgaagaacaacccgcaggtcgacgccgcggccctggccaaggccagcgtggtggtgcaggggctctccgcctacgaatacatcctcttcgacagcaagatcgacctcgccgacgccgccaccaaggcccgctattgcccgttgctggaagccatcggcacccaccagcagcaactggcccaggacatcctggcgcgctggaagaacgacggcggcatgctcacccagatgagcaagttccccaacgaccgctacgccgacgcccacgaggcgatcgccgagctgctgcgggtccaggtcaccgccctggacatgctgaagaagaaactcggtactccgctgggccggcagagcaagggcattccccagccctaccaggccgaggcctggcgcagcaacgcctcgctggccagcctggacgccagcctgagcggcgcccaggcgctctgggaaggtatcgacggcaagggcctgaagaccctgctgccggccgaacagaaggacctggccggcaagatcgacgccgcctacgccgacagccacgcgaagctggcggcgctggaacagaaaccgctctccgaactgctcgccagcgaagacgggcgcaaccagctcaacgccctctatga

SEQ ID NO: 7914 - DNA, 1185 bp, Pseudomonas aeruginosa
tgtgtcggattcgccccgaaacggggcgctctcggcataccagggaccaggattatgttgctccgccgcatgttgatcatgctcgccgcggtgatcgccgtggtggcgattctcgccggctacaaggtctactccatccgtcagcagatcgcccttttcagcgcaccgaaaccgccgatcagcgtgaccgccagcctggccgaaaagcgtccctggcagagccgcctgccagccatcggcagcctcaaggcattccagggcgtgaccctcaccgccgaagtctccggcacggtacgcgacgtactgttcctttccggcgaccaggtgaagctggaccaaccgctgatccagttggaaagcgacgtcgaggaagccaccctgcgcactgccgaggccgatctcggcctggccagggccgagtaccagcgcggccgcgaactgatcggcagcaaggccatctcgaaaagcgaattcgatcgtctcgccgcgcagtgggccaagaccagcgccaccgtcgccgagctgaaggcggcgctggcgaagaagcgcgtgctcgcgcccttcgccgggaccatcggcatccgccaggtggacgtcggcgactacgtctcgcccgggacgccgatcgccaccttgcaggacctttccaccctgctcctggatttccacctgcccgagcaggacttccccctgctcagccgcggccagctggtgaaggtccgggtcgccgcctaccccggccaggtgttcgacgccgagatcgccgccatcaaccccaaggtcgacaacgagacccgcaacctgcaggtccgcgctgccctggagaacccggacggcaagctgctgccgggcatgttcgccaacctcgaggtgatgttgcctggcgaggaacaacgcgtcgtggtgccggagacggcgatcaccttcaccctctacggcgactcgatctacgtcgtcgggcagaagaaggacgagcagggccaggtgtcgaaggatgacaagggccagccgcaacaggtcgtcgagcgccgcttcgtcaggatcggcgaacgccgcgaaggcctggcggtggtgctcgaaggcctggagggcggcgagcaggtagtgacttccgggcaactgaagctcgacaacggcgccgcggtggccatcgtcgccgagcgggacctccagcaagagcactga

SEQ ID NO: 7915 - DNA, 495 bp, Pseudomonas aeruginosa
gccgatcggattgagcttgagcgacttgcccgcgcgcttgacctccagggtatccaggtcatagctgagatcggccacgctcagctcgcggcggccgccaccctgggcgcgacgcagcaccgcctcgatgcgtgcggaaagttcggaaagggcgaagggcttgaccaggtaatcgtcggctccggaacgaaacccctgcaggcgatcgtccaactggtcgcgggcggtgagcatgatcaccggggtgtcgcgccgtgcgtcttcgcgcaggcgccggcacagggcatagccgtcgattcccggcagcatcacgtcgagcacgatcaggtcgtagtgctcggtggccgccaggtgcaggccggacagcccgtcctgcgcgcaatccacggtatagcccttgagcgacaggtaatcggccaggttggccaggatgtcgcggttgtcttcgaccaccagtattcgcatgtcccactccttcgcaggaagaccgattga

SEQ ID NO: 7916 - DNA, 981 bp, Pseudomonas aeruginosa
gcgcctctcgcgcatttacggattcttcaccggcgattcacaccggctctacgctcgccaccagagactgcatggcgtcttccatggccgccgatcatagcggctttgcggatgcgcacgaaccccggcggtggatttaaccagcgtcgaagtcaagagaacgtcaacgccagcgttggagatcgcatgacccaggccgccgtccattccccttcccgtccattcaacccctggctgttcctcgccctgccgctgggcctggcggcactgctgctggccttcgagccggtgaccctcgacctcgccctggccaacctgatgtacgacccgggcgccggcttcatcggccggcacagttggttcctggagaacatcctgcacgaccgggtcaagcaactggtgatcgccatcagcgtcctcggcctgctggtctccatcgccggactgttccaccggccatggcgcgcactgagcaggccgctggcctatgtgttcctcgccatgagccttgcagccagcatagtcactccgctcaaggcgctcaccgccgtgcagtgcccctggagcctggcgcagttcggcggcgaggaaacctatagttcgctgctcagcccacggccgccgaccgagcaccccggacgctgctggccgggcgggcacgcatcgtccggattcgtcctgttcgcgctgttcttcgccctgcgcgaccgcaagcccaggctggcgcgctacgccctggccttcgccttcgccatgggctgtctgctatcgctgtcgcgcatgctgcaaggtgcgcacttcctctcgcacaacctgtggacgatgctgttcgactggctgatctgcctcggcctgtaccgcctgatgctctaccgaccggagacgcggggacagcgcaacggcggcgccgacgaaaaccgcgttcaggaagacgattcgtccgctcccagcacgccgaactcgatgggcaccttcatgtag

SEQ ID NO: 7917 - DNA, 1722 bp, Pseudomonas aeruginosa
aaaagccccgccgaagcggggctcttccaaccacaggagccggtcggcttacatcatgccgcccatgccgcccatgccgcccatgtcaggcatgccgcccatggccggcttgtcttccacgatctcggcaaccatggcttcggtggtgatcatcagaccgccgatggaggccgcagcctgcagagcggaacgagtgaccttggccgggtccaggatgcccatctcgatcatgtcgccgtacacgccggtagcagcgttgaagccgtagttgccggaaccctgcttgaccttgtcgaccactacgctcggctcgtcgccggcgttggccacgatctggcgcagcggcgattcgacggcgcgacgcagcagggcgataccgacgttctgctcctcgttgtcacccttcaggccttcgatggcttgcagggcacgaaccagggctacgccgccgccgggaaccacgccctcttccaccgctgcacgggtagcgtgcagggcgtcttcgacgcgggctttattctctttcatctcgacttcggtggcagcgcctaccttgatcacggcaacaccgccggccagcttggccaggcgctcttgcagcttctcgcggtcgtagtcggaagtggtttcctcgatctgcttgcggatctgcaggacgcgggcttcgatatcagcctgcacaccggcgccatcgatgatggtggtgttttccttgttgatcacgacgcgcttggcgttgcccaggtgctccagggtagcgccttccaggctcaggccgacttcttcgctgatcacggtaccgccggtgaggatggcgatgtcctgcagcatggccttgcggcgatcgccgaagcccggagccttgacagccgcgaccttgacgatgccacgcatgttgttcaccaccagggtggccagggcttcgccctcgacgtcctcggcgacgatcagcagcggacggccggccttggcgacggcttccagcaccggcagcatttcgcggatgttggagatcttcttgtcgaccagcagcagcagcgggctatccagctcggcagccatggtgtccggcttgttcacgaagtagggggacaggtagccgcgatcgaactgcatgccttcgacgacggacagttcgttttccaggcccgagccttcctcgacggtgatcacgccttctttaccgactttttccatggcttcggcaatgatctggccgatggactcgtcggagttggcggagatggtgcctacctgggctatggccttggtgtcggcgcagggcttggccagctctttcagctgggcgacgatagccacggtggccttgtcgatgccacgcttcaggtccatcgggttcatgccggcggcaacggccttcaggccttcgttgacgatggcctgggccaggacggtcgcggtggtggtgccgtcaccggcagcgtcgttggccttggaggcaacgtctttcaccagttgcgcgcccatgttctcgaacttgtctttcagctcgatttccttggcgacggaaacgccgtccttggtgatggtcggagcgccgaaggacttgtccagaaccacgttgcggcctttcgggccgagggtggccttgacggcatcggccagcacgttcacgccgaccagcattttcttgcgagcggaatcgccgaacttaacttctttggcagccatgttctctttcctctaaatcgaattcggtga

SEQ ID NO: 7918 - DNA, 2229 bp, Pseudomonas aeruginosa
gacagcctgcccttgtggcagggaccttgcggtgaccgttacataaggtcgccacaagccatttcaagggcatgcagtgaaatttttttttcagttgcgcgaatcgtcgcggcgctcgtactcgccctcgatgacgttcggccgcgacggaccctgtccgtagcgggcgttcaggtcgtcggcgaaggcgcgccggcgcagcgcctgctgttcgacgcggcggcgcaggccgccgagcatcaggcgacgggtgaaaggaatcaggcagaggatgccgaagatgtcgctgatgaaacccggcagcatcagcaggccgccgccgacggcgatcaacaggccttcgagcatttcctgctccggcagttcgccacgggccagtcgttcgcgggcgcgccaggcggtggccacgccggccacgcgcaacaatgcagcaccgatgaaggcgctggcgacgatcaggaacagggtccagccgaccccgatgacactgccgaccttgatcaggacggccagctcgaccagcgggaagagcaacagcagaaagaggaaagcgcgcatttcagagtccttggcggggcccgtttgcccccggtaccaccagtagttggcgccagccgggggaagaattcaaccctgctccggctcgacggtaggccagcgctcggccctggccaattgcaccagcgcctggcgcacggccccggggttgccgcaggcggcggggaacggcagccagtgcaggccctggccgatgcgcaggtggaaaccttctgtatcaattcccgccagctgcgccgcggcatgcgccggcagtccggccagttccacatagtgggcgatggcggcggcgtggtcgctgttcatgtgctcgaccatgccgcgctcggcttctccggcgaacggattggccagcggcacgcgctcggcggccagccagtggatcgcgccgaaaccgccgatgaaacgccactggaccggctgcagcacccagaagtcgaaatcgtggacccgatggtagtcggcggactcggggaaatagcggtagtaacgctcggccgccgcggcgacctcctcctccgccaattgccgcgcctcggccagcagggtgaggcggccgacagcctggatatcctcggcgccgcgctcgcctaccagcatcgagcagcgcgggtccgcctgcaggttgtgggtgtgctgggcgatccggctgatcaggatcagcggccggccttcggcatccaggcaatagggaaccaccgaaccgaaaggaaagcccggccatttcttcgagtgggtggaaaggaccgcacggtattccttgagcagcaattctcgggcattctttgcagcttcaacgctcaatttatgactccttgcatagaatccgtcgtaaacggacgggcatatcaaagtacgttcgcaggtgccggcaaggtccgcttccagaaactgctcgtggggttccaagcaatgcaattgaaagacaaggtcatcatcatcaccggcggctgccaggggctcggccgggcaatgggcgaatatctcgccggcaagggcgccaggctggccctggtcgatctcaaccgcgaacgtctcgacgaagccgtcgctgcctgcaaggccgccggcggcgacgctcgcgcctacgtgtgcaacgtggcggacgaggaacaggttacccacatggtggcccaggtcgccagcgacttcggcgcgatcaacggcctggtcaacaacgccggcatcctccgcgacggcctgaccatcaaggtcaaggacggccagttgagcaagatgagcctggcccaatggcaatcggtgatcgacgtcaacctcaccggtgtgttcctctgcacccgcgaagtggcggcgaagatgatcgagctgaagaacgaaggcgcgatcgtcaacatttcctcgatctcccgcgccggcaacatgggccaggccaactactcggcagccaaggccggggtggccgcggataccgtggtctgggcgaaggaactggcgcgctacggcatccgcgtggccggcgtggcgccgggcttcatcgagaccgagatgaccgccgggatgaaacccgaggcgctggagaagatgaccgccggcatccccctcaagcgtatgggcaagccggtggagatcgcccactcggtggcctacatcttcgagaacgactactacaccggccgcgttctcgaactggacggcggcctgcgcctgtag

SEQ ID NO: 7919 - DNA, 504 bp, Pseudomonas aeruginosa
ttggtcaccgttccgttggacagcgccccgttgggcacgatgatccgcttgttgtcgccgctacgcagcacggtgtggaagatcaggatcgaatccacggtaccggccacgccctgtgcctcgatccagtcgccgaccttgaacgggcggaacagcaggatcagcacgccgccggcgaagttagccaggctgccctgcagggccaggccgatggccaggccggcggcgccgatggcggcgacgaagctggtggtctggatgccgatcatggaagccacgctgaccaccagcaggatcttcaggacgatgctcaccaggctgccgacgaagccttgcagggtgcggtcgacgctgcgcctggcgagcaggccgccgacccggccggtcagggtgttgatcagccaccagccgatcgccagggtcagcagcgccagggcgaccttgccgctgtactccagcacgatcggcagccaggactcggtctgctgcaccagtcggtcgtag

SEQ ID NO: 7920 - DNA, 1887 bp, Pseudomonas aeruginosa
ttcaattccatgcattacctccatttctcgaaaaaacacccctcccttccgcaacggaaacgggacgggcttgcagattcctgcccggacgccgtggggcgacgtttccgggcctggatacgaatcggcgcagcgcggacgaaccgacgctgcgccgacaggggcggacaacgcgggagaggtcgcggcggcgctactccctattgcgatgcccgggatggcgagaggttccgaaaaacctcgtcaatcgcggaagttggtgaactgcaacggcatgccgagcgattcgccgcgcagcagggcgatggcctcctgcagatcgtcacgcttcttgccggtgacgcgcacctgctcgccctggatggcggcctggaccttgagcttgcgctccttgatcagaccaacgatcttcttcgccaggtccttgtcgatgccctcgcggaagttgacgtcctgcttgaccaccttgcccgacgggtaggcatccttgatctccatgcactggctgtcgaccttgcgcttgaccaggttggaacgcaggatgtcgagcatctgctcgagcatgaaatcggcttcggcggtgagggtcaccgacttgtccttggcttcgaaactgcatttgcctttcaggtcgaaacggcgatccagttccttgatggcgttgtccacggcgttggtcaactcgtgtttgtccagttcggacaccacgtcgaacgaaggcatgtcatctctccagatggacggcgcgacagggttcacagacggaaccgcgcctggcttgacggtaaaaaatgcccgcccattataaccgagccctcgcgagcgaatgcccgccggtgtggcggagaccgacgatttcttcccgatggcgcgcgcgaccgcggccgggacccggcctcccgcgacgaaccgggcccttgccggcagcgtaccggcgcccatcctcttctcgagtccgttcatgcccaaccccgatctcagcatcctggtcgtcgacgacgccaagttttccagcgccatgatcggccgcgccctcagccaggccggctaccaggacatccgcttcgccagcagcgccagcgaggccctgcagcagctcgaacaacgcccggtcagcgtgctcctggccgactggctgatgccggagatggacggcctggaactgaccgcccgggtccgccaactggacgaaagcatcaaccactacacctacatcgtcctgcttaccggcaaggagggcgagaacgtcctcggcgaggccttcgaccgcggcgtcgacgacttcgtcagcaaggccgcgatgaacgagcaactggtgccgcgcatctacgcagccgaccgcctgtgcaacaccctgcaacggttgctggtggaaaaccgcctgctcaccgaaaacatcgcgcggatggaagaacgcaacctggtggataccctcaccggcctcggcaatccccgctacctgcgacagaagctggccgacagcctgcgccaggtggaaacccgcggtggagcgctgtgctacctgctggtcggcatgcccgaggcaccggtcctgcgccagcggcacggcgaggccttccatcgcgagctgctgctcggcgtggccaggcgcctgcaacagctggtccggccgctggatgtgctggtgcgcctggacgagcagcatttcgccctgatcaccctggtggaggacctgcacgaatgctcgtcgagcagcttcaagcggctgcacgacgggctcaacctgaaggccttcaagaccagcgaaggcttcatcagcctgaaagccggcatcgccatgctcggcctcgacagcggggcattgccgctgggcatcgacgaactgctgcagcgcaccgaggccctgttgcccgatgcctatgctag

SEQ ID NO: 7921 - DNA, 3030 bp, Pseudomonas aeruginosa
cctcggcagcctctgggccgcgcgcctcgggcgcgccggcctgcccgtccgcctgatcctgcgcgaccgccagcgcctgcgccgctaccaacaggccggcggactgagcctggtggaagacggccaggccagcctctacccgatcgccgcggaaaccccggacggcgggcaacccatccagcgcctgctgctggcctgcaaggcctacgacgcggaggaagccgcctccagcgtggcccatcgcctggccggcaacgccgaactgctgttgctgcagaacggcctgggcagccagcaggcggtcgccgcccgcctgccgcgcagccgctgcctgttcacctccagcaccgaaggcgcgttccgcgatggcgatttccgcgtggtcttcgccggccgggggcacacctggctcggcgatccgcgcgacacaagcgcccccgcctggctggcgcagctgtcccaggccgggatcccgcacagctggagcgacgacatcctcgaacggctgtggcgcaagctggccctgaactgcgcgatcaacccgctgaccgtcctccacgattgccgcaacggcggcctgcggcagcacccggaagagatcgccgcgctttgcgacgaactcggccagttgctccacgccagcggctacgacgccgccgccaggagcctgctggaggatgtccgggcggtgatcgacgccaccgcggccaactattcctcgatgcatcaggacgtcacccgcggccggcgcacggaaatcggctacctgctcgactacgcctgccagcacgggcagcgcctgggactaccgctgccgcgcctgggaaccttgctcgcccgcctccaggcccatctgcgccagcgcggtttgcccgaccgctaaagcgcgttaccctgcccgccattccttttcgccgcggaccgccagagcccatgaacctgcgccagcgcctcgacaacctgcccgtagggcagaaactgctcgccgccctgctgatcctgctggctaccgtgctgctggtggccaacctggcgttcatcagcgccgcctactggatttcccaggagagcgtcgccccccaggcgatgcagaccatcggccggctgatcgccaacccggcgctcagccagccggcactcagttcgccgcagaccgccgaggtcctgctgcgccagctcaacgattaccagccgttgcgcgccgcggccctgtacgacagcaatgggctgatgctggccgacctgcaacgcggcgacaccctcaagctgccggcccgcctggaccgcctggagcactggaggcgcggcgagtaccgcctcaacgcgctgatcgaactgccccaggaaaacgcccgtcccggctacctgctgctggtggccagcggtgaactgccgagcgcgttctacaccggaaccctcaccgccagcctggcgatcctcggcgtcagcgtgctgctctggctgctggtggcgcagcagatacgccgcctgatcacccggccgatccgcgatctcgaggaactgtcgcggcaggtcacccgcgaggagaactacgccctccgcgcccagcgcggcaacggcgacgagatcggccgcctggccgacgcgttcaacaccatgctgacccgcatcgaggcccgcgagcagcagctcaagcgcgcccgcgacgatgcccaggaagcggtcgagcaggcccagagcctggccgaggaaacccgccgctcgaaccgcaagctggaactggaagtgcaggtgcgcagcaagatcgagaagaagctcaccggtttccagcactacctcaacagcatcatcgactccatgccttcggcgctgatcgcggtggacgagcaactctacgtcacgcagtggaaccaggaggccagccagctttccggcaccagcctggacgatgcggtcaaccagccggtgttcctcgcctttccctcgctcaagccgttccttccgcagctcacccgggctgccgagaagcacagcgtggagcgtgtcgaacgggtcacctgggcgctgatcgacacgccacgccactacgccctgaccttctacccgctgatgggcggcaccggccgcggcgcggtgatccgcatcgacgacatcacccagcggctgagcctggaagaagtgatggtgcaatcggagaagatgctctcggtcggcagcctcgccgccggcatggcccacgagatcaacaacccgctcggcgcgatcctgcacaacgtgcagaacatcaagcggcgcctgtccccggagctggcgaagaacgtcgagctggcggccgaggtcggagtgccgctggaagacatcaatcactacctcgacggccgcgacatcccgcgcctgctggaaggcatccagcacgccggctcgcgggcagcgaagatcgtcacccacatgctcgccttcagccgccgcagccaccggcagatgaccgcttgcgaactgcccgcactgctcgaacaggcggtggaaatcgccggtaacgacttcgacctggccgaaggcttcgacttcaagtcgttgcagatcgtccacgagttcgaccccaacctcggcccggtgccggtgatcgccaacgaggtcgagcaggtcctgctcaacctgctgaagaacgccgcccaggccatccaccagcgcgacgacgaagaggaaggcgaacagggccggatcgtcctgcgcacgcgcctgacgccgccctgggcggaagtccaggtggaagacaacggcagcggcatgcccgaactggtgcgcaagcgtatcttcgagccgttcttcaccaccaaggaagtcggccagggcaccggtctcggcctgtccgtctcgtatttcatcatcaccaacaatcacaagggccagatggaagtacgctcggaactgggccgcggcacctgcttcagcatccgcctgccgctggaaagctccgaagcggtcgccccggcacaagccaaggccctgccgcccgctctgccgcaacccggtagcagcctgcggcggggcgacgaagaggaaggttga

SEQ ID NO: 7922 - DNA, 756 bp, Pseudomonas aeruginosa
atccatgggcaatcgattgtcgaagatctacacccgtaccggcgaccgcggcgagaccggcctggccggcggacgccgggtgcccaagagccatccacgcatcgaggcgatcggcgcggtggacgaattgaacagccagttgggcctgctccttgccgagctgctggaagcgcgtggcgcacatcccggcctggaggagatcgtccaggcgctggcgccggtgcaacaccgcctgttcgacctcggcggggagctggcgatgccggagtatcgggccctggacgagacggaagtggcacgcctggaaagctgcatcgaccgctggaacgacgagctgggcccgctgaagaatttcatcctccccggcggttcccgcccggtcgcccaggcccatgtctgccgcagcctggcgcgcagtgccgaacggcgctgccaggcgctggaccaggaggaaacgctggagggcgtcggcctgcgctacctgaaccggctctccgacctgctgttcgtcgccgcccgcgccatcgcccggcgccagggcgtggcggagattctctgggaggcggcggcaaaaccggactgacggcgagcgagggctcggcatcgagacgaaaaaaaggaggccgaagcctccttttttcttcattccaccgtcaaaggccgcccggccagaacgcacggatacccgccacgccctgggctccatgctcccaagcctgctcggcttgctgcggaccgaggccacccagcaggtag

SEQ ID NO: 7923 - DNA, 1008 bp, Pseudomonas aeruginosa
tcgtgccggacctggatcagcggccgggcccgctcgacacggatgcccagttcctcttccagctcacgggccaacgccgcgcgcaccggctcgccgtcctccaccttgcccccgggaaactcccacaggccgccctggtgcttgtcttccggccgccgggcgatcagcacccggccatcggagccacgaatcacggccgcggcgacatgtactcgtttcacggatcatctcctcgctactgccgtcacgcaccgcaagcggcggacggccatcaactaccggcctgctcgcgcaatgccgcgtcgtaccaggcgcggaacgcaggccactgataaatcgtctcgacataggtccgggcgatatccggcaactccaccgcataactgcggaaacgcgccgccaccggtgcgtagaacgcatccgccaggctggcgtggccgaacaggaacggaccgtcctggccgaagcgccgccggcaatccgcccaggcttcgcagatacgttgaatatcctgtcgtgtcgcctcggacaattccaccaatggctgctggcgccgcaggtccatcggcagctcgccgcgcaacgcggcgaaaccgctgtgcatttccgcgcaaaccgaacgggccagcgcccgcgccgcctcgccgcgcggccacaggtgggcctcggggaagcgctcggcgaggtactcggcgatggccagggaatcccagatgtcgccatcctcgcttttcagcaagggcaccttgccggtcggcgaatattgcaggatccgctcccgggtatcgggccgccccagcgggacgaggatctcgtcgaacgccgccccgctcatgcgcaaggccagccagccccgcagcgaccaggacgagtcattgcgattgccaatcacgatggtcagggccatgcgcctctcctcttcgaccgcccgacgcggacggccatgcaccagagaacttaagaggcgcacggaccgatggcaaattcccgattttcatccatcgatga

SEQ ID NO: 7924 - DNA, 3135 bp, Pseudomonas aeruginosa
tgccggcggaagcgatgccgagttcgaaaccggggaccgggtgcagggtggacagggggccaagaccgacagccatgggaacgcgctcctttaccaaacagtggactcgatgccgtccgcgacggcgtgacggaaaacgcatcggcgccgggctggcgccaattcgaacaaacgccgcgagcggcaggaccggtcgcggcgttggtgaaccaggcgggaagcttagtccagctgcccgtggcagtgcttgtatttcttgccggaaccgcacgggcaaggctcgttgcggccgatcttctgctcgttgcgcacaggctcgagcggcacgaccggagccgggccctcgggaagctcttcttcctcgccggccacggcctgctccatcgagggagcctcggcgtgctggaactgcatgcgcttggccagttcctccgcctcgcgacgcaggcgggcctcctcttcggccgggtcttcgcgacggacctggacgtgggacagcacgcggatggtgtcgcgcttgatcgagtccagcagctcctggaacagggtgaaggactcgcgcttgtattcctgcttcggattcttctgcgcgtagccacgcaggtggatgccgtgccgcaggtggtccatggtcgacaggtggtccttccacaggtcgtccagcacccgcagcagcatctgcttctcgaaggcgcgcagggcttcggcgccggccagctcttccttctcgtagtaggcggcgacgatctgctcgaggatcttgctacgcagggtttcctcgtacagcttgtcgtcttcgtccagccactgctggatcggcaggcgcacggcgaagtcgctgtacagcgcagcctccaggccttcgatgtcccactgctcgggcagcgactgcggcggaatgtgctggttgatggtggcgctgagggtttcctcgcggaattccttgatggtctcgcccacgtcctctgccgacagcagggtattgcgcatgtggtagatcaccttgcgctgctcgttggctacgtcatcgaattccagcagttgcttgcggatgtcgaagttgcgcccttcgaccttgcgctgggccttctcgatggcgttggtcaccatgcggtgctcgatcgcctcgccggactgcatgcccagcgccttcatgaagttcttcacccggtcggaggcgaagatccgcatcaggttgtcttccagcgacaggtagaagcggctggaacccgggtcgccctgacgaccggcacggccgcgcaactggttgtcgatccggcgggattcgtggcgctcggaggcgatcacgtgcaggccgcccgcctcgatcacctgctggtggcgcttctgccattcggccttgatctgggcgatctgctcctcggtggggttctccagggccgcgacttcgacttcccagttgccgccgaggaggatgtcggtaccgcggccggccatgttggtggcgatggtcaccgaaccgggcgcgccagcctgggcgatgatctcggcttccttctcgtggtacttggcgttgagcaccttgtgctcgatgcctgcctcttgcaacagcttggaaacgtactcggaactctcgatcgacgcggtgccgaccaggatcggccggccgagggcctggcactgcttgatgtcggtgatgatcgccgcgtacttctcttcctgggtcaggtagaccaggtcgttgaagtccttgcgcgcgatcggccggtgggtcgggatcaccaccacgtcgagaccgtagatctggcggaactcgaaggcctcggtatcggcggtgccggtcatgccggccagcttgttgtacaggcggaagtagttctggaaggtggtggaggccagggtctggctctcggcctggatcggcaggccttccttcgcctcgatggcctggtgcaggccctcggacaggcgacggccaggcatggtgcggccggtgtgctcgtcgatcaggaggatctggtcgccctggacgatgtactcgacgttgcggtggaacagggtgtgcgcgcgcagcgctgcgtagacgtgggtcagcaggctcaggttgtgcgccgagtagaggctctcgccttcgccgagcaggccgttctggctcagcaggtcctcgatgaactggtggccctgctcgttgagttcgacctggcgggtcttctcgtcgatgctgtagtggccttcctcggtcggcttgccctcgacctcttcgacctggcgcttgagacgcgggatcagcttgttgatcttgatgtacagctcggagctgtcttcggcctggccggagatgatcagcggggtacgcgcctcgtcgatgaggatcgagtccacttcgtcgaccacggcgaagttcagctcgcgctggaacttgtcgtccaggctgaaggccatgttgtcgcgcaggtaatcgaagccgaattcgttgttggtgccgtaggtgatgtcggcggcgtaggcggcgcgcttgtcttccggcggctggaagggagtgaccacgccgacgctgaggccgaggaactcgtacagcgggcgcatccagttggcgtcgcggcgcgccaggtagtcgttcaccgtgaccacgtgcacgcccttgccggacagcgcgttgaggtagaccggcagggtgcccaccagggtcttgccctcgccggtacgcatttcggcgatcttgccgtcgtgcagggtcatgccaccgatcagctggacgtcgaagtggcgcatgcccatcacccgcttgccagcctcgcgaaccacggcgaaggcttcgggcagcaattggtcgagcgtttcgcccttggcgtagcgctgctggaattcagccgttttcgccttcaactgctcgtcggagagcgccaccatctggggctcgagcgcattgatggcctgtacagccttggccatgcgctttacatcacgctcgttcttgcttccaaagagtttcttcaacaaaggcgcaaacatatcgacttggtcatccacacgtggggaatggaaggctcacccatccggcggcccgtgccgatcaacggcatgaaagggaacattctacccggaaacgggtatgagaaaagtacagcagatcaatgcgcgtcgctcactcggaaacagacgcgcgtgcgatga

SEQ ID NO: 7925 - DNA, 513 bp, Pseudomonas aeruginosa
cgaaacgctttctgctaccattccgactcagtaacccccaggcttcccgccatgtcttttcgtcccttgcccgcccaggcatcgacccagttgctgcgccaggccaggccgctgcagatgctgttcgccgaagcccagcgcatctgccgcctgcagcaactgctggaaagccagttgcaaccggcggcgcgcccgtactgccatgtggcttcgtggcgcggcggttgcctgctgctgatcgtcaccgatggccactgggccacacgcctgcgctatcagcagcggcgcctgcagcggcagctgcaggctttcgaagaattcgcgaacttagcgaaaatccttttcaaggtgcaacccaccacgtccacacaacgtgcggcacgtcgcagcttgaccctgtctgccgtcgcggcggaaaaccttcgcgaatccgccgagatcgtcggcaatccacgcctgcgggaagcgctcgagcggttggcaagccgcgccgagaaaagccggcaagaataa

SEQ ID NO: 7926 - DNA, 1038 bp, Pseudomonas aeruginosa
aaagaggccaccctgaggtggcctccaaatatggaaaggagagttttcctacactgccgccgccgggcgcatataggaaataggcgcggtacgcgcgtcttcgaaggtcaccacttcccaagcatccttgtctgcgatcaacgtacgcagcagttggttgttcagggcatggccggacttgaagccacggaactcgccgataagactgttgccgagcagatacaggtcgccgatggcatccaggatcttgtgcttgacgaactcgtcctcgtaacgcaggccgtcttcgttgagcacgcggttctcgtcgaccacgatcgcgttctccacgctaccgccgagtgccaggttctgcgaacgcaggtactcgatgtcgcgcatgaacccgaaggtacgggcgcggctgacctccttgacgaaggaagtactggagaaatcgaccgaggcctgctgggtgcgaccacggaagaccggatgatcgaaatcgatctcgaagctgaccttgaagccgtcgaacggaacgaagacggcgcgcttgtcgccctcttccacgctgacttcgcgcttgatgcggatgaacttcttggcagcttcctgctcttgcaatccggcggactggatcaggaatacgaacggaccagcgctgccatccatgatcggcacttccgaagcggacagctcgacgtaggcgttgtcgatacccaggccggccatggccgagagcaggtgctccaccgtatccactttgacgtcacccttgaccagggtggtcgacatggtggtttcgccgacgttctcggcccgggccgggatttccactaccggatccaggtcggtgcggcagaacacgataccggtgtccaccggcgccggtttcagggtcaggtaaaccttttcccccgagtgcagaccgacgccagtagcccggatgatgttcttcaaggtgcgttgtttgatcatggctttggccgcttaagcgctgactgcgaactgttttcaacaatggccggcgatgatagcagaaccggcctttgctga

SEQ ID NO: 7927 - DNA, 1701 bp, Pseudomonas aeruginosa
aggcacggtcgatcttctcctcgaccaggcgttgcagcaggtcttcgccgacatcgatgccgaaggcatcgaccccggcggccagcagggattgcaggaccatcgcgccggacttcagcgacacctcgcgctcggcgctcttgccgccgaacagcacggcgacacggccgaacgccttgggatcctgggtgccgttcagcaggctatcgaggcaaaggttcatgcgcccttccctcccttgccggcgaacagcgggttcttgatcagttgcggggccaggccgccgacatcgccagcgccctggcaaagcaggatgtcgccagcgcgcagcagcggcttgaccagcggcgccaggtcggcgtcgcgctcgaagtagatcgggtcgagctggccgcgctggcggatgctgtggcacagctggcggctgtcggctcccgggatcggctcttcgccggccggatagacctccatcaacagcagcacgttggcttcgcccagcacctgcacgaagtcttcgtacaggtcgcgggtacgggtatagcgatgcggctggtagaccatcaccaggcgacgctccggccaaccgccacggatcgccttgatcaccgcggcgacttcgcgcggatggtggccgtaatcgtccaccagcatcacgctgccaccctcgacctgcagctcgccgtagacctggaagcgccggcctacgccctggaagccggacagcccctggacgatggcttcgtcggagatgccctcgtcggtagcgatgacgatggtcgccagggaattcagcacgttgtgcaggccgggcatgttcaccgagacgtccagcggctcgcgctccgggcgcaacacggtgaaccaggtgcgcatgccttcctggcggatgttgatcgcgcgcacgtcggcgtcttcgctaaggccgtaggtcacggtcgggcgggcgatctgcgggaggatctcacgcacaaccggatcatccacgcacatcaccgccagtccgtagaacggcaggttgtggaggaactcgacgaaggtcttcttcagcttgttgaagtcgccgccgtaggtcgccatgtggtcggcgtcgatattggtgaccaccgcgaccatcggttgcaggtgcaggaagctggcgtcgctctcgtcggcctcggccaccaggtagcggctggcgccgagctgggcgttggtcccggcggcgttcagccggccgccgatgacgaaggtcgggtccaggccgccggcggcgaacaccgaggcgatcaggctggtagtggtggtcttgccgtgggtgccggctaccgcgatgccgtgccggtagcgcatcagctcggcgagcatctccgcacgcggcaccaccggaatccgccgttccagggccgatgccacttccgggttggcccggttgatggcactggacaccaccagcacgtcggcgccgtcggcgttttccgcctggtggccgatgaagatctgcgcgccgaacttctccaggcgctcggtcaccgccgaggccttgaggtccgagccggatacctcgtagccgaggttcagcagcacttcggcgatcccgcacataccggcgccgccgatgccgacgaaatggatgcggcggatacggcgcatggtccgggtgacgccattcggttctttaaccacgggccacctccaggcaggcatcgaccaccgtccgggtag

SEQ ID NO: 7928 - DNA, 564 bp, Pseudomonas aeruginosa
cggacggagaaatacagcgggttgcccgactgcgccgctgccacctcggaagacgcggaagtcaccatcaccagggccgaggccgagcagcgccaggcaacccgccagcagcgggaagtccaggtcgatgccgtgccggctcaacagcggcgacgggaaggggcgcaacaccgacagcatcacgctagctcctctacggctttggcgaacaggcgtccgcgttcttcgaagttcttgaacatgtccaggctcgcgcaggccggcgacaacagcaccgcatcgccttcgcgggccagctcggcggcctgccggactgcttcgtccagcgttgcgacgcgcaccagcggtaccgcgttgcccagtgcctgggcaatcagcccggcgtcacggccaagcagtaccaccgcccggcagaagcgcgcgaccggctcgcgcaggtcatggaaatcggcgcccttgccgtctccgccggcgagcagcaccagcttgccgtcgatgtcggcacccagcccctcgatcgccgccagggcggcgccgacgttggtggccttggaatcgtcgtag

SEQ ID NO: 7929 - DNA, 1170 bp, Pseudomonas aeruginosa
cgcaccagggacatgccgctcttgccgaggccgacaacgatgcggaagtggtcggaggcgatcaggctcatgctctcttcgtcctcaacgcagcttcaaggtggcgaggccgatcagcaccaggatcacggtgatgatccagaagcgcacgatcacgcgcggctccggccagcctttcagttcgaaatggtgatggatcggcgccatgcggaagacgcggcgtccggtcagcttgaaggaagcgacctggatcatcaccgagagggtttccatgacgaacaccccacccatgatgaacagcacgatttcctggcgcacgatcaccgcgatggtgcccagcgcggcgcccagcgccaacgcgccgacgtcgcccatgaagacctgcgccggataggtgttgaaccagaggaagccgaggccggcgccgaccagcgcggcgcagaacacgatcagctcgccggcgcccggtacgttgggaatcaacaggtactcggcgaacttcacgttgcccgacaggtagcagaagatgcccagcgcgccggcaaccattaccgtcggcatgatcgccaggccgtcgagaccgtcggtgaggttcactgcattgctcgaaccgacgatgacgaagtaggtcaggaccacgaagaagatgcccaactggatctcgacgctcttcagcatcggcacgatcagggtggtctcgatcggggtttcggcagtcatgtagaggaacacggcggcgccgatgccgaacaccgactgccagaagtacttccagcggctcggcaggccacgggagttcttctcgatcaccttgcggtagtcgtccacccagccgatggcaccgaacagcagggtaacgaccagcactacccacacgtagcggttggaaagatccgcccacagcagcgtgctgatggctatggcggtaaggatcagggcgccgcccatggtcggggtgcccttcttcgacaggtgcgactgcggaccgtcgttgcgcacggcctggccgatctggcggatctgcaaggtacggatcatccagggccccagccacagcgacagcgacagcgcggtgagcacgctgagaatgccgcgcagggtcaggtactggaagacgccgaagcccttgtagaactgttgcaggtattcggccagcagcaggagcattag

SEQ ID NO: 7930 - DNA, 1611 bp, Pseudomonas aeruginosa
tcgtggccgtcgaaacgcggcccactcagggcaatgaacagttggccgggcccgatggcgcgactgtcggtggaaaccgccgaaaagacggcgtcctcgccgatcaggcgggcgtccagcgcgaccgtcaactggctgaggcgaagaggctcaagcatgcggcacctcccaggcggccagggcgcgctcggcctgctcgatgtcggagaacggatggcgtacgccgtcgatctcctgataatcctcgtgacccttgccagccaggagcaccacgtcatccaccgcagcggaagcgatcagatgggcgatcgcctcaccgcgcgacggcaggaaggtaaccttgtcagcggcagcgaagcctttgcggatatcggcgatgatcgccgcactggcctcggtgcgcgggttgtcgtcggtgaccagcaccccatccgccaggcgttcggcgatcgcagccatcagcggacgcttgccggcatcgcgatcgccaccgcagccgaacaggcacagcaggcgcgcggccgcgtgcggacgcagggcctccaggactttttccagggcgtcgggagtatgcgcgtagtccaccaccaccagcggcttgtcgccgcctcccaggcgctgcatgcggccgaccggcccctgcagttgcggcaaggtgcggaggatatcgcccaggggataacccaggccaagcaacgcaccgaccgccgccagcaggttgctcaggttgaagcggccgagcaacgggctgcgcagcaggccctcgccgtgcggagtgaccagcgccgcctcgatgccggcgtcgccgaagcgcgcttcgcggcaatagaggaacgccgagctgtcggtgaggctgtaggtgatcagctccgagtcctgctcctcgccggccagtcgacggccgaaatcgtcgtccaggttgatcacccggcagcgcaggcccggccaggcgaacagcttggccttggcggcggcataggcttccatcgaaccgtgatagtcgaggtggtcgcgggacagattggtgaacaccgcgatatcgaaaccgagcgccgccacgcggccctggtcgaggccgtgggaagacacttccatcgctaccgcgcgggcgccggcctgcttcagcgtggccagcgtggcctgcaccgcgagcgggtccggcgtggtgtgccggccgctctccagggcgccgtagaaaccggtgccgagggtgccgacgatgccgcagcgctcgccgagcagatccagggcctgggccaccagttggctgacgctggtcttgccgttggtgccggtgacgccgatcaggtccagcccgcggctcggctcgccgtagaaacgcccggcgaccgccgacagttgcgcggccagccccttcaccgcgatcagcggcgcatcgctgggcggcaactctccggcgccttccgcctcgtaagccacggcagccgcgcccttgggccagggcatcggcgatgtgcgcacgaccatcctggcgcccgcccggcaccgccaggaacaggtcgcccggacgaacgccgcggctatccagggtcagctcgcggatcagcagatcgcgctcggcctggggaaacagttggttcaggctcatag

SEQ ID NO: 7931 - DNA, 1932 bp, Pseudomonas aeruginosa
gcatcagccacgccctccttttgcgggcgcagcattgacctgctgctgttcggtggccgtcggcaggttatccggcggcacgttcatcaggcgcagcgcgccagccatgaccttactgaacaccggcgccgacaccaggccgccgaagtagcccgccttgctcggctcgtcgatcaccacgaccatcgcgatgcgcggatcggtggccggggcgaaaccggcgaacagcgagcgataggcgttttcccggtagcccttggtgccgaccgagaccttgcgcgcggtcccgctcttgccggcggcgtggtaacccggcacctgggcgcggaacaccccgccgtgggcctcgaccacttgttgcagcatgccctgcacggtggaagccacttcaggcgagatcacctgcacaccatccggcacgcggtcgactcgggtcatgctcagcggcacgctcttgccgtcgttggccagggccgcataggcatgcgccaactggatcgcggttaccgagagaccgtagccgtaggccagggtcgcggtttccgccttcggccacttgcggtggttgggcaggttgccgacgcgctcgccggggaagcccaaccccgtgtcctgcccgagaccgacctgttgcatgaccgagtagatggattcggcgccgatgtcgaaggcgatcttgctgatgccgacgttgctcgacttgatcaggatgccggtgagatcgagttgccgcgaattgcgcgatacgtcgcgaatggtgtagcggccgatctgcagggtgcccgggtagacgtcgacgatatcgctgggtttccagcgcccgctggccagcgccgcgctcatcgagaacggcttgaccgtcgagcccggctcgaacacgtcgatcatcgcccggttgcgcatggccgccggctgcaggttacgacgattgttcgggttgtaggtgggctggttggtcatggccaggatctccccggtcttcacgtccatgatcaccaagctgccggccttggcgccgttttccagcagagcgttgcgcagttcgcgatgagccaggtactgcaggcgcaggtcgatggacagcgcaagggtcttgcccggtttggcattcttggtgacctgcacgtccttgatcacgcggccacggcgatccttgagcacctggcgcttgcccggcacgccggccagccattcgtcgaaagccagctcgataccttcgcgaccgcggtcgtcgacatcggtaaagccgaccgcatgggccaccacttcgccagccgggtagaaacgccgaaactcctcgatggagtacacgccgggcaccttcagggcgatcacgccttcgccctgctccggggtcagcccacggaccagatagatgaactcgcgctcggcgttctgctcgatgcggtcggcgaacagcttggtatcctgcccgagcgccgccgccagttgcggccagcgttccttggcggtcatcagctccttggggttggcccacagggtggtgaccggggtgctcaccgccagcggttcgccgttgcggtcagtgatcaggccccggtgcgcagggatggcgatatgccgcacgctacgcgcgtcgccctggcccttgaggaagtcatggtcgatcacgtgcaggtcgacgattcgccagacgatggcgccgaccatcgccagcagcaggccgacgatcacgcagaaccgccatgggtagagggcgccctggaaataattcagtttcatggcgccaccatcctgacctcggccgggtcgggaacgcgcatgcgcaactgttccaccgccaggctttcgatgcggctatgggcggtccaggtgctctgctcgagaatcaaccggccccactcggcctgcgccttgtcgcgcacgctcagctcggaatacagcgagttgagcagttgccggttccagtag

SEQ ID NO: 7932 - DNA, 765 bp, Pseudomonas aeruginosa
cttctaccgccaggcccaggccgatggcgtcgaactggtcgtcggtccactggagaagccgctggtcaagcaactcgccagccgcgagcaactgccgatcaccaccctcgcactcaactacagcgacaacagccaggaaggcccggcgcagctgttccagttcggcctcgccgccgaggacgaagcgcgcgcggtggccagccgggcctggggcgacggcatgcgccgggccgtggcgctggtgccgcgcggcgaatggggcgaccgcgtgttggccgccttcagccagagctggcagtccgcgggcggcagcctgatcgccgccgagcatgtcgaccagccggtacaactggcgcaacagatcgccgacctgctgcaactgcgccagagcgaaggccgcgcccagcgcctgcagggcgccctcggcagccagatcgccacccagccgtcgcgccgccaggacatcgacttcgtgttcctcgccgccaccccgcagcaggcccgccagatcaagccgaccctggccttccagtacgccggcgaccttccggtctacgccacttcgcacctctacaccgggaccaacaacccgacccaggaccaggatctcaacggcatccgcttctgcgagaccccgtggctgctcaaccccagcgacccgacccgccagcaggtcgccgcccaatggccccaggccaacggcagcatgggccgcctctacgccatgggcgtcgacgcctaccgcctcgctccgcgtctgcctga

SEQ ID NO: 7933 - DNA, 516 bp, Pseudomonas aeruginosa
actgaaggccgtgccgagcctgcagatcgacggcctgaccggtaccctgagcctgaatccgacccaacgtatcgaacgccagttgcaatgggccgagttccgcaatggccaggtccagccgctggggaccagcagcttttgaccgatagggaaagctcccgggacaaggggcgccaggccgaggaactggcctgcgcccatctacggcgacagggccttgccacacttggcaagaattggacctgtcgccgcggagagctcgatctggtcatgctcgacggcgatacagtagtattcgtcgaagtccgctcccgccggcatcgcgcctggggcggagccctggagagcatcgacgcgcgcaagcggcagcgcctgattctctccgccgaactttttctgcaacaggaggcgcgctgggccaaatgcccctgtcgcttcgatgtggtcaccgtcgataccagcgacggacaatcaccaccgcgactggactggattcagaacgcattcgacgcctga

SEQ ID NO: 7934 - DNA, 582 bp, Pseudomonas aeruginosa
agaatgagccgtaccgccttcgtcgccgccaccctggccctgagcctggccctgggaggctgcagcagtttcctcagcgccacccgggacaaaccgatcgacgacgatcgcgggacccgaaccatcggcagcaagatcgacgactcgctgatcgagaccaaggccgcggtgaacatcgccaaggccgatccggccctggacaaggactctcacatcgtcgtggtcagctacaacggcatcgttctgatcgccggccagaccccgcgcgccgacctcaagagcaaggccgaacaggccgcgcgcacggtgcagaaggtcaagaacgtgcataacgaactgcaggtgacctcgccctcctccctgctcgcccgcaacaacgacgcctggatcaccaccaagctgaagacccagatgctcagcgaccccaacgtgccctcgtcgcggatcaaggtggtcaccgagaacggcatcgtctacatgatgggcctggtcaaccagcaggaagccgcccaggctgtccgcgtcgcccagggcgtcgacggggtgcagaagatcgtcaagctgttcgaatacataaactga

SEQ ID NO: 7935 - DNA, 459 bp, Pseudomonas aeruginosa
aaaaacgcccagctccgaagaggtgggcgtttttcagcaagcgtcgaattaacgcttggagtactgcggacgcttacgcgctttacgcagaccgactttcttacgctcgacttcacgggcatcgcgagtcacgtagccggccttgcgcagcgagctacgcagggtttcgtcgtactcgatcagggcacgggtgatgccgtgacggatcgcaccggcctgaccgcttacgccaccgccaacgacggtaacgaagatgtcgaacttctcgacggtctcggtcagctcgagcggctgacgcacgaccatgcgagcggtttcacgaccgaagaactgatcgagaccacggttgttgatggaaatcttgccagtacccggacgcaggaagacgcgagcggtagcggtcttacgacggccagtgccgtaattttgagtcgccgacataatgagctatcccgttaa

SEQ ID NO: 7936 - DNA, 540 bp, Pseudomonas aeruginosa
agtgtgcagcctcgttcgcggaggtctgcatgcgtattctcgccgatgaaaacattcccgtggtcgacgccttcttcgccgaccagggctccattcgccgcttgcccgggcgcgccatcgaccgcgcggcgctggccgaggtcgacgtgctgctggtgcgctcggtcaccgaggtcagccgcgccgcgctggccggctcgccggtgcgcttcgtcggcacctgcaccatcggcaccgaccacctcgacctcgactacttcgccgaggccggcatcgcctggtccagcgcgcccggctgcaacgcccgcggggtggtggactacgtgctcggctgcctgctggcgatggccgaggtgcgcggcgccgacctggccgaacgcacctatggggtggtcggcgctgggcaggtcggtgggcggctggtggaggtgctgcgcgggctgggctggaaagtgctggtctgcgatccgccgcgccaggcacgcgagccggacggcgaattcgtctcgctggaacggctgctggccgaggccgacgtga

SEQ ID NO: 7937 - DNA, 1446 bp, Pseudomonas aeruginosa
ccggcgctggttgaggtcgacgaacaggaagcgcgggaattcttccgggaacacgtcgttgggccccaccgaataccagggctcggacgacatctcgtcctcggggaagcgcggctcggggatgtagcggaagttcacctcggtgaggtagcagatctcgtcgtagtcgtagaacaccacccggccgtggcgggtcacgccgaagttcttcagcagcatgtcgccggggaagatgttcgccgccgccagttgcttgatcgccagcccgtagtcgttcagcgcctcgcgggtctgcgcctcgctggcgttctccaggtagatgttcagcggggtcatgcgccgctccgtccagcagtggcggatcagcaccacgtcgccttccatcaccaccgtcgacggcgccacttccagcagttctgccaggcactccggctcgaacttgctcaccgggaagcggaagtcggcgaactgctgggtgtcggccaggcgtccgacccggtcgtggttcttcaccaactggtacttctggatcaccgtggcgtggtcgacgctcttcgacgggttgaagcggtccttgatgatcttgaacaccgtgttgaagccgggcagggtgaacacgctcatcaccatgccgcgcaccccgggggccatgacgaagcggtcgtcggtggtcgccaggtggttgatcagggcgcggtagaactcgctcttgccctgcttgtagaagccgatcgaggtgtacagctcggccaggtgcttgcccggcagcagacgcttgaggaaggccaccagctcggccggcaccggcacgtcgaccatgaagtacgaacgggtgaaggagaagatgatcgagacttccgcctcgtcggtgatcaccgtgtcgaactggatgccgtggccctcgcggtgcagcagcgggaacaccagcggccactgctcgtccggggtgaacaggcggcccaccaggtaggcgcccttgttgcgatagaacaccgagccgatcagctcgatggccaggtccgggtccttgcacacccagtccggcaggttgctgtgcagcagtgcgtcgatccgttcgaggtcgcgctcgcggtcgtcgtagggcacgtcgaagcggtagtcgtcgaagatcttctccagcgcctggcgcaggtcgccgcccggccggtaggtgcgggtgtagggcgcgcgggcgtgggcgcgcagcgagggccgggtggtgtgcacgaacatcgtgccgtcgctgatgttgtcgtggctgaacagcccgcagaagatcgagttgaaccaggtctcggccagctcgtcgtccagccgcaggtcgatctgcgcgatgtaggcgctcttgatgatcggccagcgctccacgtccagcagctcgctgtcggccagccccgcgcgcagcccggccaccggtctcggcgaccttttcctcgtagaggttga

SEQ ID NO: 7938 - DNA, 852 bp, Pseudomonas aeruginosa
gggcggcgatttcgctggctggggcgctctggaccatgctggcgtcctttcgttgttcgaaggtcgagcttagccagagccgcgcggcagggaaagcgcgatctccgaccggctggtcgagcccggcgcagacgcttatgctgggtggccagacagcccagggatgaccgcaatgaccgccgaatcgccgacgatccgcctcgaacgctacagcgaacgccacgtggaaggcctcaccaccctgtacaacgaccccgccgtggcccgccaggtcctgcagatgccctaccagtcggtggagcagcgccgcaagcgcctgcacgacagcgcggacgacgaccgcctgctgatcctcgtcgccttgcaccagggggacgtcatcggcagcgccagcctcgaacagcacccgcgcatccgccgcagccacagcggcagcatcggcatgggcgtcgccgtcgcctggcagggcaagggcgtcggcagccgcctgctcggcgaactgctggacatcgccgacaactggatgaacctgcgccgcgtcgaactcaccgtctacaccgacaacgccccggcgctggcgctgtatcgcaagttcggcttcgagaccgaaggagagatgcgcgactacgcggtgcgggatgggcgcttcgtggatgtgtacagcatggcgcgcttgcggagggtcgaggggcgggtgggggaatgaggggcgggcgcgacgagaggctgcggaccggcgcgacctcctggctcgccgggcttccgttccacgacaggttcgtcctgggcttcgggcatacggtgacagtggacaagcagcgcggctgttatctgggaggcgagggcgcgtga

SEQ ID NO: 7939 - DNA, 963 bp, Pseudomonas aeruginosa
ttcagaagccatccgctccgccgaccgacagcgcatggtcgcgttgctcgaaaacctggcgccccaggagggctacaacctcaccgggctcgactgcgtccgcctgctgcgttcggatcgtccgctggcgcggacgccggtgctctacgatccggggatcgtcatcgtttgccaggggcgaaagcgcggctatttcggcgagcagatctacctgtacgacgagcagcactacctggccgtggcggtgccggtgccgttcaccatggagaccgatgccacgccagagcgaccgctgctggcgatctacctgcacctggatttcccgctggcggccgggctggcggtggagatcgaccgtcagcgcgcgcttgcgcaggtcgaagcgccgcgcagtctgatgtccagccctatggacgcgccgctgcgggcatcggtgttgcgcttcctggaggcgctgggcgatccgctggagacagcgatcctcgcgcctgcgctactgcgcgagctgtacttccgcgtgctcaccggccctcagggcggcgccatgcgcgcggcactggccatgcgcgggcgcttcggcaacattgcccgggcgctgcgccgcatccacgcgcaatacgccgagccgctcgagctggcgcaactggcgggcgaggcggggatgagcgtgccgtcgttccacagccacttcaaggcgatcacccagacctcgccgatgcagtacctgaagtgcacacgcctgcaccaggcgcgtctgctgatggtgcgccagggcatgagcgcccaggccgcctgccatgcggtcggctacgccagcgcttcgcagttcaaccgcgagttcaagcgtctgttcggccgttcgccactggtcgaggcccggcgcctgcgcgcgggattctcgctgccgccggcgcaggggggagaggagtacgtgtcgtcgcattagtggggagcggacgctga

SEQ ID NO: 7940 - DNA, 1416 bp, Pseudomonas aeruginosa
acaccaactactgggataccgtcaaccaccccaatcgttgcatcatttccgtcaccgtcgacaagagcaagcggatcacccagttcgaggccgacgacggcgagttgctgctgtcccacggctgcgccggcatcaagtacggcccgccgtaggcgcttctcgaccggccttgtctcaggaagcgtggctggcggccgccgggcgctcgcgcagggcgcgcagggtggcgcgcaattccgtggggcgcaccggcttggagagcagggcgatgttggtgtcttcgacgctagcctggatacgctcgatgtcgtggccgctgatcaccagcgccggtatcgcctctccgcgttgccgccgtacccgctcgatgcactcgacgccggaggcgtgggggccgaggtcgtagtcgacgacgagtatgtcgcaatcggttcgccagccgtccgcctcggtttccgcctggaccgtgcagccccagcgttcgagcaacgccgaggtggcgcgcaggacgttgcgatcatcttccaccaggcacacccgcaagccggtgagcaggccggcctgcaggggatcgtcgcggcggggcagggcttgcgcggcgaccgccggcaggccgtgcagggtcaccgcggtgccgcgtccgacccgcgagcgcagcgtcacctcgatcccggtcaactgccccaggcggcggacgatggacagccccaggccgattccctcgacgtcgcggtcgcgcgtctcgcgtacccggtagaactcctcgaacacccgcggcaggtgttcctccgcgatcccccggccctggtcgtagatggctacggccaggccgtcgcctcgccgccgcacgccgatcagcagcgggcgctcggcggcgtacttgaggctgttggagagcaggttctgcagcatggtcgacagcagccccggatcggttcgcgtccacaggcggcaagggcgcaggcgcagttccaccccggcccagcgcgccgcttcagcgttgcgccggaccaggtcgcgcagcaactcgcccaggtggacgttctcctgcttgggctggagccggccgttgtcgagggtgtagagatcgaggatggagcggaacagttgcgagacgttgagcagcgagcggtcgatgttgtccaccaggcgccgttcctcgtcgcccaggcgggcgtcgcgcaggcaggcggtgaacaggccgatggagtggatcggctggcgcaggtcgtggctggcctgggccagcaggcgcgatttctcctggttcgcctgcaacgcttcctcggtggccttgcgcgtgcgctccagcaggaggtgcgcgtagaagggaatgacggtactggtggtcatcagcatcagcaccatgaacggctgggcctgccaggccggggtcagtcgatagatgaccagtag

SEQ ID NO: 7941 - DNA, 639 bp, Pseudomonas aeruginosa
  unsure (127): Identity of nucleotide at the above locations are unknown.
tcaggtcggcgtagcctcgggtcagggtcagcaggtagccgccctgggccaccagcaacgccgccgacaggtagtgctggcagcgctggcgcacctggcgggtcaggccgaggtggccgagggccangtcttcgatgcagatgccgcgtcgccgcgaggtcaccgcgacatggtccgccgccaggtactcctccgcactcaggtcgccggcgaagcccggcccggccatcacgcacaggctgtcgtcgagcaggtgctggcggcgcagggcggcgtcggtgggccgggcgatctcgatggcgaggtcgatgcgtccggcgcccagttccgccttcaggtccgcccagtgcaggctgttgcagcgtatctcgatgcgtggcgcggcctggcgcaggtgggcgaggatcgccgggagcaccagcggctccagttgctccggcatgttcagttggaaggtccgcgcgtcgcgccgagggtcgaacgtctggcagcgattcatgctgcggtgcaggccggcgagggcgtcatggatgcccggcgccagtcgctcggccagcggcgtcggcgcaaccccgcgcccctggcggacgaacagcgggtcgccgagctggtcgcgcaggcgcgccagggcgtggctga

SEQ ID NO: 7942 - DNA, 1710 bp, Pseudomonas aeruginosa
cccgctccccggagaacctgccgtgaccgctcccttcaacgccttgctgatcgccaaccgcggcgagatcgccattcgcatcgcccgcgcctgcgccgacctgggtatccgctcggtggcggtgttcgcggaagacgatgccgcgtccctgcacgtgcgcaaggccgatgtcgcgctgccgctggccggccgtggcgtggcggcctatctcgacatggatcggctggtcgcgctggccctggagcagggctgcgaggcgatccatccgggctacggttttctcgccgagaacggcgaattcgcccgtcgctgccagcgcgcgggcatccacttcgtcgggccgcaagcggaagtgctcgacctgttcggcgacaaggctgccgcgcgcgccctggccgagcgcctggaggtgccgctggtggccgggatcaaccgtgcggtcagcgtcgaagaggccgaggcgttcctggaagggctgggcgatggcgccgcggtgatgctcaaggcccttgccggcggcggcggacgtggcatgcgcgcggtggaggaggttgcgcaactggccgatgcctaccgccgctgccgtgccgaggcgcaggcggcgttcggccgggacgagttatacgtcgagcaacgggtagcgcgggcgcggcacatcgaggtgcaggtgctcggcgacggcagcggtgcggtcagccacctctgggagcgcgattgcagcctgcaacggtgccagcagaagctgctggagatagcccccagcccggacctgccggaggccactcgcgaggcgctgatcgattgcgccctgcgcatggccggcgcggtgcgctatcgggggatcggtaccttcgagttcctggtcgacgacgagcgccccgggcgcttctatttcatggaagccaatccgcgcatccaggtggagcacaccgtcaccgaggaagtcaccggggtcgacctgctgcacgcccagttgcgtctcgccgccggcatggagcttgccgccctcggcctggagcgaccgccggcgatcggcggctgcgcggtgcaactgcggatcaacctggagaccctggcggccgacggcagcgcccgtccggcggtgggcactatcggcgcctacgaaccgcccagcggtcccggcctgcgggtggacggctacggctatgccggctatcgggtcagccccagctacgattcgctgctggccaagctcgtcgtgcgtggtgcggattatcccgccgcgttgcgccgggcataccgggcgctctgcgaattccgcctggagggcgtggcgagcaacctggatctgctgcgcaaccttctgctgcatccggcggtacaggccaaccgggtcgacacccgcttcgtcgaaagccacctggagacactgctggcgcctatcccggcgagccatccgcggctccgcgccgagtgcccgctcgccgaggacgccgcgcctgcgcgggtcgaggcgccactcggcagcctgccgctgtctgcgccgagcagcggggtgctggtggccctggaagtgggcgatggcgaacgggtgcgtgccggccagcgggtcgcgatcctggaagcgatgaagatggaattcgaggtcaaggcacccggcggcggtatcgtccggcgactcgcggcgagcctcggggagcctctggaggagggcgcgacgctgctgttcctcgaaccgacggaggatga

SEQ ID NO: 7943 - DNA, 1761 bp, Pseudomonas aeruginosa
cgacgagcaggcaccgaccgaacaggcgctggacctggcgcatatccgcgccgatctcgccgaggtactcgagcgccaggcagcgctgggcgacgagcgtcgtccgcaggcgctggccaggcggcgcaagaccggacagcgtaccgcgcgggagaacgtgctcgacctgctggacgagggcagcttcagcgaatatggcggtttcgccctggccgcccagcgtcgccggcgctccgccgaggagttgctggagctgagccccgccgatggcctggtcgccggcaccggtacggtgggggccgccagcttcggcgcgcaggccgcgcgttgcctggtgctggcctacgactacacggtgttcgccggcacccagggggtgatgaaccacaagaagaccgaccgcctgctcggcctggccgaacagtggcgcttgccgctggtgctgttcgccgagggtggcggcgggcgcccgggcgataccgatttcgtcggcgtcgccggtctcgattgccataccttcgtcggcatggcccggctctctgggctggtgccgctggtgggagtggtctccggtcgctgcttcgccggcaatgccgcgttgctgggctgctgcgatgtgatcatcgccacccgcgacgccaccatcggcatggccggcccggcgatgatcgagggcggcggcctgggccgtttcgccgccgaggaggtcggtccgacgggcgtgcaggggcccaacggagtgatcgacgtactggtggaggacgaggccgaagcggtcgcggtggccaggcgctacctcggctatttccagggcctgctgcccgactggagttgcgccgaccagcgcgagttgcgccacctggtgccggagaaccgcctgcgtgcctacgacatccgccaggcgatcgaggtcctggccgaccgggacagcgtgctggaactgcggcgccagttcgctcccggcctggtcaccgcgctgctgcgcatcgagggccgggcgttcggcctgatcgccaacaaccctggccatctcggcggcgccatcgatgccgcggccggcgacaaggccgcgcgcttcatgcagttgtgcgacgccttcgacattccgatcgtctcgctctgcgacacccctggcttcatggttggcccggaggcggaaaaacaggccacggtgcgccacgtctcgcggatgttcgtcagcgccgccagcctgacggtgccgttcttcaccgtggtcctgcgcaagggctacggactgggtgcccaggccatggcggcgggcagcttccattcgccgctgttcaccgtcgcctggcccagcggcgagttcggcgccatgggcctggaaggcgcggtgcggctgggcttcgccaaggagctggcggccgaggaagactcccagcggcgcgaggcgctgttccgtggcatggtggacaaggcctaccgcaacggcaaggcgctgaacatggccagctacctggagatcgacgcggtgatcgacccggcggagacccgcgcctggctcctgcgcggcctggccgtcgccggagaaccggcgccgagggcggggcgcaagcggccgttcgtggatacctggtagatggtcggcccgcagtgccctggcgcctcaggacgacggcggcgtcgcctgaacctgcgcggcgaccgccgccttgtcgatcaccgaccagacgccggcgatgcgctcgtcttcgaattcgtagaagacgttctcggcgaagcgtacccgctggccgttga

SEQ ID NO: 7944 - DNA, 576 bp, Pseudomonas aeruginosa
gcgacaagcgaaacccgctatttcctcgcgcaagcagccgcagcaggcccgttccagcgagttggtggcgagcatcctggaggcggctgttcaggttctggccagcgaaggcgcgcaacgtttcaccaccgcgcgggtggcggagcgcgccggggtgagcatcggttcgctgtaccagtatttcccgaacaaggcggcgatcctcttccgcctgcaaagcgacgagtggcggcgcaccacgcgtctgctcggcgagatcctcgaggacaccgcccggccgccgctggagcgcttgcgccggctggtgctggcattcgtgcgctcggagtgcgaagaggcggcgatacgcgtggcgctgagcgacgcggcgccgctgtatcgcgacgccgacgaggcgcgggaggtgaaggcggagggcgcgcgggtgttccaggtgtttctccgggaggccttgccggaggtcgccgaggccgagcgcagcctggccggcgacttgctcaccaccaccctcggcgcggtcggcaagcagttctccgaacagccgcgcagcgaggcggagatcgagcgttacgctga

SEQ ID NO: 7945 - DNA, 2313 bp, Pseudomonas aeruginosa
gtgattgcccaatcgctcatgggtaggctccttgttttcgctgagttggcaggccggcagggcccgaagggtagaccggcgcggtcgcgcaagggttgccctggcgcgatgggcggtccgcgtccgactgtcggccgagggcggaaaacacttatgattcagccacatgctttgtctggaccggaccccgatgctgtctgccgtacggcgctacaagtcgatgctctccagcgccctggcgcgttgtttcccgcgtaccaccgcctacctgcaggccgagcgcgaggctcgcgaagccttgttgcagccggccaaggcccgctccaggaagaacgccgcgaaggctccggccaaggccgccggcaagcctgcgaagggcgccgttcggggggccccacgcaagcccgctgccgcctcgcggcgcgcgccgcagggaatctatccggctgccgcactgaaggtcgacgaatcccaggagcgcgccatgcgcgagcaggtggcgcaggccgtgacgctcggtgtggtcagcccgccgtccgaggaacagtgggcgatgatcctctgccgccagccgctggcgcggatcttcgccggtgccggctcgggcaagtcgaccaccctggtcctgcgggtggtgttcatgctctgccacctgggcgtcgagccgcagcggctgacagtgatttccttcaccaacgcctcctgtgcgcagttgcgcgaacaattgctgcggctgctcgcgcactggcagtacccgttcgacgcggcccaggcgcggcagtgcgtgcgcactttccattcggcgctcggcagcctggcccgcgaggtgctcggcaatccgcgctggttcgaacaactggacgaccgcgaccccgccgccgagccggacaacccccttgccgccggacgcctgcgtccggcccagcagcgcctgctgaagcaggcctaccagcagtgttacgcgcaaagcccggcgttccgcgccaagatccacaagctgctggaactgccgccgccggcggagccggaagagggcgcgcggcggcagccgaaggcgccgctggagccgttcaagctggccggcgagttccaggcgctgccgctgtacgaagccttccatgcccaggccgggttcgccgagagcctgggcctgcgcgtcgaacgcctggacagcggcaagctggaatgcgggttgcgcgagaagatcttcgtcgaagccatggcactgttctgggcgaggttccaggcgctgttgcgcgaggagggcctgatgaccttcgacgccgcgttccagcagctcggcgagcggatggccggcggggccctggcggaaacggcgctggcgccgttcacccatctgctgatcgacgagttccaggatgtctcgccgcagatcgtcctctggctacaggcgttgcaccgtcgcctggcgacccagggcaccgcgccgagcctgatggccatcggcgacgactggcagtcgatctacggctggcgcggcagttcgccggagctgttcatcgacttcgaccggcacttcccctcgcgtgggcggggacgcaagagcgcgctgctggtgctggaaaccaactaccgctccgtcgaaccgatcattcgcgacggcgagaaggtgctggccggggtgcgtttcaagcaggacaagacctgccgcgcgttccgcccgatccagccgggcgaccatggcgtgaagctggtgcagcgtttcgacctgcgtgcgcaactgccgaagctactggcggaaatccgcgcccagagcgagcacgccgccgctcgcgagagcagcgagcgcaccgcggtgctgttgctgagccggcgcaacgagccgttgcaggcgatccaggcggagttggatcgcgcgctgccggtgaagggcatgaccatccatcgcgccaagggcctccaggccgaagtggcgatcgtcgtcgacgactgcctgccgggcgagaagcatccgttgcgcaacgcgctgtacgcggcttcgggtttcttccgcaacagctacgaccaggccatggaggacgaaagcctgcgcctggcctacgtggcgatcacccgtggcgtcagccgggtgctctggtacacgcgcaaggcccagggcgccacggccctgttggcccgacgctgaggacgaccgtctcggcgggctacgcctggcgctgcatccaggcgctgaatgcgcgcaggcgctcgatgaacaccgccgggtcggtgacctggccgtccagcacggccttgaaatattccagggctggcgcctgtccggggtgccgcgcgcgaaacagcgccaggtaa

SEQ ID NO: 7946 - DNA, 1173 bp, Pseudomonas aeruginosa
tcgccaggcggcgctaaagggacatggattttggccatatcgatccctttttggccgccgccgccgttttgccgcgaccgcgcgctgggcagaatccctccaccaagaacaagaaacctgcgaggtctctccatgctgagcgtctacagcgacgatcatcgtctgcacttcggccagtcggaactggtcgacggcaagctgcaaccctgtttcgaaatgcccagccgggccgacaccgtgctggcccgggtgaagtcgcagaaccttggcgaggtgatcgcgccgaaggatttcggccgcgagccgctgctgcgcatccacgacgccgcctacctggacttcctccagggcgcctgggcccgctggaccgccgaaggccacagcggcgacgtggtgtccaccaccttccccggccgccgcctgcgccgcgacgggccgatccccacggcgctgatgggcgaactgggctactacagcttcgacaccgaggcgccgatcaccgccggcacctggcaggccatctacagctccgcccaggtcgcgctgaccgcccaggaacatatgcgccagggcgcccgcagcgccttcgccctctgccgtccgccgggccatcacgccggtggcgacttcatgggcggctactgcttcctcaacaatgccgccatcgccacccaggcgttcctcgaccagggtgcccggcgcgtggcgatcctcgatgtcgactatcaccatggcaacggcacccaggatatcttctaccgccgcgacgatgtgctgttcgcctcgatccatggcgatccgctggtcgaatacccgtacttcctcggctacgcagacgagcgcggcgaaggcgccggcgagggctgcaaccacaactatccgctggcccatggcagcggctgggacctctggtcggcggcgctcgacgacgcctgcgtgcggatcgccggctacgccccggatgccctggtgatttcccttggcgtggacacctacaaggaagacccgatctcccagttcaagctggattcgccggactacctgcggatgggcgagcgcatcgcccggctgggcctgccgaccctgttcatcatggaaggcggctatgcggtggaagccatcggcatcaacgcggtcaacgtgctgcagggctacgaaggcgcggcccgctga

SEQ ID NO: 7947 - DNA, 699 bp, Pseudomonas aeruginosa
ggagcgaagcatgcaatcgactcgcaagctgctggccggcctcgcgctggccgtttccgccgggctggttcaggccgcgccggaagtacggatctacaactggttcgactacatcgccccggacaccctgaagaacttccaggcgcagaccggcatcgcgccgaagtacgacgtctacgacagcaacgaggtgctcgaggccaagctgctgtccgggcattccggctacgacctggtggtgcccagcgacagcttcctgcccaactacctgaaggccgaggtgttccagccgctggacaagagcaagctgccgaactggaagaacctcaacccggccctgctcaaggtgctcgccggcaaggaccccggcaaccgctacgtgatgccctacatgtggggcaccaacggcatcgcctacaacctcgacaaggtccgcgcggtgctcggcgacgatgcgccgctggactcctgggacctggtgttcaagccggagaacctggcgaagctgcaacagtgcggcgtggccttcctcgactcgcccaccgaggtgatccccgaggtgctgcactatctcggcctgtcgcccaacagccaccagccggaagactaccgccgagccgaggagcacctggcgaagctgcgcccgtacatcacctacttcagttcctcgaagttcgtcagcgacctggccaacggtaa

SEQ ID NO: 7948 - DNA, 1389 bp, Pseudomonas aeruginosa
gtccgccgatgccttcgccttccagaccatgctgttgctctgcgtgatctggggcatccagcaggtgaccatcaagtgggcggcgacggacatcgcgccggtcatgcaggcggccatccgttccggcatcgccgccgccctggtcggcctgctgatgtgctggcgcggcggctgggagggcttgcgccagggcaccctgggcgccggcctgctgaccggcacgctgttcgccctggagttcctgttcatcgccctcggcctgcaatacaccacggcttcgcacatgtcggtgttcctctataccgcgccgatcttctctgccctcgggctgcacttcctgcttcccagcgaacgcctgcggcccttgcagtggctgggcgtggcggtgtgcttcggcggcatagcggtggccttcggcggaggcctgtcgtgggcggaaatggatgggcggatgctgctcggcgacgctttcggcctgctcgccgggatgtcctggggcgcgaccacggtggcagtgcgcggcacccggctgtccgaggcaccgccaagcctgacgctgttctaccaattgttcgtggcatgcgccgggttattgctgatcgctcttttcagcggccagttcggcgaggtccgctggaccccggtgagcaccgccagcgtgctgttccagggcgtggtggtgtcgttcgccagctacttctgctggttctggctactgcgtcgctaccaggcgaacaacctggcgatcttctccttcatgacccccctgttcggcgtcaccttcggtgtattgctgctgggcgagccgctcagcctgaacttcgtcgccggcgcggcgctggtcctcgccggcatcaccctggtcagcggcgagcagtggctgcgacgcctgctgcgacgctgagcgagtgcggccggcgcaacagcaggccggcgaagaccaggccgagcccggcgagcgccagcgccggttgcaggccgccggcgaaatgcgtgctgagcgccgccagcagcgggccgagcaactggccgagggcgaaaccggtggtcagttggccggcgttgcgctgcggcgtatgcggcgccagttcgcgggcgtattgcatcaccagttgcatgccggcgaggaacggcaggccggtcagcactacccccagggccagtccgccgatccccggcagcaggcaggcgagcacgccgagggcctgtagccagagcgcgccgaccagccagcggcgggtgccgtccgggcgctgccggcgcaggctgatcagcactaccccggtggccgaggccaggccgaagcagggccagaacaggtcggcctgccattgcccgtggaaacgcgccgcggccatctgcgagagaaaggtggccgggatgatgtag

SEQ ID NO: 7949 - DNA, 1242 bp, Pseudomonas aeruginosa
ttggcggcggccagcaggccggcgccggtcaggtcgagctggccttcgcggatcaggtgcggcagttgcggggtcagggagaagcgcccgacccccatggcgaccaccagtgccagcaggcaggcgagcaggccgaccagcggcgaacgaagaaaatcacgggacatgtgcggattcctgccgggggatgaatggcagcaggttaggtcttgcggcaattctgtaaaaatgaataatcgtgaattacttgttctgttttggagaattaatcgtggagttcggccagttgaggattttccaggcggtcgccgaggaaggctccatcgcccgcgccgccgaacgcctgcaccgggtgccgtcgaacctgtcgacgcgcctgcggcaactggaggaacagcttggcgtcgacctgttcctccgcgaacgccagcgcctgcaactgtcgccggccggcaaggtcctgctggactacgccgcgcggctgttcgccctgcaggaggaggcgcgcgcggcggtgcaggggggcgaaccggtgggcgacttcgccctcggctcgatgtacagcaccgcggcgatccacctgccgccgcgcctggcggaataccaccggcgctatccggcggtgaacctgcaattgcagaccgcgcccagcggcgagctggtcgagtcgctgctgggcgggcgcctggatgccgtgctggtggacggcccgctggacttcgacggtctggagggcctgccgatgttcgaggagcgcatggtgctggtcaccgagaatggccacccgccggtgcgcggtcccgaggacgtggccggcagcgcggtgatcgccttccgcccgcgctgctcctatcgcctgctgctggagtcctggttcgccagcgcgcgggtgagcatgggccgggtgatggagatcgagtcctaccacagcatgctggcctgcgtggtggccggcggcggggtggcgctgatgccggtgtcgatgctgcaaagcctgccggggcgggagtcggtggcggtgcatgcgctggccgaaccgttcgcccgggcgaatacctggctggtctggcgcaagggcatggtcggcgccaacctgaaggcctggatcggtctcctgcaagggcgggaatcggcgttggcttgattcaggtcagggtccggggccggtttcccgcagtaaagttgtttccaaggacggagtggaacgtgcggagagtgggacgccggtctactctttcctag

SEQ ID NO: 7950 - DNA, 1626 bp, Pseudomonas aeruginosa
cgattctcatcgcggtctctgtcggtggaaaggctatcccagaaggataggcgttcagggtatgaccttgcccgggttgaacagcccgctggggtcgagcagttccttgatctgcgccatcagcgcgagcttcagcggatcggcgtagcgtcccagggcttccttcttctccaggccgatgccgtgctcggcggagatcacgccagcgcattcgcccaactcgccgtagaggatttcctccaccgcctggtgcagcggcagcagcgggacgtcggcggcgagcatgacgtgcaggttgccgtcgaggaaatggccgaagaggaagacctgcatgcccttcaccaggtcgtccaggcgccgccggatgcgctcgacgtagccggccagggccggcaccgggagcgatacgtcgaaggacaggctgtcgacgccggcgtggatggccgcgtcggagtcttcgcgcaggcgccagatggccaggcgctgggtttcgttggcggcgagcagggcgtcttccaccagcccgtcctcgaagcagtcttccagcagggcggtgagcgcctcgccggcatccaggtggcggtcctcggccagttccaccagcaggtagagagggcagggcgccaggctcggcgcgctgtcgcccatgggtgcggcggtgcattgcaggtagtcgtgccagaggatctcgcaggcgaacaggcgttcggcgtgctcgcggcgcaggcgcgcggcgatggtgatcgccgcgtcgacgtcgggcaggccgagcagggcggtggcgccgggacgctgcaacggctccaggcgcagtaccgcacgggtgacgatgccgagggtgccttcggcgccgacgaacaactgcttgaggtcgtagccggtggtgttcttcagcagcccgcgcaggtcgctgtagacgctgccgtcggcgagtaccgcttccaggccgagcacgcgctggcgcatggtgccgaagcggaaggcgcggatgccgccggcgttggtcgcgaccagcccgccgacgctggcgctgccgcgcgcggcgagatcgatgccggggtcgagtccggcctcggcggccagcgcctgggcctgttcgagggtgacgccggcgtcgaggtcgagggtctggctggccgcatccagccgatgtatgcggttcagcctgcgcagcgagagcagcacgtcgccggcttgcgcggcgccgccgccgaccaggccggtgagtccgccctggggtaccagggcgcgtcccgcctggcggcacagacgcaccacggcggcgacctggtcggtgctttccggcaggaccaggaagcttccggcgaggttctgcggatggtagccggggtcctgcccggcgagcgcggcactgtcgcgcacgccacgggcgccgaggatctcgcagagggagcggtagagttcggaatcgtccatggcgggctccgggtcagggatggaagggcgcggcttgcagcacctcgacgatcagcggacggtccgccggggcgccgcgcatcagttcgcgcaggtgttcgagatcgcgcgcgcgttcggcggcgcagccgaagccgcgggcgatggcgaggaagtccggggtgtatatatcgaccccgagcggagtga

SEQ ID NO: 7951 - DNA, 708 bp, Pseudomonas aeruginosa
tcggtttcgcccagctcggtgccgatggccagcaccacgtcggcctcggcggccagctcgcgtaccggcacgcaggactggttgctgcccagcagcagcgggtggtcggccggtagcaggcccttggcgttgatcgtcagggcggtcggcgcgtccagcgcggcggccagggcacgcgcttcggcggcggcctcgacgcagccgccgccgagcagcagcagtggctttttcgcgttgcgcaggcgcgccgcggcctcgcgcaagggcgcgagggccggcgccgggcggctggcgagggtgcgtgggcgcagggccaggtgttcggcgggcgcggtgatgacgtcgagcggcagctcgatgtgcaccggccgcggccgctcgctgtcgaacacggcgaaggcgcgggcgagcaccgccagcaactccccggcgctcatcagggtatggcctgaaggggcagacgttgcctaccaggttgcgctggttcggcagctcgtgcaggtagccgttgccgtgggccaggcgcgcgcgttcgttgacgctggagatcaccagcatcggaatcgagtcggcgtaggcatgggccatggcggtgaggatgttggtcatccccgggccggtgatgatgaagcacacgccgggcttgccggtgacccgtgcgtagccgtccgccatgaagccggcgcccctgctcgtggcgcggggtga

SEQ ID NO: 7952 - DNA, 1101 bp, Pseudomonas aeruginosa
aggcggcgaaataggcctcggcatcgttgcgggcgaaggccgccaccagtcggcgggcggcctccagcacctgttcgacgcggtcgtcggtcatggtcgcgctacggctcagcgacgcaccacgcccgggaggacgcagagcatttcatagagcaggttggcgcccagcaacgaagtgttgccggtggtgtcgtagggcggcgagacttcgaccaggtcgcagccgatcaggtccaggccctggcagccgcggatgatttccatcgcctggatggtggtcaggccgccgatttccggggtgccggtgccgggcgcccaggccgggtcgatgccgtcgatgtcgaagctcaggtagacggggccgccgccgaccttctcgcggacctcggccatcagcggctccagcgacttgtgccagcactcctcggcctgcaccacgcggaagccctgcttgcggctccagttgaagtcctcggcggtgtagccctgggcgcgcaggccgatctgcacaacacggtcgcaatccagcaggtcttcttccaccgcgcggcggaaggtggtgccgtgggcgatcttctcgccgaacatgtggtcgttgacgtcggcgtgggcgtcgacgtggaccaggccgaccttgccgtgcttcttcttgatcgcgcggaggatcggcagggtgatggtgtggtcgccgccgagggtcagcgggaggatgccgtgaccgaggatgcggtcgtattcctgctcgatgatgcgcacggcttccagcaggttgaaggtgttgatcgcgacgtcgccgatgtccgccacgttcagcgagtcgaagggggcggcgccggtggccatgttgtagggacggatcatcaccgactcggcgcggatctcgcgggggccgaagcgggtaccggagcgcagggaggtgccgatgtcgaggggcacgccgacgaaggcggcatcgagggcgtcgagttcggcgggggactggacatggggcaggcgcatcatggtggcgatgccgccgaagcggggcatttcattgccgcccaggggctggtggagattcttgtccacggggtggcctcacggtcgttgtggttgttttag

SEQ ID NO: 7953 - DNA, 540 bp, Pseudomonas aeruginosa
agatcggcgttgagggtgcgcgagaactgctgcaccgcttctaccaccttgtgcgtgctctcgcggatgccgaggatcgccgcgccggcctcgttggccagctccacgccgcgccgcgcctgttcctggctgtgctgcatgtcgtcgatgacgctgcgggtgccggtctggatgcgaccgatcatgtcggcgatctccttggtcgacttgctggtgcgttccgccagttgccgcacctcgtcggccaccacggcgaagccgcgaccctggtcgccggcgcgggcggcctcgatggcggcattgagggcgagcaggttggtctgctcggcgatctcgcggatggtgttgacgatcgaggtgatctgttgcgagtgctgtgacagttcgccgatgttcagcgaggaagcatccagggtattcgcgatcttgagcatttcctccaccgcgctctggatgatcagcgcgccgtgttcggcgaccgtacgggtctcggtggacagggtatgggcctggtgggcgttgtccgcctcggcctggtag

SEQ ID NO: 7954 - DNA, 1464 bp, Pseudomonas aeruginosa
gaggaagccccctccgcctgtggcacactgggccccttccaggagtcgtcccatgccacgtatccgctgcgagcgttgcgctcgccccgccagccattgcctctgcgcgctgattccctccttgccgtcgcgtacgcgggtgctggtcctgcagcaccccagcgaggtcgggcacgcgttgaataccgcaggattggccgtcctcggcttgtgcaatgcggagctgcgggttggcgagcgtttcgccgaggagacctggcgggtaccgggctaccgggcctgcctgctgtttcccggcgagcaggcgcgtgcgctggcagagatggccgccgaggccgccggcgagcccctcctgctggtggtgccggacggcacctggcgcaaggcgcgcaagctcctgcacctgaacccggccctggcggccctgccgcgggtgagcctggccgaaggcatggcgtcgcgttatcgcctgcgcaaggcgccgggagagggcgcgctgtcgaccatcgaagcaatcgctgcggcgctcgacgaactggaggcgccgcgtacccacgaagccttgttgaaacccttcgatgccctgatcgaggggcagatcgcggcgatgggcgaggacacctatcggcgcaaccatctcagccaggagcgccgccgccgatagcggtcgagcagttccgggattgccgtttcgcgccagaactccgggctgaccatgccgctggacatgccgccgtgggcgtggcgcgcgaggtagatcaaggcatcgtattccagcgaatggccgctgaggcgctcgaaggtctcgccgagcaggtgttccagggccgctgcggaagccggccaggacgcgtccgccagttgcccggccatttcctgccagaggtaggggtcgccacggccgccccagcgcgagggttcctgttcgaagagttcggagatgcgcggtctggccatgtcggtcggtcgtgtctgtcggaaacgaaaagtatgcccgattggcagggccgcatgggcggagtagactgccgcggtctttccttccgtacgaggtgttcgtccgatgcgcaattgatgctgccgtgtctgcacggccggttttccgtccctggcccgagggcccgggggaatgcatggcatcaagggggtatccatgacgaatacgtcgaccctgacgctcgatggcgtctctttccagctgccggacggcagccttctgttttccgatctcgacgaaacgttcgacacccggcacaccgggctggtgggacgcaacggcgttggcaagtcgctgctcgcgcgcctgctcgccggacacttgcagccgtccagcggcagcgtccggcgccaggggcgcgtgcgctacctggcgcagcagctcgaaccggccgactacccgaccgtcgccgatctggccggcgtccgcccatggctggaggcgctggcgcggatcgaggcgggtag

SEQ ID NO: 7955 - DNA, 468 bp, Pseudomonas aeruginosa
cgaggtcagcgccggcaagatgcgcaacgcccaccaggcggagcgcgagcgtctcgaccgcgaggtgcgcgaggctgcccgggaggtcgaggaggcgtcgccgctgctgctcgattcgcccgatgccgaactggcggcacagcgccggatcgtcgagttgaagggcgcggtcctgccgcatttgcgcgggccgttgcgcgaaatcgacctgctcctgagcggtccgcgacggctggcgctggtcggcccgaacggcagcggcaagtcgaccctgctgcggctgctggccgggcaacgggcgccgctggcgggaacctgcgcggtgacggtgggcgccgcctatctcgaccagcggctgagcgtgctggaccacgggcgaggcgtgctggagcagttgctggaggtcaatcgcagtcgcggcgaaagctggctgcgcacgcgcctggcgcaactcggcttgccggctga

SEQ ID NO: 7956 - DNA, 468 bp, Pseudomonas aeruginosa
tgtccgagacggcgcctgtggatgatccggccggccgggtcgagcacgaggtcttccaggtctttgccctcgagggcgatctggcgggcgagaaaaccgccttgggcggattgcgccagcagatggcggcagtcgctcaggagcagcggttgtcccggtgtcagcggcaccttgaacagtcgctgggcggcatacccgagttgcagattgaccagcaggctgtcgtccgtggcgttatggaagacctgcaggcactggccccgttcggccagttcgaagctgcgcaggctgtcgtcggccagattccagagctcgagccgggggttggcgcgggcgatggccaggcgttggccgtcgagaaagcacaggtcccacaccggtggacgatgcaggaaccgccgatctttgcccagggctaggttttccaggatcggcagcgctgcttcgcgttgtgtcgaggcagggtag

SEQ ID NO: 7957 - DNA, 537 bp, Pseudomonas aeruginosa
ttcgcgccacgggcatccaggcgacgaacctcagcgtggcgcccggcctggcggtcgcggctgcctttcgttctacctggaatctttcggataaaggaatccagcatgcacattcgcaagcgcgtcgacgccgacaacacggcattggtcgacctgtgggaacgttccgtccgcgcgacccacgactttctcagtgaagcggacatcgtcgagctttacccacaggtccgcgacctgtacctgccggccgtcgaggtctgggtgctggtcgacgacgacggcgtggcccagggcttcatcggcctgaaccaggcgcatgtcgagatgctcttcgtcgaacccgggctgcgcggccggggtatcggccgacgcctgctcgatcatgcgcgggcgacctggccgcgcctgagcgtcgatgtcaacgagcagaacccgcaggcctgcggcttctatcgacactatgggttccgccagaccggccgctccgcgaccgactcggcggggcggccgttcccgctgctgcacatgagcctgtag

SEQ ID NO: 7958 - DNA, 2778 bp, Pseudomonas aeruginosa
gacaggtcaaacgttgcggcgcaggcctgcccgatagttctgttcatcagaacgaggcgcaggaatcccatgaacggcatcccacccctgtcttcccgcgacgcccatgccagcccgccgcaacgggtgctggaacgattgcacagctccgccgccggcctggacgcggacgaagccgcccgccgcctggcggcgcacggctacaaccgattgcccgcgccgaaacgccaggggccgctgctgcgcttgctgcggcagttccacaacgtcctgctgtacatgatgctgttcgcctcgctggtcaccgcgctgctcggcttctgggtggacagtgcggtaatcctcctggcggtggtggtcaacgcgctgatcggtttcgtccaggagggcaaggcggccaacgcgctggacgccatccgcgacatgctttcgctgcatgccctggtcctgcgcgacggccagcgccaggcgctggacgccgaacgcctggtaccgggcgacgtggtgctgctggcctccggcgaccgggtgccggccgacctgcggctgttcgaaacgaagaacttccatgtcgacgagtcggccctgaccggtgagtcggtgccggtggagaagggctgcgtcgcggtggccatcgacgcgctgctcggcgaccgccgttgcatggcctattccggcaccctggtgaccagcggccaggcgcgcggagtggtggtcgccaccgccggggataccgaactgggccggatcggtacgctgttgcgcgaagtccgcaccctggccactccgctgctgcgacagatcgccagcttcagtcgctggctggccctggcgatcctgctgctggccggcgccactttcgtcctcggcaccctctggcagggccagccgatggtggacatgttcatgctggtggtggcgctgaccgcctcggcgattcccgagggactgccggcgatcatgacggtgatcctcgccctcggcgtacagcgcatggcccggcgcaacgccatcgtcagccgcctgccggcggtggagacgctgggttcggtgacggtgatctgctcggacaagaccggcaccctgacccgcaacgagatgaccgtgcagcgtatcgtcaccgccgaccaggtaatcgaggtcagcggcgccggttacgcccccctgggtggtttcagccacaacggcgaaggcctcgatcccgccggacgcgacgatctgcaggagatcggtcgcgcggcgctgttgtgcaacgaggcgcgcctgcaccaggagggcgaggcatggcaactggagggcgaccccaccgaaggcgcgctgctcagcctcggcctcaagctgggcctcgatccgcaggcgctggcggcggaacggccacgcagcgatgcgattccgttcgagtccgagcatcgcttcatggccaccctgcaccacgaccacgcaggccaggcgatggtctacctgaagggcgcgccggagcgcatcctcgacatgtgcgaggctgaacgggtgggcgactcggtgcggccgctggacccggactactggcggcgcctggccaccgacaccgccgctcgcggcctgcgcctgctggccatcgcccgacgggcgatgccggcggagcagcgcacgctggatttcgccgacgtggaacatggcttcaccctgctggccctggtgggcatcatcgaccctccgcgcgaggaagccgtggccgcggtcgccgaatgccaggcggcgggtatcgcggtgaagatgatcaccggcgaccacgtcgacaccgcgcgggcgatcggcgccatgctcgggatcggcatcgaccggccggcgctgaccggcgcggagatcgagttgctcgacgaccagcgcctgcgcgaagtgctgccgggcgtcgatgtgttcgcccgcgccagccctgagcacaagctgcgcctggtgcaggccctgcaggccagcggcgaggtggtggcgatgaccggcgacggggtcaacgatgcgccggcgctgaagcgcgccgacgtcggcgtagcgatgggcaacaagggcaccgaggcggccaaggaggcggccgaggtggtcctcgccgacgacaatttcgccaccatcgccaatgccgtgcgcgagggaagggcggtctacgacaacctgaagaaattcatcctcttcatgctgccgaccaacggtggcgaggcgctgatcgtgatcgccgcgatcctgttccagttgaccctgccgatgacgccggcgcagatcctctggatcaacatggtcacctccagcaccctgggcctggcgctggccttcgatccggccgagcgcggcctgatgcagcgtccgccgcgtccgccggcggagcccctgttgtcgctgttcttcgtctggcgggtgctgctggtctcgctgctgatgatggcgggcgccctgggcgtgttcctctgggagctggagcatggcaccgggctggagagcgcgcggaccatggcggtgaacagcgtggtggtgtgcgagatgttctacctgctcaacagccggcatatctacgattcggtgctcagccgcgagggcctgttcggcaaccgccaggtcttgctggcgatcgccgcctgcgtggtgctgcaactgctctatacctacgcgccgccgttgcaggcgctgttcggctcggtcggcctggccccgggcgagtgggcgcgggtgctgctggccgggctcggcctgttctgcgtcgccgaactggaaaagtggctatgtcgccgggtccgtgcccggcaggcctga

SEQ ID NO: 7959 - DNA, 735 bp, Pseudomonas aeruginosa
gaagaacgtagcgctatggccttggttgacggttttcttgagctggaacgctcaagtggaaaattggagtggagcgccatcctgcagaagatggcgagcgaccttggattctcgaagatcctgttcggcctgttgcctaaggacagccaggactacgagaacgccttcatcgtcggcaactacccggccgcctggcgcgagcattacgaccgggctggctacgcgcgggtcgacccgacggtcagtcactgtacccagagcgtactgccgattttctgggaaccgtccatctaccagacgcgaaagcagcacgagttcttcgaggaagcctcggccgccggcctggtgtatgggctgaccatgccgctgcatggtgctcgcggcgaactcggcgcgctgagcctcagcgtggaagcggaaaaccgggccgaggccaaccgtttcatggagtcggtcctgccgaccctgtggatgctcaaggactacgcactgcagagcggtgccggactggccttcgaacatccggtcagcaaaccggtggttctgaccagccgggagaaggaagtgttgcagtggtgcgccatcggcaagaccagttgggagatatcggttatctgcaactgctcggaagccaatgtgaacttccatatgggaaatattcggcggaagttcggtgtgacctcccgccgcgtagcggccattatggccgttaatttgggtcttattactctctga

SEQ ID NO: 7960 - DNA, 657 bp, Pseudomonas aeruginosa
aattatgaaatttgcataaattcttcagcttcctatttggaggaagtgaagatgatcgtacaaattggtcggcgcgaagagttcgataaaaaactgctgggcgagatgcacaagttgcgtgctcaagtgttcaaggagcgcaaaggctgggacgttagtgtcatcgacgagatggaaatcgatggttatgacgcactcagtccttattacatgttgatccaggaagatactcctgaagcccaggttttcggttgctggcgaattctcgataccactggcccctacatgctgaagaacaccttcccggagcttctgcacggcaaggaagcgccttgctcgccgcacatctgggaactcagccgtttcgccatcaactctggacagaaaggctcgctgggcttttccgactgtacgctggaggcgatgcgcgcgctggcccgctacagcctgcagaacgacatccagacgctggtgacggtaactaccgtaggcgtggagaagatgatgatccgtgccggcctggacgtatcgcgcttcggtccgcacctgaagatcggcatcgagcgcgcggtggccttgcgcatcgaactcaatgccaagacccagatcgcgctttacgggggagtgctggtggaacagcgactggcggtttcatga

SEQ ID NO: 7961 - DNA, 411 bp, Pseudomonas aeruginosa
caggattgtcattcaggggtcagggtggggtcccgctgcgctgcttataaagaagaacgaagtcggccgcgcgaggccggccactgggaaaggtggacagatgcaggcgttgcgcagtggtgggggacgggtcctggtgggcgtgctggcggcgggcctggtcgccttcggcggttgggcatggctcggcggcgacgccggggcgaaggcggcgcccgcgccggccagggtcccggtgaacgtggcgcgggtggagcggcgcgacgtcgagcaacaggtcagcggcatcggcacggtgacttcgttgcacaacgtggtgatccgcacccagatcgacggccagttgacccgcctgctggtgagcgaagggcagatggtcgaggcgggcgagttgctggcgaccatcgatga

SEQ ID NO: 7962 - DNA, 3210 bp, Pseudomonas aeruginosa
ccaggtggtggtggacggccactcgcggctgatgcccggcgccctggtcgatatccaggagccgcgcccgagcctggctcaggcggcggagcggcagccgtgacgccgcgcgccgggatttccggctggtgcatacggcacccgatcgccaccgcgctgctgaccctggcctcgctgctgctggggctgctggcgttcctccggctcggtgtggcgccgttgccggaggcggacttcccgaccatccagatcaacgccttgttgcccggcggtagcccggaaaccatggcctcgtcggtggccacccccttggaagtgcagttcagcgcgattcccgggatcaccgagatgacttccagcagcgccctgggcaccaccaccctgaccctgcagttcagcctcgacaagagcatcgacgtcgccgcccaggaggtccaggcggcgatcaacgccgcggccgggcggctgccggtggacatgccgaacctgccgacctggcgcaaggtcaacccggcggacagcccgatcatgatcctgcgggtcaactcggagatgatgccgctgatcgaactcagcgattacgccgagaccatcctcgcccgccagctcagccaggtgaacggcgtggggcagatcttcgtggtcggccagcagcgcccggcgatccgcatccaggcccagccggagaagctcgccgcctaccagctgaccctggccgacctgcgccagtcgttgcagtcggccagcgtcaacctggccaagggcgcgctctacggcgaggggcgggtgtcgacccttgcggccaacgaccagttgttcaacgccagcgactatgacgacctggtggtcgcctaccgccagggcgcgccggtgttcctcaaggacgtggcgcggatcgtctcggcgcccgaggacgactacgtgcaggcctggccgaacggtgtgcccggggtggcactggtgatcctccgccagcctggggcgaacatcgtcgataccgccgacgcgatccaggccgcattgccgcgcctgcgcgagatgctcccggcgaccatcgaggtagacgtgctcaacgatcgtacccggaccatccgctcgtcgctgcacgaggtcgaactgaccctgctgctgaccattggcctggtggtgctggtgatgggcctgttcctccgccagctgtcggcgaccctgatcgtcgccacggtgctggcggtgtccctgagcgccagcttcgcggcgatgtacgtgctcggcttcaccctcaacaacctgaccctggtggcgctgatcatcgccgtcggcttcatcgtcgacgacgccatcgtggtcgtggagaacatccaccgacacctggaagcgggcgcctcgaaggtcgaggcggcgctcaagggcgcggcggagatcggctttaccgtgatttccatcagcttctcgctgatcgccgcgttcattcccctgctgttcatgggcgggatcgtcggccggctgttccgcgaattcgcggtcagcgtgacggtggcgatcctgatctcggtgctcgcttcgctgaccctggcgccgatgctggcttcgcgcttcatgccggcattgcggcatgccgacgcgccgagaaagggcttcgccgaatggctgaccggcggatacgagcgcggcctgcgctgggcgctcgggcaccagcggctgatgctggtcggcttcgcctttaccgtgctggtggcggtggccggctacgtcgggattcccaagggtttcttccccttgcaggacaccgccttcgtcttcggcacgagccaggctgccgaggatatctcctacgacgacatggtcgccaagcaccggcaactggccgagatcatcgccagcgacccggcggtgcagagctacaaccatgcggtgggcgtcaccggcggtagccagagcctggccaacggacgtttctggatcgtcctcaaggaccgtggcgagcgcgatgtctcggtcggcgagttcatcgaccggctgcgcccgcaactggcgaaggtgccgggaatcatgctctacctgcgcgcggcgcaggacatcaacctcagttccggaccctcgcggacccagtaccagtacgccctgcgcagcagcgacagcacccagctggcgctctgggcgcaacgcctcaccgagcgcctgaagcaggtgccggggctgatggatgtgtccaacgacctgcaggtcggcgccagcgtcaccgcgctggacatcgaccgggtggccgcggcgcgtttcggcctcagcgccgaggatgtcagccagaccctctacgacgccttcggccagcgccaggtcggcgagtaccagaccgaggtcaaccagtacaaggtggtcctcgaactcgatgcgcgccagcgcggccgcgcggaaagcctggactggttctacctgcgctcgccgctgagcggcgagatggtcccgctgtcggccatcgccaaggtcgcggcgccgcgctccgggccgctgcagatcaaccacaacggcatgttcccggcggtcaacctgtccttcaacctggctgccggggtgtccctcggcgaggcggtgcaggcggtgcagcgcgcccaggaggagatcggcatgccctcgaccattatcggcgtgttccagggcgcggcgcaggccttccagagctcgctggcctcgcaaccgctgctgatcctcgccgcgctgatcgcggtgtacatcatcctcggcgtgctctacgagagtttcgtacatccgctgacgatcctctcgaccctgccctcggcggggatcggcgcggtgttcgtgctctgggcctggggccaggacttctcgatcatggcgctgatcggcatcgtgctgctgatcggcatcgtcaagaagaacggcatcctcatggtcgacttcgccatcgtcgcccagcgcgagcagggcatgagcgcggagcaggcgatataccaggcctgcctgacccgtttccggccgatcatgatgaccaccctggccgcgctgctgggcgcgatacccctgatgatcggcttcggcaccggttccgagctgcgccagcctctgggcatcgcggtggtcggcgggctgctggtgagccaggtgctgaccctgttcagcacgccggtggtatacctggccctggagcggctgttccaccggcgcgggaccacgacctcggacggcggaaccgctggggcgacggcgacatga

SEQ ID NO: 7963 - DNA, 771 bp, Pseudomonas aeruginosa
cagtgctccggccagcctgaccgaagccagcagcgacccgaccctggtcaagctcaacggcgttccggcggtgaacatggccttggagcagggtgcccaggacgccgcgcaggcggcgaaaggcgggccggcgaagagcgccgatccgcgccaggcgaacctcggcgatgcccttgccagcctgacttccgactccttgcccaaggccgtcgacggcaaggcgctcgaggcccagttgcagcagaccgccgagccggccatcgccagcgccgcctccgagagcctgctggagagcaaggcggagccgcgcggcgagcctttcgcggccaagctcaacgggctgacccaggccatggcgcagcaggccctgaccaaccgtccggtgaacggtacggtgcccggccagccggtggcgatacagcagaacggctggagcgaggcggtggtggaccgggtgatgtggatgtccagccagaacctgaagtcggcggagatccagctcgacccggccgagctgggacgcctggacgtgcgcatccacatgaccgccgaccagacccaggtgaccttcgccagtcccaacgccggcgttcgcgacgccctggaaagccagatgcaccggctgcgcgacatgttcagccagcagggcatgaaccagctcgacgtgaacgtctccgaccagtcgctggcgcggggctggcagggccagcagcagggcgagggcggatcggcgcgcggacgcggcttggccggcgaggcctcgggcgatga

SEQ ID NO: 7964 - DNA, 489 bp, Pseudomonas aeruginosa
tcagtcccagcgaacgcatcaagaagctgcgctgacatgcgtcgctacctgttcgccggcttcctgccggcactcgcctcgctgagcgcgccgctgtgcgccgccgaggggacgacgggtgccgccgcgccgacggtgggcgccgcttccggcgccgccgcgcaactggcccaactggtgctcggcctgggcctggtgatcggcctgatcttcctgctcgcctggctggtgcgccgggtgcaacaggccggtccgcgcggcaaccgcttgatccgcacccttgccagccagccgctgggtccgcgcgaccggctggtgctggtgcaggtcggtgaggagcagatcctgctcggcctgacgcccggccggatcacgccgttgcacgtgctcaaggagccggtacacctgccggacggcgagccggccacgccggaattcgcccagcgcctgctggagctgctgaacaaggaccccaagggcaagccatga

SEQ ID NO: 7965 - DNA, 1035 bp, Pseudomonas aeruginosa
ggtggcactcgacctgttccgcgaggcgttgtggctgacggcgatgatcgtcggcgtgctggtggttccgagcctgctggtcggtctcgtggtggcgatgttccaggccgctacccagatcaacgaacagaccctgagcttcctgccgcgcctgatggtgatcctgctcaccctgatcgtgctgggcccctggctgctgcggcagctgatggaatacacccagacgctgatcggcaacatcccgctgctgatcggctgatgctggagctgaccaacgcgcagatcggcggctggatcgccagcttcgtgctgccgctgttccgggtcgcggcgctgctgatgaccatgccggtgattggcacccagctggtgccggtgcgggtgcgactgtacctggcgctgggcgtctgcgtggtgctggtgccgaacctgccgccgatgccgcaggtggacgcgctgagcatgaaggccatgctgctgatcggcgagcagatcctggtcggcgccttgctcggcttttccctgcagttgttgttccacgccttcgtgatcgccgggcagatcatctcgatgcagatgggcctgggcttcgcttccatggttgacccggccaacggcgtctcggtgccggtgctcggccagttcttcaccatgctggtgacgctgctgttcctggcgatgaacggacacctggtagtgttcgaggtaatcgccgagagcttcgtcaccctgccggtgggcgagggcctgagcggcaaccatttctggatcatcgccggcaagctcggctgggtgatgggcgcggcactgctgctggcgctgccggcgatcaccgcgctgctggtggtgaacctcgccttcggcgccatgacccgcgcggcgccgcaactgaacatcttctccatcggctttccgttgaccctggtgctgggcctggtgatcctctggatcggcaccgccgacctgctcagccagtaccaggtgctggccggcgagaccctgcaattcctccgtgaactggtgcgggcgaaatag

SEQ ID NO: 7966 - DNA, 723 bp, Pseudomonas aeruginosa
  unsure (167): Identity of nucleotide at the above locations are unknown.
cccagggcgctgcgcagcagcccgccgccgcgccctcgccagctcccacgcagcctgccgctccggcggccaacggggggcgccgctgatggctcgcgcgacccagggttcgaacaatgtctgggtgatctggctgagcctgctggtcgggctggtgctggccgtancgccgatgcctaccttcaccgagatcggccgcccgctgtggctggcgatgctgctgacctactgggtgttgctgctgcccgagcgcgtcgggatggtcaccgcctggctgctcggcctggcccaggatgtgctctacggcaacctgctcgggcagaacgcgctgatcctcggcctgatcaccttcctcgtgctgtccctgcaccagcgcctgcgcatgttcccggcatggcagcagtgcctggtgctggtggtggtctacggcctggcgcaactgctccagctctggctcaacgccctgaccggcaatcgcccgccgaccctgaccttcctgcttccggccctggtcagcgcgctgctctggccctgggtgtacgccctgctgcagttcgtccgcctgcgtctcaacgtgaggtaggtccgcttcgcagctatgctgcggcggatacgtcattcttcgaaacgggtgatcggcgcatcgcccgacgcgtttcccgggagcctccatgccgtcgctgtatctcgcctccgcctcgccccgtcgccgtgaactgctga

SEQ ID NO: 7967 - DNA, 420 bp, Pseudomonas aeruginosa
aatggcggatgtgggaagcctcggaacgcgactgctacggatcgtcctgggtttgtgcgccctggtactggtgctgctggcgctgtacgtcagccttggccggcaactggtgccgctggtggccgaataccgccagcagctggaggacgaagctggcaagcaactcggcataccggtgcggattgccgagctgacgggctcctggcgcggcttcgagcctctggtggtggcgcgcgacatccaggtcggcgacggcgaacagagtctgcgcctggcgcgggtgcggctggcgccggacctgctcggcagcctgctggcgcgccaggtgcggatcggcagcctggagctggaaggactcaagctgaccctgcgcgaaggcgaggatggccagtggagcctggatggcctgccgcacagtga

SEQ ID NO: 7968 - DNA, 819 bp, Pseudomonas aeruginosa
caagcccagcgatccccggaagctcctgcaattcctgctgcagacccaacgcatctcgctgctggacagtcaactggaggtggcgccgcggggaagcgcagcgttgtcgctcagcgcggtcggcgcgaccctgcgcagttcatcggttggtgggcagagtctcgatgcccgcctgcaactgccggatggccaacctctggcgctgcacgccgaagggcggatcgacagcgaggactggccgcgcagcagcgccaggttctatctcagcctgccgcagagcgactgggcgcaatggttgccggctggtctgacccaggaatggaagatcgtccgggccaaggccggcggagacttctggttcgactggcgcgacggcaaggcgcaacggctggtggcacggctgctggcgccgcagttgaaggcgtcgtatgccgcgcgcaagccggtggaaatcaacgacctgggcatgaacctgttcttcgatcgcgaagcgcagggctggaaggttcgggtcggcgacctggcggcgaatttcggcgagcagcgctggggcgaggtggagttgctgttgcgtcgcgaccagcagaacaacgagccacactggaagctgcaggccgaccgcgtcgacctgacgcccctggtgccggcgatagaagcgctggcgccgctgccggacgcggcggcggagtgggtggcgggcctgaagccgaagggcatcctgcacaacctgaacgccgatttctggccgcagcgagaggtgcccgagcgggtcagctacgcgaccaacctggaaaaggtcggtatctcggcgttccatga

SEQ ID NO: 7969 - DNA, 765 bp, Pseudomonas aeruginosa
cgctgcgggcctgctgcgcggcgccgacctgcgcatcgacagcttcaagggcttcggccaggagctgaagaacctgaccgtcgacctggcccgccaggagcgggcctggcaactggtgctggtcagcgacctcgcatcggggcgcctggtcctgccggatgccaggggcgcgccgatcgtggtcgatctggaccgcctgaacctgccgaagtcgacccttcccgacgagaacaaggtggaggactcggacccgctggccgccgtcgatccgcgcagcctgccggcggtagacgtgaagatcggccaggtcgccctcggcggccagccgctgggcgcctggagcctgaaggtacggccgggcagcaacggcgtggcgttcaacgacctggacctcgacctgcgtggcctgcacgtcaacggcagcctgcgttgggacggcagtccgggcaatacccgcagcacctatcagggccggatcgagggcaagaacctggcggatgtgctcaaggcctggaatttcgcgccgagtgccaccagcgaacgtttccgcatggatatcaacggccagtggccgggatcgccggcctacatggccctgaagcgcttcagcggcagcatggatgcatcgctgcgcaaggggcagttcgtcgaggtcgagggcagcgcccaggcgctgcgagtgtttggcctgctcaatttcaacgcgatcaaccgccggctgcgcctggatttctcggacatcctcggcaagggactgagctatga

SEQ ID NO: 7970 - DNA, 1503 bp, Pseudomonas aeruginosa
tctgcgacttgctcttctcttcgaattgcgagtcgtcgtcgtgaaattcagccatggtggtggtccagtggaaaacgccgccatgataacgagtcaggggccgcttgtccggcccggccgcgtgggcggccacgtcaacaggagagtcaacagatgagtctacatgccgcggcagtcggtccctccgtgcttccggaccttcgcgagcaggtcgagcagatcatcgccgaggcccgccgccagggcgccagtgcctgcgaagtggcggtgtcgctggagcagggcctgtccaccagcgtgcgccagggcgaggtggaaaccgtcgagttcaaccgtgaccaaggtttcggcatcaccctctacgcaggccagcgcaagggctcggcgagcacctcggcgaccggcgaggcggccatccgcgagacggtggcggcggcgctggcgatcgcccgccatacctccgaggacgaatgcgccggtctcgccgatgccgcgttgatggcccgcgagttgcccgagctggacctctatcatccatggagcctgagtcccgagcaggccgtggaacgtgccctggcttgcgaggcagcggcgttcgccgccgacaagcgggtgaccaaggccgacggcaccaccctgaatacccaccagggctgccgggtatacggtaacagccacggtttcatcggtggttacgccagcacccggcacagcctcagctgcgtgatgatcgccgagggcgaaggacagatgcagcgtgactattggtatgacgtcaaccgccgtggcgaggccttggccagcgccgagtcgatcggccggcgcgccgccgagcgcgccgccagccgactgggcgcgcggccggtgcagaccgccgaagtgccggtgctgttcgctccggaaatcgctgttggcctgttcggccatttcctcggggcgatctcaggcggcagcctgtatcgcaagtcatccttcctcgaaggcgcgctgggccagcgcctgtttcccgagtggctgagcatcgacgagcggccgcacctggtcggcgcgctcggcagcgccagcttcgatagcgacggcctggcgacctatgccaagccattcgtcgagaacggcgagctggtgtcctatgtcctgggcacctattccgggcgcaagctcggcctgccgagcacggccaacgccggcggcgtgcataacctgttcgtcagccatggcgacgaggaccaggccgctctcatacgcaggatggggcgtggcctgctggtcaccgagttgatggggcagggcgtcaacctggtgaccggcgattattcccgcggcgccgccggctactgggtcgagaacggcgagatccagttcccggtccaggaagtcaccatcgccgccaacctgcgcgacctgttccgccgtatcgtcgcggtcggcaaggacatcgaacggcgcggcaacctgcataccggttctgtactggtcgagtcgatgatggtggccgggcgctga

SEQ ID NO: 7971 - DNA, 426 bp, Pseudomonas aeruginosa
tcaatctcattatcgtctggtgaggttgccatgtccttcgaggcgcacgacccgcaagcattggatcactggtactggctgggcacgcagatccgctgcgcgctcgatcccgacgaaccgcgcctgctcgaccagtacctcggcgaggcgcgctatctcgccggttgggaaggtgtggccgcctggccgctgttcgagaaagcctacaacctcctgctcgataccggtcgcgatccgatattgccctggcactggcgcagcctctgcctcgactacgcctaccggcccctctgcgaacttcagcgactgaccaccaacggcagccagcgacgccggctgcgccagctctccgtacgaatggccaggcaggacctggcgccgtcgatgagcttcgatcacccgcaacaaggaaaccaagatgactga

SEQ ID NO: 7972 - DNA, 705 bp, Pseudomonas aeruginosa
gcactacctccatgccctggccctggcccaggtgctgctggaacgctggggcgacgccgacgaggcggtgatggcgttcgtgatttcccatcacaacctgcccgacttgcacctgcaactggagcaaccggaggagaccgcagaatacctgtgcgcctgccacgagcgcctgttgcgggtcagcgccgaccagaagctgccgctggccctgcgccaggcggcccagcatcacagccggcgcacctatgtcgaactgctgtcgttcatcggcgaacacggtgcctatccgcgcaccgagcgcctgctcaagggaccgccgaacgcggaggtccgacccgagttcctcgctccgcccccctcacttcgctatcactgacggagagtttccatgccccacgccttgccgcccttgccttacgcctacgatgccctggaaccgcacatcgatgcgctgaccatggagatccaccacagcaagcaccaccagacctatgtgaacaacctgaacgccgcgctggaaggcacgccctatgccgagcagccggtggaaaatctgctgcggcaactggctggtctgccggagaagctgcgcaccccggttgtcaacaatggcggtgggcatgccaaccactcgctgttctggaccgtgatgtcgccccagggcggtggccgtcccgatggcgacctggggcgggccatcgatga

SEQ ID NO: 7973 - DNA, 582 bp, Pseudomonas aeruginosa
gcggttactggcggcgaagcgcggcagccatttgttcaggtagccgacgatgtcctggtacatttcctcgacgtccggctgggcggccagatactcgcggacttccggctccagccccgaatgatcgcgcaactcgggcttccagtaggggttcggcaggcagcgcacatcgaacaccaggtcggcgtcgactggcatgccgcgcttgaagccaaaggattcgacgaggaacgcggtgccgggctccggcttgttcaacaggcgcagtttgatggtgtcgcgcagctgatagaggttgaggctggtggtgtccagcttcaggtcggcgaggtcggcgatcggtccgagcaattggctctcgtcgccaatcgcctccgccagcgaacgggtgtcggtagtcagcgggtggcgccggcgggtttccgagaatcgtttgagcagcgtctcgtcgtcggcgtcgagatacagcacatcgcagttgatgtggttgtcccgcacttcctgcaacagttcggggaagcgctgcaactggctgggcaggttgcgggcgtcgatcgacaccgccacctgtggctgcagtag

SEQ ID NO: 7974 - DNA, 1122 bp, Pseudomonas aeruginosa
tccgagttcgccgagaagttcgtcgaggacggcgagcttgtcttcccggccctgatagaggtgctggatgcccaggttgcgcgcgcgccgttcgaccaccggagtgtcgcggccggtgatgatggcggtgcgcacgccggaggcgatgagcatcttgatgccatgtccgtccagggtgttgaaggtcttgaactcgctgccgtcgacgaggaaatacagcttgccgtcggtcagcacgccgtcgacgtcgaagatcgccaggcgtatccggcgggcccggaccgggagttccgcggccgaatgggtatcgctcattacatcactcctgcgcgcaacaggtcgtgcatgttcagggcgccgaccggacggtcgtccgcgtcgaccaccaccagtgcgccgatcttgttgtcttccatgatcttcagggcttccgcggcgagaatttcggcgcggacggtcttgccgtggacggtcatcacctggtcgatggtgacctggcggacgtcgatgccccgatccagggcgcgacgcaggtcgccatcggtgaaaatgccggcaagcttgccatgttcgtcgagcactacggtcatgcccaggcccttgcgggtcatttccatcagcgcgccggtcagcgaggtgccgagcagcacctgcggcagcccttcgcccacgtgcatgacgtcttccaccttcagcagcagtcggcggcccagcgcaccgcccgggtgcgagaaggcgaagtcttccgcggtaaagccgcgggcttcgagcagggcgatcgccagggcgtcgccgaggaccagggttacggtggtggaggaggtcggggccaggttcagtggacaggcttcctggccgacactggcgtccaggttcacttccgcagccttggccaggggcgactcggggttaccggtcatgctgatcagggtgatgcccaggcgcttgatcagaggcaacagggtgacgatttcggcagtcgagccggagttggacagggcgaggaccacgtcgtccttggtgatcatgcccatgtcgccgtggctggcctcggccggatgcacgaagaaggagggggtgccggtgctggccagggtagcggcgatcttcttgccgatgtga

SEQ ID NO: 7975 - DNA, 996 bp, Pseudomonas aeruginosa
cctggccgagaccgccagcatcgccgactacatctatatcgtcggcgacggccgggtacttggccacgggacgccggacgtcctcaaggaaaccgacgatcctcgtatccgccagttcgtcaagggaatcccggatggtcccgttccgttccattatccggcccgcgactaccgggccgacctgctgggagagcgctgatgcgtagagtctctcccctcgagcgtatccgcctgttcggccgcgccggcctggacgtggtcgccgcgctcggccgctcgaccctgttcctcggccacgccctgctcggccggcgcacgccaggcaccgggttgcacctgctggtgaagcaactctattcggtaggcgtgctgtcgctggcgatcatcgtcgtctcgggcctgttcattggcatggtgctggccctgcaggggtacaacatcctgatttcctatggttccgagcaggcggtcgggcagatggtggccctgaccctgctgcgcgaactggggccggtggtgaccggcctgctgttcgccggccgtgccggctctgcgcttaccgcggaaatcggcaacatgaaggccaccgaacagctttccagcctggaaatgatcggtgtcgacccgctcaagtacatcgtcgcgccgcgcctgtgggccggtttcatctccatgccgctgctcgccgcgatcttcagcgtggtcggcatctggggcggggcgatggtcgcggtcgactggctgggcgtatacgaggggtcgttctgggcgaacatgcagaacagcgtgcagttcaccgaggatgtgctcaacggcgtgatcaaaagtatcgtattcgccttcgtggtgacctggatcgcggtctaccaaggctacgactgcgagccgacctcggaaggaatcagccgggcgacgactcggaccgtggtctatgcctccctggcggtgctggggctcgacttcattctgactgctttgatgtttggagatttctga

SEQ ID NO: 7976 - DNA, 474 bp, Pseudomonas aeruginosa
atgcaaacccgcaccctggaaatcggtgtcggcctgttcctcctggccggcctgctggccctgttgctgctggccctgcgggtcagcggcctgagcgtgggcaacgccggcgatacctacaaggtctacgcctacttcgacaacatcgccggtgttaccgtgcgcggcaaggtcaccctggccggcgtgacgatcggcaaggtgacggcggtcgacctggatcgcgacagctacactggtcgcgtgaccatggagatcaaccagaacgtgaacaacctgccggtcgattccacggcgtcgatcctgaccgccggcctgctgggcgagaaatacatcggcatcagcgtcggcggcgacgaggacgttctgaaggacggcagcaccatccacgacacccagtcggcgctggtgctggaagacctgatcggcaagttcctgctgaactcggttaacaaagacgaagccaaaaagtga

SEQ ID NO: 7977 - DNA, 558 bp, Pseudomonas aeruginosa
tcatcaacggcatcaacatcggcaagctgttccgcgaccagttcgccgacaccatgcagaagaaccgcaacgacctcgagaagaccatcgccggctggggtgaggtggtcgccaaggccaaggaaaccgcgaaagcggaagaggccggggcgaaatgagccaggccagcctgcgcgaaggcgcggccggcgaactgcagctcgccggcgtgctcgactacagcagcgggccggcgttgcgcgagcagggcggtcggctgatccgcgccagccaggcggcggaactggttgtcgactgctcggcggtggagcgctccagcagcgtgggcatttccctgttgctggccttcatgcgcgacgcacgcaaggccggcaaggtcctgagcgtcagggcgttgccggacgacatgcgggagattgccaaggtcagcagccttctggagatcctgcctttgcaggaatgaccggccggcggaacgagcggccctccgtctgcgcgtcccttcctggggttcgcaggcggagggcttttttgtatgatggccgaccgtgcgcgtag

SEQ ID NO: 7978 - DNA, 261 bp, Pseudomonas aeruginosa
ggcgcccgattgaggttgagcatgcaggccgaagacgttaagagccttctccaggaaaaactccccggcacccaggtggaagtcgagggcgaagggtgcaatttccaactgaatctgatcagcgacgaactggccggccagagcccggtcaagcgtcagcagcaggtctacgcccatttgaacgcctggatcgccgatggcagcatccatgccgtcaccatgaaattcttcagccgcgccgcctgggccgagcgttcctga

SEQ ID NO: 7979 - DNA, 1335 bp, Pseudomonas aeruginosa
aagaggctcgctatgaccgctcccttcgctatccgtcgactcaatgccgctgatccggacttcgggcgtcatctggatcatctgctgagctgggaaagtgtctccgacgattcggtcaaccagcgcgtcctcgacatcatcgccgccgtacgcagccgtggcgacgccgccgtggtcgagttcacccagcgcttcgacggtctccaggccgcctcgatggccgacctgatcctgccgcgcgagcgcctggagctggctctcacccgtatcaccgtagcccagcgcgaagccctggaagtcgccgccgagcgcgtgcgcagctaccacgagaagcagaagcagggttcctggcgctacaccgaggccgacggcacggtgctcggccagcaggtcaccccgctggaccgcgccgggctctatgtgccgggcggcaaggcgtcctacccgtcctcggtgctgatgaatgcgatcccggccaaggtcgccggggtgtccgaagtggtcatggttgtaccgaccccgcgcggcgagatcaacgagatcgtcctcgccgccgcctgcatcgccggcgtcgaccgtgtcttcaccatcggcggggcacaggccgtggccgcgttggcctacggcaccgaaagcgtgccgcgggtggacaagatcgtcggccccggcaacatctacgtggccaccgccaagcgtcacgtgttcggccaggtcggcatcgacatgatcgccggtccctcggaaatcctcgtggtctgcgatggccagaccgatcccgactggatcgccatggacctgttctcccaggccgaacacgacgaagacgcccagtcgatcctggtcagtccggatgcggcgttcctggaccgcgtcgcggacagcatcgctcgcctgctgccgaccatggagcgcgccgagatcatccgcacctccctggaggggcgcggcgcgctgatccaggtcgccgaccaggcccaggcctgtgcggtcgccaaccgcatcgccccggaacacctggagctgtcggtggccgatccggaaagctggctgccggagatccgccatgccggcgcgatcttcatgggccgctacactgccgaggccctgggcgactattgcgccggcccgaaccacgtgctgccgacctccggtaccgcgcgtttctcttcgccgctgggggtatatgacttccagaagcgttcgtcgatcatcaactgctcggccgagggcgcttcggtcctcggtcgtaccgcctcggtgctggctcgcggcgagtcgttgaccgcccacgcgcgtagtgccgaataccgcatcctcgacgagaaggaggcctga

SEQ ID NO: 7980 - DNA, 270 bp, Pseudomonas aeruginosa
tcgacgaggcctatgtcgacttcggcggcgagagcgccatcgccctggtcgatcgctacccgaacctgctggtcacccagacgctgtccaagtcgcgctccctggccggcctgcgggtcggcctggcggtcggccatgccgatctggtcgaggcgctggagcggatcaagaacagcttcaattcctacccgctggatcgcctggcgatcgccggcgcggcggcggctttcgaggacgacgcttatttccgtcggacctgccaggcagtga

SEQ ID NO: 7981 - DNA, 1380 bp, Pseudomonas aeruginosa
tcgtccgccatttcaagcaggcgcggatcgaccagttcctgcgtatcaccatcggcagtccggagcagaaccaggcgctactggacgccctgcacttcctcaagtgatacgaaaacggcgcccgagggcggccgttttcaatggcggggattactcgccgccgtcctgtttctgctgtggagccggtgccggcggcggacgcaggccgacctcggcggtcaggttgaccttctgtccgttgcgcagcaccacgatgctgatcttctgtcccggacgggtgcgcgccacctggttcatcgagcggcggccgtcgctggcttcctgcttgtcgatggtcaggatcacatcgcccggcagcaggccgccgcgtgccgccggaccgtcgcgatagacgccggcgacgacgatcccggcggtttcgccgaggcccagcgactccgccagttccggggtcagcgccttgacctcgacgccgagccagccgcggatcacctggccgtgctcgatgatcgactgcatgacctccagggccagcttggtcgggatggcgaagccgataccctgggagccgccggacttggagaagatcgccgtgttgatgccgatcaggttgccggcagcgtccaccagcgcgccgccggagttgccggggttgatcgccgcgtcggtctggatgaagttttcgtaggtgttcaggccgagctggttgcgtccggtggcgctgatgatgcccatggtcacggtctggccgacgccgaacgggttgccgatggcgaggcagacgtcgccggtgcgaatgccgtcggagcggccgagggtcatcgccggcaggttcttaaggtcgatcttcagcacggccaggtcggtttccgggtcgctgccgaccaaatgggcgatggtttcgcggccgtcgcgcaaggccacgatgatctggtcggcgccagcggtcacgtggttgttggtcagcaggtagccttccgcgctcatgatcaccgccgagccgaggctcgactccatgcgcttctgttgcggcaggttgtcgccgaagaagcggcggaacatcgggtcgtcgaacagggggtgggagggcttgctgaccatcttggtggtgtacaggttggccactgccggagccgctcgactcaccgcgttggcataggacaccgggccttcctgcaggcggctgagcagaggcgcctgctcgacgtgcacctcctggcgtggcaggccgaccagctcggggttgtgctggatgatcagcagggccagcagcacgccgaccagcacgggccagccgaggaaacgcagggccttgggcatcgggaaaatccttggggttgcgaggccgaaaagcggccgataaggtggcgcccattatag

SEQ ID NO: 7982 - DNA, 576 bp, Pseudomonas aeruginosa
agacggcatgaactggccgtagcccatggcgccggcataggaaccgcgcagggccagcgggtcggtgccttccttgcgcgcctggaggaggaattgctccagttcgccgctgaagaattccgcgcggcgagggtaggagaaggacagggtggacagcgcatcgatgatccgcgtcttgcccatcacacgcccccagcgggtttccacgccgatgatgccgacgatgatctccggcggcacgccgtagacgcgcgatgcccgttgcaggtcggtttcgtattggtcccagaacagcacgccgttctgtacgttgcctggcgtgacgaacttcttccggtagcgcagccaggcgccgttcggtccgctgggtggggtataggtcggggcttgccggtccatcaggcggatcacccagtccaggcgctgggtctgggcgaacaggtcgtgcagttgctggcggttgaagccgtgctggctgaccatcctgtcgatgaagcgctgtgccgccggattgttcgcgtaatcgccgcgcagcggcagtatcggttgcaccgactggcgtacggggcggggtga

SEQ ID NO: 7983 - DNA, 1959 bp, Pseudomonas aeruginosa
ccaggccggttcgatggaagaaaagaaacgtcagggctatttctgaggatacgcagcatgtctcatcaatccgatctgatcagcgaggacatcctcgcctacctggggcagcacgaacgcaaggaactgctgcgcttccttacctgcggcaacgtcgatgacggcaagagcaccctgatcgggcgcctgctgcacgactccaagatgatctacgaggatcacctcgaggccatcacccgcgactcgaagaaagtcggcaccacgggcgacgacgtcgacctggcgctgctggtcgatggcctgcaggccgagcgcgagcagggcatcactatcgatgtggcgtaccgctacttcagcaccgccaagcgcaagttcatcatcgccgacacgcccggccatgagcagtacacccgcaacatggctaccggtgcctcgacctgcgacctggcgatcatcctgatcgatgcccgctacggcgtgcagacccagacccgccggcacagtttcatcgcgtccctgctgggtatccggcatatcgtggtcgccatcaacaagatggacctgaagggcttcgaccagggtgtcttcgaacagatcaaggccgactacctggcctttgccgagaagatcggtctgaagaccagttcgctgcacttcgtgccgatgtcggcgctcaagggcgacaacgtggtcaacaagtccgagcgttcgccctggtacgccggccagtcgctgatggaaatcctcgaaaccgtcgagatcgccgccgaccgcaacctcgatgacatgcgcttcccggtgcagtacgtgaaccggccgaacctgaacttccgcggtttcgccggcaccctggccagcggcgtggtgcgcaagggcgacgaagtggtggcattgccgtcgggcaagggcagcaaggtgaaatccatcgtcaccttcgagggcgaactggagcaggccggtcccggccaggccgtcaccctgaccctggaagacgagatcgacgtttcccgcggcgacatgctggtgcatgccgacaatcgcccgctggtcaccgacggcttcgatgccatgctggtgtggatggccgaggagccgatgcttccgggcaagaagtacgatatcaagcgcgctaccagctatgtgccgggttcgattccgagcatcgtccacaaggtggacgtgaataccctggagcggaccccgggcagcgagctgaagctgaacgagatcgccagggtcaaggtcagcctggacgcgcccatcgcgctcgatggctatgagcagaaccgcaccaccggcgccttcatcgtcatcgatcgcctgaccaacggcaccgttggcgccggcatgatcatctccgctccgtcggcggcccatggcagcagcgctcatcacggttcgaatgcccatgtgacgcgcgaggagcgtgccggccgcttcggccagcagccggcgaccgtactgttcagcggcctctccggcgccggcaagagcaccctggcctacgccgtggagcgcaagctgttcgatatgggccgcgcggtctacgtgctggacgggcagaacctgcgccacgacctgaacaaggggttgccgcaggaccgcgccgggcgcaccgagaactggctgcgcaccgcccatgtcgccaagcagttcaacgaggccgggttgatcagcctctgcgccttcgtcgcgccgagcgcggaagggcgcgagcaggccagggcgctgatcggcgccgagcgcctgatcaccgtctatgtgcaggcgtcgccgcaggtctgccgcgaacgcgatccacaggggctgtatgcggcgggcgaggacaatatccccggcgagtcctttccctacgacgtgccgctggatgccgacctggtgatcgatacccaggcgctgagcgtcgaggacggcgtgaagcaggtgctcgacctgttgcgcgagcgccaggcgatctga

SEQ ID NO: 7984 - DNA, 1446 bp, Pseudomonas aeruginosa
aggacctgctgctgccacgcatgcaggactgacgtcgtcgcgccggccctgctaccatccggcgcgccattcttttctttgcctgacatctggtatcgcatgactactcgtatcctgaccggcatcactcctaccggcactccgcacctgggcaactacgccggcgccatccgcccggcgatcctcgccagccgtcggagcgacgtggattcgttctacttcctggcggactaccacgccttgatcaagtgcgacgatcccgctcgtatccagcgctcgcgcctggaaatcgccgcgacctggctggccggcggcctggacgtcgagcgtgcgaccttctaccggcagtcggacatccccgagattcccgagctgacctggttgctcacctgcgtcagtgccaagggtctgctcaaccgcgcgcatgcctacaaggccgcggtggaccgcaatgtcgaggctggcgaagacccggacgccggcgtgaccatgggcctctacagctatccggtgctgatggccgcggacatcctgatgttcaacgcgcacaagatcccggtcggccgcgaccaggtgcagcacgtggagatggcccgcgacattggccagcgtttcaaccacctgttcggcaacggccgcgagttcttcgtcctgcccgaagcggtgattgaggaaaacgtcgccaccctgccgggcctggacgggcgcaagatgtccaagagctacgacaacaccatcccgctgttcaacccgtccaggcagctcaaggacgccatcgcacgcatcgtcaccgactcgcgcgcgccgggcgagccgaaagacccggacagttcgcacctgttccttctttactcggccttcgccagcgccgaacaggtcgccgcgttccgccaggaactgctcgacggcctggcctggggcgaagccaagcagcgactgttccagttgctcgacaacgaactgggcgaggctcgcgagcgttaccaggcgctgatcgccaagcccgacgatatcgaggacattctcctcgccggcgccgccaaggcgcgccgcatcgccaccccattcatcgccgagttgcgcgaggcagtcggcctgcgctccctgcgcgagccgctgaaaagtgccgagagcggcaagaagaaggccgccaaggctgcgcgcctggtcagcttccgcgacgacgacggcagcttccgcttccgcctgctggacgccgccggcgaacagctactgctgtcccgcgccttcgccgatggcaaggccgccggtgcggtgagcaagcgcctgctggctggcgagactgccgacctgcgggccgagggcaatgcctttggcctgtggctggatggcgaggcggtggcgcatatcccggccttcgccgacgccgccgcccgtgacgccgccatcgagcgcacccgcgaagcgctggcaccgcaggagtag

SEQ ID NO: 7985 - DNA, 354 bp, Pseudomonas aeruginosa
atttcccccttatctcggcatgcccccttcggcaagcccgaccagggcctcggcccttcgtcctacggtagcggcggcttctacgcctggaaccgcgtgcggacccacatggggccggacaaggtcttcatacagaccggcaccgagtacgtcggccagcgcgagacctgggtcggcgtcggtggccagggggtcgccggcatggcgccggtgagtagcgaggcggtctatcgcaagaccggctactacgagaacgagaccatcctcgactatttctgcagcatcaccctgtacaccgacagccgggacatcatcaccaacgccagcgtgatcgactgccgggacagccgctga

SEQ ID NO: 7986 - DNA, 1734 bp, Pseudomonas aeruginosa
cgcagcgtggtgccccgcggaaggtctgttctagcggcccgccggctggttccggtagtagtcgaagaaggcctccagcggcagtgccttgccgaaatgccagccctggccgagggcctcgggcgagcggcgcagcacgtggtcggcctgggcctgtgtctcgatcccttcgacgaccacgccgatctccaggtgctcggccatcgagcagagcttgtcgaagatcagttcgacggcgctgctgtcgccgatggactgagtgaagaccttgtcgatcttgatcgcgtctaccggcaggttggccaggtagaccaggttcgaatgaccggtgccgaaatcgtccacgtagatcttcaggccgagttcgcgcaggcggttcatcccggccagcaggcagccctgggcctcggtggtgcgctcggtcagttccagcgcgacctgttccgggcgcacgctttccctggccatctggcgcatggcgaaatcgatgaaaccggggtcggcgatgtccttgccggtgacgttgacgctgacgtagaagctccgctgttccctcagcaacggcccgagctgcttcagggcgcggcggaagacgaaacgggtcagcagttcgatgtcgccgctctcctccagggcgccgatgaagacatccggggaaacccgccccaggctgctatcggtccagcgcgccagggcctcgaccccggcgcagcggccgctggccaggcgcacgatgggctggtagtgcacctccagggcctcgcgcttcaacgcgcgcagcagcctggccggcagtttttcgtcgttgaggaagccgaacaggtagctgagcagcagcatgacgccgaacaacagcccgccgccgatcgccgcggccatggccgcgcgtccgggctcggtgccaagcaggccgcgttcgcggagaagggagaccacgcagatgtcctgcgtcgggtcgcacaggcttatctgccgggcgccgatgaagcgcggccagccgggccggccgagcgcctcgaggggctggtcgtcgtcccaggcgaaacggtggtagatgtagtcgccgccactgctgacggccgccgccgaaatgcccgggtccgggtggtcgacatcgaaataggcgtgcggggcaatgaatacgacggcgttgccgcgactgaccagcccggtgggcagcgcctgcaacggcaggggcatgccctccgtccagaagcgggtgccggcggcatctacccggtcgggcgcggacaatccccagggcgcgcgcagccggccccggacgcccgtgcacatgacccggtcgccgctgatcctgccaacgtcgctcatgaagcgcgactcgagcacgatggaacgcagcatttccaggtcccggtcgctgcaggccggcgcgctgccggcgttcatctcgcggagcatctggtccgccgcggaggaaatctccagtgcccgctccagcgccctctcggtgtacgagcgcaggtgcgcgccgtcgtgctggcgatccagttcgttgatgacgaagatcccacagataccgcccaccagggtggtggtgagcagtatcggcaggatgcgtcgccagttgatccggccttctgcagccgttccacgctcggacataccttcttccgcctaatgaatccatggaaagcacgccagattgccgaacagcttcacgggccctgccgggccgtgcgcagaaccttttcagatttgtcccgatcgtga

SEQ ID NO: 7987 - DNA, 780 bp, Pseudomonas aeruginosa
tctgcaattgcaggccgccgaggagcatcaccccgggcagggtccagccggggaacggcacgctgcgctcatggcagccggtggccaggagcaggtgcgaatactccacctcgtgcagccgttccgcctcgtcgaggaccatcaggcgctggccgtcgccaccgaccacgcggctgttcaggcgcaggtcgatgtgcccggcgcaggcggagaaatcgcgccgcagtttttccagcatccgggtgtagcgcgcgccgaggtaggccggatcgacgccggcccgcaaggggccgcgatagaccaccccgccgggacgcgaggcctcgtcgaagaggacgcaggggaccccgcgcctggccagctcgatggctgcggccatgccggccgagccgccgccgacgatcaccgggcgcaggttcatggccgttcctcctggtcgaagcggttgctttcggtttccacccgcatgcccggccggacgacggtctggcaggcgcggcgcttgggccggccgtcgatggcgaccaggcagcagtggcatacgcccatgccgcagaaggcgccgctggcctggccatggtcgttgcgcgcgagccggcgcaggcccacggcattgagcacgttgagcacggtctcaccggcagccgccgcgacgggctggccattgaggtggatggtcatgtctgcccgcgagaggggctggatatcgtgttgacgttcaagaaggtgcattgccctttcatccgtgagagagatagtcgggagccggcgacactatga

SEQ ID NO: 7988 - DNA, 360 bp, Pseudomonas aeruginosa
gtggggtgcaggcgttcgccccggaaaagtcgaacccgcgcctaccccagggtgccaagcagcaaagccggctcacccgtgggaggccccatgctgcaatccttccagccgccctggtggaaaccccccggtgatctaccagggtctacccgcgttcgttcacccgacagcgacggcgacctgcccggcctggtcgcgcgcctggaccacctgcgccgccttggcggcgacgccctctggccgtcaccggtgtatcgctcgcccgaccccggcgctgccgccgcagatcgccaccacccgtcgttccgtcatgtccgactcagtgcgcgcgggccacgccgcgcaagaggttggcgctga

SEQ ID NO: 7989 - DNA, 498 bp, Pseudomonas aeruginosa
cctcttcctggtagcgccctcgatcgaggcgcatggcagtggtggtctcgatgcaagaagggataccgcggtcagatacacccccctcggtgcaaaggatcccctgagcgaggacggattctatggcaggggagggatatggccaggggaaacatcactccgcgcacgcggcaactggtggacgccctcaatgactgcctgggccggggggagcacagggagatgtttcaccacagcgacgatgcgggcaacccaggctcccatatgggtgacaacttcccggccaccttctaccttccccgggccatggagcatcgggtcggagaagagtccgttcgcttcgacgaggtctgcgtggtggcggatcggaagagcttttccttgctggtcgagtgcatcaagggcaacggctatcacttcaccgcccatcccgactggaacgtgccgctgcggcccagcttccaggaggcgctcgactttttccaacgtaaggtctga

SEQ ID NO: 7990 - DNA, 1221 bp, Pseudomonas aeruginosa
cgacgacctgccggaggaccccgccgattggccggcctggctcgacgccggggcccggcgcaccgccgaggcgcatgccgaatacctccgggcacgtcggcgcggcgaagggcgacgctacttccaggttccctcccaggcgatgcacttcattcgcagcgtggccccgaccaagctggtcgacggcgcctggctctatgggctgttgccgcatcatggcgaggaacgcctgcggccgctgctggagaccttcctcgaagaactcggcgacggcgtcccggcacgcaaccacgtcctgctctaccggcgcctgctggccagcatcggcagcgaggaagtcgaaggcctcagcgacctccactacctgcagggcacccagcaactcgccctcggccacctcgccgcggactacctgcccgaagtgatcggctacaacctcggctacgagcaaccgccgctgcacctgttgatcaccactcaggagctgcgcgagctgggcttcgacccctactacttccagttgcacgtgaccatcgacaacgccgccagcggacatgcgcgcaaggccctgcgcgcgctctacgacaacctgccgcagcttggcgggcgcgcggccttcctcgaacgggtgaggaacggctaccgcctgaacgaggtcggcctgagcaccgagcaggtgatcgacggcttcgatctcgaggaagaattgctggccatgttcgagcgcaagcgcccctacgccgccggcatgcattcggatcgttgccggatcggcgggcgcacggtgaaccagtggctggcggtgcccgggcggttcccggcgtttctcgcctgcctcgaggaagagggctggatccggcgccatgccgatccgcgcggcagccgtttctggaacctgatcgagggcgaccgggcggcgatgttcggagtcttcactccctacgagcggcagttgctgtacgactggatcgctggcgactggcaagcccccgctccggcggacagggacccgcttgcgccgctggcggagccggcgacggcgggcggagacgtggacgccgagcaggtcgcgctgcgacgcgagctgctgcggctatcccccgagcagggcgtcgcacgccttctcgaactgatggccccgcacctccaccacggacccgccggtctccttgccacgcggatgttcagccagcgctggagggccgcccatgcccagcctga

SEQ ID NO: 7991 - DNA, 729 bp, Pseudomonas aeruginosa
ttgcccggtgcgaggcgatggggattgtccgccggcacccgctggttgctcgcggaaaagacgatgcgcccgccgttgggcatggcgtcgcgggcgttggtggcaaggttgatgatggacagttcgagctggttggcgtcggtcaggccgaggtcgagatccaggggaaagcgcgtctcgatcgatacgctcggtcccagggaatggatcagcaggtcggtcatcccgcgcaacaggtcggggatcgcgcagggctgcggatcgagacgttgcttgcgggcgaaggaaagcatccgctgggtcaggttggcgccgcgctgggcggcctccagggcgttctgcaagaggtcggcggtgcgctggtcgccgggcaggcgtttcttcagcagcccgaggctgccgatgatcaccgtcagcaggttgttgaagtcgtgggccacgccgccggtgaggtgccccagggactccatcttctgggcctggaacagctcctggcgggcccgttccagttcgcgttcggcttcgatccggtgggtgatgtcacgggttaccttggcgaagccgatcagccggccatcgctgtcgcggatcggatcgatcaccacgttggcccagaagcgactgccgtccttgcgcacccgccagccttccttctcgaaacgcccttcgcgttcggcggcggccaggccgcgggccggctcgccggcctcgcggtcttcgggggtgtag

SEQ ID NO: 7992 - DNA, 762 bp, Pseudomonas aeruginosa
tacgaagaacgtcttccggccgctcgctggctcgccccaggaacttggccgacctttcggaagaccccggcgcggccggcgaattccattcgccggaaccttgtccggagtatggctttcgatatgcaggtagggacatctcctttccaccgcaccgaccccggagttcccatgcgcaatctggaaaccgcaaccctgaagctggggatattccatccccacgacagcctgagccaggcgctgatcgccgccgccttgcagcgacagatcgaagtcagcgccttgcaagccgatctcaacagcctgcaggcgcgccccgggctgcgctgcaagccagccagcctggcgtcgtcgatcgaggtcagccaggcggctgccggtctcgacctgctgttcgcgccgttgtccgactacgccgccgaagccttgccgccgatctgcgccgcgctgatcgatggcgccctgcgcgccgaggtaccgcgcctgttcctgcttggccattggcaatggctggtggcgccgcgcgatgccggcgaggagcaactgggtgccgggctcgagcgcagcctcacggtcagcggcctggactggacgctggtggaggtcccgagcctgcccgccggcctgcgcatcgacgatttcagccgcgccggcgacgtcgcggaagtggaggccgccagggtgttcgcctgcgccgaagcgctgctcgacgaagtccgtctcggcctgcacaagcgccagtgcctgcgcctggcgccctga

SEQ ID NO: 7993 - DNA, 360 bp, Pseudomonas aeruginosa
ggagaaccagccatgtccggacccgataccctcagccaggccttcggcaccctgctgctggccctggccttcagcgccttcatcgttttcgttcgcggctaccgcccgggcggggtcagcggcgcctggtacgacctggtgctcgccttcgtcgcggtatggctggcgttctggcccgaagccggcgtactcgcacgctcgccgagcctggccaatgccctggggttggtcttgcaggtcggcgctaccctgctcggctgcctgcttggctacggggtggcaaggggattgcggcgggcgatgcgggaaacccggcaaaaaagatcggcttcttcgccaacgagccggcgaggttcctag

SEQ ID NO: 7994 - DNA, 627 bp, Pseudomonas aeruginosa
gacagcacgccgtcgagtaccgcctcgccggccaggatctgtaccggacagacgccgaagctcaccggctgggcgccgccgagcgccactacgcgcagggtaccgtcggcctcgacgcgcttgacgatcatggcgatctcgtcgaggtgcgcgagcagccgcaccgcggcccgccgcgcctgctcgcgcggcaggtgcggcgggctgatgcgcgcgaccaggttgccggcggcatcgctgccgacctcgtcgcaacagccctcgagttcccgctggcagatggccctgacctcgtcttcctggccaccggggccacgtgccagcaggagttcctcgagcaaggcgcggtcttcttcgcgcatgcctcaggccgcccgtttttccaggcgcgctttcagctctttcttgtgctgctgcatggcctggccgagttgcttgagggcggcggcgtcgagcaattgccgggcgcgtgggaatagttcgccctcttcctcctcgatgtggtgttcgaggagttccttgagcaccttgacccggccggcgaactgcacggtatccgggcgggtgcgcttgaggtcgggaaggaccagggaatccaccgtgcggtgttcctccttggcctcgtag

SEQ ID NO: 7995 - DNA, 702 bp, Pseudomonas aeruginosa
cgcgttcctcgtcgagatggcccgccgcctgcgcggcgccgccggccccgagcgccatgtgcacctggtcctggagaacgacgacaaccgcgccagcctgctgcgccagggctacgacgcacagtggaacgacgatggccaccatgcgctgcacgtcctgctcaccggcgagaacgacggctactaccaggactaccccgagccgctgcgctgcctggcgcgctgcctggccgaaggcttcgtctaccagggcgaagccaaccgccacggccggccgcgcggcgaaccgagtgccgacctggcgccggacgccttcgtgctgtttctgcaaaaccacgaccaggtcggcaaccgcgccttcggcgagcgtctcagcgtcctcgccgaaccccaggcgttgcgcctggcgatagcgctgcaactgctcgcgccgatgattccgctgctgttcatgggcgaggaatgcgccgcgcgcgaaccgttcctgtatttcaccgatcaccagggcgaactggcggacgcggtccgcgagggacgacgcaaggagttcggcgagttcggccgcttcggcgagggcgccaccctggcttcgctccccgacccaaacgcggtggagaccttcgagcgctcgcgtcccggcctggccgattgcgacccggcctggcgcggcttctaccggcaactgctggaaatccgtcatga

SEQ ID NO: 7996 - DNA, 2046 bp, Pseudomonas aeruginosa
gtgacgcacgcctggccgaactggccgccgccgtgggcctgcaactcgactggcaggacgccaacggacggccgcagcgggtcgacccggaggtccagcgcggcctgctggaagcactcggctatccggcgcagagtccgcaacagatcgaacagagcctggccgcgctggcccggctgcgcgaggacagcgccaacctcggactgctggtcggcgaatgcggccagccgctggagcaagcgctcggccccgccggcaccccgggcgagctggtctacgaggacggcacgcggatcgccctgcgcctggatgccgaaggccgcctgccggcgcaggcccgcagcggctatgcgcagctgtcgctggagcagcgggaatgggcggtggcgatggcgccgccgagctgtccgtccctggccagcctcgccccgggtcgctcgcgtcgctggggtctggccgcccagtctatgccctgcgccgccccggcgacggcggcctgggcgacagcgccgccctcgaggacctgctgcgcagcgccgcgcggcatggcgccgacgcgctggcgatcagcccgctgcacgccctggccgaggccaacggacatgcctacagcccctactcgccgtccagccggctgttcttcaatgtcctgcacgccgcgccggcgaccattctcggcgcggcagcggtggaacaggcgatccgtcgcgccggcctggccgcggagatggcccgcctggagagcctggagctgatcgactggacagcggcggcggacctgcgcatgcgcctgctgcgccaactccaccgcgacttcaccgagcgcgccagtcccttgcgccacgacctcgccgaattccgccgcgaagccggcgaggccctgctgcaccactgccgcttcgagaccctgcaggcgcacctgggcgccggccccgactggagacgctggccggagccgctgcgccgccccggcgagccggcggtggccgcgttctgcgccgatcacgccgaggaagtggacttccgtgccttcggccagtggctgacccaacgttgcctgcaacatgcccagcgccaggcgcgcgaggccgggatggccatcggtctggtcgccgacctggcggtgggcgccgacggcggcggcagccaggcctggtcgcggcaggaagagctgctcgccgaagtgaatgtcggcgcgccgccggacatcctcaaccagtccggacaggactggggcgtttccgcgttcaatcccgaaggcctgcgccgccacggctaccgggcattccgcgagatgctgcgggccaacctggcctggcccggagggctacgcatcgaccatgtgatgggcctgcaacgtctctggctgatcccgcgcggccagccgccccacgccggcgcctacctgcgctacccgcaacgcgagctgctgcgcctgctggcgctggaggccagtcgcgcctcggcgctggtcatcggcgaggacctcggcaccgtgcccgaaggcctgcgcgaggaactggcacgccgccaagtgctgggtacccgcgtgctgctcttcgagcggcgcggcgaacgcttcgtgcccccggcgcaatggccggcggacgccatggccaccaccagcacccacgacctgccgagcctgtccggctggtggcggggccaggacatccactggcgcggccgcgccggacaccgcagcgccgaggaatgcgcggccgacctggaactgcgcgccgaggagcgccgggccctggccgccagcctcgaaccgccggtcgatcccgaccccgccgccgaagtaccgctggacgcctgcatcggctatgtcggggcaacccccgcgccgttggtgctactgcccctggaggacgccctgggcagcctggagcagccgaacctgcccggccccggcgacgcccacccgaactggcggcggcgctggccggaaaacgccgcgcagatgctcggaacgccgcaggtcgaccggcgcctgcgcctgctcgaacgcagccgccgggatgccgaggaggccgcccatga

SEQ ID NO: 7997 - DNA, 651 bp, Pseudomonas aeruginosa
gcctggaccgcgaggccggccgcctgctggcgagccacggcgagcagcgcttccccctctggccgggcagttacccggagctgctggaagacagcggcgagccgcgcctgtcagccctggccggcggtttccgcgagtgccggcaggaccgcgaggccttgcgcgagatgcagcgtcaactggcggctgcgctcgccgagagcgctccgcgcgcagccctccagcgcacgctgggcgaactccaggaacgccacgaggaggctcgccaacgcctgcaccgcctgctcgaggcgcagcactaccgcctggccagttggcgcaccgcggcggacgacatcaactggcgccgtttcttcgacatcagcgaactggtcggcctgcgggtcgagcgcggcgaggtgttcgaggccgtgcacggcaaggccttccagttgctcgaggacggtctgctcgatggcctgcgcatcgatcacgtcgacggcctggccgatccgcgcggctattgccgacgcctgcgccgccgcagcgagcggatccgcgcccgtcgcggcggcgcgccgatgctgctgtacgttgagaagatcctcggtggcgaggagcgcctgcccgaggattggctgtgcgacggcaccaccggctacgacttcatga

SEQ ID NO: 7998 - DNA, 402 bp, Pseudomonas aeruginosa
gcctgtccgaagtgctcgccgactttcccgtcaacctgctttaccgcctcgcccaggaggacaccccatgagcgccgacgaaaaacgcatacgagagttcgcctaccagatctgggaatccgagggctgccccgacggccaggccgaacgccactgggccatggcccggcaactggccgaagcggaagccgccgcggcggcaccgaagaagacccgcggtcgggccaaggccgccaaggaaaccccggccctgctgcaagcgccggccgccaagccgcgcaagccgagggccgcgtccccggcgcggcccgccagcgaaaaaccggcggcggccaagccgcgcagccgccgcaagcccgaagcgggcgaatgaggagtccagtgcatgagcagaaagcgtag

SEQ ID NO: 7999 - DNA, 477 bp, Pseudomonas aeruginosa
acttcgtcaccgcccacgacggtttcaccctgcgcgacgtggtttcctacgatcacaagcacaacgaggccaacggcgagaacaacgccgacggcagcgaccacaacctgtcctggaaccacggctgcgagggccccaccgacgacccggagatccgcgccctgcgcctgcgccagatgcgcaacctgctgtccaccctgctgctgtcccagggcaccccgatgctggtcgccggcgacgagttcagccgcacccagcagggcaacaacaatgtctattgccaggacaacgaactgggctggatcgactggcggctggacgacgagggccgttcgctgctggccttcacccagcgcctgctggccctgcgccaacgctatccgatcctgcgcagggggcgcttcctggtcggcgagtacaacgaggcgctgggtgtcaaggacgtcacctggctggcgcccggcggcgaggagatga

SEQ ID NO: 8000 - DNA, 516 bp, Pseudomonas aeruginosa
acggcggggaaaaaagctgaaccgcccccggcacctccagtcggaacctgtaggtgccgcacgcggcgcccgcacatccaccctacacaggaggacagcatgaagatcagcgacatcatgacccgcaacgtccaggtcgccgacccgcagcagagcatccgcgaggcggccgccaccatggcgaggatcgacagcggcgccctgctggtcggcgaaggcgaccgcctggtcgggatgatcaccgatcgcgacatcgccatccgcgcggtggccggcggcctgtccggggataccccgctgggccgcatcatgagcggcgacatccactattgcttcgaagacgaagacgtccagcacgtggcccgcaacatggccgacatccagatgcgccgcctgccggtgctcaaccgcgagaagcggctggtcggcgtggtttccctgggcaacatcgccagctgccgcgaccaggcctccagcgccaccgtcctgcagggcgtcgcccaggcccactactga

SEQ ID NO: 8001 - DNA, 1314 bp, Pseudomonas aeruginosa
gcctttcttccacccggcccgcctttgccgttccggccgaggccgggccccaaccgggagaacgccatgaaagccgtggtatttcatgacatcggcgacatccgcctggaagacgtggcggagccgcgcctgcaggagcccaccgacgccatcgtgcggctgaccgcctcggcgatctgcggcaccgacctgcacttcgtccgtggcagcgtcggcggcatgcgtccgggaaccatcctcggccatgagggcgtgggcatcgtcgaggcgctcggcgacgaagtgcgcaaccttcaggtcggcgaccgggtggtgattccctcgaccatcgcctgcggcaattgcgtgtattgccgagccggctactacgcccagtgcgacgtcgccaaccccggcggcagccaggccggcaccgcgttcttcggcggcccccgggccaacggcggcttccatgggctgcaagccgagaaagcgcggattccctatgccaacatcggcctgatccgcctgcccagcagcatcagcgacgaccaggcgatactcctgtcagacatcttccccaccggttacttcggcgccgaactggccggtatcgcccccggcaacaccgtcgccgtgttcggctgcggtccggtcggccagttcgccatcgccagcgcgttgctcctcggcgccgccagggtgttcgccatcgaccgccacccggaccgcctgcacatggcccgccagcaaggcgccgaagtgatcgacttcgagcgcgaggatccggtccaggccctgcgctggctgaccgccgggatcggcgtggaccgcgccatcgacgccgtcggcgtggacgccgagcacagccatggcaccgccaccccggcgccgcgccaggagggcaccagctggagtcccggcaacgcccccgcacaggccctggagtgggcggtgcagggcctggccaaggccggcaccctgtcgatcatcggcgtctacgccgaagactcgcggcagtttcccatcggcctggcgatgaaccgcaacctgaccatccgcatgggcaactgccaccaccgcaagtacattccgctgctgctcgaacatgtgctcagcggacgcatcgacccggcgaagatcctcacccaggtgaagccgatcggcgacgccatcgaggccttcgaagccttcgaccgccgcgagaccggctggatcaaggtcgaactggtgccgcagaagcgccaggtcgagggcagcgaggaacgcctcgacgaacgcgcggtggacgaactggcgcgccggccgacgccggaaagcggcgcccgggggtga

SEQ ID NO: 8002 - DNA, 942 bp, Pseudomonas aeruginosa
tgcatgagcgcaccggcacgcctgcgcatcggcatttccggctggcgctatgccccctggagaggtgacttctatcccgaggggctgcgccagaaggacgaactgcgcttcgcctcgcgggcggtgaacagcatcgagatcaacggcaccttctacgccctgcagacgcccgagcgcttccgcggctgggccgaggacacccccgaggacttcgttttcagcgtcaaggccccgcgttacatcacccacgtgcggcgactgcgcgagatcgacgagccgctggcgaacttcttcgcctccggccccctcgccctgcgccagcgcctcggcccgttcctctggcagttcccgccgagcatgcgcttcgaccgcgagctgttcgccgatttcctcgcccgcctgccgcgcgacggcgccgccgcgcagaagctcgcccggcacagcgccgcgcgcctgcaccgcgagggctacctcgacggcgatccggcgcagcgcctgcggcatgccgtggaaatccgccatgagagcttcgtcgacccgacgttcatcgagctgctgcgcgaataccgggttgccctggtggtggccgataccgccggcaagtggccgctgctcggcgacgtctgcgccgacttcctctacctgcgcctgcatggcgacaaggagctctaccgcagcggctattcggaagcggccctgggccagtggcaggcacggatccgcgcctgggccggcggcgaccaggccgacgacctgcgccgggccagccaggacgccccggcgaaggcgacggcgcgcgacctgtactgctacttcgacaacgacgtcaaggtgcgcgcaccctacgacgcccggcgcctcctgcagctgctggaactcgacggcggcctgcgcacggtgcccggacagttgcccgatgacctgcgggagagtgccgcatga

SEQ ID NO: 8003 - DNA, 1434 bp, Pseudomonas aeruginosa
tcgacatcggccgtccgctgcacgcggtctgcgtgcacctgggattgcgcgaggcgcagcgccagcgccagttgcaactgctctgcgaactggtggcgggcctgccggagcgcgagccggtggtggtcgccggcgacttcaacgactggcgccagcgcgctgaccaactgctcgccggttgcggcctgcgcgaagtcttcgtcggcgcccagggccggccggcgcgcagcttcccggcgcgctggccggtgctgccgctggaccgcatttacctgcgcaatgcccgcgggcgccagccgcgcatcctctcgcggcggccctggtcgcacctgtccgaccacctgccgctggcggtggaggtggagccatgaacttcccctggcgcgacggcaaccgcgtagaactgctgatcaacggcgaagagtactttccgcgcctgttccagtgcatcgccgaggcgcgccgggagatcctcctggaaaccttcatcatcttcgaggacgaggtcggccggcagttgcaggaagccctcagcgccgccgccgagcgcggtgtcgaggtgcaggtcacggtggacggctacggcaccgcctcgctcagcccggactacctggccaggctggccgcctccggggttcgcgtgcacctgttcgacccgcgcccgcgcctgctcggcatgcgcaccaacctgtttcgccggttgcaccgcaagctggtggtgatcgatcgccggcaggccttcgtcggcggcatcaattacggcgaggaccacctggtacgtcgcggcaacatggccaagcaggactacgcggtgcgcgtcgagggcccggtggtgcgcgatatccgccaggcctgcctggcgctgctcgaaccggacgccgactacccgccgttgcggccgtcgggcgccgggcagccggcgcgggtgcgcctggtgatccgcgacaacgaccagtccagcgacgacatcgagcgcgagtacctgcaggcgatccgccaggcgcggcgacgcctgctgatcgccaacgcctatttcttccccggctaccgcctgcttcgcgagctgcgcgatgcggcgcgccgcggcgtgcgcgtcgacctggtactacagggcatgccggacatgccgctggtgcgcctgtgcagccggctgctctacgactacctgctgcgcgagggcgtgcgtatccacgaatactgccagcgtccgctgcacggcaaggtcgcggtgatcgacgacgactggtcgaccatcggctcgagcaatctcgatcccctcagcctgtcgctgaacctggaggccaacctggtgatccgcgacgtcgccttcaacggccagctctaccagcacctgcgcgagctggcgcgccgccactgccggcgcatcagccgccgccacgcgaggcgcggctactggtggcgagcgcccgctga

SEQ ID NO: 8004 - DNA, 1251 bp, Pseudomonas aeruginosa
aatcgctggagccgcgtccgtcgcggcgctggcaggaacgccagggccagcggggcaacccatgaacggcagcggtcacgaagccacctcgacgccgccgcgccgctctcactggcgctggctgcgcaggctgctgaccctggcgttcttcgtgctggtcccggtgctgctgttcctgctggtgaagaatctcgactggcaggaagtccgccacgccctcgacgagtatcgccccgcgaccctgttcctcgggctgctgctggcggccgccggctatacggtgttcagcagcttcgacctgctcagccgctactacatcggccactcgctgcccaagcggcgggtcttcaccgtggcgttcgtgtgcaatgcgttcaacctcaacctgagttcctgggtcggcgccgtggcgctgcgctatcgcctgtacagtcggctcggcctggacatcgccgatatcacccggatcctcaccttcagcctggtgaccaactggttcggctacctgctgctcgccggcatcctgttcagctgcggcctgccggccttgccgccgggctggaagctcggcagcgacggcctgcgcctgatcggcgccctgctcctggcgctggccgcaggctacctgctggcctgccgtttcgcccgacgccgcgcctggggctggcgcgagcatcggctgaccctgccgtcctggcggctggcggccctgcaaggcctgctcggagcgagcaactggtcgctgatggcgctcctgctgtacagcctgctgccgcacagcgtggattacccgagcgtcctggcgatcctcctgatcagcagcatcgccggggtcatcacccatatcccggccgggctcggggtgctcgaagcggtgttcatcgccctgctccaggggcgcctgtcccagggcgtgctgctggccgcgttgatcggctaccgggtgctgtatttcctcctacccctggcgctggcctgcgtggtctacctgctgttggagcgccgggcgatccgcctgcgccgcaaacagcgccgcctgcgccagggccaggcgtgaatcagccggccggacgcagcagcaacgtgcccagcggcggcaggtcgagcaccaccgactgcgcctggccatgggcgccgcacgactcgctggagacgcggccctggctgcctgcgccggaaccggcgaacgcctgggcgtcgctattgagcagcacgtcccagtcgccgccttgcggtacgccgatccgatag

SEQ ID NO: 8005 - DNA, 570 bp, Pseudomonas aeruginosa
tcagcagcccgccggctgcctgccgggccagcagcggcaggcgttcgagcagcgccggcaggcgttccagcaggcgccgcgcccgttccgccgcctcgccctgcaacggtcgtggcggctcgctcaggcgtttgccggcttcgcgcaactgttcggcgatacgcagcgcccaggcctggacgctggcttcgtcgctctcgcggctgccgaaggccggatcgtccgactcgccggccagtacgctgtgcatctcgccgagccgggcgccgaggttggcggcgaagccgcgcagttcggcgaggctgtcgtattgcccttcgagcgcctcgctggccgcggatatctcgtcgcgcacggctcgctccaggttgtccagggtccagttccaggcgtcgccctggttgttcaggtagccctgcaggatcatcagcgtgtgcggctcgccatccgcgccgacccgccgtacctcgccgagcaacggggcgatgccggggtaaccgtggcgggtcaggtagccgccgacctcgatttccgggtgcagccccggaaggatcttgcgcagcaccttga

SEQ ID NO: 8006 - DNA, 393 bp, Pseudomonas aeruginosa
actggatctcgccgtcgccgtgggcgatcaccgcctcggcgcggagttgcgcgaggaccttgcgggcgaacagcggcaggctggcggcgtcggtcagcaggccgaccttgcgaccgcgccgcaggcgcgccagggccagcaactgaggcaggctgtcgccgcgctggtcggcgtcgaggaagcccagcggcaactggtagcgcagcccgtcgatctccacttcgcacagcgcacagcgcggctccgcctcgtccagcggaacgatgtagcagagccgtggctggcctttctcgccggcgaaccagcggcgcttcggcaggtaggccggcagcgtctcgccttccaggatgttccgcgatgcgccctgcagcagctcgccgaggcgctgcttga

SEQ ID NO: 8007 - DNA, 405 bp, Pseudomonas aeruginosa
agaacgtcgaagcccatcgcggcgatctgcggcaggcgccggatcacgtcgtcgaaggtaccgtggcgtgtcgggtcgccgctttccgagcgagggaacagctcgtaccaactggcgaagcgcgccagcggtcgctccacctccaccgggtattcgcggctgcgcaccaggtgctcgcgcgggccgaccagacgcaacagttcgccggtctgcgccgccagccacagcgccacccgctcctcgacgctctggcaggcctgcaggcgttcggccagcggcgcacaggcggcggcgatctccggaccgccgcgctcggcgcagcgctgcagcagttcgtcgccctcgcgcagctccaggtccagcggcaggcgtgcgccatgcttggcacgcaattcgcggcggtag

SEQ ID NO: 8008 - DNA, 417 bp, Pseudomonas aeruginosa
ctggcggcagccttgccggcgaagatcttcacccgcggcacgcggtcggcggtcgggtcgttgcggatctcctggtacagcgccacggtgtgcagcaggttgagcaactgccgcttgtattcgtggatacgcttgatatgcacatcgaacagcgcttccggttcgatcgccacgccgaggctgtccagcaccaggcgcgccagggcggtcttgttctgccgacgctgctcggcgaagcgtgcccgcagcctggcgtcctcgacgtgttcctcgaggtccggcaggcgccgttccggggtgtccagcaggtcggcgccgagggtctccaccagcagctcggtcaaccccgggttggcctggaacagccagcggcggaacgacacgccgttggtcttgttgctgatgcgctgcggatag

SEQ ID NO: 8009 - DNA, 219 bp, Pseudomonas aeruginosa
cctttcccgtattccggcaggagcgctccgatgcaggctttcatggttcatttctcagacgccggacaacccggccggaccgtgctcaccactttcgcgccaaccctcagcaccagcgaggcgcacgttcgcctgcaactctgctatcccctgctgttcccgcagcgtctgagcgcggtgcgggtctaccccctgctgccggcggcggcacgcgagtga

SEQ ID NO: 8010 - DNA, 465 bp, Pseudomonas aeruginosa
gccaccaggcgagaggcctcgtccgcgagttgcaggtcgggcatggcacgctcctcagggcgagatcgggtcgctggcgggaaaggtctccttcaacgcgtcgtccagctggcgatcctccgccacctggggccgggtggtgccgccacaggggcaatcggcgtcgcgacacggctcgccctgggggtggccgccggcgcaggccgcgcagcaatagtgctggccgtcgcgttcgacggcatcggcgccgggctggcaggtgcatttgggacaggcacaggtttcgctgttcatgggcagtctccagtggggttcacttgctgtgttccggcgaggtcaccgggcgcaagccacgggggccggtccagccccagaggaccaggccgagcacgggcaggagcaggatcagcagtgaccagccgagcttgcgactggcggagctgtcgctgcggagcacgctgttga

SEQ ID NO: 8011 - DNA, 450 bp, Pseudomonas aeruginosa
ggaaggcgcgcaggcccagctcgtcgagcaacgtcaggctcagctgggtcgcttcgagcatgcgcttccacggcagcgccgggtccgggtcgaggtcgaggacgaaacggtcgggccgctccaggttggccaggctggcgttccaagtatggaattcgatgctgcccatctgcaccgcgccgaccagcgcctcggcgctgcggatttgcaacagcggcggatgaccgggatcgagcgccgggtcgagctggacgatgccggggatcttcaggcgcgccgcgtgcttctggaagaacagttcgccgccgattccgtcggggccgcgcaccagcgacaccgggcgctcgcgcaggtcgcgcaggagcaggtcggcgtagcgcgcatggtactcggcgagttccagcttgctggcctggatcgacgggtcgatcagccgctgcggatggctga

SEQ ID NO: 8012 - DNA, 477 bp, Pseudomonas aeruginosa
tccagtcgttgctgcggcgcgaacggtaggcgctgcccagacgcttgccgatcacgccttcaagaccgagcttgcaggcgctggccagcaggtcgcgggggtcttccgcgagcgtcgcggagaaccgcagcgggtcttcgtctcgcccttccagcagcgcctccaggcgcgcgcggcgctcctccagggcgacatcgcgcagatcctcgccttcgtggtacggcaggtcgaagaggacgtacaggatgttctcgccgcgaccttcctcgaaggcgttctgcagggcctggaagtccggtcgaccctcctcgtcgaggacgaccagttcgccgtccagccaactgcgctgcagaccgagcccggccaaggccttctccaggtgcggcaggcgttcggtccagtcatggccgttgcgggtcagcaggcgcacgtggccgtcttcgatgcggctcatcagccgatagccgtccagcttga

SEQ ID NO: 8013 - DNA, 564 bp, Pseudomonas aeruginosa
cgttgttgccgaaccagctcggcgaagtcgccagtcgactggagttcgccggcgagagcctggccttcgaccagttcatctacccctgagtcatccgttccgaggaggcgcacgatggattccatactgcgagccgccgcgctctacctggtcctgctggtactcttccgcatcgccgggcggcgttcactgaccgacatcaccaccttcgacctgctgctgctgatgatcatcggcgaagccacccagcaggcgctgctgggcgacgacttctcgctggtcaacgcggtactggtgatcatcaccctgatcgtcatcgacgtcggtctgtccctgctcaagctgcgccatccgaagctcgacaccctgatcgagggctccccgacgctcatcgtcgagtacggcaggccattgcacgcacgcctggccgaggcccgcctgcgcgaggaagacattctcctggccgcccgcgagacccagggcctggaacgcatggagcagatccgcttcgccatcctcgagaagaacggcaagatctcgatcattcccgatcgcggcgactga

SEQ ID NO: 8014 - DNA, 465 bp, Pseudomonas aeruginosa
ggtagtacaggccgccgatgccgcggatgccgaaccagccgagcaggcgccgctgcgccgggtgcatcagccgccggccgaccagcagccagaccatcgccggccgacacacgcagaacagcagcagcgccagcggcagcgcgcgccagtcccagtgctggtaggagcatggcaccgagcagggtcaccagcagcacttccagcgagcgctccagcaggttgccgaaggagagcacgtcgagcatcaccgcgccggccgccaccttcgggtgttcgctgcggtcggcgccgtactcgatggcgccgctggcctgccctgcctcgcgcacgtcggcggcggccgcctgcgcctcggccggtgccgaggcgcgccccagcgtcgccacctcggcgtggcgcaggccgatcccggcggcgaagctggcgaggaagccccagccgcccagtgcgtcggcgccgacatag

SEQ ID NO: 8015 - DNA, 582 bp, Pseudomonas aeruginosa
  unsure (166): Identity of nucleotide at the above locations are unknown.
ccagggcgctgcgcagcagcccgccgccgcgccctcgccagctcccacgcagcctgccgctccggcggccaacggggggcgccgctgatggctcgcgcgacccagggttcgaacaatgtctgggtgatctggctgagcctgctggtcgggctggtgctggccgtancgccgatgcctaccttcaccgagatcggccgcccgctgtggctggcgatgctgctgacctactgggtgttgctgctgcccgagcgcgtcgggatggtcaccgcctggctgctcggcctggcccaggatgtgctctacggcaacctgctcgggcagaacgcgctgatcctcggcctgatcaccttcctcgtgctgtccctgcaccagcgcctgcgcatgttcccggcatggcagcagtgcctggtgctggtggtggtctacggcctggcgcaactgctccagctctggctcaacgccctgaccggcaatcgcccgccgaccctgaccttcctgcttccggccctggtcagcgcgctgctctggccctgggtgtacgccctgctgcagttcgtccgcctgcgtctcaacgtgaggtag

SEQ ID NO: 8016 - DNA, 495 bp, Pseudomonas aeruginosa
actgctgacccagatcggcgttccgctgtccgtgctcgccaccgctatcgacgagtcccccttgccgaacgaagcgcccgccgcctacgtcgagcgcctggcgcgcggcaaggcggccgccgggctggctatgctggaagggcgcggcgaggacggttatgtcctgggcgcggatacctcggtggtgatcgacgggcgaattctcggcaagcccgtggaccaggccgaggggctggccatgctggctgcgctgtccgggcgcgaacaccaggttctcaccgccgtggccctggccgccgctggcggcgtcgaggcgcgggtagtggagtcccgggtgcgcttccgccaggtcgccccggaagaagcgctgcgctactggcagagcggcgagccggcggacaaggcgggcggatatgcgatccagggcctcggagcgatattcgtcagccgcatcgaaggcagttacagtgcggtggtcgggctgcctttgtgtga

SEQ ID NO: 8017 - DNA, 1095 bp, Pseudomonas aeruginosa
  unsure (88): Identity of nucleotide at the above locations are unknown.
ggggcaggcgctggtggtgcaggtgaccaaggatccgatcggcaccaagggcgcacggctgaccacccacctgtcgattccttcgcgntatgtggtgtacatgccgcgcaccagtcatgtcgggatatccctgcggatcgaggacgaagtcgagcgcgagcgcctgaagaaggtggtggccgactgcgtggcggcggaaggcatcgaggggcagggcggcttcattctgcgcaccgctgcggaaggtgcgggcgaggacgagattctcgccgacatccgctaccttcgccggctatgggaccagatcgccgcgcagatccagaccgtcggcgcgccttcggtgatctacgaagacctgtccctggcgatccgtaccctgcgcgacctggtgaacccgcggatcgagaagatccgcatcgactcgcgagagaacttccagaagatcacttccttcgtcgaagaattgatgccggagatttccgatcgcctcgaacactacccgggcgagcgaccgatcttcgatctctacggcgtcgaggacgaaatccagaaagccctggagcgcaaggtactgctgaagtccggcggctacctgatcgtcgatccgaccgaggcgatgaccaccatcgacgtgaacaccggcgccttcgtcggccatcgcaacctcgaggaaaccatcttcaagaccaacctcgaggcggccaccgcgatcgcccgccaactgcgcctgcgcaacctgggcgggatcatcatcatcgacttcatcgacatggaggacgaggagcatcgccggcaggtcctgcgcaccctggagaagcaactggagcgcgaccacgcgaagaccaacatcatcggcatcaccgagttgggcctggtgcagatgacccgcaaacgcacccgcgaaagcctggtacagatcctctgcgagccgtgcccctgctgccagggacgcggcatgctgaagactgcggaaaccacctgctacgagattttccgcgagattctccgcgaggcgcgtgcctaccaggccgactcctacctggtgctggccaaccagaaggtggtggaccggctgctcgacgaggagtcgggtaa

SEQ ID NO: 8018 - DNA, 3861 bp, Pseudomonas aeruginosa
cgtggtcctgctctgaggcgtatggctgaaatggcggatgtgggaagcctcggaacgcgactgctacggatcgtcctgggtttgtgcgccctggtactggtgctgctggcgctgtacgtcagccttggccggcaactggtgccgctggtggccgaataccgccagcagctggaggacgaagctggcaagcaactcggcataccggtgcggattgccgagctgacgggctcctggcgcggcttcgagcctctggtggtggcgcgcgacatccaggtcggcgacggcgaacagagtctgcgcctggcgcgggtgcggctggcgccggacctgctcggcagcctgctggcgcgccaggtgcggatcggcagcctggagctggaaggactcaagctgaccctgcgcgaaggcgaggatggccagtggagcctggatggcctgccgcacagtgacaagcccagcgatccccggaagctcctgcaattcctgctgcagacccaacgcatctcgctgctggacagtcaactggaggtggcgccgcggggaagcgcagcgttgtcgctcagcgcggtcggcgcgaccctgcgcagttcatcggttggtgggcagagtctcgatgcccgcctgcaactgccggatggccaacctctggcgctgcacgccgaagggcggatcgacagcgaggactggccgcgcagcagcgccaggttctatctcagcctgccgcagagcgactgggcgcaatggttgccggctggtctgacccaggaatggaagatcgtccgggccaaggccggcggagacttctggttcgactggcgcgacggcaaggcgcaacggctggtggcacggctgctggcgccgcagttgaaggcgtcgtatgccgcgcgcaagccggtggaaatcaacgacctgggcatgaacctgttcttcgatcgcgaagcgcagggctggaaggttcgggtcggcgacctggcggcgaatttcggcgagcagcgctggggcgaggtggagttgctgttgcgtcgcgaccagcagaacaacgagccacactggaagctgcaggccgaccgcgtcgacctgacgcccctggtgccggcgatagaagcgctggcgccgctgccggacgcggcggcggagtgggtggcgggcctgaagccgaagggcatcctgcacaacctgaacgccgatttctggccgcagcgagaggtgcccgagcgggtcagctacgcgaccaacctggaaaaggtcggtatctcggcgttccatgaggttccggcagtggaaaatgtcagcggcaccttgaccggcaccctggctggaggccagctcgacgcatcggcgcaggatttcatgctgcacctggccaaggtgtttcccgagccgtggcgctaccgcgaggctcgcacgcggatgttctggagcctggacgaccgcgccttcaccctcggcagccacctgatgcgggtcgagggcgaggagggccgcctggccggcgacatgctgatccgcctgatgcgcgatcccggcgctgaagactacatggacctgcaggtcggcctcagcgacggcgacgcgcgcttcaccgccaagtacctgccgacccagttgccgggaatgaacaaaagcctggcgaactggttgaagacggcgatccgcagtggccatgtcgagcagggctacttccagtggcagggctcgctgaatcgcggcgcggcggccgaagcccacgtcatgaacctctacttcaaggtccgcgacggcgagctggcctaccagcccggctggcccgccttgagcaaaacggtcggcgaggtgttcgtcgaggattccggagtccgcgtgctggcctccagcgggaatctgctgaattcccgggtcagcgacgtcaaggtcgacattcccctcggccgtccgggacagacgccgcacctgtatgtggatggggccgtcgacagtaacctgaaggacggcatcaagctgctccaggaagcgccgatcccgacccgcaagatcttcgccggctgggagggcgatgggcccttgcagggccacctgaagctggatattccgctggaccacgacgaggccggcaagaccggggtggtcgtggatttctccaccgtgggcgcgaccctgaagatgcccagtccgaagctggatatgagcgaagtgaagggcgacttccgtttcgacctggccaagggactgagcgccccggcggtgcaggcccgggtgctgggcagcgaggtacgcgggcggatcgtcgccgaggggcgcggcgatgcgcgcacgcgcttgctgctcaacggccaggtggcggtcaagtcgctgagcgactggctcggcgctggccagcgtccgttgccggtctcgggacgcctgccgttccagctcaacctgctgctggatggcaaggacagccaattgcagatcgattcggatctcaagggcgccgtcgtcgacctgccggcgccgttcggcaagacggccgcccaggcgcggccgacccaatggcggatgaccctggatggcgccgaacggcgttactgggcgcgttacgacggcctcgccagcttggcctatgcggccccggcggacaagccgctgaacggacgcggcgccctgcgcctgggcggtgacccggcgttgctgccctcggcacaggggctgcgggtgcgcgggcgtctggcggaactggactgggacgcctggcaggccaccctgaagcgctacggcagcggcgaccaggccgccagtagcgctgcgggcctgctgcgcggcgccgacctgcgcatcgacagcttcaagggcttcggccaggagctgaagaacctgaccgtcgacctggcccgccaggagcgggcctggcaactggtgctggtcagcgacctcgcatcggggcgcctggtcctgccggatgccaggggcgcgccgatcgtggtcgatctggaccgcctgaacctgccgaagtcgacccttcccgacgagaacaaggtggaggactcggacccgctggccgccgtcgatccgcgcagcctgccggcggtagacgtgaagatcggccaggtcgccctcggcggccagccgctgggcgcctggagcctgaaggtacggccgggcagcaacggcgtggcgttcaacgacctggacctcgacctgcgtggcctgcacgtcaacggcagcctgcgttgggacggcagtccgggcaatacccgcagcacctatcagggccggatcgagggcaagaacctggcggatgtgctcaaggcctggaatttcgcgccgagtgccaccagcgaacgtttccgcatggatatcaacggccagtggccgggatcgccggcctacatggccctgaagcgcttcagcggcagcatggatgcatcgctgcgcaaggggcagttcgtcgaggtcgagggcagcgcccaggcgctgcgagtgtttggcctgctcaatttcaacgcgatcaaccgccggctgcgcctggatttctcggacatcctcggcaagggactgagctatgaccgggtgaagggggttctctccgccaccgacggcgtctacgtcacccgcgagccgctgaagctggaaggaccgtcgagcaacctggagttgaacggtaccctggacctggctcacgatcggatcgacgccaagctgctggtgaccttgccattgaccaacaacctgaccctggcggcactgatagtcggcggtccggcggtcggcggcgcggtcttcgtcgtcgacaagctgctcggcgaccgggtctcgcgcttcgccagcgtgcaatacagcgtcaagggcccctggcaggatccgaagatcagcttcgacaagccattcgagaagccccgctga

SEQ ID NO: 8019 - DNA, 1899 bp, Pseudomonas aeruginosa
atccgacgactatgctttcggtcagaagatcgtggtggcggatacgccggtcggccgcctcggcctgacggtctgctacgacctgcgttttccggagctctataccgccatgcgcgaggccggcgcggagctgatcacggcgccgtcggcgttcaccgcggtgaccggcgcggcgcactggcaggtactggtccgcgcccgcgccatcgagacccagtgctacctgctggcggccggacagggtggcgtccacccacggggccgggagacgttcggccattcggccatcgtcgatccctggggccgggtcctggccgagcggccgcagggcgaagcggtgctgctggcggtgcgcgacgccgcagaacaggcggatatccgccggcgcatgccggtggtggcgcacagacgatttttcccgccggccgaaccgcggccggcgcgtacggagtgaatatgagcgagttgttgtcatccgtcagccagcaattgctggcccccggtggtctggaactggacagcctgcccggcattcttcatgaactgaacggcccgggcatcgatgccgccgacctgtatttccagagccaggtctccgagtcgtggatgctcgaggacggcatcgtcaaggaaggcagcttcaatctcgaccagggcgtcggggtacgcgcgcagtcgggcgagaagaccggcttcgcctatagcaatgcgatcaccgccgaggcgttgaaacaggccgcggtggcggcccgttcgatttcccgtgcgggacagaacggcagcgtgcaggcgttcaaggccgtggtgccggctcgcctgtacgccggcgagaacccgctggacgtgctcagccgtgccgagaaggtcgagttgctgaagcagatcgacgccgctacccgtgcgctcgatccccgcatccagcaggtcacggtgagcatggccggcgtctgggagcagatcctggtagcggccatcgacggttcgctggccgccgacattcgtccgctggtgcgtttcaacgtcagcgtgatcgtcgaacagaacggccgacgcgaacgcggcggccacggcggcggcggtcgcaccgactatcgctatttcctccagggggatcgcgccatgggctacgcccgcgaggccctgcgccaggcactggtgaacctcgaggcgattcccgcgccggccggcaccctgccggtggtgatgggcgcgggttggtccggggtcctgctccacgaagcggtcggccacggcctggagggcgacttcaaccgcaagggcagctccgcctacagcggccgggtcggcgaaaaggtcgcctcgagcctgtgcaccatcgtcgacgacggcaccctggccgggcgtcgcggctcgctgagcgtggatgacgaaggcacgccgagcaactgcaacgtgctgatcgagaacggcgtgctcaagggctacatgcaggacaagctcaacgcccgcctgatgggcgtggcgcgcaccggtaacggccgccgcgagtcctacgcgcacctgccgatgccacgcatgaccaacacctacatgctggccggcgagagcgatccgcaggaaatcatcgcctcggtggagaagggtatctactgcgccaacctcggcggtggccaggtcgatatcaccagcggcaagttcgtgttctccaccagcgaggcctacctgatcgagaacggcaggatcaccaccccggtgaaaggcgccaccctgatcggcaacggtccggaagcgatgagccgggtgtccatggtcggcaacgacctggccctggacagtggcgtgggaacctgcgggaaggacggtcagtcggtgccggtcggcgtcggccagccgaccctgaagatcgatgcgatcaccgtcggcggcaccggcgcctga

SEQ ID NO: 8020 - DNA, 1407 bp, Pseudomonas aeruginosa
gcttcgatcacccgcaacaaggaaaccaagatgactgacacccgcatcgaacgcgacagcatgggcgaactggcggtcccggcgaccgccctctatggcgcccagacccagcgcgcggtgaacaacttcccggtcagcggccaacgcatgccccaggccttcgtccgcgccctgctgctggccaaggccgcggcggcgcgggcgaacgtctccctgcagcaactggatgcaccgatgggcgaggcgatcgccgagacctgcctgcaactgctgcaggaggacttcatgcagcatttcccggtggatgtgttccagaccggctccggcaccagttccaacatgaacgccaacgaagtggtggcgaccctggccagtcgtcgcctgggcggcaaggtcaatccgaacgaccatgtgaactgcgggcagagcagcaacgacatcattccctcgaccatccacatcagtgccgccctcgagatcagcgaacgcctgctgccggcgctgcgccacctggagcagactatccagagcaaggccggcgaagtgcatgcctatgtgaagaccggccgcacccacctgatggatgcgatgccggtacgcatgagccaggtgctcggtggctgggcgcagcaggtgcgacaggccggcgtgcacatcgagagcgtacttcctgccttgcagcagttggcacagggcggcaccgcggtgggcaccgggatcaacgcccatcctcggttcgccgaacgtttcagccaggagctgaacgacctgaccgggctggcgttccgccccggcgacgacttcttcgccctgatcggttcgcaggacaccgcggtcgctgcgtccggccagttgaagaccctggccgtgaccctgatgaagctggccaacgacctgcgctggatgaactccgggccgcttgccgggctcggcgaaatcgagctggaagcgctgcaaccaggctcctcgatcatgcccggcaaggtcaacccggtgatcccggaggccaccgcgatggtcgccgcccaggtgatcggcaatgacgccgccattgccgtcgctggccaatcgggcaacttcgaactgaacgtgatgctgccgctggtggcggacaacctgttgcacagcatccagttgctggccaacgtcagccggctgctggcggacaaggccatcgccagcttcaaggtcaaccagggcaagctcagcgaggcgttggcgcgcaacccgatcctggtcactgcgctgaacccgatcatcggctaccagaaggctgcggaaatcgccaagcaggcctatcgcgagggacggccgatcatcgatgtggcgctggaaaacaccgatctggaccgtgcgcgcctggaggtgttgctggatccggaaaaactcacggctggcggcctctga

SEQ ID NO: 8021 - DNA, 477 bp, Pseudomonas aeruginosa
ggccgccccaccactggaggtaccgccatgcgtcattggcaacgaacgatcgaacagggcaaccgctgtttcgtcaccggcgcattgatcgatgcgcgtgagcactacctccatgccctggccctggcccaggtgctgctggaacgctggggcgacgccgacgaggcggtgatggcgttcgtgatttcccatcacaacctgcccgacttgcacctgcaactggagcaaccggaggagaccgcagaatacctgtgcgcctgccacgagcgcctgttgcgggtcagcgccgaccagaagctgccgctggccctgcgccaggcggcccagcatcacagccggcgcacctatgtcgaactgctgtcgttcatcggcgaacacggtgcctatccgcgcaccgagcgcctgctcaagggaccgccgaacgcggaggtccgacccgagttcctcgctccgcccccctcacttcgctatcactga

SEQ ID NO: 8022 - DNA, 624 bp, Pseudomonas aeruginosa
cggagagtttccatgccccacgccttgccgcccttgccttacgcctacgatgccctggaaccgcacatcgatgcgctgaccatggagatccaccacagcaagcaccaccagacctatgtgaacaacctgaacgccgcgctggaaggcacgccctatgccgagcagccggtggaaaatctgctgcggcaactggctggtctgccggagaagctgcgcaccccggttgtcaacaatggcggtgggcatgccaaccactcgctgttctggaccgtgatgtcgccccagggcggtggccgtcccgatggcgacctggggcgggccatcgatgagcagctcgggggcttcgaggcgttcaaggatgcgttcaccaaggctgcgctgacccgcttcggcagcggctgggcctggctcagcgtgactccccagggcagcttgctggtggagagcagcggtaaccaggacagcccgctgatgaacggcaatacgccgatcctcggcctggacgtatgggagcacgcctattacctgaagtaccagaaccgccgcccggaatacatcggcgctttctacaacgtgatcgactggcgggaggtcgcgcgtcgctatgcgcaagccctggcctag

SEQ ID NO: 8023 - DNA, 939 bp, Pseudomonas aeruginosa
tgcgagatggctggccggcagcctggcggtgcagcgatgaaggcgttgctccatggcatcgccgaaggtaacgggcggacgctgcgcaacctgctgggcctgctgatcttcatcggcggcggctacctgctcggccgccacgcgctgttgctggccgagctcaacctgccggcgcccatcgtgctggcgttgaaaggcggcctgctctgcgccttcggtaccgctctcggggcgatgccggtgctggtggtgaagaccatgccggcgcgcctgtcggatgcgctgctgggcttcggtgccggcgtgatgctctcggcgacggccttctcgctgatcatgccggcgctatccgcggccggcgacctcggctactcgaagttcggcgcggggttcctggtcagtttcggcctggcggtcggcgtgatggggctgttcatcctcggccggctgatgccggacgtccatcccggttgcgagggcgcgccactgtccggtggcattcccccgcgcatcctgctgttcgtcacggccatcgtcctgcacaacatccccgaaggcatggcggttggcgtgtcggccggtgccggcctggacgaggccaacggcctcgccctaggcatcgctctgcaggatgtgccggaaggtctggtggtggcgctggtgctggccggagtcggtatgtcgcgtttcaaggcgatgctggtcggtgccgcgtcgggcctggtcgagccgctgttcgcggtgctctgcgcctggctggtcggcctctctgcgctgctcctgccctgggggctggccgccgcggcgggagcgatgctcttcgtggtcacccacgagatcattcccgagtcccaccgccagggacatgccgccgaggctacgctgggcctggtgttcggtttctgcctgatgatggtgctggataccgcgctgggctag

SEQ ID NO: 8024 - DNA, 360 bp, Pseudomonas aeruginosa
aggttgaggctggtggtgtccagcttcaggtcggcgaggtcggcgatcggtccgagcaattggctctcgtcgccaatcgcctccgccagcgaacgggtgtcggtagtcagcgggtggcgccggcgggtttccgagaatcgtttgagcagcgtctcgtcgtcggcgtcgagatacagcacatcgcagttgatgtggttgtcccgcacttcctgcaacagttcggggaagcgctgcaactggctgggcaggttgcgggcgtcgatcgacaccgccacctgtggctgcagtagctccgtgtgcaacagggcgcgctgcgccaggtcgggaagcaggctggcgggaaggttgtcgatgcaatag

SEQ ID NO: 8025 - DNA, 1188 bp, Pseudomonas aeruginosa
aaagaaatatttcagctcgaaaatgccgcgcggcgtatgcatgtatttctgcgtggtgacccgcgaaatggtcgattcgtgcatgcccaccgcttcggcgatgtcgtgcaggaccagcggcttcatggcttcttcgccgtagtcgaggaaaccgcgctggtgctcgacgatctgggtggcgaccttcatcagcgtttcgttgcggctctgcaggctcttgatgaaccagcgggcttcctgcaactggttgcgcatgaaggtattgtcggcgctgctgtcggcgcggcggaccatgccggcgtaggtggcgttgacgcgcaggcgtggcatcgcctcctggttcagctcgaccagccagcgctcgttgtccttgcgcacgatgacgtcggggacgatgtattcggcttcgctcgattcgatctgcgaaccgggccggggatgcaggcactggatcagctcgatgacctggcgcagttcgtcttccttgagcttcatgcgccgcatcaattggctgtagtcgcggccgccgagcaggtcgaggtagtcggataccaggcgcagcgcttcgttcagccagggcgtggtggacggcaactggcgcagttgcagcagcaggcactcgcgcaggttgcgggcgccgatgccggcgggttccagttgctggatgcggcgcagcacgacttccacttcgtcgagctcgacgtccagttccggatcgatggcggcgaggatttcttcgagggactcttcgaggtagccatcgttgttgatgctatcgatgatggtcaccgcgatcatccgatcggtgtccgacatcggtgccaggttgacctgccagagcaggtggctgtgcaggctctcgccgctgctggtgcgcgcggtgaagtcccattcgtcatcgtcgttgctgggcaggctgctggcgctggtctggtagatgtcttcccaggcggtatccaccggcaactcgctgggtatgcgttcgctccactggtcgtcgtcgaggctttcgacgctgggcgtggcgctttcctggagggggctctcctggggcgcgctggccgcctgttcggcgccatcggcgagagggtcgctgttgtcgaaatcgtcgccgtcttcctggcgttcgagcatgggattggattccagcgcttcctggatttcctgctggaggtccagggtggatag

SEQ ID NO: 8026 - DNA, 528 bp, Pseudomonas aeruginosa
gagatttcttcagaggcggaactcgtgccccaggtagacttccttgaccaggtcgttggcgaggatgctctcggcatccccctccgcgatcaactgcccatcattgacgatatacgccgtttcacagatgtccagggtctcgcggacgttgtggtcggtgatgaggatgccgatacccttcgccttgaggtgatggatgatctgcttgatgtcgccgaccgagatcgggtccacgccggcgaagggctcgtcgaggaggatgaatttcggcgcgctggccagggcgcgggcgatttccacccggcgtcgttcgccgccggacaggctcatgccgaggttgtcgcggatgtggtggatgtggaattcctgcagcaggctttccagggcttccttgcgaccgttgcgatcgaggtcgctgcgggtctcgaggatcgccatgatgttgtcggataccgacagcttgcggaagatcgaggcttcctgcggcaggtagccgatgccggcccgggcgcgcccgtgcatcggtag

SEQ ID NO: 8027 - DNA, 945 bp, Pseudomonas aeruginosa
acggcatggtgccaggccttgggccagaacccgccgcagtgctatagtccgcgcccattcgacccctcccggatgcgtgcctttgcaacggggcaaggcgtccagcatggacgggtcgcatcgcaaggagtcctgatgagcaccgatagtgcctacgcggtcgagttgaagggcctgaccttcaagcgcggatcgcgggcgattttcgacaacatcgatgtgcgtatcccgcgcggaaaggtgaccggcatcatgggcccgtccggttgcggcaagaccacgttgctgcggctgatcgcctcccagttgcgtccttcgaagggggaggtctgggtcaacgggcagaacctgccgcagctttcgcgcggcgacctgttcgacatgcgcaagcagttcggcgtgctgttccagagcggggcgctgttcaccgatctcgacgtcttcgagaacgtcgcgtttccgctgcgcgtgcatacccagctgccggaagaaatgatccgcgacatcgtcctgatgaagcttcaggccgtcggcctgcgcggcgccgtggaactgatgccggacgagctttccggcggcatgaagcgccgcgtcgccctggcccgggcgatcgccctggacccgcagatcctgctctacgacgagccgttcgtggggcaggatccgatcgccatgggcgtcctggtgcgcctgatccgcctgctcaacgatgccctcggcatcaccagcatcgtggtttcccatgacctggccgagaccgccagcatcgccgactacatctatatcgtcggcgacggccgggtacttggccacgggacgccggacgtcctcaaggaaaccgacgatcctcgtatccgccagttcgtcaagggaatcccggatggtcccgttccgttccattatccggcccgcgactaccgggccgacctgctgggagagcgctga

SEQ ID NO: 8028 - DNA, 360 bp, Pseudomonas aeruginosa
ggtggtcgccaaggccaaggaaaccgcgaaagcggaagaggccggggcgaaatgagccaggccagcctgcgcgaaggcgcggccggcgaactgcagctcgccggcgtgctcgactacagcagcgggccggcgttgcgcgagcagggcggtcggctgatccgcgccagccaggcggcggaactggttgtcgactgctcggcggtggagcgctccagcagcgtgggcatttccctgttgctggccttcatgcgcgacgcacgcaaggccggcaaggtcctgagcgtcagggcgttgccggacgacatgcgggagattgccaaggtcagcagccttctggagatcctgcctttgcaggaatga

SEQ ID NO: 8029 - DNA, 1659 bp, Pseudomonas aeruginosa
actggtgaagaccatgcgtgcctcgatcctggtgctgggcccgatgctggcgcgcttcggcgaggccgaagtggccctgccgggcggttgcgcgatcggttcgcgtccggtcgacctgcatatccgcggtctcgaggccatgggcgcgcagatcgaggtcgaaggcggctacatcaaggccaaggcgcccgccggcggcctgcgtggcggtcacttcttcttcgataccgtcagcgtgaccggcaccgagaacctgatgatggccgccgcgctggccaacggccgcaccgtgctgcagaacgccgctcgcgagccggaggtggtcgacctggccaactgcctgaacgccatgggcgccaacgtccaaggcgctggctccgataccatcgtcatcgaaggcgtgaagcgcctcggcggcgctcgctacgacgtactgcccgaccgtatcgagaccggcacctacctggtggccgcggccgcgaccggcggccgggtgaagttgaaggataccgatccgaccatcctcgaggcggtcctgcagaagctggaagaggccggtgcccacatcagcaccggcagcaactggatcgagctggacatgaagggcaaccggccgaaggcggtcaacgtgcgtaccgcgccgtacccggcgttccccaccgacatgcaggcccagttcatctccatgaacgcggttgccgaaggcaccggcgcggtcatcgagacggtcttcgagaaccgcttcatgcatgtttacgaaatgaaccgcatgggtgcgcagatcctcgtcgaaggcaacaccgccatcgtcaccggcgtacccaagctcaagggcgctccggtcatggcgaccgacctgcgcgcatccgcgagcctggtgatcgccggcctggtggccgagggcgacaccctgatcgatcgcatctaccacatcgaccgtggctacgagtgcatcgaagagaaactccagctgctcggcgccaagatccgccgcgtaccgggctagcggaggctgtcgcgcaaatgctgaccatcgccttgtccaagggccggattctcgacgataccctgccgctgctcgcagcggcgggcatcgtaccgtcggagaacccggacaagagccgcaagctgatcatcccgacgtccctgcccgatgtgcgcctgctcatcgtgcgcgccaccgacgtgccgacctatgtcgagcatggcgccgccgatctcggcgtggccggcaaggacgtgctgatggagtacggcggccagggactctacgaaccgctggacctgcgtatcgccaactgcaagctgatgaccgccggcgccattggcgcgcctgaacccaagggacgcctgcgggtggccaccaagttcgtcaatgtcgccaagcgctactacgccgagcagggccgccaggtcgacgtgatcaagctgtacggctcgatggagctggcgcccctggtcggtctcgccgacaagatcatcgacgtcgtggataccggcaataccctgcgcgccaacggcctggagccccaggaactgatcgccacgatcagctcgcgcctggtggtcaacaaggcctcgatgaagatgcagcacggtcgcatccagtcgctgatcgataccctgcgcgacgccgtcgaggcgcgacaccgtcactga

SEQ ID NO: 8030 - DNA, 297 bp, Pseudomonas aeruginosa
acgccggcgacgacgatcccggcggtttcgccgaggcccagcgactccgccagttccggggtcagcgccttgacctcgacgccgagccagccgcggatcacctggccgtgctcgatgatcgactgcatgacctccagggccagcttggtcgggatggcgaagccgataccctgggagccgccggacttggagaagatcgccgtgttgatgccgatcaggttgccggcagcgtccaccagcgcgccgccggagttgccggggttgatcgccgcgtcggtctggatgaagttttcgtag

SEQ ID NO: 8031 - DNA, 285 bp, Pseudomonas aeruginosa
gtgttcaggccgagctggttgcgtccggtggcgctgatgatgcccatggtcacggtctggccgacgccgaacgggttgccgatggcgaggcagacgtcgccggtgcgaatgccgtcggagcggccgagggtcatcgccggcaggttcttaaggtcgatcttcagcacggccaggtcggtttccgggtcgctgccgaccaaatgggcgatggtttcgcggccgtcgcgcaaggccacgatgatctggtcggcgccagcggtcacgtggttgttggtcagcaggtag

SEQ ID NO: 8032 - DNA, 924 bp, Pseudomonas aeruginosa
gtagccatggtcgacaaactgacgcacctgaaacagctggaggcggaaagcatccacatcatccgcgaggtggccgccgagttcgataacccggtgatgctgtactcgatcggcaaggattccgcggtcatgctgcacctggcccgcaaggccttcttccccggcaagctgcccttcccggtgatgcacgtggacacccgctggaaattccaggagatgtacaggttccgcgatcggatggtcgaggaaatgggcctggacctgatcacccacgtcaacccggacggcgtcgcccagggcatcaacccgttcacccacggcagcgccaagcacaccgacgtgatgaagaccgagggactcaagcaggccctggacaagtacggtttcgacgctgccttcggcggcgcgcgccgcgacgaggagaagtcgcgggccaaggaacgggtctattcgttccgcgacagcaagcaccgctgggacccgaagaaccagcgtcccgagttgtggaacatctacaacggcaaggtgaagaagggcgagtcgatccgcgtattcccgctgtccaactggaccgagctggacatctggcaatacatctacctggaaggcatcccgatcgtcccgctgtacttcgccgccgagcgcgaggttatcgagaagaacggcacgctgatcatgatcgacgacgagcgcatcctcgagcatctctctgacgaagagaaagcccgcatcgagaagcgcatggtgcgcttccgtaccctcggctgctacccgctcaccggcgcggtcgagtccagcgccaccacgctgccggaaatcatccaggaaatgctcctgacgcgtacttccgaacgccagggtcgggtcatcgaccatgaccaggccggttcgatggaagaaaagaaacgtcagggctatttctga

SEQ ID NO: 8033 - DNA, 738 bp, Pseudomonas aeruginosa
acgagtcgacccgagccggggtcacggagttcctgtttgtctacccgcgaaatccctgtatccatcgatggcccctgcgggccgctggaagccctgcacctcgatctgcccgatgcccgcggcatcgccctggtctgccatccgcacccgctgttcgccggcaccatgcagaacaaggtggtcgccactctgcaacgcagcgcccgcgatgccggcctggcgaccctgcgtttcaacttccgtggcgttggccagagcgctggcagctatggcgaggggatcggcgagatcgacgacgccgaggccgccgcgcgctggttgctggcacgccatccggggttgccgctgacactgatgggcttttccttcggctcctgcgtcgccggcaatctggcgggtcgcctggaagcgcagggcgtcgggctggcgcggctgttcatgatcgcgccgccggtggaacgcttcgcggtcagcctgcctgcgcgttgcccgctgaccgtggtgcagccggaggacgacgacgtggtcacgccggccgcggtatatgcctggagcgagtccctggcacgaccgcacgagctgttgcgggtggcagaaagcggacatttcttgccatggcaagctgatcgatctgaaggacctgctgctgccacgcatgcaggactgacgtcgtcgcgccggccctgctaccatccggcgcgccattcttttctttgcctgacatctggtatcgcatga

SEQ ID NO: 8034 - DNA, 327 bp, Pseudomonas aeruginosa
ttgaggaaaacgtcgccaccctgccgggcctggacgggcgcaagatgtccaagagctacgacaacaccatcccgctgttcaacccgtccaggcagctcaaggacgccatcgcacgcatcgtcaccgactcgcgcgcgccgggcgagccgaaagacccggacagttcgcacctgttccttctttactcggccttcgccagcgccgaacaggtcgccgcgttccgccaggaactgctcgacggcctggcctggggcgaagccaagcagcgactgttccagttgctcgacaacgaactgggcgaggctcgcgagcgttaccaggcgctga

SEQ ID NO: 8035 - DNA, 1131 bp, Pseudomonas aeruginosa
agtgacggccccgttttcgttgcattgctaccgatcatgacgcccctcgagcgctaccaggccgatctccaacgccccgatttcttccacgatgccgcacaggcgaatgccgtgaagcatctgcaacgcctctacgatgacctggtcgccgccgaccacgccaagcccggcctgttcggcaagctgctcggcaggaagtccggcgggccggtgaagggcctgtatttctggggcggcgtcggccgtggcaagacctacctggtggacactttcttcgagtcgctgccgttcgagcagaaggtgcgcacgcacttccaccgcttcatgaagcgggtgcacgaagaactgaagaccctcaagggcgagaagaacccgctgaccatcatcggcaagcgcttcgccgacgaggcgcgggtgatctgtttcgacgagttcttcgtctccgacatcaccgacgcgatgatcctcgccaccctgctggaagagctgttcaagaacggcgtgagcctggtggcgacctccaacatcgtgccggacggcctgtacaaggacggcctgcaacgcgcccgtttcctgccggcgatcgccctgctcaaggagcataccgagatcgtcaacgtcgatagcggcgtcgactatcgcctgcgcgcgctggagcaggccgagctgttccactggccgctcagcgaacaggtcgaggaggagatggcgcgcagcttcaaggccctgaccccggactgtgccaaggcccagcgcgacgaggcgctgatgatcgagaaccgcgagatccgcgcgcgcctgacctgcgacgacgtggcctggttcgaattccgtgagctgtgcgacggcccgcgcagccagaacgactacatcgagctggcgaagattttccacgccgtgctgatctccaacgtcgagcagatgggcgtcaccaaggacgacatggcgcggcgtttcatcaacctggtggatgagttctacgaccgcagcgtcaagctgatcatctccgccgaggtcgagctaaaggatctctacagcggcggccggctggagttcgaattccagcgcaccctcagtcgtctgctggaaatgcagtcccacgaatacctgacgcgtccgcaccggccctga

SEQ ID NO: 8036 - DNA, 1488 bp, Pseudomonas aeruginosa
gtaagggaaagcggtcaaaaggcggctggatcgtcttattttttggcgcaactgtccagtgcgtcggtcggggcatttccctacagtcgaagacctgccgcgtgcagccaacccgatcccagactgtttccaggtgaccacgatgataccgagaaccctgttcagctccgaccacgaactgtttcgcgacagcgtgcgcaagttcctcgaacaggaagccgtgcctttccatcaccaatgggaaaaggatgggcatgtcgaccgcgcgctctggaacaaggccggcgaggccggaatgctctgttcgcacctgccggaagagtatggcgggatgggcgcggacttcctctacagcgccgtggtcatcgaagagatcggtcgggccggcctgaccgggatcggtttctccctgcattcggacatcgctgcaccctacatcctccactacggcagcgaggcgctgaagcgcaagtacctgccgaagctggtatccggcgagatggtcgcggccatcgccatgaccgagccgggggccggttccgacctgcaaggggtgaagaccactgcggtactggatggcgacgagtacgtcatcaatggctcgaagaccttcatcaccaacggcttcctcgccgacctggtgatcgtggtggcgaagaccgatccgaaggctggcgccaagggcataagcctgttcgtggtcgaggcgggtacgccgggcttcagcaagggcaagcgcctggagaaggtcgggatgaaggcccaggacacctccgagctgttcttccaggatgtgcggattccccgggagaacctgctcggcaaggacggccagggattcatctacctgatgcaggagctgccgcaggagcgcctgaccgtcggtatcggcgcgctggcgtcggccgaggcggccctgcaatggacgctcgactacactcgcgagcgcaaggcgttcggcaagtcggtggcggacttccagaatacccgcttcaagcttgccgagatggctaccgagatccaggtcggccgggtcttcgtcgatcgctgtatggagcagcatctccagggcaagctggacgtacccaccgccgccatgtgcaagtactggacgacggacctgcaatgcaaggtgctcgacgaatgcgtgcagttgcacggcggctacggcttcatgtgggaatatccggtggcgcgggcctgggccgatgcccgggtgcagcggatctacgccggtaccaacgagatcatgaaggagatcatcgcgcgggccctgtgaggcgcgcctggtcaccgggaggggcggacgaccgcatcgcgcggttgtccgccgaacccgcggcagcgccaggcccctggaggctcagggagccgggttcggttgctcccggtggattgcatcgataccggcgagcaattcctcgtccagcctcaggtcgacgctgccgagattggtttccagctgttccagcgaggtggcgccgatga

SEQ ID NO: 8037 - DNA, 1113 bp, Pseudomonas aeruginosa
ccggcgcggcgctggcgatgctgctctggccgttgctggcgcggtgcgccggggcgctgttccggcgtggccggcggagtctccggcatgccgcctgagcctgcgtctggcggcggggtggatttcttgtcaccctgggtctccccgccgccagcgagatacgccatgtcccggattcccgacgccagcatcatccacagccgcctgcgcctgcgccagttgcgcctgatgctggccctggaggaactcggctcgctgcgccgcgccgccgacgagattggcatgacccagccggcggcgaccaagatgctccacgaggccgaagacctgctcggcgtcgagttgttcgagcgtttgccgcgcggcatgcgcgcgacgcctttcggcgagacgctgatctattactcgcggatgatcttcgccgagctgtccgggatgcgcgaggaactggtcgcgctggaatccggcaatctcggccgggtcaccgtcggagcgatcccggcgctggcctcgagcctgctgacgcgcaccatcgccaccctgaagcagagtcatccacggctgtcgatgagcatccaggtggacaccagcgacgtgctggtccaggccctgcaacaggaccagctggacgtggtgctcggacgcatccccagcggcgcgcgcaccgacgacctggtgttcgacagcctcggcgaggaagaactctgcgtggtggtcggcgcgcagaacccgttgtcgcaggcacgcaagctggactggggcgagttgcaggagctgacctgggtgttgcagcagcaccccagcccgatgcgcgggatcgtcaaccaggccttccacaatgcgcgcatcgacctgccgagcagtatcgtcgagaccacctcgatcatgaccctgctctccctgctgcaacagaccgacatgatcggcatcactccacgctcggtgatcgaggactacccgggcaagcacctgctggcgatcctgccgatccagctggagccgcgcctgccgccctacggcctgatcacccgacgcaaccgggtccactcctcggccatgcagaccttcatggccagcgtacatgccgaacaggcgcggcacctggcgaagtga

SEQ ID NO: 8038 - DNA, 255 bp, Pseudomonas aeruginosa
ccgcgagccggctggacctctaacatcctgcggcatttcaacggagtgaatgccatgccctcgatcaagcccttcggtctcgccctgctcgtcctcggtctcagcgcctgcgcctccctcggtcagtcggggaatcgcgacaacgaggtcaaggtcgccgcgcagaagctcatcggccagcccgccggcaaggccttcgaactgttcggggggtcatgccgagataaggggaaaattcattcatttggaatgtaa

SEQ ID NO: 8039 - DNA, 384 bp, Pseudomonas aeruginosa
ggccgcggccgaggaggcaatatgatcgagattgcgtcagcgtcttttcgagtcacaccctacggtgaggtggacatcgcagcactggacagaatgcgagccggattcgatacatcccaacttctacggctagttgaaggtctggatgcatgcctctcggaaatgggtggtatcaccgccttgcgtgacgaactgctgaaattgcacgcaatggcactgactatcgtcgaggggactgccccggctgcacccaccgagaacgcgtgtatctgggctgaagcagaatctgtgcagttgggcctagaagcgctggcgacgtggattcgctccgctcagggcttcctaactcccttgaccagtcttgagcctgagcatcagcagtag

SEQ ID NO: 8040 - DNA, 471 bp, Pseudomonas aeruginosa
gaatcccagcatcgacgcaatacgggtcgagctgggcaataccggctcgaaaaccaccatccatcgctacctgaaagaactcgaagacgccgaccgcggccggaacgcggccgcattgccgctcagcgagcagctggccaacctggtggcccagttggcggatcagctcaaggaggaagcgcaggccgacgtggcccaggagcgcgagcaactggcacgggaacgactcgattaccagaaccagattcggcaggccgaaagccgtatccagcagctggaaggtcagtgcgctgggctcacggagcagttccaggctgcccagcaagcactgctgcaggaacaacagctgcgccaacaggccgaggtcgagaatgcccgcctgcagcaagccaaccacgaccaggaagcgcgcctgcaagaccgcgacgggcagattcgctcgctggaggacaagcatcagcatgcccgtga

SEQ ID NO: 8041 - DNA, 267 bp, Pseudomonas aeruginosa
ctcatgatccagcacactgaggtcagaagcggagtggaggttcagatgacgctaccctacgaacgtacccgctcggtggtgcaggcccaggagtttctcgtcgagctctctcgtgacaccaccttgtcggagtccatccgcaatgaggctcggcggctgctgtgtcactacccgagcaagggcgacatgctgcaggccggccggaatgaggagcaagcggcgggttcgattttcgagcctgtcttcagctcttcgattgaagactga

SEQ ID NO: 8042 - DNA, 1008 bp, Pseudomonas aeruginosa
atcgattcattcttttctcccgacccttggcccctgccaaactcccttcgccacgggatacccccgcgccgacatggcggcattcccatccggaatgtccgccccacattgcaaggccctgatcgtcgatcgcggccgacaaggagctggaactttcatgaagaaactccccgccatcaccgccctcgccctcgccctgatctccggcctggcccaggccgaccgcctggaggacatccgcaaggccggcgtattgcgcgtcgcgtccttcgacagcaacccgccgttcggcttcgtcgacgccaagagcaagcagatcgaaggcctcgacgtcgactatgccaaggccctggccgacaagctgggcgtccggctgcaagtgctgccgaccaacccggccaaccgcatcccgctgctgacggcgaacaaggtcgacctggtcctggccaacttcaccatcaccccggagcgtgcgcagcaggtggacttcagcatcccctacttctcctccggccagcagttcatcgtcaagaaaggcaccctgacctcgccggaagtcctcaacaagtggcgggtcggcgtggacaagggcacggtcaacgaaggcgtgctgcgcgagaagttccccggagccaaggtcatcgcctacgacgacacgcccttcgctttcaccgccctgcgcaacggccaggtccaggccatcacccaggacggtccgaagctgatcggcctgctggccaacgtgcccgaccgcgacaagtacgaagtgccgcccttcaccatttccaacgacctgatcggcgtcggtattcccaagggcgagaagtccctgaccgagttcgtcgacaagagcctgcgcgagctggagcaggacggccaggcgcagaagatctacgacacctggttcggtccgcagaccaagaccccgctggcgcgcctgtacaagatcggcgacaagagctgagcggcccgcttcgcccgcacgacccgcgcgcctcacttcgctga

SEQ ID NO: 8043 - DNA, 753 bp, Pseudomonas aeruginosa
ggcgcgtttttcgttctacccgacggaatcccgcacatgttcggcgaacttctcgccccgcagtacctgcgctggttgctcgacggcttcctgctgaccctcggtcttgccctgctcagttgcctgctcgccaccctgatcggcgcccccctggccatcgcccggctgtcgcgccggcgcctgctgtcctggccggcgcgcgcctacctggcgctgttccgcaataccccgctgctggtgcagctgttcttctggtacttcggcgttcccgcgctgctgccggaggcgctggtgagctggctgaacacgccgcacgagacgcccttgctcgactggccgtccttcgagttcctcgccggtgcctgggggctgaccctctatacctcggctttcgtcgccgaggagttccgcgccggcatcgcctcggtacgccccgagcagcgcgccgccggcctcgccctggggctgacccagcgccaggtatggcgcgtggtggtgctgccgcaggccctgcgcacggctctgccgccgctgctcgggcagtacatgaatgcgctgaagaactcctcgctggcgatggccatcggcctggccgagctgtcctacgcttcgcgccaggtggaaaccgagaccttcaagaccttccaggccttcggtatcgccacccttctctacatcggcgccatcgccctgatcgaagctttcggccaggcgttgcagcagacccgccgctaccgccagggaggtgcctga

SEQ ID NO: 8044 - DNA, 1089 bp, Pseudomonas aeruginosa
  unsure (44),(722): Identity of nucleotide at the above locations are unknown.
gatggatttctcggtcatctcggacaacctgtcatacctgctgntcggcgcatacccggacggcccgctcggcggagcggcgctgaccctgctgctggcgtcgctctccggactggcttcggcggtgctcggcctggtcctcggcgtggccctcgcggtgctgcccggcaagccgcgcctgctgctggtggcgctgctcggcttcttccgcgcgatcccggtgctgatgctgatcttctggacctacttcctgctgccgatcgtcttccatgtcgacgtaccggcgctggccaccgtggtctgcgcgctgtcgctgatcggcggcgcctacctcgcccactcggtgtacgccggcatccacagcctccccgccgggcagtgggcggccgcccgcgcgctcggactgcggccgtggcaggtattgcgcctggtgatcctgccgcaggcgctgccggtgatgctgccatccttcctcaaccagtgggtgtcgctgatcaaggacacttccctggcctacgtgatcggcgtcggcgagctgtccttcgtcgccacccaggtgagcaaccgggtgatggtccacccgacggagatcttcctgttcgtcgccctgctctacttcctgctctgcaccagcctcgacctggccgccgcgttcctcgcccgccgccggcgggcctgagcggcggccggtggctcaggcgtcgccgcgcgcccgcgcgtantcgaccaggtcgccgaggtaatgcggcgaggcgcgcaggacgccatcgtcccagccgtagagcacgcccagcgccgacacctccatggcccaccagccccaggcgtaggggccggtcaggcggcgggtcttcttctgcgccttgggggaaagctggaaaaactcccggtactggctttgcaggtaaggcgccagcgcctgggcgtcgctgccgtccgcctcttcgaagaacgcccgcaactgcccgaacggccttggatggaaggtttcctcgctggcggaagtcaggccgagggcggccgcgccgagatagtcgagcaggcggtcggtatcgaactgcaggacctcctcgaccagcgccgggatga

SEQ ID NO: 8045 - DNA, 666 bp, Pseudomonas aeruginosa
acaggcgcatcgaaaagcgtcgaggacatgagctccatgaaccggccgggctcgacgcccaggcgcttcaccagggcgacgctttcgcccatgctttcgatggcgctggcgatcatgaagttaccagagatcttcaccgccattgccccgcgcgggtcttttccgaaaaaccatgtcttctgtcccataatttccagcagcgccttgacttgctcgatggcttcctccggaccgccgacgacgatgttcagcttgccggcctccgccacgtcggtgcggccgaacaccggcgcggcgacgaacgcgaggccctggcgctggtgcgcctggtcgagcgcctcgacgcaatcgagcgacagggtcgacatgctcaggtggatgagacccggcctcgcccgttcgagcgcgccgctgtcgagcagcacgccgcgaatcgcctggtcgtccgccagcatgctgatgaccacgtcgaggccgaacaggtcgccgacctcctccgccctggcagcgcccagcgccaccaggggctcgcaggccgccgcggaacggttccacaccgtcacttcgagtcccgcctgcaccaggcgggtggccatggcggcgcccatgccgcccaggcccagaaatccgactttcatccgtttcactcctcatggggtcttgtag

SEQ ID NO: 8046 - DNA, 1434 bp, Pseudomonas aeruginosa
gttccggatctaccggagacaggctggccgctggcagttcctcgaggaggaacacctggcggtccgccaggagatcggcgacggcatcggccatcgccctgtagtgcggcatccgtcggtgccgctcgatggcgtcgcggtcggcccagcgctcgacgaagacgaagcgcccggcctcgtcgaggctccggtgcaggacataggacaggcagccgtcctcggcccgcgacggctgcacgcaggccagcagcagccgctcgacctccgccgccctgccctcgcgcgcctgcaacagcgctaccacacggaccgcctggttcatgcgtcggctccgacgcgcaccaccagcttgccgaaattgcgtccctggagcaggccgaagaaggcctcgggggcattctccaggccgtcgacccgctcttcgcggtactggatgaggccgtcggcgaaccacttcgacatgtcgcgctggaattcatcgtagcgatggccgtagtcgtcgaagatgatgaagccctgcaccttgatgcgcttgcgcaggatcgtgcccatcagcgccggcaagcggtccggcccgggtggcagctcggtgtcgttgtagtgggcgacgatgccgcagaccgggatccgggccttggcgttgagcagcgggaagacggcgtcgaagaccttgccgccgacgttctcgtaatagatgtcgatgccgtccgggcaggcctcggccagtcgttcggcgaagtccgcggcatggtggtcgaggcaggcatcgaagccgagcacctgcacggcgtggcggcatttttccgcaccgccggcgacgccgaccactcggcagcccttgagcttgccgatctgtccgacggtggcgccgaccggcccggtggcggcggccaccaccagggtctcgccggcctggggcttgccgatgtcgagcaggcccatgtaggcggtgaagccgggcatgccgagcaggcccagggcgtaggacggatgctccggcgactcgcccaggcgcgccaggccgctgccgtcggaaagcgcgtagtcctgccagccgttggccgagagtacccagtcgccgaccttgaacccgggatggttcgaggcttccacccggctgaccgtgccgccgaccatgaccgcgccgagctccaccggcggcgcgtaggacggcgcgtcgctcatccgtccgcgcatgtagggatcgagcgacaggtagacggtgcgcagcagcacctggcccgcgccgggctcaggaagcggaacctgctcgatgcggaagttatcccgggtcggggcgccgtgggggcgcgaggcgaggacgatgcggcggttgacctgcgtggattgggacatttccagactcctctgtctgacgaatgtggcgaacggctcataccgtgcgccgggcaaattagaccagtcaactactga

SEQ ID NO: 8047 - DNA, 2055 bp, Pseudomonas aeruginosa
agtccatcccgtggcgttcgatcagttctcggtgcagttccgggtacagcgcgttggattgcagggcgaggtcgaagaacgccggcggcaggatgtgcggcgtgctcgcgtccaccgccaccgccgcgccctgggcctcgcgccggttgcgggaggacatcatgcggaagaagatcaccccgcagcccagtcccaccgattcgccgatggcccagaggccgccggccgaggcgcgggtggcgttgcccgggcgcttgtcgtcgaccacggcgatgcgcaggttgccgcgcctggacagttggtaggcgcaggacgcgccgatcacgccgccgccggcaatcacgatgtcataggttctgttcatgttcaggcttccgtaccgaggttctggaatgcggaaaacgggatcggatcgatcgggaaacgcggccgcagccagccgacgtcgtggcgtccggtggcgcggcgcaggcgatcgctgcagtagccgatgcacatccgcccctggcagtcgcccatgccggcgcgggtgcgcatcttcagcccggcgatgtcctgcacgccctgttcgagcgcgcgctcgatgtcgccacgggtgacctgttcgcagcggcagatcaccgtatcggcccgcgccagttcgacctggcgggcgccgcgctgggtgtagcgctcgactccggcgcggaagcgcttgatcgcctccaggcgggcgagatgggattctcggcgttcgatggcctcggcgggcgcgatggcctcgcgttgcaggaggatcgacaaggccgcgatgcgcccgccgatcatcgccgcctcgccgccgcggatacccgccatgtcgccggccaggtggatgtgcggttggctgctctgctgccagacgttgcattccgcgcgcaggtatccgtcgtcgctgaagccgtgctccagacccaactgctggctgagctgggtgcgcgggatgaagccatagccgaccgccagggtgctggccttcaccggtcgcgcgttttccaggtcgggccgccactcttcgtcgtagggcgctaccgtcacttccgtcagttccccctcgccgctggcctccaccacgccccagccatagtgcagcggaatgccgttgagcttgagatagccgagcatgctcaggccgtcgaggaacagttgcggcttgttcagcagcgccaggctttccctggccatgcggccgaacgcgcaggcctcgtagaccccggcgacacgtaccccggccgcatgcagctggcaggccaccagtggcagcagcgggccgctgccggcgatcagggtatcgcccaggggcttcaccacgccgctcttgatctgcaattgcaggccgccgaggagcatcaccccgggcagggtccagccggggaacggcacgctgcgctcatggcagccggtggccaggagcaggtgcgaatactccacctcgtgcagccgttccgcctcgtcgaggaccatcaggcgctggccgtcgccaccgaccacgcggctgttcaggcgcaggtcgatgtgcccggcgcaggcggagaaatcgcgccgcagtttttccagcatccgggtgtagcgcgcgccgaggtaggccggatcgacgccggcccgcaaggggccgcgatagaccaccccgccgggacgcgaggcctcgtcgaagaggacgcaggggaccccgcgcctggccagctcgatggctgcggccatgccggccgagccgccgccgacgatcaccgggcgcaggttcatggccgttcctcctggtcgaagcggttgctttcggtttccacccgcatgcccggccggacgacggtctggcaggcgcggcgcttgggccggccgtcgatggcgaccaggcagcagtggcatacgcccatgccgcagaaggcgccgctggcctggccatggtcgttgcgcgcgagccggcgcaggcccacggcattgagcacgttgagcacggtctcaccggcagccgccgcgacgggctggccattgaggtggatggtcatgtctgcccgcgagaggggctggatatcgtgttga

SEQ ID NO: 8048 - DNA, 2649 bp, Pseudomonas aeruginosa
cgttcaagaaggtgcattgccctttcatccgtgagagagatagtcgggagccggcgacactatgagtcgggccgggcgcggacattgatccatgacaggtgggtatcttcccctgccaattctggtaggtggggtgcaggcgttcgccccggaaaagtcgaacccgcgcctaccccagggtgccaagcagcaaagccggctcacccgtgggaggccccatgctgcaatccttccagccgccctggtggaaaccccccggtgatctaccagggtctacccgcgttcgttcacccgacagcgacggcgacctgcccggcctggtcgcgcgcctggaccacctgcgccgccttggcggcgacgccctctggccgtcaccggtgtatcgctcgcccgaccccggcgctgccgccgcagatcgccaccacccgtcgttccgtcatgtccgactcagtgcgcgcgggccacgccgcgcaagaggttggcgctgagcttgtcggcgttgcaggtcgcgatgttggccagcgagacgatgcctaccaggcgcttgttgcgatccattaccggcaagcggcgcttctccagttgcgccatgttcttcgccacatggtccacttcctcgtcctcgaagcagtagcgcagttcaccgctcatcacctcgcgcaccgggcggtcggctccgagtccatcggcgatgccgcgcaccgccaggtcgcggtcggtgaccacgccggtcaggcgctcgccctcgttgaccagcaaggcgccgatatcggcttggcgcatctgctgcgccgcctcgccgagggtggtctggggggtgacggtacgtacttcgcgactcatgatttcccggactttcatcgttctgtctctttcttccggcgcgccgttttcggcgcggctctccctgcttgtgaatcgcccgcatacggggagttcgaagtttcttcccggcgtcgcagccatttacctagcgctcgcgcgggcagcgtgcggaaaacaaaaaatttgcccgcgttttctgatatctcgccgctgcccggattcttattctcgactccttctttggcatatgcgggaaaacgaaccatgcgtatcgacggtcatcgtcaggtggtttctaacgcaacggcacagcccggaccgctactgcgccctgcggatatgcaggcacgggctctacaggacctgttcgatgcgcagggggtgggggttcccgtcgaacatgccttgcgcatgcaggcggtggccaggcagacgaataccgtctttggcattcgcccggttgaaagaatcgtcaccacgctgatcgaagagggtttcccgaccaagggcttctcggtgaaggggaaaagctcgaactggggtccgcaggcggggttcatctgtgtcgaccagcatctcagcaagcgggaagaccgcgacacggcggaaatacgcaagctgaacctggctgtggcgaagggaatggatggcggagcctatacccagaccgacctgcggatctctcggcaacgccttgcggagctggtgcggaatttcggcctggtggcagacggtgtcgggccggttcgcctcctgaccgcgcagggccccagcggcaaacgctatgagttcgaggcccgccaggagccggacggtctctacaggatcagccgcctggggcggtcggaagcggtgcaggtactggccagcccggcttgcgggctggcgatgaccgccgattatgacctcttcctggtagcgccctcgatcgaggcgcatggcagtggtggtctcgatgcaagaagggataccgcggtcagatacacccccctcggtgcaaaggatcccctgagcgaggacggattctatggcaggggagggatatggccaggggaaacatcactccgcgcacgcggcaactggtggacgccctcaatgactgcctgggccggggggagcacagggagatgtttcaccacagcgacgatgcgggcaacccaggctcccatatgggtgacaacttcccggccaccttctaccttccccgggccatggagcatcgggtcggagaagagtccgttcgcttcgacgaggtctgcgtggtggcggatcggaagagcttttccttgctggtcgagtgcatcaagggcaacggctatcacttcaccgcccatcccgactggaacgtgccgctgcggcccagcttccaggaggcgctcgactttttccaacgtaaggtctgatgtgcgaaggtcgttggcaaggcccgctttccccggcggcatgggcatcctgccgcctgttcgaacgggactttccgaagccccggaccggctctcttcggccgatgtgaaaacggcgcatcccgttggggatgcgccgtacgcttcagcggttcggcacggtcaggacgagcgtccgccgccgtggctgtgctggccacccttgcgtcctgcctcggaggccttttcccgatcgttggcgaagttcccgccgctctgctggccgcccttgcggcccgcctcggcggctctttccgggtcattggcgaaattgcctccgctctgctggccacccttgcgcccggcttcggcggcgcgctgcgggtcattggcgaagttgccgccgctggcctggccacccttgtggccgatctcctggtag

SEQ ID NO: 8049 - DNA, 1641 bp, Pseudomonas aeruginosa
aactccttgccgtggctcctggaggtagctgcgccgcctttctgcccggcttcgctggtgctcatgccttgtcgtttgtcggtcatgctcgtgtcctcctctcgagggttgaaagggatgcggcgtttttcgccgcgtgcacttactccgaaggcttgcgcgatggatcgttcaaactctttgcgggcgccctgggacgaaaaaatcattagccgatccaaggccttccgcttgccggaatatgctgggcggcgcgggaaactaagaatggatactccactggcaggcggcagcgggtataggcgaatcgtccaccgtatggatcagtccgcaagccagggcgtcttccggaccaaggatgcgcggataggccatcaggtatcgcgggatgtccaggcgttccggcgcatcacgggtgttctcggcgacaatccgggcgtaaagctccaggtcgtagtcgaggctcatcgcatattccgccatccgcgcatggtccaccgcgccatgcagggtccagtggaaaggatggaacaggaacttgctgtgggcactggcgctgcgtcgctcgccggcgaggaacaggatgttgcccatcgactcgactgtacccaggttgtgggtatgtatcggcaccggcagcgcgcgcaggaagttgtacagggtaaagccgtagctgcattccccgcccatggtggcgatgttgatccgcaacccctcggcctcctgtggcaggaccttggcgcaagtgttgatcaaattgccgcaggtggacgaattgatcggcccggtgaaatggatgatgtgctgcttggacatgctcgcctctctttccgtatcggttcctcgacggtctgcaatgctttccctacagaggattgccgtacgtccgccgtgagccatcgtcgcgacgaatggcacccagggagcgagggcctgcgttcctcgccggcctccacgactcaacgtggtgcagtggcctccgggggccggtatcgagcgccacccatcccgccgaatgaactccggtgctgctgcgcacgccccacctgcacgacccacagccaggagcaatgccatgcgcgccctcaccttccacggcagccacgatgtccgtatcgatcgggttgccgaaccgcgcctgcaggaacccgacgacctgctgcttcgcgtgaccgccaccgccatctgcggctccgacctacatctctaccggggcaagatcccgatggtcgagcagggcgacatcctcggccacgagttcatgggcgtcgtcgaggaagtcggctcggccgtgaccgcggtgcgtccgggcgaccgggtggtggtgcccttcgtcatcgcctgcggcgagtgcttcttctgccgcctgaacctgcacgccgcctgcgagaccaccaacccggggcgcggcgcgatcctcaacaagaagcagattccgccgggcgcggcgctctatggctacagccacctgtacggcggcgtgccgggtggccaggccgaatacgttcgggtgcccaaggccaacagcgggcctttcgtgattcccgacgtaatggaagacgaacgcgtgctgttcctcagcgacatcctccccaccggctaccaggcggtgcgcaatgccggcgtccgccagggcagtag

SEQ ID NO: 8050 - DNA, 1107 bp, Pseudomonas aeruginosa
ggtgccgggcgtggaggccgggactcgcccgccgacgtcgggcatccgcgctcaaggcgctttgtcggcagccgcgccagcgcccaggtccgcacctgtcagcggatcggccatggggtcggagcgggtgcggtctgccattcgctgcaacacctcctgctcagtctcggacaggttcacgctggccgtgccgtcgcctccatccatggccggctgtggcgcctccacgtattcccagccatcaccctcgttccaggaaccgcgcgtgtcgccctcgccgcgcgacatgttcaggtaacgccgggcgaactccggcatcccttgcagcttgccttgcgggaagttcggctggatcgagtgcagggccttttcgaaggaaagctggtgcgccagctcgcgggtcatgaggaaggtcagcgcatccttgatgccgggatcgtcggtgaggttgatcagtcgttcgtaaacgatcttcgcacgcgcctcggcggcgatgttggaacgcaggtccgcggtcggctcgccgatggtatcgatgtaggccgcgctccagggtacgccaccggagttcaccagggcgggcccgccgccgtaaagcagcgaggtgatatgcgagtcgttgccgcctccggtcaacgaacggtacagctcggcctcctcctccaccgcttcggccagacgccccttggcgcccttgttgagcatgccgacgatcgaaccgatgatttccaggtggctgagttcctcggtggcgatgtccatcagcaggtccttgcgaccgggatcgcactcgccgaggccctgggtgaaatagcgcatggcggcggccagctcgccctgcggcccgccgaactgctccagcagcaggttggccaggccaggatcgggcgcggcgaccctgacggtgtactgcagtcgcttgtcatgtacgaacatggttcgttcctctgtgggttcgtggaccttccctccgacggacattcgaacaacggctattcgaagcggcgctttcatcctgcgcacggaagctcggaatcccgcagcgggcgatggttcagaacttttccccaacgcgtctcgcctggcgcaacggcgccgctgcgctga

SEQ ID NO: 8051 - DNA, 552 bp, Pseudomonas aeruginosa
gcgaagtccttcacgacgagttcgccctgctcctcgccggtgcccgccgtacgccgcggatcgggcgcgcctgttcctgagcggcccggctcagtgatagccggcatcggcgctcttgccgcgaaatacgtagtagctgcaggcggtgtagccgaggatgaagggaatgatgaacggcgcgctagccggccaaggccggctggagattttcctccagcagctcctccaccagccggcgcagtgccggatggcgctcctggcccgcttcgcgcaacctccggtaacgccgcaactggcgggcggcggaggtctcttcgagtaacccgcaggcatgctggtaggcccactcgttgccctggcgggcctgcggccggcactgtcgccaggccatttccagccagtccccggcacctacgcagcggccgtcgacgagatagcggccggcgcaaccgtaacgcagcgcctgccaatagttttcctccaggcaggcgtcgcgcgcgaccggcaacgcacgcgggtccgcgcccagcgcttcgcccaccagcgccctga

SEQ ID NO: 8052 - DNA, 2325 bp, Pseudomonas aeruginosa
acagcccggccaggctcagcgcgtcggccaggcgcgggcaggcgtcgcagatacgcagctccagggtcggcacatgggatgacggccggatcatccaccagacctggccatcctcgcggatgcagccggtctcgcgcagcagcgccaggtggcggcgataggcgtcctcgtcgggcaaggcaggaggaatgttcatcctcggccactcgccgcagagtgcccgtcgatagctcgccaggccgctgcgccggccgccgcggaacggcgaggatgcgctcaacgccagcagcagcggcagccacggcaacacgcgctggagcacagccatgcggtcgtggctcggcggtatctccacatgcacgtgcaggccgcagaccaggctgcgccgggccacccgcccctggtcctcgaacaggcgggcgaagtgcgccgccgggttgcttcgcgcccgccgccagtcggcgaagggatgggtgccgacgcagagcgagcgcaggccgaagtccatggccagatgcgccaggcgttgccgggcctgaccgtggaagcgcgcggcctcggccagggtggagaacaccgggctggccacctcgacctggcattcgaacatctcctcggcgaaatgctcgccgagcgtgtcacggcaggccgcgacgaatccggcgggggcggagcggacgatgtccaggtcggaggcatcgagcaggaagaattcttcctcgatgccgaagcgaaggccgctggcggccaggtcgtgggtcatcggcgcagctcccggggattgtctcgggaagacgccggagtgccgtcgaggttcgttttttccgccgtgaggttccccggcgcgccgccgatcctgccagtgaaacctttttcccctggtgtcactcgcacccatatgtgtggtcgccccggccgcccccgcaaacccacgacaaggaacgcgacatgagcctgtcttcacccctccctgcctccagtgcaagcccttcgcccagggtccgcgacctgtaccacgccctgctcgacgagccccgcgagcacctcgaagccgccggcgagttcctcgaccagcaattgagcctggccgccacccatgacgacgacctgccggaggaccccgccgattggccggcctggctcgacgccggggcccggcgcaccgccgaggcgcatgccgaatacctccgggcacgtcggcgcggcgaagggcgacgctacttccaggttccctcccaggcgatgcacttcattcgcagcgtggccccgaccaagctggtcgacggcgcctggctctatgggctgttgccgcatcatggcgaggaacgcctgcggccgctgctggagaccttcctcgaagaactcggcgacggcgtcccggcacgcaaccacgtcctgctctaccggcgcctgctggccagcatcggcagcgaggaagtcgaaggcctcagcgacctccactacctgcagggcacccagcaactcgccctcggccacctcgccgcggactacctgcccgaagtgatcggctacaacctcggctacgagcaaccgccgctgcacctgttgatcaccactcaggagctgcgcgagctgggcttcgacccctactacttccagttgcacgtgaccatcgacaacgccgccagcggacatgcgcgcaaggccctgcgcgcgctctacgacaacctgccgcagcttggcgggcgcgcggccttcctcgaacgggtgaggaacggctaccgcctgaacgaggtcggcctgagcaccgagcaggtgatcgacggcttcgatctcgaggaagaattgctggccatgttcgagcgcaagcgcccctacgccgccggcatgcattcggatcgttgccggatcggcgggcgcacggtgaaccagtggctggcggtgcccgggcggttcccggcgtttctcgcctgcctcgaggaagagggctggatccggcgccatgccgatccgcgcggcagccgtttctggaacctgatcgagggcgaccgggcggcgatgttcggagtcttcactccctacgagcggcagttgctgtacgactggatcgctggcgactggcaagcccccgctccggcggacagggacccgcttgcgccgctggcggagccggcgacggcgggcggagacgtggacgccgagcaggtcgcgctgcgacgcgagctgctgcggctatcccccgagcagggcgtcgcacgccttctcgaactgatggccccgcacctccaccacggacccgccggtctccttgccacgcggatgttcagccagcgctggagggccgcccatgcccagcctgaatga

SEQ ID NO: 8053 - DNA, 573 bp, Pseudomonas aeruginosa
ggtcgtggatcagctgggcgaagccgagcaactggccctggctgtcgcggatggcgtcgatcaccacctgcgcccagaatcgcttgccgttgctgcgcacccgccagccctcggtctcgaagcggccctcgacatccgcctggcgcagcgcctgttgcggaacgccggcgtcgcggtccttgcgggtgtgaaagcaggcgtagtcgcggccgaggatctcgctcgcgtcgtggccgaacaggcgcgccgcgccggcgctccagctggcgatacggccagcgctgtccagggtgtggatcgcgtagtcgtcgaccgcttcgtcgagcaggcggttgcgcgtggcctggttcaaggggactttcggttttcttgtggttttcatggacgtgttcactcgtcggctgctcgacccgggctgcaaggcacacccagcaaggtagtacgaagaacgtcttccggccgctcgctggctcgccccaggaacttggccgacctttcggaagaccccggcgcggccggcgaattccattcgccggaaccttgtccggagtatggctttcgatatgcaggtag

SEQ ID NO: 8054 - DNA, 327 bp, Pseudomonas aeruginosa
tcccgctccagggacggagtggatctttttcttgcgcttcgcgaactggggagacctgaccagatgaacctttcctacctgtacctgaagaagatcctcgaggaggaactgcgcgaccacgactgccagtgcctgctgaactctgacttcacggtgaccatcagttgccgcgtcgacggcccccacggcgcgctctacatcgtgcccaacagcgacttcctgaagagcagcagcttcagcgatctcagcgccttcatcctcaacctgcgcgaggaaatcaggcgcttcggcgagttcgaggcggaactccagaccggcaccggctga

SEQ ID NO: 8055 - DNA, 459 bp, Pseudomonas aeruginosa
gcaggaagtcgccgtgttcgtcgggaccgcggtagatcacccggctgttgtccggcaggcgcttgtcttcgtggatctcgaacgacgcggcgcgcaccgcgggcagccccggatcggcgcggaaggcttccagcgcggcgatctcggcgctgctcgcgccgccgacccgccaggactgctcgagcacgccgaagcgctcccgaccgttgccatcccggccctgggcaatgtcgtagttgcgccgcgaggcgaagcagccggggaagaagatcgccgcggcggtgtcgaagatccgcgcgtactcgatggcctggcgcacctcgcgggccaggtccagggccagcagctcggcgtagccaccgcgcgccaccagcaggtcggagccggcatagaccagttcgccgcgcgcgttgcgggtctggtgctggtgaccgtggtagctcagcaggaaaccgttga

SEQ ID NO: 8056 - DNA, 654 bp, Pseudomonas aeruginosa
acgcgtgctcgacgaaaccgccgagcagatcttcgtcactgttcacgcccaggcgcacggcggtctccctgccgaccagggtgcgggtcgggaccaggtagagggggcctcgctggtgcaattcgggttcgtagcggccgccgaactccagcttctggacttccgccagccagcgcgccagggccaggttgccctgcacttcgtgttcggcggccgcgggatcgacactatgggccaccaccagtctctgccgagggtctgcgctcatgttccgctcctcctggatggaaaccgggcattcagggctccggtatgggcgagaggggctcttcgttgggctgttccatcggaatctcttccgggaattcctgggggacgtggctttcgtggtcaggaaccggatattcgtccggatccctcgaggggttgcgtggagtggtcgctgtcgcgcccgatgatgcagaagtgggaaaacgcatgtccgcctccatcgtagggatgacttctagatggagggggcgaagacggatttggttcggaccatgcgtcggaaggccgggtcggcgactgaccgacccggagctgaaacagcctgctcagcgagccaggctcatggtacgcagcttgccgccggcgaccaggaccttgcgatga

SEQ ID NO: 8057 - DNA, 1947 bp, Pseudomonas aeruginosa
ggaaaccgcgcagagctacctcgatgcggtgatgcgcgcgatcaacgtctaccactgtccctcgctgctcaacgccatgcgctgcaaggcgatggccgcgccgatgttctggagcgactcggtggagccttacaaccgcctgtaccggcgcctgttgaggaataccgctccggccctgcgcggggtacgccagtgatggcgatccggcgccgcttcggcgcccagttccaaggcaacggccggacctgcttcggcctctgggctccggacgcccgtgaggtccgggtcgagaccgccgacggccgcgactggccgctggaaggcagcgacagcggctggttcgaggcgaccctgccctgtccgcccggcacccgctaccgttaccgcatcgatggtcgccccggggtgccggacccggcctcgcagttccagcccgacggcgtgcatggacacagccaggtgctggaccatggcgcctacgcctggcgcgtcgacgagtggcgcgggcggccctggcacgaagcggtgatctacgagctgcacgtcggcctgttcggctcctacgccgaggtcgagcacttccttccgcgcctggtggaactgggcgtgaccgccgtggagctgatgccactgggcgagtttcccggtcgccgcaactggggctacgacggcgtgctgccgttcgccccggcgtcggcctacggcacgcccgagcaactcaagcatctgatcgacagcgctcacggcatgggcctgatggtcttcgtcgacgtgatctacaaccacttcggcccggacggcaactacctcgcgcagtacgccgccgcgttcttccgcgacgaccggcagacgccctggggccaggccatcgatttccgtcgaggcgaagtccgcgagttcttctatgagaacgccctgatgtggctgctcgactatcgcgtcgacggcctgcgcttcgatgccgtgcacgcgattcccgatagcgcgttcctcgtcgagatggcccgccgcctgcgcggcgccgccggccccgagcgccatgtgcacctggtcctggagaacgacgacaaccgcgccagcctgctgcgccagggctacgacgcacagtggaacgacgatggccaccatgcgctgcacgtcctgctcaccggcgagaacgacggctactaccaggactaccccgagccgctgcgctgcctggcgcgctgcctggccgaaggcttcgtctaccagggcgaagccaaccgccacggccggccgcgcggcgaaccgagtgccgacctggcgccggacgccttcgtgctgtttctgcaaaaccacgaccaggtcggcaaccgcgccttcggcgagcgtctcagcgtcctcgccgaaccccaggcgttgcgcctggcgatagcgctgcaactgctcgcgccgatgattccgctgctgttcatgggcgaggaatgcgccgcgcgcgaaccgttcctgtatttcaccgatcaccagggcgaactggcggacgcggtccgcgagggacgacgcaaggagttcggcgagttcggccgcttcggcgagggcgccaccctggcttcgctccccgacccaaacgcggtggagaccttcgagcgctcgcgtcccggcctggccgattgcgacccggcctggcgcggcttctaccggcaactgctggaaatccgtcatgaacacctgatcccgcgcctgcgcggcgcccgttcgctgggcgttaccaccatcgccggcgccgcgctgtcggcgcgctggcgactcggtgacggcagtgactggcgaatcgacttcaacccttctccgctcgaagcggaagtcgagccgccggcggccgccacctgggtgctgttcctcgacaacctcgcctgtgccgagtatcgccgcggccgcctaagtccccgcagcatcgcggtcagcctggagcccgcccatgagtga

SEQ ID NO: 8058 - DNA, 2046 bp, Pseudomonas aeruginosa
cgcacgcctggccgaactggccgccgccgtgggcctgcaactcgactggcaggacgccaacggacggccgcagcgggtcgacccggaggtccagcgcggcctgctggaagcactcggctatccggcgcagagtccgcaacagatcgaacagagcctggccgcgctggcccggctgcgcgaggacagcgccaacctcggactgctggtcggcgaatgcggccagccgctggagcaagcgctcggccccgccggcaccccgggcgagctggtctacgaggacggcacgcggatcgccctgcgcctggatgccgaaggccgcctgccggcgcaggcccgcagcggctatgcgcagctgtcgctggagcagcgggaatgggcggtggcgatggcgccgccgagctgtccgtccctggccagcctcgccccgggtcgctcgcgtcgctggggtctggccgcccagtctatgccctgcgccgccccggcgacggcggcctgggcgacagcgccgccctcgaggacctgctgcgcagcgccgcgcggcatggcgccgacgcgctggcgatcagcccgctgcacgccctggccgaggccaacggacatgcctacagcccctactcgccgtccagccggctgttcttcaatgtcctgcacgccgcgccggcgaccattctcggcgcggcagcggtggaacaggcgatccgtcgcgccggcctggccgcggagatggcccgcctggagagcctggagctgatcgactggacagcggcggcggacctgcgcatgcgcctgctgcgccaactccaccgcgacttcaccgagcgcgccagtcccttgcgccacgacctcgccgaattccgccgcgaagccggcgaggccctgctgcaccactgccgcttcgagaccctgcaggcgcacctgggcgccggccccgactggagacgctggccggagccgctgcgccgccccggcgagccggcggtggccgcgttctgcgccgatcacgccgaggaagtggacttccgtgccttcggccagtggctgacccaacgttgcctgcaacatgcccagcgccaggcgcgcgaggccgggatggccatcggtctggtcgccgacctggcggtgggcgccgacggcggcggcagccaggcctggtcgcggcaggaagagctgctcgccgaagtgaatgtcggcgcgccgccggacatcctcaaccagtccggacaggactggggcgtttccgcgttcaatcccgaaggcctgcgccgccacggctaccgggcattccgcgagatgctgcgggccaacctggcctggcccggagggctacgcatcgaccatgtgatgggcctgcaacgtctctggctgatcccgcgcggccagccgccccacgccggcgcctacctgcgctacccgcaacgcgagctgctgcgcctgctggcgctggaggccagtcgcgcctcggcgctggtcatcggcgaggacctcggcaccgtgcccgaaggcctgcgcgaggaactggcacgccgccaagtgctgggtacccgcgtgctgctcttcgagcggcgcggcgaacgcttcgtgcccccggcgcaatggccggcggacgccatggccaccaccagcacccacgacctgccgagcctgtccggctggtggcggggccaggacatccactggcgcggccgcgccggacaccgcagcgccgaggaatgcgcggccgacctggaactgcgcgccgaggagcgccgggccctggccgccagcctcgaaccgccggtcgatcccgaccccgccgccgaagtaccgctggacgcctgcatcggctatgtcggggcaacccccgcgccgttggtgctactgcccctggaggacgccctgggcagcctggagcagccgaacctgcccggccccggcgacgcccacccgaactggcggcggcgctggccggaaaacgccgcgcagatgctcggaacgccgcaggtcgaccggcgcctgcgcctgctcgaacgcagccgccgggatgccgaggaggccgcccatgattga

SEQ ID NO: 8059 - DNA, 1032 bp, Pseudomonas aeruginosa
gccccgcgctaccctgcgcctgcaattccacgccggcttcaccctcgacgatgccctgccctggctggactatttcgccgacctgggcatcagccatctctacgcctcgccgctgttccgcgcgcggcccggctccagccacggctacgacgtggtcgacccgacccggatcaatccggaactgggcggcgagccggcgctgctgcgcctgatccaggggctgcggcaacgcggcatgggcctgctcatggacatagtgccgaaccacatgggcatcggcggcggcgccaatccctggtggcaggacgtgctcgaatgggggcgcgagagtccctacgcgagtttcttcgacattcagtgggaatcccacgacgccgcgttgcgcggccaggtgctgctgccgttcctgcgcagcgactacggcgaggtcctggctgccggggagatcggcctgagcctggaccgcgaggccggccgcctgctggcgagccacggcgagcagcgcttccccctctggccgggcagttacccggagctgctggaagacagcggcgagccgcgcctgtcagccctggccggcggtttccgcgagtgccggcaggaccgcgaggccttgcgcgagatgcagcgtcaactggcggctgcgctcgccgagagcgctccgcgcgcagccctccagcgcacgctgggcgaactccaggaacgccacgaggaggctcgccaacgcctgcaccgcctgctcgaggcgcagcactaccgcctggccagttggcgcaccgcggcggacgacatcaactggcgccgtttcttcgacatcagcgaactggtcggcctgcgggtcgagcgcggcgaggtgttcgaggccgtgcacggcaaggccttccagttgctcgaggacggtctgctcgatggcctgcgcatcgatcacgtcgacggcctggccgatccgcgcggctattgccgacgcctgcgccgccgcagcgagcggatccgcgcccgtcgcggcggcgcgccgatgctgctgtacgttga

SEQ ID NO: 8060 - DNA, 516 bp, Pseudomonas aeruginosa
cctggagaacctcgcccagggacttttgcgggtggcgcgggccgacctggccagccgcgacctgaccctgggcggtatccgccgcgcgctgttccagttgctcgcgcgctttccggtctaccgtacctacgccggggcctgcggtcgctcggtgcaggatcgcgaggtgttccgctatgccgcagaggcggcccgcgaggatctcgacgaagccgaccgggcggtcctcgaccatctcgaacgctggctcggcgggcagccgctgcgcgagctgccgcccggtccgctgcggcgcctgcgcggcgagttgctggcgcgcttccagcagttgagttcgccgaccgccgccaaggccgtggaggataccgcctgctatcgctcggcggccctgctctcgcgcaacgacgtcggcttcgacccgcagcgcttcgccgcttccgccgaggaattccatgccgcctgcgaagccaggcgcctggccagcccacgcgccctgctggccaccgccagccatga

SEQ ID NO: 8061 - DNA, 1236 bp, Pseudomonas aeruginosa
cgtcgagcactggcaaagcctggccacgccgttgcgccgcgacctcgccgaggggccggcgccgagtcccggcgacgagctgatcctgttccaggccctgctcggcagttggccgctcgacgcgccttgcgacggcgccgccctggaccaagcgttcctcgcgcggatgcgcgaatggcaatgcaaggccttgcgcgaagccaagctgcgcacgcgctggaccgcgcccgacgaagactacgagcgcgcctgcgccgactatctggaacagctcctgcgcgcgccactggcccaggccctgcgccagtcgctgggcaacgcggcggtgcgactgatgccggccggggccctgaatggcctcgcccaatgcctgctgcgcctgacctgcccgggtatccccgatctctaccaggggcgcgaggactgggacttcagcctggtcgacccggacaaccggaggccggtggacttcgcccggcacgccgccgccctggccgcgccgacgcccttcccggaactgctggagcactggcgcgacggtcgcatcaagcagaccctgatcgcccgcgtgctggggctgcggcggatgcagccgggcctgttccgcgacggcgactacctgcccctggaggtcagcggcgagcatgccgagcgggtcctggccttcgcccggcgcagtcgtcacggttgcctgctggtggtggtcccgcgcctggcctgcgccctgctcggccacgccacgcagccgcaggtgccggccgaggcctggggcgacacctgcctgctgctgccgccgagtctctccgaatgcacctacagcggcctgttttccaccatgccgctgcccagcgacgggcacctgagcctgtccgaagtgctcgccgactttcccgtcaacctgctttaccgcctcgcccaggaggacaccccatgagcgccgacgaaaaacgcatacgagagttcgcctaccagatctgggaatccgagggctgccccgacggccaggccgaacgccactgggccatggcccggcaactggccgaagcggaagccgccgcggcggcaccgaagaagacccgcggtcgggccaaggccgccaaggaaaccccggccctgctgcaagcgccggccgccaagccgcgcaagccgagggccgcgtccccggcgcggcccgccagcgaaaaaccggcggcggccaagccgcgcagccgccgcaagcccgaagcgggcgaatga

SEQ ID NO: 8062 - DNA, 1944 bp, Pseudomonas aeruginosa
ggagtccagtgcatgagcagaaagcgtagccccgctccttcgcggatcagcgaagggcaccccttcccccttggcgccacctgggacggcctcggcgtcaatttcgcgctgttctcggcccacgcgaccaaggtcgagctgtgcctgttcgacgcgcgcggggaaaaggagatcgagcgcatcgaattgcccgagtacaccgacgagatctggcacggctacctgcccgacgcccacccggggcagatctacggctaccgggtgcacggtccctacgagccggatgccggccaccgcttcaatcccaacaaattgctcctcgatccctacgccaagcagttggtcggccgcctgcgctggtccgaggcgctgttcggctacaccatcggctcggccgacgccgacctcagcttcgacgagcgcgacagcgcgcccttcgtgcccaagtcgaaggtcatcgatccggccttcacctgggccgagcgcccgccggtacgcgtcccctgggaccgcacggtgatctacgaagcccacctgcgcggcctcagcatgcgccatccacaggtcccggaggcggttcgcgggaccttcgccgggctgatgaacgccgacctgctggcgcacatccgccggctcggggtgaccagcgtcgagctgctgccgatccacggcttcgtcgacgacaagcacctgctggaaaacggcatgagcaactactggggctacaacagcatcgccttcttcgccccgcacccggcctacctcgccagcggccaggtcaacgagttcaaggagatggtcgcgcacctccacgacgccggactggagctgatcctcgacgtggtctacaaccacaccgcggaaggcaacgagctgggtccgaccctgtgcatgcgcggcatcgacaacgcctcgtactaccgcctgatgcccgaccagcgccgctactacatcaacgattccggcaccggcaacacccttgacctcagccacccctgcgtgttgcagatggtcaccgactcgctgcgctactgggccacggaaatgcgcgtggacggcttccgcttcgacctggcgaccatcctcggccgccatccggacggtttcgacgagcgccacggcttcctcgtcgcctgccgccaggacccggtgctgagcaagtgcaagctgatcgccgaaccctgggattgcggccccggcggctaccaggtaggcggcttcccgcccggctgggcggaatggaacgaccgtttccgcgattgcgtgcgcgcctactggcgcggcgacgacgggcatgctgccggaactggcgcgacgcctaaccgcctccggcgatctctacgaccagcgtggacggcggccctacgcgtcggtgaacttcgtcaccgcccacgacggtttcaccctgcgcgacgtggtttcctacgatcacaagcacaacgaggccaacggcgagaacaacgccgacggcagcgaccacaacctgtcctggaaccacggctgcgagggccccaccgacgacccggagatccgcgccctgcgcctgcgccagatgcgcaacctgctgtccaccctgctgctgtcccagggcaccccgatgctggtcgccggcgacgagttcagccgcacccagcagggcaacaacaatgtctattgccaggacaacgaactgggctggatcgactggcggctggacgacgagggccgttcgctgctggccttcacccagcgcctgctggccctgcgccaacgctatccgatcctgcgcagggggcgcttcctggtcggcgagtacaacgaggcgctgggtgtcaaggacgtcacctggctggcgcccggcggcgaggagatgaccgaggaacactggcacgacgagcacgcccgctgtctcggcgtgctcctcgatggccgcgcgcaacccaccgggatcctgcgcagcggtga

SEQ ID NO: 8063 - DNA, 963 bp, Pseudomonas aeruginosa
acagcatcgagatcaacggcaccttctacgccctgcagacgcccgagcgcttccgcggctgggccgaggacacccccgaggacttcgttttcagcgtcaaggccccgcgttacatcacccacgtgcggcgactgcgcgagatcgacgagccgctggcgaacttcttcgcctccggccccctcgccctgcgccagcgcctcggcccgttcctctggcagttcccgccgagcatgcgcttcgaccgcgagctgttcgccgatttcctcgcccgcctgccgcgcgacggcgccgccgcgcagaagctcgcccggcacagcgccgcgcgcctgcaccgcgagggctacctcgacggcgatccggcgcagcgcctgcggcatgccgtggaaatccgccatgagagcttcgtcgacccgacgttcatcgagctgctgcgcgaataccgggttgccctggtggtggccgataccgccggcaagtggccgctgctcggcgacgtctgcgccgacttcctctacctgcgcctgcatggcgacaaggagctctaccgcagcggctattcggaagcggccctgggccagtggcaggcacggatccgcgcctgggccggcggcgaccaggccgacgacctgcgccgggccagccaggacgccccggcgaaggcgacggcgcgcgacctgtactgctacttcgacaacgacgtcaaggtgcgcgcaccctacgacgcccggcgcctcctgcagctgctggaactcgacggcggcctgcgcacggtgcccggacagttgcccgatgacctgcgggagagtgccgcatgatcctgccgcgcctgcaggtgctgacggtgaacacccacaagggtttcaacccgttcaatcggcgcttcatcctgccggagttgcgcgaagcggtgcgcagcgtcggtgccgacctggtgttcctccaggaggtcctcggctcccatag

SEQ ID NO: 8064 - DNA, 2403 bp, Pseudomonas aeruginosa
ccaactgctcgccggttgcggcctgcgcgaagtcttcgtcggcgcccagggccggccggcgcgcagcttcccggcgcgctggccggtgctgccgctggaccgcatttacctgcgcaatgcccgcgggcgccagccgcgcatcctctcgcggcggccctggtcgcacctgtccgaccacctgccgctggcggtggaggtggagccatgaacttcccctggcgcgacggcaaccgcgtagaactgctgatcaacggcgaagagtactttccgcgcctgttccagtgcatcgccgaggcgcgccgggagatcctcctggaaaccttcatcatcttcgaggacgaggtcggccggcagttgcaggaagccctcagcgccgccgccgagcgcggtgtcgaggtgcaggtcacggtggacggctacggcaccgcctcgctcagcccggactacctggccaggctggccgcctccggggttcgcgtgcacctgttcgacccgcgcccgcgcctgctcggcatgcgcaccaacctgtttcgccggttgcaccgcaagctggtggtgatcgatcgccggcaggccttcgtcggcggcatcaattacggcgaggaccacctggtacgtcgcggcaacatggccaagcaggactacgcggtgcgcgtcgagggcccggtggtgcgcgatatccgccaggcctgcctggcgctgctcgaaccggacgccgactacccgccgttgcggccgtcgggcgccgggcagccggcgcgggtgcgcctggtgatccgcgacaacgaccagtccagcgacgacatcgagcgcgagtacctgcaggcgatccgccaggcgcggcgacgcctgctgatcgccaacgcctatttcttccccggctaccgcctgcttcgcgagctgcgcgatgcggcgcgccgcggcgtgcgcgtcgacctggtactacagggcatgccggacatgccgctggtgcgcctgtgcagccggctgctctacgactacctgctgcgcgagggcgtgcgtatccacgaatactgccagcgtccgctgcacggcaaggtcgcggtgatcgacgacgactggtcgaccatcggctcgagcaatctcgatcccctcagcctgtcgctgaacctggaggccaacctggtgatccgcgacgtcgccttcaacggccagctctaccagcacctgcgcgagctggcgcgccgccactgccggcgcatcagccgccgccacgcgaggcgcggctactggtggcgagcgcccgctgattttcctcggcttccacttttccaggcactttccggctatcgccggttgggtacccgcccatctgccacgcctgaaatcgctggagccgcgtccgtcgcggcgctggcaggaacgccagggccagcggggcaacccatgaacggcagcggtcacgaagccacctcgacgccgccgcgccgctctcactggcgctggctgcgcaggctgctgaccctggcgttcttcgtgctggtcccggtgctgctgttcctgctggtgaagaatctcgactggcaggaagtccgccacgccctcgacgagtatcgccccgcgaccctgttcctcgggctgctgctggcggccgccggctatacggtgttcagcagcttcgacctgctcagccgctactacatcggccactcgctgcccaagcggcgggtcttcaccgtggcgttcgtgtgcaatgcgttcaacctcaacctgagttcctgggtcggcgccgtggcgctgcgctatcgcctgtacagtcggctcggcctggacatcgccgatatcacccggatcctcaccttcagcctggtgaccaactggttcggctacctgctgctcgccggcatcctgttcagctgcggcctgccggccttgccgccgggctggaagctcggcagcgacggcctgcgcctgatcggcgccctgctcctggcgctggccgcaggctacctgctggcctgccgtttcgcccgacgccgcgcctggggctggcgcgagcatcggctgaccctgccgtcctggcggctggcggccctgcaaggcctgctcggagcgagcaactggtcgctgatggcgctcctgctgtacagcctgctgccgcacagcgtggattacccgagcgtcctggcgatcctcctgatcagcagcatcgccggggtcatcacccatatcccggccgggctcggggtgctcgaagcggtgttcatcgccctgctccaggggcgcctgtcccagggcgtgctgctggccgcgttgatcggctaccgggtgctgtatttcctcctacccctggcgctggcctgcgtggtctacctgctgttggagcgccgggcgatccgcctgcgccgcaaacagcgccgcctgcgccagggccaggcgtga

SEQ ID NO: 8065 - DNA, 4125 bp, Pseudomonas aeruginosa
aatcgccgaccaccgagacgcgcacggcgttcggcgcccagaccgcgaagcgcacgccctccacgccttcgtgacgggtcacttgcgcgcccagacaggaggccagttggcggtggttgccttcggcgaacaggtagaggtcgagttcgccgagcaacggcccgaaggcataggggtcttcgctttcctgcacgccgtccggccagtgcacgcgcaggctgtagcgcggtggcaggggctccaggtggcgctggaacaagccgctgccggggtcgctctgctccagttcggcgagcgtcgcgccgtcttcgtcgagcagctcgacgcgctgcgcgccgggcaggtaggcgcgcagcacgccgccttcgccgccggggtcgcgctgcgggccgaggaaggcgaatggatcgccctgcaggccgcgctgcagcttgtccagctccagttgccagcgttcgcgttcggacatcggttcgctcatcggttcttgcccttcaggaggtgttcggtgagttcggccagaccggcgagaggcacttccagccagtcggggcggtagtcggcttcgtagagcagttcgtaggcggccttttccaggcaggccagggccagcgccgccccctcgccttcgcgaccgtgccaggcgtgcatgagcccccccgcggcggcccgatagccggccaggaaggcatcgcgggcttcgctgcgatagcgcatggcgaccttgcgccgggcgctgtcggcctgttccgagctatcggtgctctgcgcgttgcgcaggaccatcgccgccgcgtagtcgaacgagcgcagcatgccgccgacgtccttcatcggactgtggcgctggcggcgctcttccaggctgcgcgtcggctcgccctcgaagtcgatgaagcgtgcgtcgccctggaccatcagcacctggcccaagtgcaggtcgccgtgaaccctgatcagcagcccgccggctgcctgccgggccagcagcggcaggcgttcgagcagcgccggcaggcgttccagcaggcgccgcgcccgttccgccgcctcgccctgcaacggtcgtggcggctcgctcaggcgtttgccggcttcgcgcaactgttcggcgatacgcagcgcccaggcctggacgctggcttcgtcgctctcgcggctgccgaaggccggatcgtccgactcgccggccagtacgctgtgcatctcgccgagccgggcgccgaggttggcggcgaagccgcgcagttcggcgaggctgtcgtattgcccttcgagcgcctcgctggccgcggatatctcgtcgcgcacggctcgctccaggttgtccagggtccagttccaggcgtcgccctggttgttcaggtagccctgcaggatcatcagcgtgtgcggctcgccatccgcgccgacccgccgtacctcgccgagcaacggggcgatgccggggtaaccgtggcgggtcaggtagccgccgacctcgatttccgggtgcagccccggaaggatcttgcgcagcaccttgaggaccatgcgctcgccgaagcggatcgagctgttggactgctccaccgagaacggcaggacgtcttcgtcggcgatgtcgtccatttccgccagtcccgccgccgggatgaactggatctcgccgtcgccgtgggcgatcaccgcctcggcgcggagttgcgcgaggaccttgcgggcgaacagcggcaggctggcggcgtcggtcagcaggccgaccttgcgaccgcgccgcaggcgcgccagggccagcaactgaggcaggctgtcgccgcgctggtcggcgtcgaggaagcccagcggcaactggtagcgcagcccgtcgatctccacttcgcacagcgcacagcgcggctccgcctcgtccagcggaacgatgtagcagagccgtggctggcctttctcgccggcgaaccagcggcgcttcggcaggtaggccggcagcgtctcgccttccaggatgttccgcgatgcgccctgcagcagctcgccgaggcgctgcttgaccaccagggtcggcagttccggcaggcgctcgtcggcggccacgtgccagctcggcatctgcgtcgcgtcggccaggtagaaccagtagaagccgtagggcggcagggtcagcaggtaggtcagctcgccgatcggcgggaacgacatgccgccgatcatctccaccggcaccttgccggcatggctggcgaggtccagttccaccgcctgggccgcgcgcgacaggttggccacgcagaggatgctgtcctgccgttcgccctcggcgtattcgcgcaggtaggcgaggatccgtcggttgctcggcgcgagcatcttcaggctgccgcggccgaaggccttctgctggctgcgcacggcgagcaggcggcgcatccagttgagcagcgaatgcgggtcgcgcgcctgcgcctcgacgttgatcgtctggtagccgtacagcgggtcgaggatcggcggcagcaccagcttcgccgggtcggcgcgggagaagccgccgttgcggtccaccgaccactgcatcggggtccgcacgccgtcgcggtcgccgaggtagatgttgtcgcccatgccgatctcgtcgccgtagtacagggtcggcgtgcccggcatcgacaacagcaggctgtgcagcagctcgatgcgccgccggtcacgctccaccagcggcgccaggcgccggcggatgcccaggttgaggcgcgcgcggcggtcggcggcatagtggttccagagatagtcgcgctcgtcgtcggtgaccatctccagggtcagctcgtcgtggttgcgcaggaagatcgcccattggcaattggccgggatgtccggggtctggcgcaggatgtcggtgatcggatagcgatcctcctgggcgatggccatgtacatgcgcggcatcagcgggaagtggaaggccatgtggcattcgtcgccctcgccgccatcctcgccgccgaagtacggccgggtgtcttccggccactggttggcctcggccagcagcatgcggtcgggatagtgcgcgtccagctcggcgcggatgcgcttgagcacctggtgggtctccggcaggttctcgctgctggtgccgtcgcgttcgatcaggtagggaatcgcgtccaggcgcaggccgtcgacgcccatgtccagccagtagcgcatcaccccgagcacctcgcgcaggacctgcgggttgtcgaagttcaggtccggctggtgggaatagaagcggtgccagtagtactgttgggctaccgggtcccaggtccagttggactgctcggtgtcgatgaagatgatccgcgtaccctggtatttctcgtcgctgtccgaccagacgtagtagtcgcgggcgcgcgatcccttcttcgcgtggcgggcgcggatgaaccagggatgctggtcggaggtgtggttgatcaccagctcggtaatcacccgcagaccgcgtcgatgggcctcggcgatgaaccggcgggcgtcggcgaggctgccgtagtcgctgtgcacgccacggtactgggcgatgtcgtagccgtcgtcgcggcgtggcgacgggtagaacggcagcagccagagagtgttcacgccgaggtcggcgatgtagtcgagcttctcgatcagcccggcgaagtcgccgataccatcgttgttggcgtcgtagaaggatttcacgtggacctggtagatcaccgcgtccttgtaccattgcgggtcgttgagaaagaccggtttctcgcgtctggccatgggtttctccttatgcgtcgacgcgccgcacgcgccagatgccgaacggcaggtgccagggttcgatgcgcatccactggaccttgccgtgccagacccagcgatgcccgttcatcaggtcctcgccctggaggctggcgtcgtcgggcaggccgaactcccacagcggcagttcgaaatgcgcctcctgggcttcgtgcgggtccaggcagaccgccaccaggacgaagttggcgaggtccgcggtgcgcttgccgaaatacaggatgcggtcgttccaggcgttgtaggcctggaacccgaggtgcgtctgcaatgccgggttttcccggcggatgcggttga

SEQ ID NO: 8066 - DNA, 993 bp, Pseudomonas aeruginosa
cgatgtcctcgtacttcttcggcgggttctccgcgtagcgcaagctaccgtccggacgccaggcgaaccagccgggatgctcgcgcagccaggggtggtcgggggagcactggatggcgaagtccagcgccagttccatgccgtgctcgcgcaccgcaacgagcagccggcggaaatcctcgcggtcgcccagttcgggatggatcgcctcgtggccgccatcctcgctgccgatcgcatacgggctgccggggtcgccggcctcggcacgcaaggaattgttgcggcccttgcgatgggtgcggccgatggggtggatcggcgggaaatagagaacgtcgaagcccatcgcggcgatctgcggcaggcgccggatcacgtcgtcgaaggtaccgtggcgtgtcgggtcgccgctttccgagcgagggaacagctcgtaccaactggcgaagcgcgccagcggtcgctccacctccaccgggtattcgcggctgcgcaccaggtgctcgcgcgggccgaccagacgcaacagttcgccggtctgcgccgccagccacagcgccacccgctcctcgacgctctggcaggcctgcaggcgttcggccagcggcgcacaggcggcggcgatctccggaccgccgcgctcggcgcagcgctgcagcagttcgtcgccctcgcgcagctccaggtccagcggcaggcgtgcgccatgcttggcacgcaattcgcggcggtagccggcaaaacggtcgatccaggcctcgatacggaagtacaggcggccgcagggcggcgtgcgcaactgcgcgctccagaaatcgttgccttcgggcagcagcggcaggcgccgctccgcggtttccccgacacgccgccagaccacctcggcaccgagtacctcatggccatcggcgaagattcgcgcggccaggcgcaggtcgcggtcgctctcggtcttcgcgggataggcaccctcttccaccacagggctga

SEQ ID NO: 8067 - DNA, 426 bp, Pseudomonas aeruginosa
cgaagtgcgattccagcactatttcatttctctcgtcgaacaggtggcgaaaccgcttttcgtcgactcctgcgaagaggcgcgcagctacggcctggactgcaacgtggacctcgacctcgacgaggacggccatcctcgcctgcgcctggaagtcggcgagccgggaggcgagaaaagccactacagcctgctggcgattcccggcgagcgggtcatccatcgccagtacctggccggggcccaggaatggcacagcctgccggccgagctggcgtcgatcaacccgatggtgctggacagcgagctggcggtattcttccgccgcgccttcgaccttcgcctggagggccccgaacgccgtcacccggccggcttctggtaaggcccttcatagcttccagatatcccgggcgtattcgctga

SEQ ID NO: 8068 - DNA, 2823 bp, Pseudomonas aeruginosa
ccagccgagcttgcgactggcggagctgtcgctgcggagcacgctgttgatggcccaggcatccaccaggagcaacaggaccagcagcgcgaggatcaggtaggcggtatccatcgggggcctcctcggcatctcgttgcacggtggaggccctgtgcgccgggggagttccgcctttttcgcggacggtcagccgcgcccgagctggcgccgcatggccgcgctgatgcgctggcgggtgccggcgtagtcggcccagggatcgtcgccggcgagttcgtcgaggcgctgcggcagactgcgcaggttccattggttggcgccctgcagcgagtcgagttcctcgcggaacaccggtaccgacaccggcaacccttcgcgggcgcgcaccgagtaggcggccacggtgctggcgccgcggctgttgcgcaggtagtcgacgaagatcttgccgacccggttgcgcggcccggaaaccgccgagaaacgctccggcatcaggcgcgccaagtgctgggagatggcctgggcgaaatccttgacctcgtcccagccatgccggcgctccagcggcaccagcaggtgcatgcccttgccgccgctggtcttgaggaaggcgcgcaggcccagctcgtcgagcaacgtcaggctcagctgggtcgcttcgagcatgcgcttccacggcagcgccgggtccgggtcgaggtcgaggacgaaacggtcgggccgctccaggttggccaggctggcgttccaagtatggaattcgatgctgcccatctgcaccgcgccgaccagcgcctcggcgctgcggatttgcaacagcggcggatgaccgggatcgagcgccgggtcgagctggacgatgccggggatcttcaggcgcgccgcgtgcttctggaagaacagttcgccgccgattccgtcggggccgcgcaccagcgacaccgggcgctcgcgcaggtcgcgcaggagcaggtcggcgtagcgcgcatggtactcggcgagttccagcttgctggcctggatcgacgggtcgatcagccgctgcggatggctgatgcgcacgccggcggtggccgcccgcgacgcaccggcgccggccttgcgcgcgccgcgcagcggcggcgggccggcgggacgctcgccggtcacctcgcgcgccggcttgtcttcgcgcaagccgtggaacactgcctggcggatgatcccgccacgggtcatctgcgcataggaaacctcgcacagctgttgcgggcgcacccactgcaccgacccggtctcgcgcgccggcggcaccttcgccaatgggctggagcggaccgcgaggggttccaggcgctcacggaccttcttcaggctggccgcggtgaagccgctgccgaccttgccggcatagcgcagccggcgctcctcgtcagggctgtagaggccgagcagcaaggcgccgatatgccggcgagagcccttcggctcggtatagccgacgatcacgaactcctggcgcaactggcacttcagcttgatccagtcgttgctgcggcgcgaacggtaggcgctgcccagacgcttgccgatcacgccttcaagaccgagcttgcaggcgctggccagcaggtcgcgggggtcttccgcgagcgtcgcggagaaccgcagcgggtcttcgtctcgcccttccagcagcgcctccaggcgcgcgcggcgctcctccagggcgacatcgcgcagatcctcgccttcgtggtacggcaggtcgaagaggacgtacaggatgttctcgccgcgaccttcctcgaaggcgttctgcagggcctggaagtccggtcgaccctcctcgtcgaggacgaccagttcgccgtccagccaactgcgctgcagaccgagcccggccaaggccttctccaggtgcggcaggcgttcggtccagtcatggccgttgcgggtcagcaggcgcacgtggccgtcttcgatgcggctcatcagccgatagccgtccagcttgagttcgtaggcccactcccctcgcggaggctgctcgaccaggctggccagctcgggggcgatccattcgggcatcggcgtcttccccccgctcttgccgagtcgcgccggcctggccgcgggcgtggcggcttcgccatggcggggcagcagcgtacgctcgctgagcacgctgtcgggacgctccttcagcacgtcgaagcgatccaggctgcgcgcctcgccgtccttggccttgaccaggaaccactggggctgcttgccgcgcaggttggtgcggatcaggtgccaacgcccggagagtttctcgccatccagggcgaagctgagatggcccttttccaggccctcgcgcggatcgtccagaggcgtccaggcgcctcggtcccagacgatgacatcgccggcgccgtagtgcccctgggggatgctgccttcgaaatcggcatagtccagcggatggtcctcaacctgcaccgcgagccgcttcaccgccgggtcgaggcacggccccttgggcaccgcccagctcttcagggtgccatccagctccaggcggaagtcgtagtgcaggcggctggcgtcgtgcttctggacgcaatagcggagcagcccggtgctgtccttgcgaggcttgcggccactgggctccggggtctggcggaaatcgcgcttgcgggcgtactcggcgagcggcttgctgctgggcatggtgggctcctcggtgctcagacgccggggcagaccggcgcgctgtgcaggaccatgtcgatggctttccccagttcctccagggtcaccggtttgagcagcaccggatag

SEQ ID NO: 8069 - DNA, 1029 bp, Pseudomonas aeruginosa
tcgagggctccccgacgctcatcgtcgagtacggcaggccattgcacgcacgcctggccgaggcccgcctgcgcgaggaagacattctcctggccgcccgcgagacccagggcctggaacgcatggagcagatccgcttcgccatcctcgagaagaacggcaagatctcgatcattcccgatcgcggcgactgacgctgcgcgcgtggcgcatcagcagcggctggatgctcagaccgtgcaagcagatgctcagggcgacgaggttcagcaccaggtcgctggcggtatgcgcgagcgccgtaggcagcccctggttcagcgcgtagctgaggtagtacaggccgccgatgccgcggatgccgaaccagccgagcaggcgccgctgcgccgggtgcatcagccgccggccgaccagcagccagaccatcgccggccgacacacgcagaacagcagcagcgccagcggcagcgcgcgccagtcccagtgctggtaggagcatggcaccgagcagggtcaccagcagcacttccagcgagcgctccagcaggttgccgaaggagagcacgtcgagcatcaccgcgccggccgccaccttcgggtgttcgctgcggtcggcgccgtactcgatggcgccgctggcctgccctgcctcgcgcacgtcggcggcggccgcctgcgcctcggccggtgccgaggcgcgccccagcgtcgccacctcggcgtggcgcaggccgatcccggcggcgaagctggcgaggaagccccagccgcccagtgcgtcggcgccgacataggacagcgcgatcagcgccagggcgaggaagtcgttggccgacaccgaggtgtcggtgtgccgcgcccgcaggtggatggccaggcggccgagaccatggcccaggcaatagcccaccagcaggccgagcggaatcgcccagagcacgtcgcgcagcagccagtccaggccgctgcggtcgaactccccgggcaggccgccgccctgaccgatcagcagcagggcggcgatga

SEQ ID NO: 8070 - DNA, 765 bp, Pseudomonas aeruginosa
gccgggtcgaaggaggcgtcgcgcaggtcgagcagggtcgccttggccttgtcggtcaggctggcgtcgtcttcgacctccagtttcttgcgctcggccaggctgcgcagttcggcgttgaccttgccgtggtcgtcgatcatctgcttggcgaataccttcacatcggcggcggtgctcttttccagcgccatcttgccggcttcgatttccgctacgccggccgccgaggcctcgctgacgaaggtctgtggcgcggtcttgttcatgtcctgggcgttggcgaaaggcagggccaggaccagcaggagccaggcggctcccttgaggggaaggctgattgctctgttcatggtcgactccgttggcgtgacagggaaaaaatgccgggacttcggcacaacgcacctcggcatcgtcgctgctgtgacggcgccgccggccgaccgttcagatttttcgccgaccgtgccaggccgggcgccctccccggtcacccctggcggctcgccagcgcctcgatccgcgcccggctcttcggccggcgtacggacagcggcggttcgacccgcatcggcggcgcgatcgcgttgccctggagatagacgtccccggtcggcagccgggcgaacgcatcgtcctcctcgagaccttccaggaccacgcagggcgccagttcgcggcacagggccagcagatggcgcagcacttcggcgcccttcgccgagcgacgtgcttcgcgggtataccggcaatcgatcttga

SEQ ID NO: 8071 - DNA, 642 bp, Pseudomonas aeruginosa
tcggcgcatcgcccgacgcgtttcccgggagcctccatgccgtcgctgtatctcgcctccgcctcgccccgtcgccgtgaactgctgacccagatcggcgttccgctgtccgtgctcgccaccgctatcgacgagtcccccttgccgaacgaagcgcccgccgcctacgtcgagcgcctggcgcgcggcaaggcggccgccgggctggctatgctggaagggcgcggcgaggacggttatgtcctgggcgcggatacctcggtggtgatcgacgggcgaattctcggcaagcccgtggaccaggccgaggggctggccatgctggctgcgctgtccgggcgcgaacaccaggttctcaccgccgtggccctggccgccgctggcggcgtcgaggcgcgggtagtggagtcccgggtgcgcttccgccaggtcgccccggaagaagcgctgcgctactggcagagcggcgagccggcggacaaggcgggcggatatgcgatccagggcctcggagcgatattcgtcagccgcatcgaaggcagttacagtgcggtggtcgggctgcctttgtgtgaaactgcggaactgttgagggaattcggcatcccttgctggcagcccgtgggtggcaacccgccgtaa

SEQ ID NO: 8072 - DNA, 1491 bp, Pseudomonas aeruginosa
  unsure (390): Identity of nucleotide at the above locations are unknown.
cgcctaacgcgccgaaataaggacagtggacgcatgagcgaagagatcctgatcaatatcacgccgatggagtcgcgcgtggcggtggtggaaaacggcgtcctgcaggaagtgcatgtcgaacgcacccagcggcgcggcatcgtcggcaatatctacaaggggcgggtggtacgggtactgccggggatgcaggcggcgttcgtcgacatcggcctggaacgtgcggcgttcatccatgccgccgagatatccaatcgcgaaggcagcgccgtggaaagcatcagtgccctggtccatgaggggcaggcgctggtggtgcaggtgaccaaggatccgatcggcaccaagggcgcacggctgaccacccacctgtcgattccttcgcgntatgtggtgtacatgccgcgcaccagtcatgtcgggatatccctgcggatcgaggacgaagtcgagcgcgagcgcctgaagaaggtggtggccgactgcgtggcggcggaaggcatcgaggggcagggcggcttcattctgcgcaccgctgcggaaggtgcgggcgaggacgagattctcgccgacatccgctaccttcgccggctatgggaccagatcgccgcgcagatccagaccgtcggcgcgccttcggtgatctacgaagacctgtccctggcgatccgtaccctgcgcgacctggtgaacccgcggatcgagaagatccgcatcgactcgcgagagaacttccagaagatcacttccttcgtcgaagaattgatgccggagatttccgatcgcctcgaacactacccgggcgagcgaccgatcttcgatctctacggcgtcgaggacgaaatccagaaagccctggagcgcaaggtactgctgaagtccggcggctacctgatcgtcgatccgaccgaggcgatgaccaccatcgacgtgaacaccggcgccttcgtcggccatcgcaacctcgaggaaaccatcttcaagaccaacctcgaggcggccaccgcgatcgcccgccaactgcgcctgcgcaacctgggcgggatcatcatcatcgacttcatcgacatggaggacgaggagcatcgccggcaggtcctgcgcaccctggagaagcaactggagcgcgaccacgcgaagaccaacatcatcggcatcaccgagttgggcctggtgcagatgacccgcaaacgcacccgcgaaagcctggtacagatcctctgcgagccgtgcccctgctgccagggacgcggcatgctgaagactgcggaaaccacctgctacgagattttccgcgagattctccgcgaggcgcgtgcctaccaggccgactcctacctggtgctggccaaccagaaggtggtggaccggctgctcgacgaggagtcgggtaacgtcgccgatctcgaggcgttcatcggccgcaccatcaagttccaggtcgaggcgatgtactcgcaggagcaatatgacgtggtcctgctctga

SEQ ID NO: 8073 - DNA, 1050 bp, Pseudomonas aeruginosa
tcggcggtccggcggtcggcggcgcggtcttcgtcgtcgacaagctgctcggcgaccgggtctcgcgcttcgccagcgtgcaatacagcgtcaagggcccctggcaggatccgaagatcagcttcgacaagccattcgagaagccccgctgagcggcgcccggtgccgcgacgcggcgctttcgtccgcaaggaggaaaccatgtccattgccgtgatccagatggtcagccaggacgacgtgacggccaacctggccgccgcccgtcgcctgctggaacaggccgccgagggcggggcgcggctcgccgtgctaccggaaaacttcgccgccatgggccggcgcgacctggccgaactggggcgcgccgaggcgcgggggaacgggcctatcctgccgtggttgaattccgccgctcgcgacctcaggttgtggatagtcgccggaacgttgccgctgccgccggatgggcaacccgaggcgaaggcgaatgcctgttcgctgctgatcgacgagcacggagagcgggtcgcccgctacgacaagctgcacctgttcgatgtggatgtagccgatgcgcggggccgctatcgtgaatccgacgactatgctttcggtcagaagatcgtggtggcggatacgccggtcggccgcctcggcctgacggtctgctacgacctgcgttttccggagctctataccgccatgcgcgaggccggcgcggagctgatcacggcgccgtcggcgttcaccgcggtgaccggcgcggcgcactggcaggtactggtccgcgcccgcgccatcgagacccagtgctacctgctggcggccggacagggtggcgtccacccacggggccgggagacgttcggccattcggccatcgtcgatccctggggccgggtcctggccgagcggccgcagggcgaagcggtgctgctggcggtgcgcgacgccgcagaacaggcggatatccgccggcgcatgccggtggtggcgcacagacgatttttcccgccggccgaaccgcggccggcgcgtacggagtga

SEQ ID NO: 8074 - DNA, 1125 bp, Pseudomonas aeruginosa
actcgctgccgtcgacgaggaaatacagcttgccgtcggtcagcacgccgtcgacgtcgaagatcgccaggcgtatccggcgggcccggaccgggagttccgcggccgaatgggtatcgctcattacatcactcctgcgcgcaacaggtcgtgcatgttcagggcgccgaccggacggtcgtccgcgtcgaccaccaccagtgcgccgatcttgttgtcttccatgatcttcagggcttccgcggcgagaatttcggcgcggacggtcttgccgtggacggtcatcacctggtcgatggtgacctggcggacgtcgatgccccgatccagggcgcgacgcaggtcgccatcggtgaaaatgccggcaagcttgccatgttcgtcgagcactacggtcatgcccaggcccttgcgggtcatttccatcagcgcgccggtcagcgaggtgccgagcagcacctgcggcagcccttcgcccacgtgcatgacgtcttccaccttcagcagcagtcggcggcccagcgcaccgcccgggtgcgagaaggcgaagtcttccgcggtaaagccgcgggcttcgagcagggcgatcgccagggcgtcgccgaggaccagggttacggtggtggaggaggtcggggccaggttcagtggacaggcttcctggccgacactggcgtccaggttcacttccgcagccttggccaggggcgactcggggttaccggtcatgctgatcagggtgatgcccaggcgcttgatcagaggcaacagggtgacgatttcggcagtcgagccggagttggacagggcgaggaccacgtcgtccttggtgatcatgcccatgtcgccgtggctggcctcggccggatgcacgaagaaggagggggtgccggtgctggccagggtagcggcgatcttcttgccgatgtgaccggacttgcccatgccgacgacgacgacccggcccttgccggccagcagcagttcgcaggccttgacgaaatcgtcgccaatccgcgccagcaggctgtctaccgcgtcgcgctcgaggccgatggtgcgctgggcggaatggatgaaatcgaggttctggctcatgttcaacgaatgtggcgcctggattaa

SEQ ID NO: 8075 - DNA, 1242 bp, Pseudomonas aeruginosa
agtctctcccctcgagcgtatccgcctgttcggccgcgccggcctggacgtggtcgccgcgctcggccgctcgaccctgttcctcggccacgccctgctcggccggcgcacgccaggcaccgggttgcacctgctggtgaagcaactctattcggtaggcgtgctgtcgctggcgatcatcgtcgtctcgggcctgttcattggcatggtgctggccctgcaggggtacaacatcctgatttcctatggttccgagcaggcggtcgggcagatggtggccctgaccctgctgcgcgaactggggccggtggtgaccggcctgctgttcgccggccgtgccggctctgcgcttaccgcggaaatcggcaacatgaaggccaccgaacagctttccagcctggaaatgatcggtgtcgacccgctcaagtacatcgtcgcgccgcgcctgtgggccggtttcatctccatgccgctgctcgccgcgatcttcagcgtggtcggcatctggggcggggcgatggtcgcggtcgactggctgggcgtatacgaggggtcgttctgggcgaacatgcagaacagcgtgcagttcaccgaggatgtgctcaacggcgtgatcaaaagtatcgtattcgccttcgtggtgacctggatcgcggtctaccaaggctacgactgcgagccgacctcggaaggaatcagccgggcgacgactcggaccgtggtctatgcctccctggcggtgctggggctcgacttcattctgactgctttgatgtttggagatttctgaatgcaaacccgcaccctggaaatcggtgtcggcctgttcctcctggccggcctgctggccctgttgctgctggccctgcgggtcagcggcctgagcgtgggcaacgccggcgatacctacaaggtctacgcctacttcgacaacatcgccggtgttaccgtgcgcggcaaggtcaccctggccggcgtgacgatcggcaaggtgacggcggtcgacctggatcgcgacagctacactggtcgcgtgaccatggagatcaaccagaacgtgaacaacctgccggtcgattccacggcgtcgatcctgaccgccggcctgctgggcgagaaatacatcggcatcagcgtcggcggcgacgaggacgttctgaaggacggcagcaccatccacgacacccagtcggcgctggtgctggaagacctgatcggcaagttcctgctgaactcggttaa

SEQ ID NO: 8076 - DNA, 681 bp, Pseudomonas aeruginosa
caaagacgaagccaaaaagtgaggttttcttccatgctgactcttctgcgtcgcggcctgctggtgttcctggcggctttcccgctgctttccatggcggcgccgaccccgcaacaggtggtgcagggcacggtcgacgaactgctttccgacatcaaggccaacaaggccgcctacaaggccgatccgcaaaagctctacgccactctcgaccgtatcctcgggccggtggtcgatgccgagggcatcgccaagagcgtgatgaccgtcaagtattcgcgccaggcctcacccgagcagatcaagcgcttcgaggaagtgttcaagaacagcctgatgcagttctacggcaacgcgctgctcgaatacgacaaccaggacatccgcgtgctgcctagctcggccaagccgagcgacgatcgcgccagcgtcaacatggaaatccgtgacagcaagggcacggtctacccggtctcctacaccatgaccaacctggccggtggctggaaggtccgcaacgtgatcatcaacggcatcaacatcggcaagctgttccgcgaccagttcgccgacaccatgcagaagaaccgcaacgacctcgagaagaccatcgccggctggggtgaggtggtcgccaaggccaaggaaaccgcgaaagcggaagaggccggggcgaaatga

SEQ ID NO: 8077 - DNA, 1506 bp, Pseudomonas aeruginosa
gagccttctccaggaaaaactccccggcacccaggtggaagtcgagggcgaagggtgcaatttccaactgaatctgatcagcgacgaactggccggccagagcccggtcaagcgtcagcagcaggtctacgcccatttgaacgcctggatcgccgatggcagcatccatgccgtcaccatgaaattcttcagccgcgccgcctgggccgagcgttcctgagcccacgggggatcattgcaatggataaactgattattaccggcggtaaccgcctcgatggcgaaatccgcatttccggcgcgaagaactcggcgctgccgatcctggccgcgaccctgctggccgatactccggtcaccgtctgcaacctgccgcacctgcacgacattaccaccatgatcgaactgttcggccgcatgggcgtgcagccgatcatcgacgagaagctcaacgtcgaagtcgatgccagcagcatcaagaccctggtcgcgccgtatgaactggtgaagaccatgcgtgcctcgatcctggtgctgggcccgatgctggcgcgcttcggcgaggccgaagtggccctgccgggcggttgcgcgatcggttcgcgtccggtcgacctgcatatccgcggtctcgaggccatgggcgcgcagatcgaggtcgaaggcggctacatcaaggccaaggcgcccgccggcggcctgcgtggcggtcacttcttcttcgataccgtcagcgtgaccggcaccgagaacctgatgatggccgccgcgctggccaacggccgcaccgtgctgcagaacgccgctcgcgagccggaggtggtcgacctggccaactgcctgaacgccatgggcgccaacgtccaaggcgctggctccgataccatcgtcatcgaaggcgtgaagcgcctcggcggcgctcgctacgacgtactgcccgaccgtatcgagaccggcacctacctggtggccgcggccgcgaccggcggccgggtgaagttgaaggataccgatccgaccatcctcgaggcggtcctgcagaagctggaagaggccggtgcccacatcagcaccggcagcaactggatcgagctggacatgaagggcaaccggccgaaggcggtcaacgtgcgtaccgcgccgtacccggcgttccccaccgacatgcaggcccagttcatctccatgaacgcggttgccgaaggcaccggcgcggtcatcgagacggtcttcgagaaccgcttcatgcatgtttacgaaatgaaccgcatgggtgcgcagatcctcgtcgaaggcaacaccgccatcgtcaccggcgtacccaagctcaagggcgctccggtcatggcgaccgacctgcgcgcatccgcgagcctggtgatcgccggcctggtggccgagggcgacaccctgatcgatcgcatctaccacatcgaccgtggctacgagtgcatcgaagagaaactccagctgctcggcgccaagatccgccgcgtaccgggctag

SEQ ID NO: 8078 - DNA, 1134 bp, Pseudomonas aeruginosa
tccggacttcgggcgtcatctggatcatctgctgagctgggaaagtgtctccgacgattcggtcaaccagcgcgtcctcgacatcatcgccgccgtacgcagccgtggcgacgccgccgtggtcgagttcacccagcgcttcgacggtctccaggccgcctcgatggccgacctgatcctgccgcgcgagcgcctggagctggctctcacccgtatcaccgtagcccagcgcgaagccctggaagtcgccgccgagcgcgtgcgcagctaccacgagaagcagaagcagggttcctggcgctacaccgaggccgacggcacggtgctcggccagcaggtcaccccgctggaccgcgccgggctctatgtgccgggcggcaaggcgtcctacccgtcctcggtgctgatgaatgcgatcccggccaaggtcgccggggtgtccgaagtggtcatggttgtaccgaccccgcgcggcgagatcaacgagatcgtcctcgccgccgcctgcatcgccggcgtcgaccgtgtcttcaccatcggcggggcacaggccgtggccgcgttggcctacggcaccgaaagcgtgccgcgggtggacaagatcgtcggccccggcaacatctacgtggccaccgccaagcgtcacgtgttcggccaggtcggcatcgacatgatcgccggtccctcggaaatcctcgtggtctgcgatggccagaccgatcccgactggatcgccatggacctgttctcccaggccgaacacgacgaagacgcccagtcgatcctggtcagtccggatgcggcgttcctggaccgcgtcgcggacagcatcgctcgcctgctgccgaccatggagcgcgccgagatcatccgcacctccctggaggggcgcggcgcgctgatccaggtcgccgaccaggcccaggcctgtgcggtcgccaaccgcatcgccccggaacacctggagctgtcggtggccgatccggaaagctggctgccggagatccgccatgccggcgcgatcttcatgggccgctacactgccgaggccctgggcgactattgcgccggcccgaaccacgtgctgccgacctccggtaccgcgcgtttctcttcgccgctgggggtatatga

SEQ ID NO: 8079 - DNA, 1095 bp, Pseudomonas aeruginosa
tgccgaataccgcatcctcgacgagaaggaggcctgagcatgagcaaattctggagtcccttcgtcaaggacctggtgccttatgtgccgggcgagcagccgaagctgtcgcggctggtcaagctgaacaccaacgagaatccctacggtccgtcgccacaggcgctcgccgcgatgcaggcggaactcaacgacgacctgcgcctgtatcccgatcccaacggcgagcggttgaagcaggcggtcgccgcgcactacggcgtacaggccaaccaggtgttcgtcggcaacggctccgacgaggtgctcgcgcacattttccatggcctcttccaacacgacctgccgctgctgtttccggacgtgacctacagcttctatccggtctattgcggcctgtacgggatcgcgcacgagaagatcgcgctggatgaaaggttccgcatccgcgtcgaagactacgcgcggcccaacggcggaatcatcttccccaatccgaacgcgccgaccggctgcctgctgccgctggacgccatcgaagcgatgctgaaggcgtcgccggattcggtggtggtagtcgacgaggcctatgtcgacttcggcggcgagagcgccatcgccctggtcgatcgctacccgaacctgctggtcacccagacgctgtccaagtcgcgctccctggccggcctgcgggtcggcctggcggtcggccatgccgatctggtcgaggcgctggagcggatcaagaacagcttcaattcctacccgctggatcgcctggcgatcgccggcgcggcggcggctttcgaggacgacgcttatttccgtcggacctgccaggcagtgatcgatagccgcgaggcgttgagcgcctctttgcaggcgctgggcttcgaggtactaccgtcggccgccaacttcgtcttcgcccgtcatccgcggcacgatgccgggcagattgcgtcgaccttgcgcgagcagggagtgatcgtccgccatttcaagcaggcgcggatcgaccagttcctgcgtatcaccatcggcagtccggagcagaaccaggcgctactggacgccctgcacttcctcaagtga

SEQ ID NO: 8080 - DNA, 771 bp, Pseudomonas aeruginosa
agaggaatttgcatggctatcgccctgagcaccctggtcgaagaggccgaccgttatctggatgccgcgcgcatccaggactactgcccgaacggcctgcaggtcgaaggccggccgcaggtgcggcggatcgtcagcggggtcactgccagccaggcgctgctggatgccgccgtggaggccgacgccgacgtggtgctggtgcatcacggttacttctggaagggtgagaacccctgcgtggtcggcatgaagcaacggcgcctgaagaccctgctgaacaacgatatcagtctgctcgcttaccacctgccgctggatctgcatccggaggtgggcaacaacgtgcagctcgcccggcagctcggcttcgaagtggaagggccgttggagccgggcaacccgcgttccatcgtcctcctcggttcgcttgccgagccgatgcagcctgccgatttcgctcggcatgtgcgcgatgcgctggggcgtgagccgctgctggtcgatgccggtcagccgatccggcgcatcgcctggtgcaccggcggcgcccagggctatatcgaccaggcgatcgccgctggcgtcgatgcctacctgaccggcgaggtttccgagcagaccgtgcacagcgcgcgggagaacggcatcagcttcatcgccgccggacaccatgccaccgagcgctacggggtacaggcgttgggcgactacctgggcaagcgcttcgccatcgagcacttgttcatcgactgtcctaatcctgcctga

SEQ ID NO: 8081 - DNA, 729 bp, Pseudomonas aeruginosa
ggaaaacgtcgccaccctgccgggcctggacgggcgcaagatgtccaagagctacgacaacaccatcccgctgttcaacccgtccaggcagctcaaggacgccatcgcacgcatcgtcaccgactcgcgcgcgccgggcgagccgaaagacccggacagttcgcacctgttccttctttactcggccttcgccagcgccgaacaggtcgccgcgttccgccaggaactgctcgacggcctggcctggggcgaagccaagcagcgactgttccagttgctcgacaacgaactgggcgaggctcgcgagcgttaccaggcgctgatcgccaagcccgacgatatcgaggacattctcctcgccggcgccgccaaggcgcgccgcatcgccaccccattcatcgccgagttgcgcgaggcagtcggcctgcgctccctgcgcgagccgctgaaaagtgccgagagcggcaagaagaaggccgccaaggctgcgcgcctggtcagcttccgcgacgacgacggcagcttccgcttccgcctgctggacgccgccggcgaacagctactgctgtcccgcgccttcgccgatggcaaggccgccggtgcggtgagcaagcgcctgctggctggcgagactgccgacctgcgggccgagggcaatgcctttggcctgtggctggatggcgaggcggtggcgcatatcccggccttcgccgacgccgccgcccgtga

SEQ ID NO: 8082 - DNA, 1275 bp, Pseudomonas aeruginosa
gggaaagcggtcaaaaggcggctggatcgtcttattttttggcgcaactgtccagtgcgtcggtcggggcatttccctacagtcgaagacctgccgcgtgcagccaacccgatcccagactgtttccaggtgaccacgatgataccgagaaccctgttcagctccgaccacgaactgtttcgcgacagcgtgcgcaagttcctcgaacaggaagccgtgcctttccatcaccaatgggaaaaggatgggcatgtcgaccgcgcgctctggaacaaggccggcgaggccggaatgctctgttcgcacctgccggaagagtatggcgggatgggcgcggacttcctctacagcgccgtggtcatcgaagagatcggtcgggccggcctgaccgggatcggtttctccctgcattcggacatcgctgcaccctacatcctccactacggcagcgaggcgctgaagcgcaagtacctgccgaagctggtatccggcgagatggtcgcggccatcgccatgaccgagccgggggccggttccgacctgcaaggggtgaagaccactgcggtactggatggcgacgagtacgtcatcaatggctcgaagaccttcatcaccaacggcttcctcgccgacctggtgatcgtggtggcgaagaccgatccgaaggctggcgccaagggcataagcctgttcgtggtcgaggcgggtacgccgggcttcagcaagggcaagcgcctggagaaggtcgggatgaaggcccaggacacctccgagctgttcttccaggatgtgcggattccccgggagaacctgctcggcaaggacggccagggattcatctacctgatgcaggagctgccgcaggagcgcctgaccgtcggtatcggcgcgctggcgtcggccgaggcggccctgcaatggacgctcgactacactcgcgagcgcaaggcgttcggcaagtcggtggcggacttccagaatacccgcttcaagcttgccgagatggctaccgagatccaggtcggccgggtcttcgtcgatcgctgtatggagcagcatctccagggcaagctggacgtacccaccgccgccatgtgcaagtactggacgacggacctgcaatgcaaggtgctcgacgaatgcgtgcagttgcacggcggctacggcttcatgtgggaatatccggtggcgcgggcctgggccgatgcccgggtgcagcggatctacgccggtaccaacgagatcatgaaggagatcatcgcgcgggccctgtga

SEQ ID NO: 8083 - DNA, 1014 bp, Pseudomonas aeruginosa
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttgggctgttctctgaagcgctggtggccatcgacggcagcaagttcaaggcggtcaacaaccgcgaccgcaatttcaccagcgccaagcttcaacggcgaatggaggctcccgcggggcgtgcgatgcaagcggtctacggcacgtcgtcgaatggacctgtgccgtctgcgatctggcggattgccggctatgtgcatgccggcctgggccgggctgaggcgtggccgtcgaaggatggttacaacgtggagccggatcgaccgatcagcaagacgtcacgcgtggtgctggtgtccgaaggtggccgtacaaggttctggccgattgagaaatgccggttcttcgaacagactcccgacctgtattgcgacatcgacggcgagcgtgtgacgttctggacgggccgaggggccgtatcgactgtgatggatgcgacaagcaccgcgagcggcggcagccagcgtagcgcagcgtccgccgcgaccggtgcgcaggtgcagaccccgcattcgtttcagccgcagcagccgtcccagggaacccgcgtgaccgtagtgtctgataacagccgctcaccccgcacgttgtga

SEQ ID NO: 8084 - DNA, 3018 bp, Pseudomonas aeruginosa
cacatggcatccctcgaacgtaccgcctaccctgtattgtcgcgctcctattcgagggccgagcttcagcgtgaattcagcttctccgaggaagaagtcacgtgggtcaaaagtcgctctaatgcagcattccgactgaatctcgctgttctgttcaagacttttcaggtactccgatactttccagaaatcgctgaagtgccggagccagttgtcgatttcatccgcacacaaataggtctacgcagcaaggttgcgctatcaccctacaagtggatgcagctttaccgccatatgagtgccgttcgggaaaaacttggggttcgaccgttctacggctcggatggtcaagacatagcatccacgcatgcacagttgatggctcccctcctcgaacagcgcgctgacattattaatgcgatcattgacgagttgctgcgccaaaactacgagctgcccgcctattcgaccttgaatgacctagcagaagccgctcgtgcagaagcacaagagaaaatcttcaaccttgtggtagccagagctccaatcaaggtgatctataagctaagggatcttctcgacacggacttcgggcgtcggcagagtgacttcaacacactcaaacaggcacccaagaaaccctcgcgcaagcatctggaggtactgatcgaccacctagcctggctagagagtttcgggaaactggatgccatttttgatgggatcgtcgatacgaaaattcgccactttgctgcccaagctgcggcgtcggatgtatctgaactgaaggactgctcgctgccgaagcgttacacgctgatgcttgctttgatctaccgtatgcgggtgcgaacccgagatcacctggccgagatgttcatccgaagaatctccacgatccacaaacgcgccaaggaggagctggagcaaatccaggcacgtcaacgtcagaagttggaacaactggcggccaccctggacggcgtggtgcagattctggttcaagagccggatgaccaggaggctggtagcctgattcgagaatacctctcccccgatggcaacatggatcggttgcgagaggtttgtgctgaagttcaggccacaggaggtaataactacttgccgctgatctggaggcacttcaagtcccatcgttcactgctgtttcgcctcagccaccttctccagttggagcccaccacccaggatcgctcacttatccaggcgcttcagctcattcaggacagtgagaatctgcaccgtgaatggatcgatgagcatgtcgacttgtcgtttgcatcagatcgctgggtgaagatcgtgcgtcgccctaccagtgaagggccgcctaccaaccgacgttatctggaggtctgcgtgttctcctacctggccagtgaactgcgctcgggtgatctgtgcgtgcagggatcggaatccttcgccgactaccgtaaacagttgctgccttgggaagagtgtctccagcggctaccggcatactgcgagaaggtgggccttcctaccacagcgaaggagtttgtcgcctcgctcaagagccagttggaggaaaccgcgcaacagttagatgacaagttcccttcctgtcgaggggatgtgtcgatcaacgatgcaggcgagccggtactgcggcgggtgatggcgcgggacatcccgccttcagccatctcgctacagacggcgcttatgcagcgtatgccagccaggcacgtgctggacattatggccaacattgagcactggattcagttcacgcggcatttcggaccgatgtccggcaacgagccaaagctcaaagagccggccgagcgctacctgatgacgatcttcgccatgggctgcaatctcggtcccagccaggccgcgcggcatctggccggtaatgtcacaccgcatatgctgtcctataccaatcgccgccacctctcgctggagaaactggacaaggctaatcgcgagttggtggagctctatctgcaacttgacctgcccaagctttggggcgatggcaaagcagtggccgcagacggtacccagttcgacttctatgacgacaacctactggccggctaccacttccgctatcgcaagatgggggccgtggcgtaccgacacgtggccaacaactacattgcagtgttccagcacttcatcccgccaggcatctgggaggcgatctatgtgatagagggactgctcaaagtcagccttagcgtcgagcccgatacggtctactccgacacccagggccagtcggccacagtattcgccttcactcatctcctgggtatcaatctgatgccgcgtatccgcaactggcgcgacctagtgatgtgccgaccggatcgaggcgtatcgtacaagcacataaaccgactgttcaccgacactgccgactggcacctgatcgaaactcactggcaggatctgatgcagattgcgctgtcgatccaggccggcaagatttcctcgcccatgctgctacgtaaacttggctcttacagccggcgcaacaagctctacctcgcagcacagacgctgggcagtgttatccgcacgattttcctgctcaattggattggcagccgagagctgcgccaggaggtcactgcgaacaccaacaagatcgagtcctacaacggcttctccaagtggctctctttcggcggcgatgtaattgccgaaaacgatccggacgagcagcagaaacgtctgcgttacaacgacatggtggcttcgtcggtgattctgcagaacaccgtggacatgatgcgcatcttgcagaaactagcccgcgaagggtggcagtttaccgatgaggacgtgtcctttcttagcccctacctgaccagtaacgtcaagcgtttcggcgagttcaaccttaagctcaaccgaccgccggagccctggatcaaggattcggtattccaacaggctgccggctcgttgcgagtcaactcgaccagtaaggccgcggccgaggaggcaatatga

SEQ ID NO: 8085 - DNA, 1011 bp, Pseudomonas aeruginosa
gagcagaccatggcccgcggcggcatcaacaaggcgctggttcagaaagcccgccaggccatcctggcgcggggtgagaatcccagcatcgacgcaatacgggtcgagctgggcaataccggctcgaaaaccaccatccatcgctacctgaaagaactcgaagacgccgaccgcggccggaacgcggccgcattgccgctcagcgagcagctggccaacctggtggcccagttggcggatcagctcaaggaggaagcgcaggccgacgtggcccaggagcgcgagcaactggcacgggaacgactcgattaccagaaccagattcggcaggccgaaagccgtatccagcagctggaaggtcagtgcgctgggctcacggagcagttccaggctgcccagcaagcactgctgcaggaacaacagctgcgccaacaggccgaggtcgagaatgcccgcctgcagcaagccaaccacgaccaggaagcgcgcctgcaagaccgcgacgggcagattcgctcgctggaggacaagcatcagcatgcccgtgatgccctagagcactatcgccaggccagcaaggagcagcgtgagcaagagcagcgccggcacgagtcgcaggtacaacaactgcaactggaactgcgacagctacagcagaccctgatcgtcaagcaggacgagctgacccacctgaaccgcgacaatgcgcgcctgcttgccgaggcgcggcagcagcagaaggatcagcatgcgcagcagaagctactgacgcagaaggctcaggctctggaggtcgcccagaacacgctgaccagcattgaacgtacgaatgaagccctggagcagcgctgccacgctctgcaggatgaggtgacccggcttggtgaagcctcctcgattcaggcacagcaaacccagagcctgcaggagcgtctggctaaagccaccgcgcaactgaaattgctcgggcaggcaccgcccacgagcagcggtggcgcaagtagctcatga

SEQ ID NO: 8086 - DNA, 969 bp, Pseudomonas aeruginosa
gatagatcgattcattcttttctcccgacccttggcccctgccaaactcccttcgccacgggatacccccgcgccgacatggcggcattcccatccggaatgtccgccccacattgcaaggccctgatcgtcgatcgcggccgacaaggagctggaactttcatgaagaaactccccgccatcaccgccctcgccctcgccctgatctccggcctggcccaggccgaccgcctggaggacatccgcaaggccggcgtattgcgcgtcgcgtccttcgacagcaacccgccgttcggcttcgtcgacgccaagagcaagcagatcgaaggcctcgacgtcgactatgccaaggccctggccgacaagctgggcgtccggctgcaagtgctgccgaccaacccggccaaccgcatcccgctgctgacggcgaacaaggtcgacctggtcctggccaacttcaccatcaccccggagcgtgcgcagcaggtggacttcagcatcccctacttctcctccggccagcagttcatcgtcaagaaaggcaccctgacctcgccggaagtcctcaacaagtggcgggtcggcgtggacaagggcacggtcaacgaaggcgtgctgcgcgagaagttccccggagccaaggtcatcgcctacgacgacacgcccttcgctttcaccgccctgcgcaacggccaggtccaggccatcacccaggacggtccgaagctgatcggcctgctggccaacgtgcccgaccgcgacaagtacgaagtgccgcccttcaccatttccaacgacctgatcggcgtcggtattcccaagggcgagaagtccctgaccgagttcgtcgacaagagcctgcgcgagctggagcaggacggccaggcgcagaagatctacgacacctggttcggtccgcagaccaagaccccgctggcgcgcctgtacaagatcggcgacaagagctga

SEQ ID NO: 8087 - DNA, 738 bp, Pseudomonas aeruginosa
  unsure (103): Identity of nucleotide at the above locations are unknown.
tcgaagctttcggccaggcgttgcagcagacccgccgctaccgccagggaggtgcctgagatggatttctcggtcatctcggacaacctgtcatacctgctgntcggcgcatacccggacggcccgctcggcggagcggcgctgaccctgctgctggcgtcgctctccggactggcttcggcggtgctcggcctggtcctcggcgtggccctcgcggtgctgcccggcaagccgcgcctgctgctggtggcgctgctcggcttcttccgcgcgatcccggtgctgatgctgatcttctggacctacttcctgctgccgatcgtcttccatgtcgacgtaccggcgctggccaccgtggtctgcgcgctgtcgctgatcggcggcgcctacctcgcccactcggtgtacgccggcatccacagcctccccgccgggcagtgggcggccgcccgcgcgctcggactgcggccgtggcaggtattgcgcctggtgatcctgccgcaggcgctgccggtgatgctgccatccttcctcaaccagtgggtgtcgctgatcaaggacacttccctggcctacgtgatcggcgtcggcgagctgtccttcgtcgccacccaggtgagcaaccgggtgatggtccacccgacggagatcttcctgttcgtcgccctgctctacttcctgctctgcaccagcctcgacctggccgccgcgttcctcgcccgccgccggcgggcctga

SEQ ID NO: 8088 - DNA, 1506 bp, Pseudomonas aeruginosa
accagtcgtctagaaacaattcgaagccatgagtatagcgccgacggcaactgcgccgctgtcgggaaccgtgcggaacggacgccggtccggcgcccgccccgctccgcggatttacccctcgcggacctagcaggccgcgaccgccacggcggcaggctccggctggaagcgcgcggcgaggaacggcgcgatgtccagcggcagcgtctcttcgtggaccagccggtcgagcagcaccccggtgatcgccgacgtgaggatgccggtgcggaaatgcccgcaggcattcaggtagccctccacttcagccaccggaccgagaatcggcagttcgtccggcgagcccgggcgcaggccggcccaggtgcgcttgaggttgacctgttgcagctccggcacgcaacgcaccgcgccctgcaccaggccggcgatttccgggaaggtgttgctgacgtcgaagcccttgtcctcggtggtgctgccgatcaggatctcgccattgtccttctgcgccatgtagcagtcgctggtggtcaggcaaccgttcagcagtcgtggcatgcgctcggtgaggacgatctggcccttcaccggcttcaccgggatgcgccggccggtggccatttcgctgagttccgcggcccaggcgccggcggcgttgatcagggtccggcaatgcagcaccccggcattgtccgtgcgcaccccgctgatccgccggccctggcgcagcacgccggtgacgttggttcccggcaacagctcgacgccgttctggcgcgccgcctccaggtaggcgtcggccaggcggaacgggctgacctggtggtcgcagaggaattccagcgcgccgtgggccgcgtggctgaccgccggctcggcacgacgcagttcctcgcggtccagccagcgcacctgctcggccagatgcgggatctgcgccacgatgtgctcggcgtactggcgatcctcgtcgtcctggatcacgtatttcagcccggtgcgctcgaacttgaagtccatcccgtggcgttcgatcagttctcggtgcagttccgggtacagcgcgttggattgcagggcgaggtcgaagaacgccggcggcaggatgtgcggcgtgctcgcgtccaccgccaccgccgcgccctgggcctcgcgccggttgcgggaggacatcatgcggaagaagatcaccccgcagcccagtcccaccgattcgccgatggcccagaggccgccggccgaggcgcgggtggcgttgcccgggcgcttgtcgtcgaccacggcgatgcgcaggttgccgcgcctggacagttggtaggcgcaggacgcgccgatcacgccgccgccggcaatcacgatgtcataggttctgttcatgttcaggcttccgtaccgaggttctggaatgcggaaaacgggatcggatcgatcgggaaacgcggccgcagccagccgacgtcgtggcgtccggtggcgcggcgcaggcgatcgctgcagtag

SEQ ID NO: 8089 - DNA, 1347 bp, Pseudomonas aeruginosa
gccatcgtcgcgacgaatggcacccagggagcgagggcctgcgttcctcgccggcctccacgactcaacgtggtgcagtggcctccgggggccggtatcgagcgccacccatcccgccgaatgaactccggtgctgctgcgcacgccccacctgcacgacccacagccaggagcaatgccatgcgcgccctcaccttccacggcagccacgatgtccgtatcgatcgggttgccgaaccgcgcctgcaggaacccgacgacctgctgcttcgcgtgaccgccaccgccatctgcggctccgacctacatctctaccggggcaagatcccgatggtcgagcagggcgacatcctcggccacgagttcatgggcgtcgtcgaggaagtcggctcggccgtgaccgcggtgcgtccgggcgaccgggtggtggtgcccttcgtcatcgcctgcggcgagtgcttcttctgccgcctgaacctgcacgccgcctgcgagaccaccaacccggggcgcggcgcgatcctcaacaagaagcagattccgccgggcgcggcgctctatggctacagccacctgtacggcggcgtgccgggtggccaggccgaatacgttcgggtgcccaaggccaacagcgggcctttcgtgattcccgacgtaatggaagacgaacgcgtgctgttcctcagcgacatcctccccaccggctaccaggcggtgcgcaatgccggcgtccgccagggcagtagcgtggcgatctacggcgccggcccggtcggcctgatggccgccgcctgcgcgcggatgttgggcgccgagcggatcttcatcgtcgaccaccatccctaccggctggacttcgccgcgcgcacctacggtgcgattcccatcgacttcgaccaggaggacgatcccgccgcggcgatcatcgagcgcaccgacgggcaccgcggcgtcgacgcggtgatcgacgcggtgggctttgaggccaagggcagcgtcaccgaaaccgtgctcaccgcgctcaagctcgaagccagcagcggcaaggcactacgccagtgcatcgcggctgtccggcggggtggcacggtgagcgtgccgggcgtgtatgccggcttcatccatggcttcctgttcggcgatgccttcgacaagggcttgaccttcaagatgggccagacccatgtacaggcactgctgccggccttgctcgaacacatcggcaacggcgacctgcatcccgaggcgatcatcagccaccgcctgcgtctggacgacgcaccggagggctacgccctgttcgacgaaaaacgcgaggattgccgcaaggtcgtcctgcgcccatga

SEQ ID NO: 8090 - DNA, 540 bp, Pseudomonas aeruginosa
gcagacacatacacaccgaggagaaccgcgatgacgagcaaacaggaaaacctgctggactggctgcgcgatgcccacgccatggagcaacaggccgagcagatgctgaaagcgcaagccgcgcggctggaacactatccgcaactgaagacgcggatcgaacagcacatcgaggaaacccatggccagcagcgtctgctcgaggagtgtctgaagcgcctggacagcagtccgtcgacgctgaaggacatcggcgccaagctgatggccttcggccaggcggtggctggcatgacagtcagcgacgaagtggtcaagggcgccatgagcggctatgtgttcgaaaacatggagatcgccgcctacaccgtgctgatcgccgccgcccgcgaggtcggcgacgccgaaacccttgccgcgctggaacgcatcctgccccaggaacaagccatggcggactggttgcgcgaccatctgccggaactcacccaggccttccttgcccgcgactctcagccggacaccgaggccaagcgatga

SEQ ID NO: 8091 - DNA, 444 bp, Pseudomonas aeruginosa
gcctggccgccacccatgacgacgacctgccggaggaccccgccgattggccggcctggctcgacgccggggcccggcgcaccgccgaggcgcatgccgaatacctccgggcacgtcggcgcggcgaagggcgacgctacttccaggttccctcccaggcgatgcacttcattcgcagcgtggccccgaccaagctggtcgacggcgcctggctctatgggctgttgccgcatcatggcgaggaacgcctgcggccgctgctggagaccttcctcgaagaactcggcgacggcgtcccggcacgcaaccacgtcctgctctaccggcgcctgctggccagcatcggcagcgaggaagtcgaaggcctcagcgacctccactacctgcagggcacccagcaactcgccctcggccacctcgccgcggactacctgcccgaagtga

SEQ ID NO: 8092 - DNA, 1026 bp, Pseudomonas aeruginosa
tggccccgcacctccaccacggacccgccggtctccttgccacgcggatgttcagccagcgctggagggccgcccatgcccagcctgaatgatccgcgcctggacgtcctggtcagcctcggcaactggttgcgaggccaggactaccgtttcgtcaccgtcaccccggctacccatgagcgcgtcaacgcccgcccggaaaaccgcatggcccgggacctggccggcatcttcggctggagccggccattcgccggggaaagcctgccggccgactggctgacccttcttgccggcgccgacctgatccgccgcgaggcggacggctggcgcagccaggtgcgcgtctccagcctcggcgagcaactgttcgtccattcggccttccctaccctggccgccgacgcggtgttcttcggccccgacacctaccgcttcgaccggctgatccgcagccacctggcatcgtccgatccggcacgcatccgccgtgcggcggatatcggctgcggcgccggccccggcgcgatccgcatcgccatggcctgcccggacgccgaagtacacgggctggatatcaatccggcggcgctcgacctggcgcgggtcaacgcggcgctggcgggggtcggtaacctgaccctggcgcgtagcgacctgctgagccaggcgcccggtcgcttcgacctgatcgtggccaacccgccctatctcctggatgcctcggagcgcgcctaccggcatggtggcgggatgctcggcgccgggctctcgctggcaatcgtcgatgccgccctcgagcgcctggaagccggcggcagcctgctgttgtataccggggtggcgatggtcgaaggcggcgatccgttcctcgcccgcatccgcgaacgcctggcgtctcgggagtgggactgggactaccaggaactggacccggacgtgttcgccgaagagttggacagccccgcctaccgcgaagccgagcggatcgccgtggtcggcctgcgggtcactcgtcccgcctga

SEQ ID NO: 8093 - DNA, 975 bp, Pseudomonas aeruginosa
ggcgctccaggccttccaccagatcctcgttcaggcgctgccagcgctcggccacctcggcctcggccggaatcaccgcgaggacctcgccatccacccactcccagggcaggcacaggcgttccgcctcggcccggctggcggcgcgcacggtgcgggcgaaacgccgccagccgcgcatgtgctggatttcgtaggtggtcatgggctcctccggaagacagggacgtttgtctttcggcgctccccgcgtcttccggttcaaggccctggatgggcggtcgcggaccgcccggcacgccacctgaaccccctcgcgccgggccggtccagactcctgaacgccacagaaaagaggtgcccgtcatgacccgcgaaatggctcggctactgatcagtccctccaatgcctggcctcgtctgcgccaggactacgaccatcaccctttcgccttcctcgttccgctgttgctattgccgctgctgccggcggcctgcctgttcatcggcactacccaggtcggctggtcgctgccgggcaacgacagcgtgcaacacctctccagcggcagcgccctgctgctggcgacgatgtgttacctgggcttcgtcgccggcgtggtgatcatgggcttattcgtacgctgggtgctgttccgcacgccgtcgcgccccagcgtaccgggcagcctgaccttcaccacggcgatcgccgtgcccttgatgctcgccgggatcgtcgccctggtgccctggcggatcctcctgctgctggccgcggcggctgcctgcgcctactcggtacgcctgctgttcaccggcctgccgctgttcatgcgcatgcaggagcggcagacattgttctacgccttctgcatcctcggcgtcggcttcctgaccctgctgaccaccgccttcatcttcatcgagctctgggggcaaagcctggccggcagcggcgagtacctgcgctga

SEQ ID NO: 8094 - DNA, 3162 bp, Pseudomonas aeruginosa
ggctcagccggccttcagcgtgccggtcaggaacaggtacaactcttcctggccgaacggcttggccagcttgggcaactgtgccgccgcgccttcgatcttttccgcgaagccggtggccagggccatcttcagcggccggccctgggccatgacccgctccaccaactggctgccgttcatccgtggcatcgcctggtcggtcaggaggatgtccagctccggcgtcgccgtgagaatctccagggccaggctgccggagtcggccttgagtaccgagcaaccgaggtcctccagcatcgccgcggtgttgttcaacaccagcgggtcgtcgtccaccaccagtactcgacaggacaagcgcacccgctcgctttcgctgggcggctgcggcgtcgcgccattgcccgtacgggcgctttccggggttcgcgggacggcgggtatccagatgttcgcggtggtgccgacgcccggctggctctccagggtgagccggccgccgagctgctcggcgaggccgtcgacgatcgacaggcccagcccggtgccacgcccaattcccttggtggtgtagaagggttccaccgcacggcgcagggtttcctcgtccatgccgctgccggtgtcgctgatgctcaggcagatatagttgcccggtgcgaggcgatggggattgtccgccggcacccgctggttgctcgcggaaaagacgatgcgcccgccgttgggcatggcgtcgcgggcgttggtggcaaggttgatgatggacagttcgagctggttggcgtcggtcaggccgaggtcgagatccaggggaaagcgcgtctcgatcgatacgctcggtcccagggaatggatcagcaggtcggtcatcccgcgcaacaggtcggggatcgcgcagggctgcggatcgagacgttgcttgcgggcgaaggaaagcatccgctgggtcaggttggcgccgcgctgggcggcctccagggcgttctgcaagaggtcggcggtgcgctggtcgccgggcaggcgtttcttcagcagcccgaggctgccgatgatcaccgtcagcaggttgttgaagtcgtgggccacgccgccggtgaggtgccccagggactccatcttctgggcctggaacagctcctggcgggcccgttccagttcgcgttcggcttcgatccggtgggtgatgtcacgggttaccttggcgaagccgatcagccggccatcgctgtcgcggatcggatcgatcaccacgttggcccagaagcgactgccgtccttgcgcacccgccagccttccttctcgaaacgcccttcgcgttcggcggcggccaggccgcgggccggctcgccggcctcgcggtcttcgggggtgtagaagcaggagaagtgccggccgatcacctcttccggcaggtagcccttgatccgctgggcgccgaggttccagttggtgatccgcccgcggtggtcgagcatgtagatggcgtagtcggtaacgctctgcaccagcaggcggaactgctcctggctgcgccgcagcgcctccttggccgcgcgcccttcgctgaggtcgtggatcagctgggcgaagccgagcaactggccctggctgtcgcggatggcgtcgatcaccacctgcgcccagaatcgcttgccgttgctgcgcacccgccagccctcggtctcgaagcggccctcgacatccgcctggcgcagcgcctgttgcggaacgccggcgtcgcggtccttgcgggtgtgaaagcaggcgtagtcgcggccgaggatctcgctcgcgtcgtggccgaacaggcgcgccgcgccggcgctccagctggcgatacggccagcgctgtccagggtgtggatcgcgtagtcgtcgaccgcttcgtcgagcaggcggttgcgcgtggcctggttcaaggggactttcggttttcttgtggttttcatggacgtgttcactcgtcggctgctcgacccgggctgcaaggcacacccagcaaggtagtacgaagaacgtcttccggccgctcgctggctcgccccaggaacttggccgacctttcggaagaccccggcgcggccggcgaattccattcgccggaaccttgtccggagtatggctttcgatatgcaggtagggacatctcctttccaccgcaccgaccccggagttcccatgcgcaatctggaaaccgcaaccctgaagctggggatattccatccccacgacagcctgagccaggcgctgatcgccgccgccttgcagcgacagatcgaagtcagcgccttgcaagccgatctcaacagcctgcaggcgcgccccgggctgcgctgcaagccagccagcctggcgtcgtcgatcgaggtcagccaggcggctgccggtctcgacctgctgttcgcgccgttgtccgactacgccgccgaagccttgccgccgatctgcgccgcgctgatcgatggcgccctgcgcgccgaggtaccgcgcctgttcctgcttggccattggcaatggctggtggcgccgcgcgatgccggcgaggagcaactgggtgccgggctcgagcgcagcctcacggtcagcggcctggactggacgctggtggaggtcccgagcctgcccgccggcctgcgcatcgacgatttcagccgcgccggcgacgtcgcggaagtggaggccgccagggtgttcgcctgcgccgaagcgctgctcgacgaagtccgtctcggcctgcacaagcgccagtgcctgcgcctggcgccctgaggagaaccagccatgtccggacccgataccctcagccaggccttcggcaccctgctgctggccctggccttcagcgccttcatcgttttcgttcgcggctaccgcccgggcggggtcagcggcgcctggtacgacctggtgctcgccttcgtcgcggtatggctggcgttctggcccgaagccggcgtactcgcacgctcgccgagcctggccaatgccctggggttggtcttgcaggtcggcgctaccctgctcggctgcctgcttggctacggggtggcaaggggattgcggcgggcgatgcgggaaacccggcaaaaaagatcggcttcttcgccaacgagccggcgaggttcctagaggaaatatcgagaaaatccatataa

SEQ ID NO: 8095 - DNA, 1650 bp, Pseudomonas aeruginosa
tcaggaacagatggctggccatcgtctcgccctcctctcttcgatgggccctgcgccaggcgcagggcccatggctatcacggcaggttcggcggcagttcggcgtccagcgcagcgtcctgccgcgagtcgtcgcgctggcgctcctgcaggcgctgcaggcggcgggtcaggtgctgcacctcctcgcgcagcaactgcaactcttcccgcggttcattgagcaggcccttgacatggcaatgcccactcaacccgcggctgaccagcaggccgccggcgaccgccttgcaggcgcgtggcaagccaccgcgggccaggccgaagccggccaggaccagtccggcgccgatggaagcgagtcgctcgccggcgctgcaggttgtgcggcaggccattgggccgtcgaagtgggcaggtattcgttcatggaattctccttgcgtcggttatcggtcaggcttcgtcgtccggcggttgcacgaggaactcgaccagcgtccgccggcaagcctcgatgccctcttccaggacgatctcgaaaccgtgtgtgttctcggtcggaatgccgatgcagccgacctgcgcggcctcgccgtggctcagcagcgcgctggcgtccgaggcgaagtccaccagcagcgccgcctgcggctggtactggcagcgttcggcggcgcgcaacaggcggtcggtgacatggcggctgtaataacccttggagtcgccgctgttgacgatcgggtcgcggcacagccgggtgccgtattcggctaccgttgggccgacttccaccgcgatgctgatgtcgcccggcagtcggcgcgcggcgaacagcgcgccggcgttactctcctcctccatggtggtgagcaccaggtagaggtcgccgtgcaactcatcgcggcgccgggcgatctcgcgagccacgccgagcactgcgagcagcggtgcgcggtcgtcgaggaagtgcgcggcgacgcaatcctggaagtacaacgggcgccgccacagacggttgagcaccacgcgggtacccggtcgcacgcccaggttcgccagctcctcggcgctgcgccgggtgaccacgtgtacgtcgcgccagtgcaccgcgcccgagagcacgtcggagccctgcggcgactcgccggtagcatgcatgctgccgtaggacagcacgccgtcgagtaccgcctcgccggccaggatctgtaccggacagacgccgaagctcaccggctgggcgccgccgagcgccactacgcgcagggtaccgtcggcctcgacgcgcttgacgatcatggcgatctcgtcgaggtgcgcgagcagccgcaccgcggcccgccgcgcctgctcgcgcggcaggtgcggcgggctgatgcgcgcgaccaggttgccggcggcatcgctgccgacctcgtcgcaacagccctcgagttcccgctggcagatggccctgacctcgtcttcctggccaccggggccacgtgccagcaggagttcctcgagcaaggcgcggtcttcttcgcgcatgcctcaggccgcccgtttttccaggcgcgctttcagctctttcttgtgctgctgcatggcctggccgagttgcttgagggcggcggcgtcgagcaattgccgggcgcgtgggaatag

SEQ ID NO: 8096 - DNA, 1386 bp, Pseudomonas aeruginosa
ggaaggtgccttcgatccggtcgtcgccgaccccgatgcggatgcgttcgctgttcgccgtcatgcctcccccgtcatcgcatacttgagcaggaagtcgccgtgttcgtcgggaccgcggtagatcacccggctgttgtccggcaggcgcttgtcttcgtggatctcgaacgacgcggcgcgcaccgcgggcagccccggatcggcgcggaaggcttccagcgcggcgatctcggcgctgctcgcgccgccgacccgccaggactgctcgagcacgccgaagcgctcccgaccgttgccatcccggccctgggcaatgtcgtagttgcgccgcgaggcgaagcagccggggaagaagatcgccgcggcggtgtcgaagatccgcgcgtactcgatggcctggcgcacctcgcgggccaggtccagggccagcagctcggcgtagccaccgcgcgccaccagcaggtcggagccggcatagaccagttcgccgcgcgcgttgcgggtctggtgctggtgaccgtggtagctcagcaggaaaccgttgacccggagctggccgacgctgtgggtgacgatgctctccaggttggcttccagtaccaggccctgcgccaactgacgctcctccagcccgccgagccaagcgtccagttcgtcgaggtcgtgcgccacgtactggccgaggccgccacaggcctccgccagcttggcccgcaccggtccttcggcgagcatgcgagcgccggcgcggtgtgcgtcggccaggctgaagacgctgacgccattgagcacgacgtcgcggaccttctccgcgaacagcgggttccagccttccggcgccacgccgccgcgcggcagcggatggacgatggccttaccggcgatgaacgcgtgctcgacgaaaccgccgagcagatcttcgtcactgttcacgcccaggcgcacggcggtctccctgccgaccagggtgcgggtcgggaccaggtagagggggcctcgctggtgcaattcgggttcgtagcggccgccgaactccagcttctggacttccgccagccagcgcgccagggccaggttgccctgcacttcgtgttcggcggccgcgggatcgacactatgggccaccaccagtctctgccgagggtctgcgctcatgttccgctcctcctggatggaaaccgggcattcagggctccggtatgggcgagaggggctcttcgttgggctgttccatcggaatctcttccgggaattcctgggggacgtggctttcgtggtcaggaaccggatattcgtccggatccctcgaggggttgcgtggagtggtcgctgtcgcgcccgatgatgcagaagtgggaaaacgcatgtccgcctccatcgtag

SEQ ID NO: 8097 - DNA, 1650 bp, Pseudomonas aeruginosa
acttccggcgctcccctccggtcacccctagcaaggacttcgcccatgccacggcgcgacggagtccgaccgaccaacgccaaggacaacgtacgaccggaggatgacatgggacattctgttgcaggcgtttgcctggaagaacccgcggtactgaccgcttttccgtcgctgctgcacccgcaggacccgccgcaacagagggatcggatactcttcgttaccgccgagctcagcgatttcgtcaaggtcggcggactcggcgacttttccgccgcgctgccgagggtcctcaagcgcgagcattcggtgcgagtcctgctgcccggctatcgccaggtgctggagcgctgccgcgacttgcggatcatcggcagcctgcccggccgggcggcgatcccgccctgcgagatcggcctggtgaccctcgacgacggcctggaagtcatgctggtgctctgcccgctgctctacgagcgcgagggtacgccgtacatggacgaccagggcaacgactggccggacaaccacctgcgcttcgcccgcctgtgcctggccgccgccgagatcgccggtggacgcggcgcccagggctggcaaccgggcctggtgcacgccaacgactggccgtcggcgctgacgccggcctacatggcctggaacggcgtgcgcacgccgagcctgtttaccatccacaacctcgcctaccagggcctctgcgacctgcaatgcagcgccgaactgggcctccccgacgaagcgctgagccacgaaagcatggagttccacgggcgcctgtcgttcctcaaggccggcatcgcccatgcccaccacatcaccacggtgagcgagacctacgcccaggaaatcactaccccggaatacggctgcggcctgcacggcatcctcaagtacaaggtcgagaagcgtcagctcagcggcatcgtcaacggtatcgacgatagctggcagccgcactgcgatccgcacctggtggcatgcttcagcgcccgccaatgggccggcaagcgcgccaacacgcgctacgtggaggagcgtttcggcctggagccgggcaaggggccgctgttcgcggtggtctcgcgcctggtgcagcagaaaggcatcgacctgaccctggagatcagcgatgccctgctccaggccggcggccgtctggtcagcatcggccgtggcgagccgaacctggagaaggccatgctcgaactcgcccggcgtcatcccggccaggtcggcgtgcacatcggtttcgacgagaccgaggcccgccgtatctacgccggcagcgacttcctgctcatgccctcgcgttatgagccctgcgggctcagtcagctctatgcgcaatgcttcggctcgctgccgatcgcgcgctgcaccggcggcctcgccgataccatcgtcgacggggtcaccggcttcctgttccgtgaggaaaccgcgcagagctacctcgatgcggtgatgcgcgcgatcaacgtctaccactgtccctcgctgctcaacgccatgcgctgcaaggcgatggccgcgccgatgttctggagcgactcggtggagccttacaaccgcctgtaccggcgcctgttgaggaataccgctccggccctgcgcggggtacgccagtga

SEQ ID NO: 8098 - DNA, 477 bp, Pseudomonas aeruginosa
tgtggctgctcgactatcgcgtcgacggcctgcgcttcgatgccgtgcacgcgattcccgatagcgcgttcctcgtcgagatggcccgccgcctgcgcggcgccgccggccccgagcgccatgtgcacctggtcctggagaacgacgacaaccgcgccagcctgctgcgccagggctacgacgcacagtggaacgacgatggccaccatgcgctgcacgtcctgctcaccggcgagaacgacggctactaccaggactaccccgagccgctgcgctgcctggcgcgctgcctggccgaaggcttcgtctaccagggcgaagccaaccgccacggccggccgcgcggcgaaccgagtgccgacctggcgccggacgccttcgtgctgtttctgcaaaaccacgaccaggtcggcaaccgcgccttcggcgagcgtctcagcgtcctcgccgaaccccaggcgttgcgcctggcgatag

SEQ ID NO: 8099 - DNA, 795 bp, Pseudomonas aeruginosa
gtccccgcagcatcgcggtcagcctggagcccgcccatgagtgacgcacgcctggccgaactggccgccgccgtgggcctgcaactcgactggcaggacgccaacggacggccgcagcgggtcgacccggaggtccagcgcggcctgctggaagcactcggctatccggcgcagagtccgcaacagatcgaacagagcctggccgcgctggcccggctgcgcgaggacagcgccaacctcggactgctggtcggcgaatgcggccagccgctggagcaagcgctcggccccgccggcaccccgggcgagctggtctacgaggacggcacgcggatcgccctgcgcctggatgccgaaggccgcctgccggcgcaggcccgcagcggctatgcgcagctgtcgctggagcagcgggaatgggcggtggcgatggcgccgccgagctgtccgtccctggccagcctcgccccgggtcgctcgcgtcgctggggtctggccgcccagtctatgccctgcgccgccccggcgacggcggcctgggcgacagcgccgccctcgaggacctgctgcgcagcgccgcgcggcatggcgccgacgcgctggcgatcagcccgctgcacgccctggccgaggccaacggacatgcctacagcccctactcgccgtccagccggctgttcttcaatgtcctgcacgccgcgccggcgaccattctcggcgcggcagcggtggaacaggcgatccgtcgcgccggcctggccgcggagatggcccgcctggagagcctggagctga

SEQ ID NO: 8100 - DNA, 3453 bp, Pseudomonas aeruginosa
tcccgcgcggccagccgccccacgccggcgcctacctgcgctacccgcaacgcgagctgctgcgcctgctggcgctggaggccagtcgcgcctcggcgctggtcatcggcgaggacctcggcaccgtgcccgaaggcctgcgcgaggaactggcacgccgccaagtgctgggtacccgcgtgctgctcttcgagcggcgcggcgaacgcttcgtgcccccggcgcaatggccggcggacgccatggccaccaccagcacccacgacctgccgagcctgtccggctggtggcggggccaggacatccactggcgcggccgcgccggacaccgcagcgccgaggaatgcgcggccgacctggaactgcgcgccgaggagcgccgggccctggccgccagcctcgaaccgccggtcgatcccgaccccgccgccgaagtaccgctggacgcctgcatcggctatgtcggggcaacccccgcgccgttggtgctactgcccctggaggacgccctgggcagcctggagcagccgaacctgcccggccccggcgacgcccacccgaactggcggcggcgctggccggaaaacgccgcgcagatgctcggaacgccgcaggtcgaccggcgcctgcgcctgctcgaacgcagccgccgggatgccgaggaggccgcccatgattgagccccgcgctaccctgcgcctgcaattccacgccggcttcaccctcgacgatgccctgccctggctggactatttcgccgacctgggcatcagccatctctacgcctcgccgctgttccgcgcgcggcccggctccagccacggctacgacgtggtcgacccgacccggatcaatccggaactgggcggcgagccggcgctgctgcgcctgatccaggggctgcggcaacgcggcatgggcctgctcatggacatagtgccgaaccacatgggcatcggcggcggcgccaatccctggtggcaggacgtgctcgaatgggggcgcgagagtccctacgcgagtttcttcgacattcagtgggaatcccacgacgccgcgttgcgcggccaggtgctgctgccgttcctgcgcagcgactacggcgaggtcctggctgccggggagatcggcctgagcctggaccgcgaggccggccgcctgctggcgagccacggcgagcagcgcttccccctctggccgggcagttacccggagctgctggaagacagcggcgagccgcgcctgtcagccctggccggcggtttccgcgagtgccggcaggaccgcgaggccttgcgcgagatgcagcgtcaactggcggctgcgctcgccgagagcgctccgcgcgcagccctccagcgcacgctgggcgaactccaggaacgccacgaggaggctcgccaacgcctgcaccgcctgctcgaggcgcagcactaccgcctggccagttggcgcaccgcggcggacgacatcaactggcgccgtttcttcgacatcagcgaactggtcggcctgcgggtcgagcgcggcgaggtgttcgaggccgtgcacggcaaggccttccagttgctcgaggacggtctgctcgatggcctgcgcatcgatcacgtcgacggcctggccgatccgcgcggctattgccgacgcctgcgccgccgcagcgagcggatccgcgcccgtcgcggcggcgcgccgatgctgctgtacgttgagaagatcctcggtggcgaggagcgcctgcccgaggattggctgtgcgacggcaccaccggctacgacttcatgaaccaggtcagcctgttgcagcacgatccgcgcggcgaacgaccgttgcgcgaactctggcagcgggtcagcggacgcccggaggcgtttctcgacgaggtctaccaggctcgccaactggtcctggcgggaagcctcgccggtgacctggagaacctcgcccagggacttttgcgggtggcgcgggccgacctggccagccgcgacctgaccctgggcggtatccgccgcgcgctgttccagttgctcgcgcgctttccggtctaccgtacctacgccggggcctgcggtcgctcggtgcaggatcgcgaggtgttccgctatgccgcagaggcggcccgcgaggatctcgacgaagccgaccgggcggtcctcgaccatctcgaacgctggctcggcgggcagccgctgcgcgagctgccgcccggtccgctgcggcgcctgcgcggcgagttgctggcgcgcttccagcagttgagttcgccgaccgccgccaaggccgtggaggataccgcctgctatcgctcggcggccctgctctcgcgcaacgacgtcggcttcgacccgcagcgcttcgccgcttccgccgaggaattccatgccgcctgcgaagccaggcgcctggccagcccacgcgccctgctggccaccgccagccatgaccacaagcgcggcgaggacgcccgcgcccgtcttgcggcgctcagtgaactggcgccctggttcgcgcgtaacgtcgagcactggcaaagcctggccacgccgttgcgccgcgacctcgccgaggggccggcgccgagtcccggcgacgagctgatcctgttccaggccctgctcggcagttggccgctcgacgcgccttgcgacggcgccgccctggaccaagcgttcctcgcgcggatgcgcgaatggcaatgcaaggccttgcgcgaagccaagctgcgcacgcgctggaccgcgcccgacgaagactacgagcgcgcctgcgccgactatctggaacagctcctgcgcgcgccactggcccaggccctgcgccagtcgctgggcaacgcggcggtgcgactgatgccggccggggccctgaatggcctcgcccaatgcctgctgcgcctgacctgcccgggtatccccgatctctaccaggggcgcgaggactgggacttcagcctggtcgacccggacaaccggaggccggtggacttcgcccggcacgccgccgccctggccgcgccgacgcccttcccggaactgctggagcactggcgcgacggtcgcatcaagcagaccctgatcgcccgcgtgctggggctgcggcggatgcagccgggcctgttccgcgacggcgactacctgcccctggaggtcagcggcgagcatgccgagcgggtcctggccttcgcccggcgcagtcgtcacggttgcctgctggtggtggtcccgcgcctggcctgcgccctgctcggccacgccacgcagccgcaggtgccggccgaggcctggggcgacacctgcctgctgctgccgccgagtctctccgaatgcacctacagcggcctgttttccaccatgccgctgcccagcgacgggcacctgagcctgtccgaagtgctcgccgactttcccgtcaacctgctttaccgcctcgcccaggaggacaccccatga

SEQ ID NO: 8101 - DNA, 504 bp, Pseudomonas aeruginosa
gcagaaagcgtagccccgctccttcgcggatcagcgaagggcaccccttcccccttggcgccacctgggacggcctcggcgtcaatttcgcgctgttctcggcccacgcgaccaaggtcgagctgtgcctgttcgacgcgcgcggggaaaaggagatcgagcgcatcgaattgcccgagtacaccgacgagatctggcacggctacctgcccgacgcccacccggggcagatctacggctaccgggtgcacggtccctacgagccggatgccggccaccgcttcaatcccaacaaattgctcctcgatccctacgccaagcagttggtcggccgcctgcgctggtccgaggcgctgttcggctacaccatcggctcggccgacgccgacctcagcttcgacgagcgcgacagcgcgcccttcgtgcccaagtcgaaggtcatcgatccggccttcacctgggccgagcgcccgccggtacgcgtcccctgggaccgcacggtga

SEQ ID NO: 8102 - DNA, 972 bp, Pseudomonas aeruginosa
gcggcttcccgcccggctgggcggaatggaacgaccgtttccgcgattgcgtgcgcgcctactggcgcggcgacgacgggcatgctgccggaactggcgcgacgcctaaccgcctccggcgatctctacgaccagcgtggacggcggccctacgcgtcggtgaacttcgtcaccgcccacgacggtttcaccctgcgcgacgtggtttcctacgatcacaagcacaacgaggccaacggcgagaacaacgccgacggcagcgaccacaacctgtcctggaaccacggctgcgagggccccaccgacgacccggagatccgcgccctgcgcctgcgccagatgcgcaacctgctgtccaccctgctgctgtcccagggcaccccgatgctggtcgccggcgacgagttcagccgcacccagcagggcaacaacaatgtctattgccaggacaacgaactgggctggatcgactggcggctggacgacgagggccgttcgctgctggccttcacccagcgcctgctggccctgcgccaacgctatccgatcctgcgcagggggcgcttcctggtcggcgagtacaacgaggcgctgggtgtcaaggacgtcacctggctggcgcccggcggcgaggagatgaccgaggaacactggcacgacgagcacgcccgctgtctcggcgtgctcctcgatggccgcgcgcaacccaccgggatcctgcgcagcggtgaggatgccaccctgctgctgatcctcaatgcctaccacgacgcggtgtccttccgtcttcccgaggtggccgaaggcagcggctggacctgcctgctggatacccagcggccggaggacccgctcggcgaacgctacccgttcgccagcgagttcctggtcggcggccgcagtttcctgctgttcgagctacaaccgccgggcgccgggagcggaaggatgaacggcggggaaaaaagctga

SEQ ID NO: 8103 - DNA, 552 bp, Pseudomonas aeruginosa
gtgccgcacgcggcgcccgcacatccaccctacacaggaggacagcatgaagatcagcgacatcatgacccgcaacgtccaggtcgccgacccgcagcagagcatccgcgaggcggccgccaccatggcgaggatcgacagcggcgccctgctggtcggcgaaggcgaccgcctggtcgggatgatcaccgatcgcgacatcgccatccgcgcggtggccggcggcctgtccggggataccccgctgggccgcatcatgagcggcgacatccactattgcttcgaagacgaagacgtccagcacgtggcccgcaacatggccgacatccagatgcgccgcctgccggtgctcaaccgcgagaagcggctggtcggcgtggtttccctgggcaacatcgccagctgccgcgaccaggcctccagcgccaccgtcctgcagggcgtcgcccaggcccactactgagcctttcttccacccggcccgcctttgccgttccggccgaggccgggccccaaccgggagaacgccatgaaagccgtggtatttcatga

SEQ ID NO: 8104 - DNA, 1134 bp, Pseudomonas aeruginosa
gggcgtgggcatcgtcgaggcgctcggcgacgaagtgcgcaaccttcaggtcggcgaccgggtggtgattccctcgaccatcgcctgcggcaattgcgtgtattgccgagccggctactacgcccagtgcgacgtcgccaaccccggcggcagccaggccggcaccgcgttcttcggcggcccccgggccaacggcggcttccatgggctgcaagccgagaaagcgcggattccctatgccaacatcggcctgatccgcctgcccagcagcatcagcgacgaccaggcgatactcctgtcagacatcttccccaccggttacttcggcgccgaactggccggtatcgcccccggcaacaccgtcgccgtgttcggctgcggtccggtcggccagttcgccatcgccagcgcgttgctcctcggcgccgccagggtgttcgccatcgaccgccacccggaccgcctgcacatggcccgccagcaaggcgccgaagtgatcgacttcgagcgcgaggatccggtccaggccctgcgctggctgaccgccgggatcggcgtggaccgcgccatcgacgccgtcggcgtggacgccgagcacagccatggcaccgccaccccggcgccgcgccaggagggcaccagctggagtcccggcaacgcccccgcacaggccctggagtgggcggtgcagggcctggccaaggccggcaccctgtcgatcatcggcgtctacgccgaagactcgcggcagtttcccatcggcctggcgatgaaccgcaacctgaccatccgcatgggcaactgccaccaccgcaagtacattccgctgctgctcgaacatgtgctcagcggacgcatcgacccggcgaagatcctcacccaggtgaagccgatcggcgacgccatcgaggccttcgaagccttcgaccgccgcgagaccggctggatcaaggtcgaactggtgccgcagaagcgccaggtcgagggcagcgaggaacgcctcgacgaacgcgcggtggacgaactggcgcgccggccgacgccggaaagcggcgcccgggggtgatgcatgagcgcaccggcacgcctgcgcatcggcatttccggctggcgctatgccccctggagaggtga

SEQ ID NO: 8105 - DNA, 456 bp, Pseudomonas aeruginosa
cttctatcccgaggggctgcgccagaaggacgaactgcgcttcgcctcgcgggcggtgaacagcatcgagatcaacggcaccttctacgccctgcagacgcccgagcgcttccgcggctgggccgaggacacccccgaggacttcgttttcagcgtcaaggccccgcgttacatcacccacgtgcggcgactgcgcgagatcgacgagccgctggcgaacttcttcgcctccggccccctcgccctgcgccagcgcctcggcccgttcctctggcagttcccgccgagcatgcgcttcgaccgcgagctgttcgccgatttcctcgcccgcctgccgcgcgacggcgccgccgcgcagaagctcgcccggcacagcgccgcgcgcctgcaccgcgagggctacctcgacggcgatccggcgcagcgcctgcggcatgccgtggaaatccgccatga

SEQ ID NO: 8106 - DNA, 756 bp, Pseudomonas aeruginosa
cctgcgggagagtgccgcatgatcctgccgcgcctgcaggtgctgacggtgaacacccacaagggtttcaacccgttcaatcggcgcttcatcctgccggagttgcgcgaagcggtgcgcagcgtcggtgccgacctggtgttcctccaggaggtcctcggctcccatagcctgcacgccgcgcgcctgccgtcctggccgccggcgccgcaatacgagtatctggccgacagcatgtggccgcagttcgcctacgggcgcaacgcggtgtatcccgaaggccaccatggcaatgccgtgctctccaagcatccgatcctcgcccaccgcaacctcgacgtctcggtggcgggcaacgaggaacgcggcctgttgcatgcggtgatcgacatcggccgtccgctgcacgcggtctgcgtgcacctgggattgcgcgaggcgcagcgccagcgccagttgcaactgctctgcgaactggtggcgggcctgccggagcgcgagccggtggtggtcgccggcgacttcaacgactggcgccagcgcgctgaccaactgctcgccggttgcggcctgcgcgaagtcttcgtcggcgcccagggccggccggcgcgcagcttcccggcgcgctggccggtgctgccgctggaccgcatttacctgcgcaatgcccgcgggcgccagccgcgcatcctctcgcggcggccctggtcgcacctgtccgaccacctgccgctggcggtggaggtggagccatga

SEQ ID NO: 8107 - DNA, 261 bp, Pseudomonas aeruginosa
tccgcgacgtcgccttcaacggccagctctaccagcacctgcgcgagctggcgcgccgccactgccggcgcatcagccgccgccacgcgaggcgcggctactggtggcgagcgcccgctgattttcctcggcttccacttttccaggcactttccggctatcgccggttgggtacccgcccatctgccacgcctgaaatcgctggagccgcgtccgtcgcggcgctggcaggaacgccagggccagcggggcaacccatga

SEQ ID NO: 8108 - DNA, 702 bp, Pseudomonas aeruginosa
tcggctaccgggtgctgtatttcctcctacccctggcgctggcctgcgtggtctacctgctgttggagcgccgggcgatccgcctgcgccgcaaacagcgccgcctgcgccagggccaggcgtgaatcagccggccggacgcagcagcaacgtgcccagcggcggcaggtcgagcaccaccgactgcgcctggccatgggcgccgcacgactcgctggagacgcggccctggctgcctgcgccggaaccggcgaacgcctgggcgtcgctattgagcagcacgtcccagtcgccgccttgcggtacgccgatccgatagccctggcgcggcaccggggtgaaattgtgtaccgccagcagcgatggctcgccggccgcgtggcgcagccaggcgtagacactgttcgcctggtcgtcgccgatcagccattcgaagccgagcgcctcgccgtcgcgcgcatgcagtgcggggagttcgcggtacagccggttgagggccgccaccaggtcctgtacgccctgatgctccggatagcgcagcaggtaccagtccagttcgccgtcgtggttccactcgcgccactggccgaactcgcatcccatgaacagcagcttcttgcccgggtgcgaccacatgaagctcaggtacaggcgcaggttggcgaacttctgccagcggtcgccgggcatcttgtccagtag

SEQ ID NO: 8109 - DNA, 1701 bp, Pseudomonas aeruginosa
cgagtgcttgccatgtaccacctcgtcgtgggagatcggcaggatgaaatgctcggagaaggcgtagagcaggccgaaggtcaactggtggtggtgatagcgccggtgcagcgggtcttcgccgatgtacgccaggctgtcgtgcatccagcccatgttccacttatggctgaagcccaggccgccctccgccaccggacggctgacgccgggccaggcggtggattcctcggcgatcaccagcgcgccgggggtttcgctggcgaccacctggttgaggtgatggaggaagtcgatggcctccaggttctcccggccgccatggcggttaggcagccattcgccttccttgcgcgaatagttcccgaagagcatcgaggggcacgcatccacccgcaggccgtcgacgtggtaggtgcgcagccagtgcagcgccgaggccagcatgaagccgtgcacctcgctgcggccaaggttgtagatgtaggtatcccagtcctggtggaagccttcgaagggatgttcgtactcgtacagcgccgtgccgtcgaaacggcccaggccgtgggcgtcggtgggaaaatgcgccggcacccagtcgaggatcacgccgatgccggcctggtggcaggcgtcgacgaaagcggcgaagtcctccggcgtgccgtagcgcgcggtgggggcgaacaacccgagcggctggtagccccaggagccgccgaagggatgttccatcaccggcatcagctcgatatgggtgaagccgagctggcgcacgtagggaatcagctcctccgccagttccgaccagtgcggcggccggccgtcgcggtggcgccaggagccggcgtggacttcgtagatcgacagcggtgccgcatagccctggcgctccgcgcgccgggccagccagtcctggtcgcgccactcgtggcgcaacgccgcgcaggtcttcgaagcggttccgggcggcgtctcgcaggccagcgccagggggtcggccttcagcggcaggaggccgtcgtggccctgcaactcgtacttgtacagttcgccctcgccgaggcgcgggacgaacagttcccagacgccggatggatagcgtcgtcgcatcgggtgacggcgcccgtcccagccgttgaaatcgccgaccaccgagacgcgcacggcgttcggcgcccagaccgcgaagcgcacgccctccacgccttcgtgacgggtcacttgcgcgcccagacaggaggccagttggcggtggttgccttcggcgaacaggtagaggtcgagttcgccgagcaacggcccgaaggcataggggtcttcgctttcctgcacgccgtccggccagtgcacgcgcaggctgtagcgcggtggcaggggctccaggtggcgctggaacaagccgctgccggggtcgctctgctccagttcggcgagcgtcgcgccgtcttcgtcgagcagctcgacgcgctgcgcgccgggcaggtaggcgcgcagcacgccgccttcgccgccggggtcgcgctgcgggccgaggaaggcgaatggatcgccctgcaggccgcgctgcagcttgtccagctccagttgccagcgttcgcgttcggacatcggttcgctcatcggttcttgcccttcaggaggtgttcggtgagttcggccagaccggcgagaggcacttccagccagtcggggcggtag

SEQ ID NO: 8110 - DNA, 420 bp, Pseudomonas aeruginosa
accctgatcagcagcccgccggctgcctgccgggccagcagcggcaggcgttcgagcagcgccggcaggcgttccagcaggcgccgcgcccgttccgccgcctcgccctgcaacggtcgtggcggctcgctcaggcgtttgccggcttcgcgcaactgttcggcgatacgcagcgcccaggcctggacgctggcttcgtcgctctcgcggctgccgaaggccggatcgtccgactcgccggccagtacgctgtgcatctcgccgagccgggcgccgaggttggcggcgaagccgcgcagttcggcgaggctgtcgtattgcccttcgagcgcctcgctggccgcggatatctcgtcgcgcacggctcgctccaggttgtccagggtccagttccaggcgtcgccctggttgttcaggtag

SEQ ID NO: 8111 - DNA, 2727 bp, Pseudomonas aeruginosa
atcaccgcgtccttgtaccattgcgggtcgttgagaaagaccggtttctcgcgtctggccatgggtttctccttatgcgtcgacgcgccgcacgcgccagatgccgaacggcaggtgccagggttcgatgcgcatccactggaccttgccgtgccagacccagcgatgcccgttcatcaggtcctcgccctggaggctggcgtcgtcgggcaggccgaactcccacagcggcagttcgaaatgcgcctcctgggcttcgtgcgggtccaggcagaccgccaccaggacgaagttggcgaggtccgcggtgcgcttgccgaaatacaggatgcggtcgttccaggcgttgtaggcctggaacccgaggtgcgtctgcaatgccgggttttcccggcggatgcggttgagccgggcgatctcggcgacgatgttgcccggcgcctggtagtcgcgcggacgcaactggtatttctccgagtcgaggtactcctccttgcccggcaaggccgccgcctcgcacagctcgaagccggagtacatgccccacagccccgaccccatggtcgccagggcggcacggatgaggaagccggggcggccggagcgttgcaggaaccagggattgatgtccggggtgttgacgaagaagttcggccggtagcagtcgcgccagggtggctggttgagttcggcgaagtactccgccagttcctgcttgtcgttgcgccaggtgaaataggtgtagctctggctgaagccgaccttgcccaggcgcgccatcatcgccgggcgggtgaacgcctcggaaaggaagatcacctgcggatggcggccgcgcacctcggcgatcagccactcccagaacggcagtggcttggtgtgcgggttgtcgacgcgaaacagcgtcacgccctgctcgacccagcccagcaccacgtcgcgcaaggcttcccacaggctcggcagggcctgttcggcgtagaagtcgacgttgacgatgtcctcgtacttcttcggcgggttctccgcgtagcgcaagctaccgtccggacgccaggcgaaccagccgggatgctcgcgcagccaggggtggtcgggggagcactggatggcgaagtccagcgccagttccatgccgtgctcgcgcaccgcaacgagcagccggcggaaatcctcgcggtcgcccagttcgggatggatcgcctcgtggccgccatcctcgctgccgatcgcatacgggctgccggggtcgccggcctcggcacgcaaggaattgttgcggcccttgcgatgggtgcggccgatggggtggatcggcgggaaatagagaacgtcgaagcccatcgcggcgatctgcggcaggcgccggatcacgtcgtcgaaggtaccgtggcgtgtcgggtcgccgctttccgagcgagggaacagctcgtaccaactggcgaagcgcgccagcggtcgctccacctccaccgggtattcgcggctgcgcaccaggtgctcgcgcgggccgaccagacgcaacagttcgccggtctgcgccgccagccacagcgccacccgctcctcgacgctctggcaggcctgcaggcgttcggccagcggcgcacaggcggcggcgatctccggaccgccgcgctcggcgcagcgctgcagcagttcgtcgccctcgcgcagctccaggtccagcggcaggcgtgcgccatgcttggcacgcaattcgcggcggtagccggcaaaacggtcgatccaggcctcgatacggaagtacaggcggccgcagggcggcgtgcgcaactgcgcgctccagaaatcgttgccttcgggcagcagcggcaggcgccgctccgcggtttccccgacacgccgccagaccacctcggcaccgagtacctcatggccatcggcgaagattcgcgcggccaggcgcaggtcgcggtcgctctcggtcttcgcgggataggcaccctcttccaccacagggctgaccgactcgatggcgatacggggctgctgaatggcgatgaccagcggatcatcgtcgctgttgcggacaatcgaactcatcgaggcgcgctcctccgggacgtgggttcggcgatgggtcgcgaggcttccgccggcctcgagtggccggcggcgcggacggtcattgattccgagcccgccggcgaccgattggttcaggttgatttacccagcggctcgcctcaggccttgcgccgcgaacgcgaggcaccggacttggcgcgacccttcgcgtcggccccggccttttcgctgcccttgtccttgccgccgccggcgcgggaacgcaggctgcgcttgagaaggtcggtgagatcgatgatgtcggcgcccttgccggccacctcctcctcttcctccaccgcgtgcagctggcccttggcggccttttcctcgaccagcttcatgatcttgtcgctgaagctgtccttgtattcgtccggctcccagtgggaagccatgtcctccaccaggcgcttggccatctccagctcgcgcttgtcgagtttcgcctcggtgacgctttcgtccagctccaggccatccaggctgcgcacctgcgacggccagcgcagggtgatcagcaccagggcgtcctgcagaggccgcaggagcgccaggtgctggcgggtgtgcaggacgacgttggccagggcgaccttgccggtgcgctccagggtctcccggagcagcgcgtag

SEQ ID NO: 8112 - DNA, 2874 bp, Pseudomonas aeruginosa
  unsure (2266): Identity of nucleotide at the above locations are unknown.
cgaacagcgccgcgccgagggttaccagcatgtgcgtgcgcaggccggcggccttgccgctctgctcgcgctcgtagccgagtaccgcgccgagcgccgccgccagcagcaggcgcaacgcggcgcgggcggtctgctcgaagtcggcgagatcggcgaactcctcgccgaggatcttccacaacgtctcccaggcgctcatcggcgttgtatctcgctgtagcgcagggcaccgcaacgcaggcagcgctcgcagtcgaaggtttcctcacccagtcgcaacgccggttgccggcaccagtcgcaaccgcctatcaggcaacgcaaggtcatccgggtcctcccgccgaatcgctcggccagccgccctttccagctgtgaccgacgagacgacgggaaggtgcgatcggattcgccagcggcgctcctcaggcggggatcgccttggtcgccgcctcgcgctgccagatccgatgctgcatcaatgcctggcgcaggccggggaagacatcggtggccgtggcgccgagcaccacgccggggtcgccaggcaacgaaagctggctggccagcgcctgggcatcgccggcgaaggccactggcttcaggtgcttgtatgcttccagcaggtagtgcaggccgcgcccgtcagcgccgatggcctggctgctggccgcgccgccaggcacgaagaccgcgtcgaaggctaccgacggcaggccgtcccaggttccctcagggctcagttcggcgccgttttcagcctgcaccggcgaagcgctgggcgcgatcagcttggcgtccgcgccctcctggcggagcgcgtcgcgcaggtcgctgacgtcgctctcggcgacgccgtcggcgatcaggatcgccaccttgcgcgaacggatgtcgccggacagcaggttcatctggctcagcgccggcgacggcttcggctgcggtgtcgggttggccggcgcggcgagctgcacaccgacgttcgccgcgaccctggcggccagttgcggatcgatgttgaggagtatctggttgacttcgcgctcaaggatcgattgccgctcgaccttggacagttcgaagctgtaggcggcgacgatatgcgcctgctcggcctcgctcatgctgtgccagaacaatgcggcctggctgaaatgatcggcgaaggagtcggcgcgcttgcgcagcttgctgccgctgactggctcgtggtaggtggagaagccgccgttgcgcgccgccggcggggtttccttcggccagccgccgtcgatcgagttcggttcataggaagcccggccgcggttgatggtctgccggtgcggcgcgtcgcgctggttgttgtggaacggacacagcgggcggttgatcgggatttcgttgaagttcggcccgctcaggcgcagcagttgggtgtcggtataggagaacagccgaccctgcaacagcgggtcgttggtgaagtcgattccggggaccacgtggccgacgtggaacgccacctgttcggtctcggcgaagaaattgtcggggttgcggttgagtaccatccgccccaccacccttaccggcaccaactcctcgggcaccagcttggtggggtcgagcaggtcgaagtcgaagctgtcctgctggttctccgggatcacctgcaggcccagctcccattcgggatagtcgcccttctcgatgtcctcccagagggtccgccggttgaagtcggggtccttgccggcgagcttctgcgcctcgtcccagaccagcgagcaggtcccggacttcggtcgccagtggaacttgaccagcacgctctcgccggccgcgttgaccaggcggaaggtgtgcacgccgaagccctgcatgttgcggtaggcgatcggaatggcgcgatcggacatcagccacatgaccatgtgcgccgactccggggtcagcgaaacgaagtcccagaaggtgtcgtgggcagacgctccggtgggaatctcgttgtgcggttcgggtttcaccgcatggacgaagtccggaaacttgatcgcatcctggatgaagaacaccggcatgttgttgccgaccaggtcgaagttgccttcgtcggtatagaacttcacggcgaagccgcgtacgtcacgcaccgtatccgcagacccgcgcggcccctgcacggtggagaaacgcacgaagaccggggtacgcttgcccgcctcggcgaggaaaccggccttggtcaggtcgctgaggtcctcgtaggcctcgaagtanccatgcgccgccgagccacgagcgtggaccacgcgctcgggaatgcgctcgtggtcgaagtgggtgatcttctcgcgcatgatgaagtcttcgagcaacgacggtccgcgctcgccggccttcagggtgttctggttatcggcgatgcgggtgccggtattggtgctcagggcctctccggtggcgtcgtctgctataggcctccagctgttccagcttggcgttgctgttgccacggtcgacggtgtcggtgccggccgcctggctgcgctgctcgttgttctgctcgctcatcggtttcctctcctcatcctgggcatgaaaatggggcggatgcctccctgctccgccccattcacttcactgcgcggttatcagttcccgccgtggctgcgctggccacctttcttgccagcctcggaggcccgctgcggatcgttcttgaagttgccgccgctggcctggccgcccttcttgccggcctccgaagcacgtttcgggtcttccgcgaagttgcctttaccaccttgatgctgtgccatttctatttcctccgaataatctcttcagaacagatttcatggacgcatgcgttgcgcatgccctaa

SEQ ID NO: 8113 - DNA, 447 bp, Pseudomonas aeruginosa
acccattcaataattaatcgtcgaactttaaaacaaatggaactcgccatggaaaacagtgacgaagtgcgattccagcactatttcatttctctcgtcgaacaggtggcgaaaccgcttttcgtcgactcctgcgaagaggcgcgcagctacggcctggactgcaacgtggacctcgacctcgacgaggacggccatcctcgcctgcgcctggaagtcggcgagccgggaggcgagaaaagccactacagcctgctggcgattcccggcgagcgggtcatccatcgccagtacctggccggggcccaggaatggcacagcctgccggccgagctggcgtcgatcaacccgatggtgctggacagcgagctggcggtattcttccgccgcgccttcgaccttcgcctggagggccccgaacgccgtcacccggccggcttctggtaa

SEQ ID NO: 8114 - DNA, 1560 bp, Pseudomonas aeruginosa
cttccagatatcccgggcgtattcgctgatcgtccggtcggcgctgaaccagccgatccgcgccacgttgagcaacgccgagcgccaccagcgatcgggctcgcgccagacttcctcgacccggcactgcgcatgccagtaggcctcgaagtcggcgcagagcatgaagcggtcgtcgtgcaccaggccgtccaccagcccttcgtagcggctgcggtcgtcggccgagaacagcccgctgcggatcgcctccagggcttcctccagccgcggcgaggccgcgatcaccccgcccatctccagctccccggcctgccggcgctgctccacctgctgggcgctgaggccgaagatgaacatgtgttccaggccgatccgctggctcatctcgacgttggcgccgtccagggtgccgatggtcagcgcgccgttgagggcgaacttcatgttgctggtcccggaggcctcgagcccggcggtggaaatctgctcggagaggtccgccgcgggaatgatcgcctcggccaggctgacgttgtagttgggcaggaacaccagcttgagcaggccgcgcacggtggggtcgtcgttgatggtgcgggcgatgtcgttggccagcttgatgatcagcttggcctggtggtagctggcggcagccttgccggcgaagatcttcacccgcggcacgcggtcggcggtcgggtcgttgcggatctcctggtacagcgccacggtgtgcagcaggttgagcaactgccgcttgtattcgtggatacgcttgatatgcacatcgaacagcgcttccggttcgatcgccacgccgaggctgtccagcaccaggcgcgccagggcggtcttgttctgccgacgctgctcggcgaagcgtgcccgcagcctggcgtcctcgacgtgttcctcgaggtccggcaggcgccgttccggggtgtccagcaggtcggcgccgagggtctccaccagcagctcggtcaaccccgggttggcctggaacagccagcggcggaacgacacgccgttggtcttgttgctgatgcgctgcggatagaggcgatgcaggtcatggaacacggtgtcgcgcatcagctcggtgtgcaatgccgataccccgttgatctggtgcgaaccgaggaacgccaggttgcccatgcgcacccgtcggccgtggccctcctcgatcaggctgaccgaacgcaacaggtcgaagtcgtggatgtcctgggcacgcagcgcgtctatatggaaggcattgatcaggtagatgatctgcatgtggcgcggcaacaggcgctccatcagcgccaccggccaggattccagggcttccgggagcagcgtgtggttggtgtaggacaaggtcgccacgctcagcgcccaggcgtccggccaggccagttggtgcacgtccaccagttgccgcatcagctcggcgacggcgatcgccgggtgggtgtcgttgagctggatcgccacctgttccggcaggctacgcaggtcgtgatgatggcgcaggtggcggtcgagcaggtcctgcagcgaggctga

SEQ ID NO: 8115 - DNA, 1083 bp, Pseudomonas aeruginosa
gacgaagaagtactcctggcgcaggcgcagttcctgaccggcctcggtgctgtcggccggatacagcacccgcgagatgctctccgccttgaccacgtcgaccaccgcgccgatatggtcgccggcgttgaaacggtccagttgcaggtcttcctcggcgcgggcgcgccacaggcgcagggtattgacgctggcacgccgccagccgacgatcggcgtgtcgtaggcgatcgcccggatccgctcgtccggccgccagatggctcggccactgtgctcgctgtcgacctgcacgctgccgccgaagtcgatgtagtagctgacctcgggtcgttcgaactcccagggattgccgaaatccagccaggtctcggtctgctcctgctgccagccgtcggtcagcacctggcggaacaggccatgctcgtagcggatgccatagccatgcgcgggaatgtcgaggctggccatgctttccatgaagcatgccgccaggcgtccgaggccgccgttgccgagcgccgcgtccggctccagggcaacgatccgctgcaggtcgacgcccagctcggcaagggcctggcgggtttcctcgagcagcccgaggttgccgaggttgtccagcaacaggcgaccgatgaggaactccagggacaggtagtagacccgcttgcgcgcgggcgcttcgccttgcggggtggcctcctcccagtggtcgatgatgtggtcgcgcaccgccagggccaccgcttcgaaccagtcgtgcgggcaggcggtggatgggtcgcggccgacgctgtagcgcagcttggcgaggatgctggctttcagggtctggaccgtgctcggggtctggtcttggctgtcgggcatcgccgggcttccttccggcccgccgctgcaggccggtgcttgcggggttttctcaggcgctcttgcgtaccggcacggcggccgccgcgctttcctggcgcaggcggtcgagcaggtcgtggccggccagggtcaggtggtggaccacccagtgctcctggccggtccaggaatgctggacgctgccgcagagcagttgcgcctggttga

SEQ ID NO: 8116 - DNA, 435 bp, Pseudomonas aeruginosa
gcgctgcccagacgcttgccgatcacgccttcaagaccgagcttgcaggcgctggccagcaggtcgcgggggtcttccgcgagcgtcgcggagaaccgcagcgggtcttcgtctcgcccttccagcagcgcctccaggcgcgcgcggcgctcctccagggcgacatcgcgcagatcctcgccttcgtggtacggcaggtcgaagaggacgtacaggatgttctcgccgcgaccttcctcgaaggcgttctgcagggcctggaagtccggtcgaccctcctcgtcgaggacgaccagttcgccgtccagccaactgcgctgcagaccgagcccggccaaggccttctccaggtgcggcaggcgttcggtccagtcatggccgttgcgggtcagcaggcgcacgtggccgtcttcgatgcggctcatcagccgatag

SEQ ID NO: 8117 - DNA, 873 bp, Pseudomonas aeruginosa
gcaccgcgtagcctcgatcgaggaggaattcctcgatccgccagagctggtcggcgtgttcttcgaggaccaggacgatcttgttttctccgttcaccatggttctccctgtcggattgtcaggaaggcttcgctgcaaggttcgcgccgtccgccccgcttgcgccggagcagcgtgaccacggcgattgggcgcggactgatcgcaaagtgcgatcagcagagtgcccggaaggcgcctgttcatcatgcagattgcccgacccgcgcggaccgctggtaagcccgccggcaccaaccacgtcgaccggggtccagcctgagagaccgcgagcgaaggagccagccatgcgccctgccccagaagacgccgcagacgatgcgttcgaccagcgcgagtatccgatcccggagcgcctggaaagccagcgccgcgcctggcgtttcgaacgggcgggcctgtgggtcctgctcggggtgatcctcctggcgctgaccggggtgttcgccggcgggcctctgagttcgcggacgctggtcagcgacagcggcaggctgaccctggcctacgagcgtttcgaacgcagcggcgccgccagccgcctgcgcatcgatctgcgcggcgcgccgggcaccgaagttggcgtgcgcctgggcggcggactgctacaggcgcacagcatccagagcctgcaaccgcaaccgctgcgcagtcacagctggcggggtggcctggaactggagggaaggctcgacgaagacggtcgcctgagcctgttcctgacgttgttgccgaaccagctcggcgaagtcgccagtcgactggagttcgccggcgagagcctggccttcgaccagttcatctacccctga

SEQ ID NO: 8118 - DNA, 1194 bp, Pseudomonas aeruginosa
gagcatggcaccgagcagggtcaccagcagcacttccagcgagcgctccagcaggttgccgaaggagagcacgtcgagcatcaccgcgccggccgccaccttcgggtgttcgctgcggtcggcgccgtactcgatggcgccgctggcctgccctgcctcgcgcacgtcggcggcggccgcctgcgcctcggccggtgccgaggcgcgccccagcgtcgccacctcggcgtggcgcaggccgatcccggcggcgaagctggcgaggaagccccagccgcccagtgcgtcggcgccgacataggacagcgcgatcagcgccagggcgaggaagtcgttggccgacaccgaggtgtcggtgtgccgcgcccgcaggtggatggccaggcggccgagaccatggcccaggcaatagcccaccagcaggccgagcggaatcgcccagagcacgtcgcgcagcagccagtccaggccgctgcggtcgaactccccgggcaggccgccgccctgaccgatcagcagcagggcggcgatgacgaaggggaaggcgatgccgtcgttgagtcccgcctcgccggatacggcgtagcgcaggcggtcgtcgtcgccggcgtggttgacctggatgtcgctggccagcaccggatcggtgggcgcgaggatcgccgcgaccagcaaggccagcccccagtccaggccgaacaggaaatgcgcgcccagggtaaggccgaggatacagccgagcaggactggtccggccagcagccaggcagcggtccaggccggcgagcgcaacggcaggcgcagcttgaggccgccgatgaacagcgagatcagcaacgccgcctcgctgaggtgttcgaaccagccgctgatgtccgccaggccgctgcgccaggcgtgcagcccggccgggccgatggccatgccgaacagcaggtagatgaacgacgtgctgaccggcagcaggcgcaggtaggccgaagccaggccgagcgtcagcaggatgcagcccagtaccagcaaccacaggctgaagctcatgcctggccaggctccgcccgcgggggcgttacttggatgggtgcgccttggccagcgcgcgggccatttccaggtggtgcttcagggccggcaggtgggtcttggcgaaggcctgcagttccgggtcggtcaggttgtccgcggcctgggtga

SEQ ID NO: 8119 - DNA, 1299 bp, Pseudomonas aeruginosa
cggcgccgccggccgaccgttcagatttttcgccgaccgtgccaggccgggcgccctccccggtcacccctggcggctcgccagcgcctcgatccgcgcccggctcttcggccggcgtacggacagcggcggttcgacccgcatcggcggcgcgatcgcgttgccctggagatagacgtccccggtcggcagccgggcgaacgcatcgtcctcctcgagaccttccaggaccacgcagggcgccagttcgcggcacagggccagcagatggcgcagcacttcggcgcccttcgccgagcgacgtgcttcgcgggtataccggcaatcgatcttgatcacatcgggacgggcatcgagaacgaagtccaggttgttgtgcgccgcgccgaagtcgtctatcgcgatgcgcacgccatgttcgcgcaggcgtcggatgaactcccgggtcgcgactctctcgcccacggcggtctcggtcagctccagcgtcagcctccgtgccacctgcggacgggcggccagccatcggcagaccgcttcccaccaggcatccatcgccgcgctctggcgcgacaggttgcaggccaggcgcaaggtaggctcggcgttcagccggtcgaggaccgtgcccagcacgcagcgatcgagcaggcgtaccaggccgagccgctccagcgccaggatcagttcctgggtcggcaacggcggctcgccgctggcggccgtgaccctgagcagggtttcccggtagagcggctcccattccggatgcccggcatgccgtacggcctgccagtccaggcgcacccgaccgcgcgccagggcggcatggaaacgccgggcgaggcgcaggtcgccggccagggaggcggcaacggccggtgggtgctcgtgctggcgagcctgtggggaactgttcactgtagagctttcctttcctggcggctgacgccgttgtcgtcgatccagtcgaacgccacctcgccgcgcgtcccgccgtccacccgccgcggcaagccgaggcgtcgttgcgagcgcggagccagcagcgttccgggcagatccaggcgcgtctcccctatctccagcgccagccccgccagggacacgaagtacggcgtcgggttgtccacccgcagggtctcgtcgcgcagcgcgaagcccagttcggcggccgcgtcctcggcgtgcggatgcaggccgtgcgggcggtacagcaccttcatctgggttcgcagggtgaccgtgagccggggccggccagcggcctcggcggtggcttgcggggggatctcgtag

SEQ ID NO: 8120 - DNA, 279 bp, Pseudomonas aeruginosa
atacccgtggtgaagacgcgactactcgccgacgatcctctcgcagccctattcctacacccagccggcggcctacatcgccatcaaggggccgggcctgaccgcgccgaccgtcggccaggcgcacgtgggcggcaactggggcggctggtacagcaactggccgggtgccatcgggctgtaccgctacgtgaccctgaaacgctatcccacttgcgcggtgatgacggacaccccgcacgtgcagttcccgtccatcaccctggcagagatcgatag

SEQ ID NO: 8121 - DNA, 1680 bp, Pseudomonas aeruginosa
gggagacgcgcctggatctgcccggaacgctgctggctccgcgctcgcaacgacgcctcggcttgccgcggcgggtggacggcgggacgcgcggcgaggtggcgttcgactggatcgacgacaacggcgtcagccgccaggaaaggaaagctctacagtgaacagttccccacaggctcgccagcacgagcacccaccggccgttgccgcctccctggccggcgacctgcgcctcgcccggcgtttccatgccgccctggcgcgcggtcgggtgcgcctggactggcaggccgtacggcatgccgggcatccggaatgggagccgctctaccgggaaaccctgctcagggtcacggccgccagcggcgagccgccgttgccgacccaggaactgatcctggcgctggagcggctcggcctggtacgcctgctcgatcgctgcgtgctgggcacggtcctcgaccggctgaacgccgagcctaccttgcgcctggcctgcaacctgtcgcgccagagcgcggcgatggatgcctggtgggaagcggtctgccgatggctggccgcccgtccgcaggtggcacggaggctgacgctggagctgaccgagaccgccgtgggcgagagagtcgcgacccgggagttcatccgacgcctgcgcgaacatggcgtgcgcatcgcgatagacgacttcggcgcggcgcacaacaacctggacttcgttctcgatgcccgtcccgatgtgatcaagatcgattgccggtatacccgcgaagcacgtcgctcggcgaagggcgccgaagtgctgcgccatctgctggccctgtgccgcgaactggcgccctgcgtggtcctggaaggtctcgaggaggacgatgcgttcgcccggctgccgaccggggacgtctatctccagggcaacgcgatcgcgccgccgatgcgggtcgaaccgccgctgtccgtacgccggccgaagagccgggcgcggatcgaggcgctggcgagccgccaggggtgaccggggagggcgcccggcctggcacggtcggcgaaaaatctgaacggtcggccggcggcgccgtcacagcagcgacgatgccgaggtgcgttgtgccgaagtcccggcattttttccctgtcacgccaacggagtcgaccatgaacagagcaatcagccttcccctcaagggagccgcctggctcctgctggtcctggccctgcctttcgccaacgcccaggacatgaacaagaccgcgccacagaccttcgtcagcgaggcctcggcggccggcgtagcggaaatcgaagccggcaagatggcgctggaaaagagcaccgccgccgatgtgaaggtattcgccaagcagatgatcgacgaccacggcaaggtcaacgccgaactgcgcagcctggccgagcgcaagaaactggaggtcgaagacgacgccagcctgaccgacaaggccaaggcgaccctgctcgacctgcgcgacgcctccttcgacccggcctacgccaacaaccaggtggcggcccacgagaaagccgtggaactgttcacccaggccgcggacaacctgaccgacccggaactgcaggccttcgccaagacccacctgccggccctgaagcaccacctggaaatggcccgcgcgctggccaaggcgcacccatccaagtaa

SEQ ID NO: 8122 - DNA, 1167 bp, Pseudomonas aeruginosa
cgcccccgcgggcggagcctggccaggcatgagcttcagcctgtggttgctggtactgggctgcatcctgctgacgctcggcctggcttcggcctacctgcgcctgctgccggtcagcacgtcgttcatctacctgctgttcggcatggccatcggcccggccgggctgcacgcctggcgcagcggcctggcggacatcagcggctggttcgaacacctcagcgaggcggcgttgctgatctcgctgttcatcggcggcctcaagctgcgcctgccgttgcgctcgccggcctggaccgctgcctggctgctggccggaccagtcctgctcggctgtatcctcggccttaccctgggcgcgcatttcctgttcggcctggactgggggctggccttgctggtcgcggcgatcctcgcgcccaccgatccggtgctggccagcgacatccaggtcaaccacgccggcgacgacgaccgcctgcgctacgccgtatccggcgaggcgggactcaacgacggcatcgccttccccttcgtcatcgccgccctgctgctgatcggtcagggcggcggcctgcccggggagttcgaccgcagcggcctggactggctgctgcgcgacgtgctctgggcgattccgctcggcctgctggtgggctattgcctgggccatggtctcggccgcctggccatccacctgcgggcgcggcacaccgacacctcggtgtcggccaacgacttcctcgccctggcgctgatcgcgctgtcctatgtcggcgccgacgcactgggcggctggggcttcctcgccagcttcgccgccgggatcggcctgcgccacgccgaggtggcgacgctggggcgcgcctcggcaccggccgaggcgcaggcggccgccgccgacgtgcgcgaggcagggcaggccagcggcgccatcgagtacggcgccgaccgcagcgaacacccgaaggtggcggccggcgcggtgatgctcgacgtgctctccttcggcaacctgctggagcgctcgctggaagtgctgctggtgaccctgctcggtgccatgctcctaccagcactgggactggcgcgcgctgccgctggcgctgctgctgttctgcgtgtgtcggccggcgatggtctggctgctggtcggccggcggctga

SEQ ID NO: 8123 - DNA, 828 bp, Pseudomonas aeruginosa
ccagcgtccgcgaactcagaggcccgccggcgaacaccccggtcagcgccaggaggatcaccccgagcaggacccacaggcccgcccgttcgaaacgccaggcgcggcgctggctttccaggcgctccgggatcggatactcgcgctggtcgaacgcatcgtctgcggcgtcttctggggcagggcgcatggctggctccttcgctcgcggtctctcaggctggaccccggtcgacgtggttggtgccggcgggcttaccagcggtccgcgcgggtcgggcaatctgcatgatgaacaggcgccttccgggcactctgctgatcgcactttgcgatcagtccgcgcccaatcgccgtggtcacgctgctccggcgcaagcggggcggacggcgcgaaccttgcagcgaagccttcctgacaatccgacagggagaaccatggtgaacggagaaaacaagatcgtcctggtcctcgaagaacacgccgaccagctctggcggatcgaggaattcctcctcgatcgaggctacgcggtgctcagcgcggcgagtcgcgacgaagccctcgaccacctggcctcggacgcggtgatcgacctgttcctgctcagcgagcagctcgaaggtcctctgagcggcagcatgctcatcgaaaccagcctgccggtgcgcccgcggatgcgggtgatcctgctcagcgacagcgctcgcgtcggcatcgacccggcggcaccctatccggtgctgctcaaaccggtgaccctggaggaactggggaaagccatcgacatggtcctgcacagcgcgccggtctgccccggcgtctga

SEQ ID NO: 8124 - DNA, 402 bp, Pseudomonas aeruginosa
tgccggagcgtttctcggcggtttccgggccgcgcaaccgggtcggcaagatcttcgtcgactacctgcgcaacagccgcggcgccagcaccgtggccgcctactcggtgcgcgcccgcgaagggttgccggtgtcggtaccggtgttccgcgaggaactcgactcgctgcagggcgccaaccaatggaacctgcgcagtctgccgcagcgcctcgacgaactcgccggcgacgatccctgggccgactacgccggcacccgccagcgcatcagcgcggccatgcggcgccagctcgggcgcggctgaccgtccgcgaaaaaggcggaactcccccggcgcacagggcctccaccgtgcaacgagatgccgaggaggcccccgatggataccgcctacctga

SEQ ID NO: 8125 - DNA, 327 bp, Pseudomonas aeruginosa
ccggaacggctggccgcgacgcagacaaggagcacggcgatgaaacgcgactgggggttgatcagggatctgctggagcatctggaaagccttggcttcggccagcactgggaagcgcgcgagctgcccggtcattgccgcgaggcggtggcctaccacttgcagttgctcaaccaggcgcaactgctctgcggcagcgtccagcattcctggaccggccaggagcactgggtggtccaccacctgaccctggccggccacgacctgctcgaccgcctgcgccaggaaagcgcggcggccgccgtgccggtacgcaagagcgcctga

SEQ ID NO: 8126 - DNA, 1191 bp, Pseudomonas aeruginosa
cctgcatcgcctctatccgcagcgcatcagcaacaagaccaacggcgtgtcgttccgccgctggctgttccaggccaacccggggttgaccgagctgctggtggagaccctcggcgccgacctgctggacaccccggaacggcgcctgccggacctcgaggaacacgtcgaggacgccaggctgcgggcacgcttcgccgagcagcgtcggcagaacaagaccgccctggcgcgcctggtgctggacagcctcggcgtggcgatcgaaccggaagcgctgttcgatgtgcatatcaagcgtatccacgaatacaagcggcagttgctcaacctgctgcacaccgtggcgctgtaccaggagatccgcaacgacccgaccgccgaccgcgtgccgcgggtgaagatcttcgccggcaaggctgccgccagctaccaccaggccaagctgatcatcaagctggccaacgacatcgcccgcaccatcaacgacgaccccaccgtgcgcggcctgctcaagctggtgttcctgcccaactacaacgtcagcctggccgaggcgatcattcccgcggcggacctctccgagcagatttccaccgccgggctcgaggcctccgggaccagcaacatgaagttcgccctcaacggcgcgctgaccatcggcaccctggacggcgccaacgtcgagatgagccagcggatcggcctggaacacatgttcatcttcggcctcagcgcccagcaggtggagcagcgccggcaggccggggagctggagatgggcggggtgatcgcggcctcgccgcggctggaggaagccctggaggcgatccgcagcgggctgttctcggccgacgaccgcagccgctacgaagggctggtggacggcctggtgcacgacgaccgcttcatgctctgcgccgacttcgaggcctactggcatgcgcagtgccgggtcgaggaagtctggcgcgagcccgatcgctggtggcgctcggcgttgctcaacgtggcgcggatcggctggttcagcgccgaccggacgatcagcgaatacgcccgggatatctggaagctatgaagggccttaccagaagccggccgggtgacggcgttcggggccctccaggcgaaggtcgaaggcgcggcggaagaataccgccagctcgctgtccagcaccatcgggttga

SEQ ID NO: 8127 - DNA, 225 bp, Pseudomonas aeruginosa
agtgaatggggcggagcagggaggcatccgccccattttcatgcccaggatgaggagaggaaaccgatgagcgagcagaacaacgagcagcgcagccaggcggccggcaccgacaccgtcgaccgtggcaacagcaacgccaagctggaacagctggaggcctatagcagacgacgccaccggagaggccctgagcaccaataccggcacccgcatcgccgataa

SEQ ID NO: 8128 - DNA, 558 bp, Pseudomonas aeruginosa
ggaaaccttcgactgcgagcgctgcctgcgttgcggtgccctgcgctacagcgagatacaacgccgatgagcgcctgggagacgttgtggaagatcctcggcgaggagttcgccgatctcgccgacttcgagcagaccgcccgcgccgcgttgcgcctgctgctggcggcggcgctcggcgcggtactcggctacgagcgcgagcagagcggcaaggccgccggcctgcgcacgcacatgctggtaaccctcggcgcggcgctgttcgtcatgccgctgcaattgcagagtggcggggcggacgcgctgagccgggtgatccagggcaccgtcgccggcatcggcttcctctgcgccggcaccatcctcaaggcaggtcgggaaagccgggtcaggggcctgaccaccgcggcgggtctctgggccagcaccgccataggcgtcgcggtcggactcggtcaccagggtaccgcggtgctcgggacggtcctggcgctactggtgctgcatgtcctggcctgcctgaaccgttcgccgccatcttccgatagccattga

SEQ ID NO: 8129 - DNA, 453 bp, Pseudomonas aeruginosa
ccctggagatggtcaccgacgacgagcgcgactatctctggaaccactatgccgccgaccgccgcgcgcgcctcaacctgggcatccgccggcgcctggcgccgctggtggagcgtgaccggcggcgcatcgagctgctgcacagcctgctgttgtcgatgccgggcacgccgaccctgtactacggcgacgagatcggcatgggcgacaacatctacctcggcgaccgcgacggcgtgcggaccccgatgcagtggtcggtggaccgcaacggcggcttctcccgcgccgacccggcgaagctggtgctgccgccgatcctcgacccgctgtacggctaccagacgatcaacgtcgaggcgcaggcgcgcgacccgcattcgctgctcaactggatgcgccgcctgctcgccgtgcgcagccagcagaaggccttcggccgcggcagcctga

SEQ ID NO: 8130 - DNA, 408 bp, Pseudomonas aeruginosa
ccctgccgccctacggcttctactggttctacctggccgacgcgacgcagatgccgagctggcacgtggccgccgacgagcgcctgccggaactgccgaccctggtggtcaagcagcgcctcggcgagctgctgcagggcgcatcgcggaacatcctggaaggcgagacgctgccggcctacctgccgaagcgccgctggttcgccggcgagaaaggccagccacggctctgctacatcgttccgctggacgaggcggagccgcgctgtgcgctgtgcgaagtggagatcgacgggctgcgctaccagttgccgctgggcttcctcgacgccgaccagcgcggcgacagcctgcctcagttgctggccctggcgcgcctgcggcgcggtcgcaaggtcggcctgctga

SEQ ID NO: 8131 - DNA, 1308 bp, Pseudomonas aeruginosa
agggcaagaaccgatgagcgaaccgatgtccgaacgcgaacgctggcaactggagctggacaagctgcagcgcggcctgcagggcgatccattcgccttcctcggcccgcagcgcgaccccggcggcgaaggcggcgtgctgcgcgcctacctgcccggcgcgcagcgcgtcgagctgctcgacgaagacggcgcgacgctcgccgaactggagcagagcgaccccggcagcggcttgttccagcgccacctggagcccctgccaccgcgctacagcctgcgcgtgcactggccggacggcgtgcaggaaagcgaagacccctatgccttcgggccgttgctcggcgaactcgacctctacctgttcgccgaaggcaaccaccgccaactggcctcctgtctgggcgcgcaagtgacccgtcacgaaggcgtggagggcgtgcgcttcgcggtctgggcgccgaacgccgtgcgcgtctcggtggtcggcgatttcaacggctgggacgggcgccgtcacccgatgcgacgacgctatccatccggcgtctgggaactgttcgtcccgcgcctcggcgagggcgaactgtacaagtacgagttgcagggccacgacggcctcctgccgctgaaggccgaccccctggcgctggcctgcgagacgccgcccggaaccgcttcgaagacctgcgcggcgttgcgccacgagtggcgcgaccaggactggctggcccggcgcgcggagcgccagggctatgcggcaccgctgtcgatctacgaagtccacgccggctcctggcgccaccgcgacggccggccgccgcactggtcggaactggcggaggagctgattccctacgtgcgccagctcggcttcacccatatcgagctgatgccggtgatggaacatcccttcggcggctcctggggctaccagccgctcgggttgttcgcccccaccgcgcgctacggcacgccggaggacttcgccgctttcgtcgacgcctgccaccaggccggcatcggcgtgatcctcgactgggtgccggcgcattttcccaccgacgcccacggcctgggccgtttcgacggcacggcgctgtacgagtacgaacatcccttcgaaggcttccaccaggactgggatacctacatctacaaccttggccgcagcgaggtgcacggcttcatgctggcctcggcgctgcactggctgcgcacctaccacgtcgacggcctgcgggtggatgcgtgcccctcgatgctcttcgggaactattcgcgcaaggaaggcgaatggctgcctaa

SEQ ID NO: 8132 - DNA, 441 bp, Pseudomonas aeruginosa
ccgtccaccgtgacctgcacctcgacaccgcgctcggcggcggcgctgagggcttcctgcaactgccggccgacctcgtcctcgaagatgatgaaggtttccaggaggatctcccggcgcgcctcggcgatgcactggaacaggcgcggaaagtactcttcgccgttgatcagcagttctacgcggttgccgtcgcgccaggggaagttcatggctccacctccaccgccagcggcaggtggtcggacaggtgcgaccagggccgccgcgagaggatgcgcggctggcgcccgcgggcattgcgcaggtaaatgcggtccagcggcagcaccggccagcgcgccgggaagctgcgcgccggccggccctgggcgccgacgaagacttcgcgcaggccgcaaccggcgagcagttggtcagcgcgctggcgccagtcgttga

SEQ ID NO: 8133 - DNA, 1755 bp, Pseudomonas aeruginosa
aacccttgtgggtgttcaccgtcagcacctgcaggcgcggcaggatcatgcggcactctcccgcaggtcatcgggcaactgtccgggcaccgtgcgcaggccgccgtcgagttccagcagctgcaggaggcgccgggcgtcgtagggtgcgcgcaccttgacgtcgttgtcgaagtagcagtacaggtcgcgcgccgtcgccttcgccggggcgtcctggctggcccggcgcaggtcgtcggcctggtcgccgccggcccaggcgcggatccgtgcctgccactggcccagggccgcttccgaatagccgctgcggtagagctccttgtcgccatgcaggcgcaggtagaggaagtcggcgcagacgtcgccgagcagcggccacttgccggcggtatcggccaccaccagggcaacccggtattcgcgcagcagctcgatgaacgtcgggtcgacgaagctctcatggcggatttccacggcatgccgcaggcgctgcgccggatcgccgtcgaggtagccctcgcggtgcaggcgcgcggcgctgtgccgggcgagcttctgcgcggcggcgccgtcgcgcggcaggcgggcgaggaaatcggcgaacagctcgcggtcgaagcgcatgctcggcgggaactgccagaggaacgggccgaggcgctggcgcagggcgagggggccggaggcgaagaagttcgccagcggctcgtcgatctcgcgcagtcgccgcacgtgggtgatgtaacgcggggccttgacgctgaaaacgaagtcctcgggggtgtcctcggcccagccgcggaagcgctcgggcgtctgcagggcgtagaaggtgccgttgatctcgatgctgttcaccgcccgcgaggcgaagcgcagttcgtccttctggcgcagcccctcgggatagaagtcacctctccagggggcatagcgccagccggaaatgccgatgcgcaggcgtgccggtgcgctcatgcatcacccccgggcgccgctttccggcgtcggccggcgcgccagttcgtccaccgcgcgttcgtcgaggcgttcctcgctgccctcgacctggcgcttctgcggcaccagttcgaccttgatccagccggtctcgcggcggtcgaaggcttcgaaggcctcgatggcgtcgccgatcggcttcacctgggtgaggatcttcgccgggtcgatgcgtccgctgagcacatgttcgagcagcagcggaatgtacttgcggtggtggcagttgcccatgcggatggtcaggttgcggttcatcgccaggccgatgggaaactgccgcgagtcttcggcgtagacgccgatgatcgacagggtgccggccttggccaggccctgcaccgcccactccagggcctgtgcgggggcgttgccgggactccagctggtgccctcctggcgcggcgccggggtggcggtgccatggctgtgctcggcgtccacgccgacggcgtcgatggcgcggtccacgccgatcccggcggtcagccagcgcagggcctggaccggatcctcgcgctcgaagtcgatcacttcggcgccttgctggcgggccatgtgcaggcggtccgggtggcggtcgatggcgaacaccctggcggcgccgaggagcaacgcgctggcgatggcgaactggccgaccggaccgcagccgaacacggcgacggtgttgccgggggcgataccggccagttcggcgccgaagtaaccggtggggaagatgtctga

SEQ ID NO: 8134 - DNA, 1260 bp, Pseudomonas aeruginosa
caggagtatcgcctggtcgtcgctgatgctgctgggcaggcggatcaggccgatgttggcatagggaatccgcgctttctcggcttgcagcccatggaagccgccgttggcccgggggccgccgaagaacgcggtgccggcctggctgccgccggggttggcgacgtcgcactgggcgtagtagccggctcggcaatacacgcaattgccgcaggcgatggtcgagggaatcaccacccggtcgccgacctgaaggttgcgcacttcgtcgccgagcgcctcgacgatgcccacgccctcatggccgaggatggttcccggacgcatgccgccgacgctgccacggacgaagtgcaggtcggtgccgcagatcgccgaggcggtcagccgcacgatggcgtcggtgggctcctgcaggcgcggctccgccacgtcttccaggcggatgtcgccgatgtcatgaaataccacggctttcatggcgttctcccggttggggcccggcctcggccggaacggcaaaggcgggccgggtggaagaaaggctcagtagtgggcctgggcgacgccctgcaggacggtggcgctggaggcctggtcgcggcagctggcgatgttgcccagggaaaccacgccgaccagccgcttctcgcggttgagcaccggcaggcggcgcatctggatgtcggccatgttgcgggccacgtgctggacgtcttcgtcttcgaagcaatagtggatgtcgccgctcatgatgcggcccagcggggtatccccggacaggccgccggccaccgcgcggatggcgatgtcgcgatcggtgatcatcccgaccaggcggtcgccttcgccgaccagcagggcgccgctgtcgatcctcgccatggtggcggccgcctcgcggatgctctgctgcgggtcggcgacctggacgttgcgggtcatgatgtcgctgatcttcatgctgtcctcctgtgtagggtggatgtgcgggcgccgcgtgcggcacctacaggttccgactggaggtgccgggggcggttcagcttttttccccgccgttcatccttccgctcccggcgcccggcggttgtagctcgaacagcaggaaactgcggccgccgaccaggaactcgctggcgaacgggtagcgttcgccgagcgggtcctccggccgctgggtatccagcaggcaggtccagccgctgccttcggccacctcgggaagacggaaggacaccgcgtcgtggtaggcattga

SEQ ID NO: 8135 - DNA, 636 bp, Pseudomonas aeruginosa
gcgccgcaagacgggcgcgggcgtcctcgccgcgcttgtggtcatggctggcggtggccagcagggcgcgtgggctggccaggcgcctggcttcgcaggcggcatggaattcctcggcggaagcggcgaagcgctgcgggtcgaagccgacgtcgttgcgcgagagcagggccgccgagcgatagcaggcggtatcctccacggccttggcggcggtcggcgaactcaactgctggaagcgcgccagcaactcgccgcgcaggcgccgcagcggaccgggcggcagctcgcgcagcggctgcccgccgagccagcgttcgagatggtcgaggaccgcccggtcggcttcgtcgagatcctcgcgggccgcctctgcggcatagcggaacacctcgcgatcctgcaccgagcgaccgcaggccccggcgtaggtacggtagaccggaaagcgcgcgagcaactggaacagcgcgcggcggataccgcccagggtcaggtcgcggctggccaggtcggcccgcgccacccgcaaaagtccctgggcgaggttctccaggtcaccggcgaggcttcccgccaggaccagttggcgagcctggtagacctcgtcgagaaacgcctccgggcgtccgctga

SEQ ID NO: 8136 - DNA, 546 bp, Pseudomonas aeruginosa
tgtcgtccgccgcggtgcgccaactggccaggcggtagtgctgcgcctcgagcaggcggtgcaggcgttggcgagcctcctcgtggcgttcctggagttcgcccagcgtgcgctggagggctgcgcgcggagcgctctcggcgagcgcagccgccagttgacgctgcatctcgcgcaaggcctcgcggtcctgccggcactcgcggaaaccgccggccagggctgacaggcgcggctcgccgctgtcttccagcagctccgggtaactgcccggccagagggggaagcgctgctcgccgtggctcgccagcaggcggccggcctcgcggtccaggctcaggccgatctccccggcagccaggacctcgccgtagtcgctgcgcaggaacggcagcagcacctggccgcgcaacgcggcgtcgtgggattcccactgaatgtcgaagaaactcgcgtagggactctcgcgcccccattcgagcacgtcctgccaccagggattggcgccgccgccgatgcccatgtggttcggcactatgtccatga

SEQ ID NO: 8137 - DNA, 729 bp, Pseudomonas aeruginosa
actgggcggccagaccccagcgacgcgagcgacccggggcgaggctggccagggacggacagctcggcggcgccatcgccaccgcccattcccgctgctccagcgacagctgcgcatagccgctgcgggcctgcgccggcaggcggccttcggcatccaggcgcagggcgatccgcgtgccgtcctcgtagaccagctcgcccggggtgccggcggggccgagcgcttgctccagcggctggccgcattcgccgaccagcagtccgaggttggcgctgtcctcgcgcagccgggccagcgcggccaggctctgttcgatctgttgcggactctgcgccggatagccgagtgcttccagcaggccgcgctggacctccgggtcgacccgctgcggccgtccgttggcgtcctgccagtcgagttgcaggcccacggcggcggccagttcggccaggcgtgcgtcactcatgggcgggctccaggctgaccgcgatgctgcggggacttaggcggccgcggcgatactcggcacaggcgaggttgtcgaggaacagcacccaggtggcggccgccggcggctcgacttccgcttcgagcggagaagggttgaagtcgattcgccagtcactgccgtcaccgagtcgccagcgcgccgacagcgcggcgccggcgatggtggtaacgcccagcgaacgggcgccgcgcaggcgcgggatcaggtgttcatga

SEQ ID NO: 8138 - DNA, 189 bp, Pseudomonas aeruginosa
accaggtgctgggaacgcatccgccgggacctgatcatcgaccaggggccgttgcagacgcgcgacagcgactatttccgcaagcgcatcgacctgctcacgttccgcgacagcgacaaccagcatctcactcatcgcaaggtcctggtcgccggcggcaagctgcgtaccatgagcctggctcgctga

SEQ ID NO: 8139 - DNA, 297 bp, Pseudomonas aeruginosa
gcaggctgtttcagctccgggtcggtcagtcgccgacccggccttccgacgcatggtccgaaccaaatccgtcttcgccccctccatctagaagtcatccctacgatggaggcggacatgcgttttcccacttctgcatcatcgggcgcgacagcgaccactccacgcaacccctcgagggatccggacgaatatccggttcctgaccacgaaagccacgtcccccaggaattcccggaagagattccgatggaacagcccaacgaagagcccctctcgcccataccggagccctga

SEQ ID NO: 8140 - DNA, 1590 bp, Pseudomonas aeruginosa
ggccatcgtccatccgctgccgcgcggcggcgtggcgccggaaggctggaacccgctgttcgcggagaaggtccgcgacgtcgtgctcaatggcgtcagcgtcttcagcctggccgacgcacaccgcgccggcgctcgcatgctcgccgaaggaccggtgcgggccaagctggcggaggcctgtggcggcctcggccagtacgtggcgcacgacctcgacgaactggacgcttggctcggcgggctggaggagcgtcagttggcgcagggcctggtactggaagccaacctggagagcatcgtcacccacagcgtcggccagctccgggtcaacggtttcctgctgagctaccacggtcaccagcaccagacccgcaacgcgcgcggcgaactggtctatgccggctccgacctgctggtggcgcgcggtggctacgccgagctgctggccctggacctggcccgcgaggtgcgccaggccatcgagtacgcgcggatcttcgacaccgccgcggcgatcttcttccccggctgcttcgcctcgcggcgcaactacgacattgcccagggccgggatggcaacggtcgggagcgcttcggcgtgctcgagcagtcctggcgggtcggcggcgcgagcagcgccgagatcgccgcgctggaagccttccgcgccgatccggggctgcccgcggtgcgcgccgcgtcgttcgagatccacgaagacaagcgcctgccggacaacagccgggtgatctaccgcggtcccgacgaacacggcgacttcctgctcaagtatgcgatgacgggggaggcatgacggcgaacagcgaacgcatccgcatcggggtcggcgacgaccggatcgaaggcaccttcctcagcccccgggcgaaggttcccggcgtgctcttcgtgcacggctggggcggcagccagcagcgcgacctgaagcgcgcccagggcatcgccgggctcggctgcgtgtgcctgaccttcgacctgcgcggccacggcgcggaaagcgggcgccaggcactggtgacgcgcgaggacaacctgcaggacctgctcgccgcctacgaccggctggtggcccacccggccatcgacagcgaggcgatcgcggtggtcggcaccagctatggcggctacctggcggcgatcctcagccagttgcgcgcggtgcgctggctggccttgcgggtgccggcgatctaccgcgacgaggattggctgacgcccaagctgctgctcgaccgcgaggatctcagcgaataccgcagcagcctgatcccggccgccagcaaccgagccctgcaggcctgcgcgggattccgcggcgatgtgctgctggtggagtcggagttcgacagctatgtgccgcactcgaccatcatgagtttccgcgccgccttccagcagacccattcgctgacccaccggatcatcgaccacgccgaccatgcgctcagcagcgaggcggcgcaggacgcctatacctcgatcctggtggactggatcaccgagatggtggtcggcgaacgtctcagcatcaccccggcctacgccaccatccatccggctttctga

SEQ ID NO: 8141 - DNA, 369 bp, Pseudomonas aeruginosa
cccgccgcctgcagcgcctgcaggagcgccagcgcgacgactcgcggcaggacgctgcgctggacgccgaactgccgccgaacctgccgtgatagccatgggccctgcgcctggcgcagggcccatcgaagagaggagggcgagacgatggccagccatctgttcctgatcagctacatcctcgacgaccagccgatgacctgcgaattgcacagcgaggcggataccctcagccgcgaggaggcccgccgccacttggaggcactgcatcgaccgcacgacgccgaggcgatcagcgatatccaggtcagcaaggtggagcgtacccatgaaccgggcaccacgccgggacactaccagcagccctga

SEQ ID NO: 8142 - DNA, 2031 bp, Pseudomonas aeruginosa
cgggcgaaaagcccgttcggcgctccttatgggcattcgaaagaacttttcgcccatatggttatatggattttctcgatatttcctctaggaacctcgccggctcgttggcgaagaagccgatcttttttgccgggtttcccgcatcgcccgccgcaatccccttgccaccccgtagccaagcaggcagccgagcagggtagcgccgacctgcaagaccaaccccagggcattggccaggctcggcgagcgtgcgagtacgccggcttcgggccagaacgccagccataccgcgacgaaggcgagcaccaggtcgtaccaggcgccgctgaccccgcccgggcggtagccgcgaacgaaaacgatgaaggcgctgaaggccagggccagcagcagggtgccgaaggcctggctgagggtatcgggtccggacatggctggttctcctcagggcgccaggcgcaggcactggcgcttgtgcaggccgagacggacttcgtcgagcagcgcttcggcgcaggcgaacaccctggcggcctccacttccgcgacgtcgccggcgcggctgaaatcgtcgatgcgcaggccggcgggcaggctcgggacctccaccagcgtccagtccaggccgctgaccgtgaggctgcgctcgagcccggcacccagttgctcctcgccggcatcgcgcggcgccaccagccattgccaatggccaagcaggaacaggcgcggtacctcggcgcgcagggcgccatcgatcagcgcggcgcagatcggcggcaaggcttcggcggcgtagtcggacaacggcgcgaacagcaggtcgagaccggcagccgcctggctgacctcgatcgacgacgccaggctggctggcttgcagcgcagcccggggcgcgcctgcaggctgttgagatcggcttgcaaggcgctgacttcgatctgtcgctgcaaggcggcggcgatcagcgcctggctcaggctgtcgtggggatggaatatccccagcttcagggttgcggtttccagattgcgcatgggaactccggggtcggtgcggtggaaaggagatgtccctacctgcatatcgaaagccatactccggacaaggttccggcgaatggaattcgccggccgcgccggggtcttccgaaaggtcggccaagttcctggggcgagccagcgagcggccggaagacgttcttcgtactaccttgctgggtgtgccttgcagcccgggtcgagcagccgacgagtgaacacgtccatgaaaaccacaagaaaaccgaaagtccccttgaaccaggccacgcgcaaccgcctgctcgacgaagcggtcgacgactacgcgatccacaccctggacagcgctggccgtatcgccagctggagcgccggcgcggcgcgcctgttcggccacgacgcgagcgagatcctcggccgcgactacgcctgctttcacacccgcaaggaccgcgacgccggcgttccgcaacaggcgctgcgccaggcggatgtcgagggccgcttcgagaccgagggctggcgggtgcgcagcaacggcaagcgattctgggcgcaggtggtgatcgacgccatccgcgacagccagggccagttgctcggcttcgcccagctgatccacgacctcagcgaagggcgcgcggccaaggaggcgctgcggcgcagccaggagcagttccgcctgctggtgcagagcgttaccgactacgccatctacatgctcgaccaccgcgggcggatcaccaactggaacctcggcgcccagcggatcaagggctacctgccggaagaggtgatcggccggcacttctcctgcttctacacccccgaagaccgcgaggccggcgagccggcccgcggcctggccgccgccgaacgcgaagggcgtttcgagaaggaaggctggcgggtgcgcaaggacggcagtcgcttctgggccaacgtggtgatcgatccgatccgcgacagcgatggccggctgatcggcttcgccaaggtaacccgtga

SEQ ID NO: 8143 - DNA, 1245 bp, Pseudomonas aeruginosa
catcacccaccggatcgaagccgaacgcgaactggaacgggcccgccaggagctgttccaggcccagaagatggagtccctggggcacctcaccggcggcgtggcccacgacttcaacaacctgctgacggtgatcatcggcagcctcgggctgctgaagaaacgcctgcccggcgaccagcgcaccgccgacctcttgcagaacgccctggaggccgcccagcgcggcgccaacctgacccagcggatgctttccttcgcccgcaagcaacgtctcgatccgcagccctgcgcgatccccgacctgttgcgcgggatgaccgacctgctgatccattccctgggaccgagcgtatcgatcgagacgcgctttcccctggatctcgacctcggcctgaccgacgccaaccagctcgaactgtccatcatcaaccttgccaccaacgcccgcgacgccatgcccaacggcgggcgcatcgtcttttccgcgagcaaccagcgggtgccggcggacaatccccatcgcctcgcaccgggcaactatatctgcctgagcatcagcgacaccggcagcggcatggacgaggaaaccctgcgccgtgcggtggaacccttctacaccaccaagggaattgggcgtggcaccgggctgggcctgtcgatcgtcgacggcctcgccgagcagctcggcggccggctcaccctggagagccagccgggcgtcggcaccaccgcgaacatctggatacccgccgtcccgcgaaccccggaaagcgcccgtacgggcaatggcgcgacgccgcagccgcccagcgaaagcgagcgggtgcgcttgtcctgtcgagtactggtggtggacgacgacccgctggtgttgaacaacaccgcggcgatgctggaggacctcggttgctcggtactcaaggccgactccggcagcctggccctggagattctcacggcgacgccggagctggacatcctcctgaccgaccaggcgatgccacggatgaacggcagccagttggtggagcgggtcatggcccagggccggccgctgaagatggccctggccaccggcttcgcggaaaagatcgaaggcgcggcggcacagttgcccaagctggccaagccgttcggccaggaagagttgtacctgttcctgaccggcacgctgaaggccggctgagcctcagcgcaggtactcgccgctgccggccaggctttgcccccagagctcgatga

SEQ ID NO: 8144 - DNA, 381 bp, Pseudomonas aeruginosa
cgggcacctcttttctgtggcgttcaggagtctggaccggcccggcgcgagggggttcaggtggcgtgccgggcggtccgcgaccgcccatccagggccttgaaccggaagacgcggggagcgccgaaagacaaacgtccctgtcttccggaggagcccatgaccacctacgaaatccagcacatgcgcggctggcggcgtttcgcccgcaccgtgcgcgccgccagccgggccgaggcggaacgcctgtgcctgccctgggagtgggtggatggcgaggtcctcgcggtgattccggccgaggccgaggtggccgagcgctggcagcgcctgaacgaggatctggtggaaggcctggagcgcctcaggcgggacgagtga

SEQ ID NO: 8145 - DNA, 402 bp, Pseudomonas aeruginosa
cccgcaggccgaccacggcgatccgctcggcttcgcggtaggcggggctgtccaactcttcggcgaacacgtccgggtccagttcctggtagtcccagtcccactcccgagacgccaggcgttcgcggatgcgggcgaggaacggatcgccgccttcgaccatcgccaccccggtatacaacagcaggctgccgccggcttccaggcgctcgagggcggcatcgacgattgccagcgagagcccggcgccgagcatcccgccaccatgccggtaggcgcgctccgaggcatccaggagatagggcgggttggccacgatcaggtcgaagcgaccgggcgcctggctcagcaggtcgctacgcgccagggtcaggttaccgacccccgccagcgccgcgttga

SEQ ID NO: 8146 - DNA, 1386 bp, Pseudomonas aeruginosa
cacgctcggcgagcatttcgccgaggagatgttcgaatgccaggtcgaggtggccagcccggtgttctccaccctggccgaggccgcgcgcttccacggtcaggcccggcaacgcctggcgcatctggccatggacttcggcctgcgctcgctctgcgtcggcacccatcccttcgccgactggcggcgggcgcgaagcaacccggcggcgcacttcgcccgcctgttcgaggaccaggggcgggtggcccggcgcagcctggtctgcggcctgcacgtgcatgtggagataccgccgagccacgaccgcatggctgtgctccagcgcgtgttgccgtggctgccgctgctgctggcgttgagcgcatcctcgccgttccgcggcggccggcgcagcggcctggcgagctatcgacgggcactctgcggcgagtggccgaggatgaacattcctcctgccttgcccgacgaggacgcctatcgccgccacctggcgctgctgcgcgagaccggctgcatccgcgaggatggccaggtctggtggatgatccggccgtcatcccatgtgccgaccctggagctgcgtatctgcgacgcctgcccgcgcctggccgacgcgctgagcctggccgggctgttcagggcgctggtgggcgaagcgctgggcgcggacccgcgtgcgttgccggtcgcgcgcgacgcctgcctggaggaaaactattggcaggcgctgcgttacggttgcgccggccgctatctcgtcgacggccgctgcgtaggtgccggggactggctggaaatggcctggcgacagtgccggccgcaggcccgccagggcaacgagtgggcctaccagcatgcctgcgggttactcgaagagacctccgccgcccgccagttgcggcgttaccggaggttgcgcgaagcgggccaggagcgccatccggcactgcgccggctggtggaggagctgctggaggaaaatctccagccggccttggccggctagcgcgccgttcatcattcccttcatcctcggctacaccgcctgcagctactacgtatttcgcggcaagagcgccgatgccggctatcactgagccgggccgctcaggaacaggcgcgcccgatccgcggcgtacggcgggcaccggcgaggagcagggcgaactcgtcgtgaaggacttcgctcatccggcgtaccgcctcgtcactggccaggagatcgagggcgactcctggaatggtgatgttttcttgcggattgacatggctgctgaattgcaaggtgacttcatgggtatcgctgatggaaaccaggcagtcgtagccagccaggtaatttcggaaactgttggcaatcatgcggggcgtagtcatggctga

SEQ ID NO: 8147 - DNA, 453 bp, Pseudomonas aeruginosa
ggagaatgcagcagggagtccgccgccatgagtttttcccgtttcgcccaacgcctgtccaactgggccggccgcccgccaaccttcgtcgttgccctcggattgatcctgttgtgggcgatcagcgggccgttcttcgacttcaacgatacctggcaactggtgatcaatacctcgaccaccattgtcaccttcctcatggtcttcctcatccagaacacccagaaccgcgataccgacgcgctgcatatcaagatcgacgaactgttgcgcagcacccgacgtgcccacaatgcgctgctcggtctggacgacctggacgccgatacccttcgcgaactgcgtcagcgctaccagcacatgggcgagcaggacggcgagacgccggaaagcgtcgccgccgaggaagagcgccagtgcggatgcggcgaggagcgacggcgcgccgactga

SEQ ID NO: 8148 - DNA, 582 bp, Pseudomonas aeruginosa
tccatacggtggacgattcgcctatacccgctgccgcctgccagtggagtatccattcttagtttcccgcgccgcccagcatattccggcaagcggaaggccttggatcggctaatgattttttcgtcccagggcgcccgcaaagagtttgaacgatccatcgcgcaagccttcggagtaagtgcacgcggcgaaaaacgccgcatccctttcaaccctcgagaggaggacacgagcatgaccgacaaacgacaaggcatgagcaccagcgaagccgggcagaaaggcggcgcagctacctccaggagccacggcaaggagttctaccaggagatcggccacaagggtggccaggccagcggcggcaacttcgccaatgacccgcagcgcgccgccgaagccgggcgcaagggtggccagcagagcggaggcaatttcgccaatgacccggaaagagccgccgaggcgggccgcaagggcggccagcagagcggcgggaacttcgccaacgatcgggaaaaggcctccgaggcaggacgcaagggtggccagcacagccacggcggcggacgctcgtcctga

SEQ ID NO: 8149 - DNA, 246 bp, Pseudomonas aeruginosa
ccgtcgatacgcatggttcgttttcccgcatatgccaaagaaggagtcgagaataagaatccgggcagcggcgagatatcagaaaacgcgggcaaattttttgttttccgcacgctgcccgcgcgagcgctaggtaaatggctgcgacgccgggaagaaacttcgaactccccgtatgcgggcgattcacaagcagggagagccgcgccgaaaacggcgcgccggaagaaagagacagaacgatga

SEQ ID NO: 8150 - DNA, 357 bp, Pseudomonas aeruginosa
tgtcgccggctcccgactatctctctcacggatgaaagggcaatgcaccttcttgaacgtcaacacgatatccagcccctctcgcgggcagacatgaccatccacctcaatggccagcccgtcgcggcggctgccggtgagaccgtgctcaacgtgctcaatgccgtgggcctgcgccggctcgcgcgcaacgaccatggccaggccagcggcgccttctgcggcatgggcgtatgccactgctgcctggtcgccatcgacggccggcccaagcgccgcgcctgccagaccgtcgtccggccgggcatgcgggtggaaaccgaaagcaaccgcttcgaccaggaggaacggccatga

SEQ ID NO: 8151 - DNA, 1059 bp, Pseudomonas aeruginosa
catcgtgattgccggcggcggcgtgatcggcgcgtcctgcgcctaccaactgtccaggcgcggcaacctgcgcatcgccgtggtcgacgacaagcgcccgggcaacgccacccgcgcctcggccggcggcctctgggccatcggcgaatcggtgggactgggctgcggggtgatcttcttccgcatgatgtcctcccgcaaccggcgcgaggcccagggcgcggcggtggcggtggacgcgagcacgccgcacatcctgccgccggcgttcttcgacctcgccctgcaatccaacgcgctgtacccggaactgcaccgagaactgatcgaacgccacgggatggacttcaagttcgagcgcaccgggctgaaatacgtgatccaggacgacgaggatcgccagtacgccgagcacatcgtggcgcagatcccgcatctggccgagcaggtgcgctggctggaccgcgaggaactgcgtcgtgccgagccggcggtcagccacgcggcccacggcgcgctggaattcctctgcgaccaccaggtcagcccgttccgcctggccgacgcctacctggaggcggcgcgccagaacggcgtcgagctgttgccgggaaccaacgtcaccggcgtgctgcgccagggccggcggatcagcggggtgcgcacggacaatgccggggtgctgcattgccggaccctgatcaacgccgccggcgcctgggccgcggaactcagcgaaatggccaccggccggcgcatcccggtgaagccggtgaagggccagatcgtcctcaccgagcgcatgccacgactgctgaacggttgcctgaccaccagcgactgctacatggcgcagaaggacaatggcgagatcctgatcggcagcaccaccgaggacaagggcttcgacgtcagcaacaccttcccggaaatcgccggcctggtgcagggcgcggtgcgttgcgtgccggagctgcaacaggtcaacctcaagcgcacctgggccggcctgcgcccgggctcgccggacgaactgccgattctcggtccggtggctga

SEQ ID NO: 8152 - DNA, 654 bp, Pseudomonas aeruginosa
cgtgcgccccatgaaaaccagctacgacgacacccgccagcatctgctcgataccggataccggatcatggcggtcaaaggcttctccggagtcggcctcaacgaaatcctgcagaccgcgggcgttcccaagggctcgttctaccattacttcaaatccaaggaacagttcggccaggccctgctggaggactacttccgcgtctacctggcggacatggaccaacgcttctccgcgccagggctgaatgcccgcgaacgactgatgagctactggcagaagtggctggacaacgcctgcccgccctgcgacgagcagcgctgcctggtggtcaagctcagcgccgaggtcgcggacctttcggaaagcatgcgcatcaccctgcgcgacggctccgacgggatcatcgaacgcctggtcggctgcctcgggcagggccgcgacgacggctccctcgcgccctgcgatgcccggcacatggccagcgcgctgtaccagttgtggctcggcgcgagcctgctgagcaagctgcaccgcagcccgggaccgctggagacagccatgcagaccacccgcagcctgctggaaatctgaggtaccgccaggaaatacccgccccgcgagaggcgggtattttttcgacccgtcagtag

SEQ ID NO: 8153 - DNA, 246 bp, Pseudomonas aeruginosa
ttgactggtctaatttgcccggcgcacggtatgagccgttcgccacattcgtcagacagaggagtctggaaatgtcccaatccacgcaggtcaaccgccgcatcgtcctcgcctcgcgcccccacggcgccccgacccgggataacttccgcatcgagcaggttccgcttcctgagcccggcgcgggccaggtgctgctgcgcaccgtctacctgtcgctcgatccctacatgcgcggacggatga

SEQ ID NO: 8154 - DNA, 630 bp, Pseudomonas aeruginosa
gcgacgcgccgtcctacgcgccgccggtggagctcggcgcggtcatggtcggcggcacggtcagccgggtggaagcctcgaaccatcccgggttcaaggtcggcgactgggtactctcggccaacggctggcaggactacgcgctttccgacggcagcggcctggcgcgcctgggcgagtcgccggagcatccgtcctacgccctgggcctgctcggcatgcccggcttcaccgcctacatgggcctgctcgacatcggcaagccccaggccggcgagaccctggtggtggccgccgccaccgggccggtcggcgccaccgtcggacagatcggcaagctcaagggctgccgagtggtcggcgtcgccggcggtgcggaaaaatgccgccacgccgtgcaggtgctcggcttcgatgcctgcctcgaccaccatgccgcggacttcgccgaacgactggccgaggcctgcccggacggcatcgacatctattacgagaacgtcggcggcaaggtcttcgacgccgtcttcccgctgctcaacgccaaggcccggatcccggtctgcggcatcgtcgcccactacaacgacaccgagctgccacccgggccggaccgcttgccggcgctga

SEQ ID NO: 8155 - DNA, 567 bp, Pseudomonas aeruginosa
tgggcacgatcctgcgcaagcgcatcaaggtgcagggcttcatcatcttcgacgactacggccatcgctacgatgaattccagcgcgacatgtcgaagtggttcgccgacggcctcatccagtaccgcgaagagcgggtcgacggcctggagaatgcccccgaggccttcttcggcctgctccagggacgcaatttcggcaagctggtggtgcgcgtcggagccgacgcatgaaccaggcggtccgtgtggtagcgctgttgcaggcgcgcgagggcagggcggcggaggtcgagcggctgctgctggcctgcgtgcagccgtcgcgggccgaggacggctgcctgtcctatgtcctgcaccggagcctcgacgaggccgggcgcttcgtcttcgtcgagcgctgggccgaccgcgacgccatcgagcggcaccgacggatgccgcactacagggcgatggccgatgccgtcgccgatctcctggcggaccgccaggtgttcctcctcgaggaactgccagcggccagcctgtctccggtagatccggaacctacaagaccccatga

SEQ ID NO: 8156 - DNA, 888 bp, Pseudomonas aeruginosa
ggagtgaaacggatgaaagtcggatttctgggcctgggcggcatgggcgccgccatggccacccgcctggtgcaggcgggactcgaagtgacggtgtggaaccgttccgcggcggcctgcgagcccctggtggcgctgggcgctgccagggcggaggaggtcggcgacctgttcggcctcgacgtggtcatcagcatgctggcggacgaccaggcgattcgcggcgtgctgctcgacagcggcgcgctcgaacgggcgaggccgggtctcatccacctgagcatgtcgaccctgtcgctcgattgcgtcgaggcgctcgaccaggcgcaccagcgccagggcctcgcgttcgtcgccgcgccggtgttcggccgcaccgacgtggcggaggccggcaagctgaacatcgtcgtcggcggtccggaggaagccatcgagcaagtcaaggcgctgctggaaattatgggacagaagacatggtttttcggaaaagacccgcgcggggcaatggcggtgaagatctctggtaacttcatgatcgccagcgccatcgaaagcatgggcgaaagcgtcgccctggtgaagcgcctgggcgtcgagcccggccggttcatggagctcatgtcctcgacgcttttcgatgcgcctgtctatcgcaactacggcccgcagatcgtcgagcagcgtttcaccccggccaggttccgcctggtcctcgggttgaaggatgtcgacctggcgctgtccgccggcaagcgccacaacgtgccgctgccgctggccagcctgttgcacgacgtgttgctcgaagccatcgcccatggcgacggggaatcggactggacggcgctggcgaaggtagcgttgtcacgatcgggacaaatctga

SEQ ID NO: 8157 - DNA, 1608 bp, Pseudomonas aeruginosa
gcggaagaaggtatgtccgagcgtggaacggctgcagaaggccggatcaactggcgacgcatcctgccgatactgctcaccaccaccctggtgggcggtatctgtgggatcttcgtcatcaacgaactggatcgccagcacgacggcgcgcacctgcgctcgtacaccgagagggcgctggagcgggcactggagatttcctccgcggcggaccagatgctccgcgagatgaacgccggcagcgcgccggcctgcagcgaccgggacctggaaatgctgcgttccatcgtgctcgagtcgcgcttcatgagcgacgttggcaggatcagcggcgaccgggtcatgtgcacgggcgtccggggccggctgcgcgcgccctggggattgtccgcgcccgaccgggtagatgccgccggcacccgcttctggacggagggcatgcccctgccgttgcaggcgctgcccaccgggctggtcagtcgcggcaacgccgtcgtattcattgccccgcacgcctatttcgatgtcgaccacccggacccgggcatttcggcggcggccgtcagcagtggcggcgactacatctaccaccgtttcgcctgggacgacgaccagcccctcgaggcgctcggccggcccggctggccgcgcttcatcggcgcccggcagataagcctgtgcgacccgacgcaggacatctgcgtggtctcccttctccgcgaacgcggcctgcttggcaccgagcccggacgcgcggccatggccgcggcgatcggcggcgggctgttgttcggcgtcatgctgctgctcagctacctgttcggcttcctcaacgacgaaaaactgccggccaggctgctgcgcgcgttgaagcgcgaggccctggaggtgcactaccagcccatcgtgcgcctggccagcggccgctgcgccggggtcgaggccctggcgcgctggaccgatagcagcctggggcgggtttccccggatgtcttcatcggcgccctggaggagagcggcgacatcgaactgctgacccgtttcgtcttccgccgcgccctgaagcagctcgggccgttgctgagggaacagcggagcttctacgtcagcgtcaacgtcaccggcaaggacatcgccgaccccggtttcatcgatttcgccatgcgccagatggccagggaaagcgtgcgcccggaacaggtcgcgctggaactgaccgagcgcaccaccgaggcccagggctgcctgctggccgggatgaaccgcctgcgcgaactcggcctgaagatctacgtggacgatttcggcaccggtcattcgaacctggtctacctggccaacctgccggtagacgcgatcaagatcgacaaggtcttcactcagtccatcggcgacagcagcgccgtcgaactgatcttcgacaagctctgctcgatggccgagcacctggagatcggcgtggtcgtcgaagggatcgagacacaggcccaggccgaccacgtgctgcgccgctcgcccgaggccctcggccagggctggcatttcggcaaggcactgccgctggaggccttcttcgactactaccggaaccagccggcgggccgctag

SEQ ID NO: 8158 - DNA, 1209 bp, Pseudomonas aeruginosa
  unsure (982): Identity of nucleotide at the above locations are unknown.
aacagaccttccgcggggcaccacgctgcgctagcatcggccgtccataccggatgcggcctggacggccgcactccggatcgcacggaacggccggaaacggccgcgatcaccacaggccgccatgcacgcattccccctcaccctggacaaccgactcgccgaagccctgccgctatggcgcaacctggcccgcaccgaccgggcgccgcgaaggaacatcgacctcgccgactggaaagccgactggcgcgaactgatcgccgcgctcgacaggttttcccggagccacggctatcgccagccgttcgccgcgcaagggcacgcagccctggaaaacgcctgggcctggggccaggccgcggaaaacgccagtacgctgctgctcaaggccatcgaccggggcctggccggcgccgaactgcgctccatctacctggagaccgccgcgctgtggctggactacagccggctgctcggcgccgcccgcgacagcctgcgcgagcagggcgaggtcgacttcgagacggtgccggccctggcgccgcgcacaggccagtatccgttcgcgctgcaactgctcgccatgggcgtgctgctcgatgcccaggagctcatcccggcgctggtcgaggaggtcctgcagttcgataccgaccgcctgctcgactatctcggcgcggccgccctcggcctgacttccgccagcgaggaaaccttccatccaaggccgttcgggcagttgcgggcgttcttcgaagaggcggacggcagcgacgcccaggcgctggcgccttacctgcaaagccagtaccgggagtttttccagctttcccccaaggcgcagaagaagacccgccgcctgaccggcccctacgcctggggctggtgggccatggaggtgtcggcgctgggcgtgctctacggctgggacgatggcgtcctgcgcgcctcgccgcattacctcggcgacctggtcgantacgcgcgggcgcgcggcgacgcctgagccaccggccgccgctcaggcccgccggcggcgggcgaggaacgcggcggccaggtcgaggctggtgcagagcaggaagtagagcagggcgacgaacaggaagatctccgtcgggtggaccatcacccggttgctcacctgggtggcgacgaaggacagctcgccgacgccgatcacgtaggccagggaagtgtccttga

SEQ ID NO: 8159 - DNA, 459 bp, Pseudomonas aeruginosa
  unsure (430): Identity of nucleotide at the above locations are unknown.
ggaaggatggcagcatcaccggcagcgcctgcggcaggatcaccaggcgcaatacctgccacggccgcagtccgagcgcgcgggcggccgcccactgcccggcggggaggctgtggatgccggcgtacaccgagtgggcgaggtaggcgccgccgatcagcgacagcgcgcagaccacggtggccagcgccggtacgtcgacatggaagacgatcggcagcaggaagtaggtccagaagatcagcatcagcaccgggatcgcgcggaagaagccgagcagcgccaccagcagcaggcgcggcttgccgggcagcaccgcgagggccacgccgaggaccaggccgagcaccgccgaagccagtccggagagcgacgccagcagcagggtcagcgccgctccgccgagcgggccgtccgggtatgcgccgancagcaggtatgacaggttgtccgagatga

SEQ ID NO: 8160 - DNA, 435 bp, Pseudomonas aeruginosa
gcgcgcgccggccaggacagcaggcgccggcgcgacagccgggcgatggccaggggggcgccgatcagggtggcgagcaggcaactgagcagggcaagaccgagggtcagcaggaagccgtcgagcaaccagcgcaggtactgcggggcgagaagttcgccgaacatgtgcgggattccgtcgggtagaacgaaaaacgcgcctcagcgaagtgaggcgcgcgggtcgtgcgggcgaagcgggccgctcagctcttgtcgccgatcttgtacaggcgcgccagcggggtcttggtctgcggaccgaaccaggtgtcgtagatcttctgcgcctggccgtcctgctccagctcgcgcaggctcttgtcgacgaactcggtcagggacttctcgcccttgggaataccgacgccgatcaggtcgttggaaatggtga

SEQ ID NO: 8161 - DNA, 918 bp, Pseudomonas aeruginosa
ggcgttaatgacctacgtggggtggaaggacatcaaatcggcgatgcgctacatcgaccctgccatctcctttggcggcctcgctgcgaggcctgctctcgaactaaatgccagcactttgactcaagtgccagcttctcactaacatcgacgcacgacaggagtgacggtgcaatgagtacgcagaccagcatcgaatggacggaaatgacctggaacccggtggtgggttgcaccaaggtgtcgccgggctgcaaacactgctatgccgagaacatggcgcgtcgcttgcaggccatgggcacgcccggctacgagaacggctttcgcctcagcctgcgcccagagaaactgcaggagcctctgcagcgcaagaagccgaccatctactttgtcaattccatgtctgacctgttccatgagcaggtgccggacacctacatcgaccaggtgttcgcggttatccaccaggcctcacagcacaccttccagatcctcactaagcgggccgagcgcctggccgactatttcagccagcgcacaccgccggccaacgcttggctgggggtctcggtcgaggaccgggagtacggcgtgcccagaatcgactgcctgcgtggcatcaacgccgcgatccgtttcctctccgcggaacccttactagaagacttgggtgaactgaacctgactgacatccattgggtcatcgtcggcggcgagtccggcgccaaggcccggccaatgaagcaggagtgggtggataacatccaccgccagtgcgatgcctttggcgctgctttctttttcaaacaatggggcggctggggctccgatggcgtgaagcgttcaaagaaagctaatggccggctgctgaagggccagacctgggatgaaattccgctgctgaccctcgcctga

SEQ ID NO: 8162 - DNA, 1338 bp, Pseudomonas aeruginosa
taccaaaacaaggacgacccgatggccaaggatgacgagaagtaccgctgggactgggcaacccaaacctttcccaccatcgatccacacagcaagatcaagcaccagatcatcgacgactacatccaggcctacatcgatgtcctgatgcggaatcagcaaatgccactgcttggcctatcaattgtcgatggcttcagcggtggaggtatatataacgacagcgcaggcggtcaccacttcggctccccggtgatcgccctggaagcaatccaggagtcggaagtgcgcaacaacgtggggcgcatcaagcatcgaccgatctgctcgcagcatcactttgtggatgtgaagccgaagaatactgcttgcttgcacgccgtcctggccagccgcggacatcaggcccgcattggacaggacattcacctgcataccgccgagttcaccaaagctcttccggccattgcgcaaagcctcaaggcctttggaaaaagcgagcgcgttctgtttctgctcgatcagtacggctacggcgacgtgccattcggccagatcaaatggatcttccagcacctcagcaatgctgaggtcctgctgaccttcaatgtcgactttctaatcacgtacttagcggaccgccacgccaaccgcaaggctattgccagtatcggtctagaacagtatgtcccctgggaacagctacggcacttaaaagcacatagctcccaggattggcagtacctgatccagcgctatctgtcggacgggatcaagcaggaaagcggcgcgcagttcatgacggtgttcttcattcgcccacacggcaccaaccccatggcctactggttcatccacctggcgaacagctaccgcgccaacgacgtgatgaaagccatacactggaagtacggcaacaatttctcccacctgttatcaccgtcctgcttctttggttacgacgctaaccgggatgtgggggtgaccggccagccggacctactctgcgaaggagaacaccagttcgaccaagtgactgatacccggattcgtggggaactgtccgagctgctacccaaacaggtattcgaagtcgagcgtcgtcccttcatccagctcatgacggagctcaccaacttcaccatggcagacgaaagtcgcgtgaagctggccctggatgtcgcggtggccaacggcgatatccaggcagtggacaaggaaggcaagagcaggcggcgcaaaggcacgagcatcaagtccaccgatatcctgatcgcgccgccgcagaagacgtttttcttctttccccaacagaagaagacgtccagggacacatga

SEQ ID NO: 8163 - DNA, 198 bp, Pseudomonas aeruginosa; identical to SEQ ID NO: 4672

SEQ ID NO: 8164 - DNA, 1410 bp, Pseudomonas aeruginosa
atggatttttcaattaatcccccccagcgaattgtctttgtgggactaggaacgattgcccagtccttccttcctctcctttctaaggttcacgacttatctactttagaaatctacgcgatcgatccaaaaacaccaccgcttattgagtactttgctaacagttttggcttaaaatttatcaactctgcaattgatcaaatcaactatcgcgacattcttgtgccgattcttggtgaagggacggttctaataaatctatcaaccgatgtctcaagtcttgccctgatagaattatgccgctccgcaggggctctttatttagacacatgcattgagccgtggaagggcggatatgatgacccaaccataccactgcataagcgaactaactatcacttaagagaacaaatgctgtctctgaaaaagaggctaggctcaggggtgacggctctcgtggcgcatggcgcgaatcctgggttggtatcccacttcgttaaacgtgctcttttagatttagcggaagagatattgggtgattgtaaaaagccctctaataaagagcagtgggctatcctaagccaaagattgggtgtcaaagtaatccatgtcgcagagtacgactcgcaaatttctcagaaatctagggagaggggtgagttcgtaaatacttggtcagtgcatgggttcataagtgagtcgcaacaaccggcagagttgggctggggaagtcacgagcgaagtctacccacggatgcgtcaatgcatacagatggatgcggagcagcaatctatattgagaagccaggggcctctgttagagttaagacatggacgccatttaacggccctagcttaggttatttggtaactcatcacgaggcaatttcaattgctgactttttgacgctcagaactgccgatgagacatatagaccaactgtccattatgcctatcgcccaagcgatgaagcaattctctctgtacatgaatggttcggcaatgattgcatgactccagaaaagacaaaagtacttcgtcctggtgatatcttgtcgggttctgattacctcggtgttcttcttatggggcacgaaaaatctagttattggtatggatctatcttaagcatcgaaaaggccaaggaacttgccactctcaacactgcaacaacgttacaggtagcagccggagttctttccggttacttatggatcctgagccatccgtcggcaggaataattgaagccgaagacatggatcatgaagtggcactatcttatatttcacagtatctaggcgaactaaaaggggtttattcggactggaatcctaccaaaaacaacccaggcaccttttcggccatagatagcgactctccctggctgttctcaaattttgtcctctga

SEQ ID NO: 8165 - DNA, 744 bp, Pseudomonas aeruginosa
acaaggagcgttcaagtgtcaaatgttaagtcgggtattggtcttaaaagctacgaatggtcatccctggagttgctgaagggtttgtcaattgaacagataaagtcgaatccctcaaagctcgaggagcgtcggcctttcttttggcatgacatgagctctgaatttgattcaataaacttcttgcgctacttgtttggccgtcgcgacattcaatttagcaatgaatttatcgagttcgtatgcctgtggcatctcgatgagcaaaatcattatcgcggactgagaaagattaatagcgtactttactccatgccggaagacatgattgatcgcgagattagatcgaactctccggacttttctcatatcgaagacttcatgaaggatgaattcacaattcttctctctatcgcatttgatgaagtgaccagcacaagagcctacaagcaagatgtaagcttctttgactcgtttgaaaacgagtctctttcaacctggattagatatgctgcccgtgatgaggcagcccattacggtaatgcaatgaaaattcttcgccttaatcactctcatcgctttgatgaggttgaggcgattctagacaagattgtggaattcgaaacttcagagagcttcgactatcagcgaacctttatatttgaccatgacaccgacgacttttctcatgttttattgaaggatagtcgcgataccatattagaggtacttcgaggaaaatga

SEQ ID NO: 8166 - DNA, 483 bp, Pseudomonas aeruginosa
ccaagatctgaagatgccatgagcaaaaattcaaatatcaagttgatctcagcctcaatagatgatgagctcttactcgtggagctaatgaaaaaataccacctatacgatggtattgagatgactgacgaagacaggctggctgcacttcgccctctcttgtcatcttcagaaaagggcaacgtttggattatttgtcttggcagcaagcagattggatatattgctacttgcaattgctacagtatcgagttcagggggattgaggtctggattgatgaattttatatcgatgaacagtgccgaggacagggatttggcagtgagattctagaaaaggtcaagtccttcttgaagtctcaaggtgccgcaatagttcatctagaagtggacgaaaataatcctaaagcagtaagcttttataagaagtcaggtttcgaatttcgcgagcgattcgttatgatgagtcatagtctcaagtaa

SEQ ID NO: 8167 - DNA, 411 bp, Pseudomonas aeruginosa
tgcaggccaaggacttcttccacatggccagcctgcgccacggcaagcagcagggcctcggtctccagccggccttccgcacccgcatcctcagccccgacggccagccggtacgcagcttcagcggcgacagcatcgccgtcgacggtcccctcgccgcctgcgatatcgtggtcctgcccgccttctggggcgatttcgacgcgctcgaacggcgctatccgcaaatcgttccctggttgcgccgcagccatgccgagggaaccgccctctgcggcgaggcgaccggggtcttctggctggcccaggcaggtctgctggatggcaaggaagcgaccacctactggcgcttctatcgagaattcgccgaacgcttcccgaacgtgctgctcaaccaggagaagcacctga

SEQ ID NO: 8168 - DNA, 420 bp, Pseudomonas aeruginosa
cagggccggcgcgacgacgtcagtcctgcatgcgtggcagcagcaggtccttcagatcgatcagcttgccatggcaagaaatgtccgctttctgccacccgcaacagctcgtgcggtcgtgccagggactcgctccaggcatataccgcggccggcgtgaccacgtcgtcgtcctccggctgcaccacggtcagcgggcaacgcgcaggcaggctgaccgcgaagcgttccaccggcggcgcgatcatgaacagccgcgccagcccgacgccctgcgcttccaggcgacccgccagattgccggcgacgcaggagccgaaggaaaagcccatcagtgtcagcggcaaccccggatggcgtgccagcaaccagcgcgcggcggcctcggcgtcgtcgatctcgccgatcccctcgccatag

SEQ ID NO: 8169 - DNA, 2010 bp, Pseudomonas aeruginosa
aaggcaagtactgacgcgctgcgcgaacctgccgacgcccatgaaaaagccccgcatccgcggggctttttcatggctgcgagacgatcagatcgcctggcgctcgcgcaacaggtcgagcacctgcttcacgccgtcctcgacgctcagcgcctgggtatcgatcaccaggtcggcatccagcggcacgtcgtagggaaaggactcgccggggatattgtcctcgcccgccgcatacagcccctgtggatcgcgttcgcggcagacctgcggcgacgcctgcacatagacggtgatcaggcgctcggcgccgatcagcgccctggcctgctcgcgcccttccgcgctcggcgcgacgaaggcgcagaggctgatcaacccggcctcgttgaactgcttggcgacatgggcggtgcgcagccagttctcggtgcgcccggcgcggtcctgcggcaaccccttgttcaggtcgtggcgcaggttctgcccgtccagcacgtagaccgcgcggcccatatcgaacagcttgcgctccacggcgtaggccagggtgctcttgccggcgccggagaggccgctgaacagtacggtcgccggctgctggccgaagcggccggcacgctcctcgcgcgtcacatgggcattcgaaccgtgatgagcgctgctgccatgggccgccgacggagcggagatgatcatgccggcgccaacggtgccgttggtcaggcgatcgatgacgatgaaggcgccggtggtgcggttctgctcatagccatcgagcgcgatgggcgcgtccaggctgaccttgaccctggcgatctcgttcagcttcagctcgctgcccggggtccgctccagggtattcacgtccaccttgtggacgatgctcggaatcgaacccggcacatagctggtagcgcgcttgatatcgtacttcttgcccggaagcatcggctcctcggccatccacaccagcatggcatcgaagccgtcggtgaccagcgggcgattgtcggcatgcaccagcatgtcgccgcgggaaacgtcgatctcgtcttccagggtcagggtgacggcctggccgggaccggcctgctccagttcgccctcgaaggtgacgatggatttcaccttgctgcccttgcccgacggcaatgccaccacttcgtcgcccttgcgcaccacgccgctggccagggtgccggcgaaaccgcggaagttcaggttcggccggttcacgtactgcaccgggaagcgcatgtcatcgaggttgcggtcggcggcgatctcgacggtttcgaggatttccatcagcgactggccggcgtaccagggcgaacgctcggacttgttgaccacgttgtcgcccttgagcgccgacatcggcacgaagtgcagcgaactggtcttcagaccgatcttctcggcaaaggccaggtagtcggccttgatctgttcgaagacaccctggtcgaagcccttcaggtccatcttgttgatggcgaccacgatatgccggatacccagcagggacgcgatgaaactgtgccggcgggtctgggtctgcacgccgtagcgggcatcgatcaggatgatcgccaggtcgcaggtcgaggcaccggtagccatgttgcgggtgtactgctcatggccgggcgtgtcggcgatgatgaacttgcgcttggcggtgctgaagtagcggtacgccacatcgatagtgatgccctgctcgcgctcggcctgcaggccatcgaccagcagcgccaggtcgacgtcgtcgcccgtggtgccgactttcttcgagtcgcgggtgatggcctcgaggtgatcctcgtagatcatcttggagtcgtgcagcaggcgcccgatcagggtgctcttgccgtcatcgacgttgccgcaggtaaggaagcgcagcagttccttgcgttcgtgctgccccaggtaggcgaggatgtcctcgctgatcagatcggattgatgagacatgctgcgtatcctcagaaatag

SEQ ID NO: 8170 - DNA, 1887 bp, Pseudomonas aeruginosa
acccgttccttggcccgcgacttctcctcgtcgcggcgcgcgccgccgaaggcagcgtcgaaaccgtacttgtccagggcctgcttgagtccctcggtcttcatcacgtcggtgtgcttggcgctgccgtgggtgaacgggttgatgccctgggcgacgccgtccgggttgacgtgggtgatcaggtccaggcccatttcctcgaccatccgatcgcggaacctgtacatctcctggaatttccagcgggtgtccacgtgcatcaccgggaagggcagcttgccggggaagaaggccttgcgggccaggtgcagcatgaccgcggaatccttgccgatcgagtacagcatcaccgggttatcgaactcggcggccacctcgcggatgatgtggatgctttccgcctccagctgtttcaggtgcgtcagtttgtcgaccatggctactcacggaattgcttatggacggccgtcgggccgtagacgaacgcgcactctatcacagcgcaaggctctaaaagattcgccatttataccgaaaaaatatacccatatagccatcagcgctcagcctcgcagccggcgaaaacactggcgtcgagaggttttccaggggcgtttcgcagaccgggcggacaaagctgagacggcatcgtcccggaccggacaaagccgtcgccgcgacagcgagcagacggtccgccccctttcggcggctcgacttgtacgccggcggcactgcgctagcatagcgggcatcgtcattccgccaagaagcccccagatgcgccgtaccgccctcgccctgcccctgttccttctggtctcagcatgcagcagcgaaccgacgccaccaccgaaacccgccgccaaaccccaggctcgcaccgtcatttcaccccgccccgtacgccagtcggtgcaaccgatactgccgctgcgcggcgattacgcgaacaatccggcggcacagcgcttcatcgacaggatggtcagccagcacggcttcaaccgccagcaactgcacgacctgttcgcccagacccagcgcctggactgggtgatccgcctgatggaccggcaagccccgacctataccccacccagcggaccgaacggcgcctggctgcgctaccggaagaagttcgtcacgccaggcaacgtacagaacggcgtgctgttctgggaccaatacgaaaccgacctgcaacgggcatcgcgcgtctacggcgtgccgccggagatcatcgtcggcatcatcggcgtggaaacccgctgggggcgtgtgatgggcaagacgcggatcatcgatgcgctgtccaccctgtccttctcctaccctcgccgcgcggaattcttcagcggcgaactggagcaattcctcctccaggcgcgcaaggaaggcaccgacccgctggccctgcgcggttcctatgccggcgccatgggctacggccagttcatgccgtcttcattcaccaagtacgcggtggacttcgatggcgatgggcatatcgacctgtggaatccgcgtgacgccatcggcagcgtcgccaactatttcaagcagcacggctgggtcagcggcgatcgcgtggcggttcccgccagtggccgggctccctcgctggaagatggcttcaagacgctgtacccgctggacgtgctcgcttccgccggattacgcccgcggggtccgctcggcggccaccggcaagccagcctgctgcgcctggacatgggcaggaactaccagtactggtacggcctgccgaacttctacgtgatcacccgctacaaccacagcacccactacgcgatggccgtctgggaactgggcaaggaagtcgaccgggtgcgtcaccgctccgtcgtcaggcaggattag

SEQ ID NO: 8171 - DNA, 1224 bp, Pseudomonas aeruginosa
tgggcgccaccttatcggccgcttttcggcctcgcaaccccaaggattttcccgatgcccaaggccctgcgtttcctcggctggcccgtgctggtcggcgtgctgctggccctgctgatcatccagcacaaccccgagctggtcggcctgccacgccaggaggtgcacgtcgagcaggcgcctctgctcagccgcctgcaggaaggcccggtgtcctatgccaacgcggtgagtcgagcggctccggcagtggccaacctgtacaccaccaagatggtcagcaagccctcccaccccctgttcgacgacccgatgttccgccgcttcttcggcgacaacctgccgcaacagaagcgcatggagtcgagcctcggctcggcggtgatcatgagcgcggaaggctacctgctgaccaacaaccacgtgaccgctggcgccgaccagatcatcgtggccttgcgcgacggccgcgaaaccatcgcccatttggtcggcagcgacccggaaaccgacctggccgtgctgaagatcgaccttaagaacctgccggcgatgaccctcggccgctccgacggcattcgcaccggcgacgtctgcctcgccatcggcaacccgttcggcgtcggccagaccgtgaccatgggcatcatcagcgccaccggacgcaaccagctcggcctgaacacctacgaaaacttcatccagaccgacgcggcgatcaaccccggcaactccggcggcgcgctggtggacgctgccggcaacctgatcggcatcaacacggcgatcttctccaagtccggcggctcccagggtatcggcttcgccatcccgaccaagctggccctggaggtcatgcagtcgatcatcgagcacggccaggtgatccgcggctggctcggcgtcgaggtcaaggcgctgaccccggaactggcggagtcgctgggcctcggcgaaaccgccgggatcgtcgtcgccggcgtctatcgcgacggtccggcggcacgcggcggcctgctgccgggcgatgtgatcctgaccatcgacaagcaggaagccagcgacggccgccgctcgatgaaccaggtggcgcgcacccgtccgggacagaagatcagcatcgtggtgctgcgcaacggacagaaggtcaacctgaccgccgaggtcggcctgcgtccgccgccggcaccggctccacagcagaaacaggacggcggcgagtaa

SEQ ID NO: 8172 - DNA, 1482 bp, Pseudomonas aeruginosa
cgaagggactccagaatttgctcatgctcaggcctccttctcgtcgaggatgcggtattcggcactacgcgcgtgggcggtcaacgactcgccgcgagccagcaccgaggcggtacgaccgaggaccgaagcgccctcggccgagcagttgatgatcgacgaacgcttctggaagtcatatacccccagcggcgaagagaaacgcgcggtaccggaggtcggcagcacgtggttcgggccggcgcaatagtcgcccagggcctcggcagtgtagcggcccatgaagatcgcgccggcatggcggatctccggcagccagctttccggatcggccaccgacagctccaggtgttccggggcgatgcggttggcgaccgcacaggcctgggcctggtcggcgacctggatcagcgcgccgcgcccctccagggaggtgcggatgatctcggcgcgctccatggtcggcagcaggcgagcgatgctgtccgcgacgcggtccaggaacgccgcatccggactgaccaggatcgactgggcgtcttcgtcgtgttcggcctgggagaacaggtccatggcgatccagtcgggatcggtctggccatcgcagaccacgaggatttccgagggaccggcgatcatgtcgatgccgacctggccgaacacgtgacgcttggcggtggccacgtagatgttgccggggccgacgatcttgtccacccgcggcacgctttcggtgccgtaggccaacgcggccacggcctgtgccccgccgatggtgaagacacggtcgacgccggcgatgcaggcggcggcgaggacgatctcgttgatctcgccgcgcggggtcggtacaaccatgaccacttcggacaccccggcgaccttggccgggatcgcattcatcagcaccgaggacgggtaggacgccttgccgcccggcacatagagcccggcgcggtccagcggggtgacctgctggccgagcaccgtgccgtcggcctcggtgtagcgccaggaaccctgcttctgcttctcgtggtagctgcgcacgcgctcggcggcgacttccagggcttcgcgctgggctacggtgatacgggtgagagccagctccaggcgctcgcgcggcaggatcaggtcggccatcgaggcggcctggagaccgtcgaagcgctgggtgaactcgaccacggcggcgtcgccacggctgcgtacggcggcgatgatgtcgaggacgcgctggttgaccgaatcgtcggagacactttcccagctcagcagatgatccagatgacgcccgaagtccggatcagcggcattgagtcgacggatagcgaagggagcggtcatagcgagcctcttttatggatggcgttgtctcgggcgccgctagactaccaagcccaccgtgcgggcacccgagaaaatttggctatgacacggataggcaggtgcggcgcggagccgcacgggtatcagtga

SEQ ID NO: 8173 - DNA, 351 bp, Pseudomonas aeruginosa
gtcggcacgtcggtggcgcgcacgatgagcaggcgcacatcgggcagggacgtcgggatgatcagcttgcggctcttgtccgggttctccgacggtacgatgcccgccgctgcgagcagcggcagggtatcgtcgagaatccggcccttggacaaggcgatggtcagcatttgcgcgacagcctccgctagcccggtacgcggcggatcttggcgccgagcagctggagtttctcttcgatgcactcgtagccacggtcgatgtggtagatgcgatcgatcagggtgtcgccctcggccaccaggccggcgatcaccaggctcgcggatgcgcgcaggtcggtcgccatga

SEQ ID NO: 8174 - DNA, 1434 bp, Pseudomonas aeruginosa
tgtcggaaagcagttcgtcgaccgtgccctgcaccacctgttgcggggtcggcgccgccatggaaagcagcgggaaagccgccaggaacaccagcaggccgcgacgcagaagagtcagcatggaagaaaacctcactttttggcttcgtctttgttaaccgagttcagcaggaacttgccgatcaggtcttccagcaccagcgccgactgggtgtcgtggatggtgctgccgtccttcagaacgtcctcgtcgccgccgacgctgatgccgatgtatttctcgcccagcaggccggcggtcaggatcgacgccgtggaatcgaccggcaggttgttcacgttctggttgatctccatggtcacgcgaccagtgtagctgtcgcgatccaggtcgaccgccgtcaccttgccgatcgtcacgccggccagggtgaccttgccgcgcacggtaacaccggcgatgttgtcgaagtaggcgtagaccttgtaggtatcgccggcgttgcccacgctcaggccgctgacccgcagggccagcagcaacagggccagcaggccggccaggaggaacaggccgacaccgatttccagggtgcgggtttgcattcagaaatctccaaacatcaaagcagtcagaatgaagtcgagccccagcaccgccagggaggcatagaccacggtccgagtcgtcgcccggctgattccttccgaggtcggctcgcagtcgtagccttggtagaccgcgatccaggtcaccacgaaggcgaatacgatacttttgatcacgccgttgagcacatcctcggtgaactgcacgctgttctgcatgttcgcccagaacgacccctcgtatacgcccagccagtcgaccgcgaccatcgccccgccccagatgccgaccacgctgaagatcgcggcgagcagcggcatggagatgaaaccggcccacaggcgcggcgcgacgatgtacttgagcgggtcgacaccgatcatttccaggctggaaagctgttcggtggccttcatgttgccgatttccgcggtaagcgcagagccggcacggccggcgaacagcaggccggtcaccaccggccccagttcgcgcagcagggtcagggccaccatctgcccgaccgcctgctcggaaccataggaaatcaggatgttgtacccctgcagggccagcaccatgccaatgaacaggcccgagacgacgatgatcgccagcgacagcacgcctaccgaatagagttgcttcaccagcaggtgcaacccggtgcctggcgtgcgccggccgagcagggcgtggccgaggaacagggtcgagcggccgagcgcggcgaccacgtccaggccggcgcggccgaacaggcggatacgctcgaggggagagactctacgcatcagcgctctcccagcaggtcggcccggtag

SEQ ID NO: 8175 - DNA, 510 bp, Pseudomonas aeruginosa
cagagcattgcagtccatacaacattgcgccgcgggggatgcggaccgacttcacagcatggctggtgtaagcgggacacgctttcccgttataatcccgcctttaatccaggcgccacattcgttgaacatgagccagaacctcgatttcatccattccgcccagcgcaccatcggcctcgagcgcgacgcggtagacagcctgctggcgcggattggcgacgatttcgtcaaggcctgcgaactgctgctggccggcaagggccgggtcgtcgtcgtcggcatgggcaagtccggtcacatcggcaagaagatcgccgctaccctggccagcaccggcaccccctccttcttcgtgcatccggccgaggccagccacggcgacatgggcatgatcaccaaggacgacgtggtcctcgccctgtccaactccggctcgactgccgaaatcgtcaccctgttgcctctgatcaagcgcctgggcatcaccctgatcagcatgaccggtaa

SEQ ID NO: 8176 - DNA, 1134 bp, Pseudomonas aeruginosa
ccccgagtcgcccctggccaaggctgcggaagtgaacctggacgccagtgtcggccaggaagcctgtccactgaacctggccccgacctcctccaccaccgtaaccctggtcctcggcgacgccctggcgatcgccctgctcgaagcccgcggctttaccgcggaagacttcgccttctcgcacccgggcggtgcgctgggccgccgactgctgctgaaggtggaagacgtcatgcacgtgggcgaagggctgccgcaggtgctgctcggcacctcgctgaccggcgcgctgatggaaatgacccgcaagggcctgggcatgaccgtagtgctcgacgaacatggcaagcttgccggcattttcaccgatggcgacctgcgtcgcgccctggatcggggcatcgacgtccgccaggtcaccatcgaccaggtgatgaccgtccacggcaagaccgtccgcgccgaaattctcgccgcggaagccctgaagatcatggaagacaacaagatcggcgcactggtggtggtcgacgcggacgaccgtccggtcggcgccctgaacatgcacgacctgttgcgcgcaggagtgatgtaatgagcgatacccattcggccgcggaactcccggtccgggcccgccggatacgcctggcgatcttcgacgtcgacggcgtgctgaccgacggcaagctgtatttcctcgtcgacggcagcgagttcaagaccttcaacaccctggacggacatggcatcaagatgctcatcgcctccggcgtgcgcaccgccatcatcaccggccgcgacactccggtggtcgaacggcgcgcgcgcaacctgggcatccagcacctctatcagggccgggaagacaagctcgccgtcctcgacgaacttctcggcgaactcggactaggctatgagcaagtcgcctaccttggcgacgacctgcccgatctgccggtgatccgccgcgtcggcctgggcatggcggtagccagtgccgacccgttcgtgcgccagcatgcccatggcgtcaccgcggcccgcggcggcgaaggcgccgcccgcgagttctgcgaactgatcatgcgcgcccagggtacgctcgaagccgcccagggcgcctatctgtag

SEQ ID NO: 8177 - DNA, 537 bp, Pseudomonas aeruginosa
gaggtcagcatgaggttcgttaataccctcccccttattttcggtctgactgccgccctcggcagctccatggccttggccctgccttcggaccgcgaacaaccgatccgcgtccaggccgacagcgccgaactggacgacaagcagggcgtcgcggtctaccgcggcgacgtcgtggtgacccagggcagcaccaagctgaccggcaacaccgtgaccctgaagcaggacaagaacggcgacatcgaggtcgtgacctcggtcggcaagcctgcctactacgagcagaaacccgctccggacaaggacgtgaccaaggcctatggcctgaccatccagtacttcgtcacgcagaaccgggtcgtgctgatcgaccaggccaaggtgatccaggaaggcaacaccttcgaaggcgagaagatcgtctacgacacccagcgccagatcgtcaacgcgggtcgtgccaccggctcccaggtgaccagcccgcgcccgcgcatcgacatggtcatccagccgaagaaaaaggcccagtaa

SEQ ID NO: 8178 - DNA, 429 bp, Pseudomonas aeruginosa
cgccgcagctgcaacaggccatacgcctcctccagctatccaccctggacctccagcaggaaatccaggaagcgctggaatccaatcccatgctcgaacgccaggaagacggcgacgatttcgacaacagcgaccctctcgccgatggcgccgaacaggcggccagcgcgccccaggagagccccctccaggaaagcgccacgcccagcgtcgaaagcctcgacgacgaccagtggagcgaacgcatacccagcgagttgccggtggataccgcctgggaagacatctaccagaccagcgccagcagcctgcccagcaacgacgatgacgaatgggacttcaccgcgcgcaccagcagcggcgagagcctgcacagccacctgctctggcaggtcaacctggcaccgatgtcggacaccgatcggatga

SEQ ID NO: 8179 - DNA, 882 bp, Pseudomonas aeruginosa
acgtacagaacgggcaatgacatgcgcctgatcatcgtcagtggccgctcgggctcgggcaagagcaccgccctgaacgtcctcgaagacaacggcttctattgcatcgacaaccttcccgccagcctgcttcccgacctggcgcagcgcgccctgttgcacacggagctactgcagccacaggtggcggtgtcgatcgacgcccgcaacctgcccagccagttgcagcgcttccccgaactgttgcaggaagtgcgggacaaccacatcaactgcgatgtgctgtatctcgacgccgacgacgagacgctgctcaaacgattctcggaaacccgccggcgccacccgctgactaccgacacccgttcgctggcggaggcgattggcgacgagagccaattgctcggaccgatcgccgacctcgccgacctgaagctggacaccaccagcctcaacctctatcagctgcgcgacaccatcaaactgcgcctgttgaacaagccggagcccggcaccgcgttcctcgtcgaatcctttggcttcaagcgcggcatgccagtcgacgccgacctggtgttcgatgtgcgctgcctgccgaacccctactggaagcccgagttgcgcgatcattcggggctggagccggaagtccgcgagtatctggccgcccagccggacgtcgaggaaatgtaccaggacatcgtcggctacctgaacaaatggctgccgcgcttcgccgccagtaaccgctcatatgtaacagttgcgataggctgtaccggcgggcaccatcgttcggtctacctcgccgagcggattggcgctgcactcagggattccctgaagaacgtgcagattcgccaccgcgatctcagcagctag

SEQ ID NO: 8180 - DNA, 567 bp, Pseudomonas aeruginosa
cccagcgcggtatccagcaccatcatcaggcagaaaccgaacaccaggcccagcgtagcctcggcggcatgtccctggcggtgggactcgggaatgatctcgtgggtgaccacgaagagcatcgctcccgccgcggcggccagcccccagggcaggagcagcgcagagaggccgaccagccaggcgcagagcaccgcgaacagcggctcgaccaggcccgacgcggcaccgaccagcatcgccttgaaacgcgacataccgactccggccagcaccagcgccaccaccagaccttccggcacatcctgcagagcgatgcctagggcgaggccgttggcctcgtccaggccggcaccggccgacacgccaaccgccatgccttcggggatgttgtgcaggacgatggccgtgacgaacagcaggatgcgcgggggaatgccaccggacagtggcgcgccctcgcaaccgggatggacgtccggcatcagccggccgaggatgaacagccccatcacgccgaccgccaggccgaaactgaccaggaaccccgcgccgaacttcgagtag

SEQ ID NO: 8181 - DNA, 711 bp, Pseudomonas aeruginosa
ccgatgatcgggttcagcgcagtgaccaggatcgggttgcgcgccaacgcctcgctgagcttgccctggttgaccttgaagctggcgatggccttgtccgccagcagccggctgacgttggccagcaactggatgctgtgcaacaggttgtccgccaccagcggcagcatcacgttcagttcgaagttgcccgattggccagcgacggcaatggcggcgtcattgccgatcacctgggcggcgaccatcgcggtggcctccgggatcaccgggttgaccttgccgggcatgatcgaggagcctggttgcagcgcttccagctcgatttcgccgagcccggcaagcggcccggagttcatccagcgcaggtcgttggccagcttcatcagggtcacggccagggtcttcaactggccggacgcagcgaccgcggtgtcctgcgaaccgatcagggcgaagaagtcgtcgccggggcggaacgccagcccggtcaggtcgttcagctcctggctgaaacgttcggcgaaccgaggatgggcgttgatcccggtgcccaccgcggtgccgccctgtgccaactgctgcaaggcaggaagtacgctctcgatgtgcacgccggcctgtcgcacctgctgcgcccagccaccgagcacctggctcatgcgtaccggcatcgcatccatcaggtgggtgcggccggtcttcacatag

SEQ ID NO: 8182 - DNA, 459 bp, Pseudomonas aeruginosa
gcatgcacttcgccggccttgctctggatagtctgctccaggtggcgcagcgccggcagcaggcgttcgctgatctcgagggcggcactgatgtggatggtcgagggaatgatgtcgttgctgctctgcccgcagttcacatggtcgttcggattgaccttgccgcccaggcgacgactggccagggtcgccaccacttcgttggcgttcatgttggaactggtgccggagccggtctggaacacatccaccgggaaatgctgcatgaagtcctcctgcagcagttgcaggcaggtctcggcgatcgcctcgcccatcggtgcatccagttgctgcagggagacgttcgcccgcgccgccgcggccttggccagcagcagggcgcggacgaaggcctggggcatgcgttggccgctgaccgggaagttgttcaccgcgcgctgggtctgggcgccatag

SEQ ID NO: 8183 - DNA, 597 bp, Pseudomonas aeruginosa
acaggcggaaacgaaaacgccagcgacgagcgctggcgatttatagagggaaacccggcctcagcgcccggccaccatcatcgactcgaccagtacagaaccggtatgcaggttgccgcgccgttcgatgtccttgccgaccgcgacgatacggcggaacaggtcgcgcaggttggcggcgatggtgacttcctggaccgggaactggatctcgccgttctcgacccagtagccggcggcgccgcgggaataatcgccggtcaccaggttgacgccctgccccatcaactcggtgaccagcaggccacgccccatcctgcgtatgagagcggcctggtcctcgtcgccatggctgacgaacaggttatgcacgccgccggcgttggccgtgctcggcaggccgagcttgcgcccggaataggtgcccaggacataggacaccagctcgccgttctcgacgaatggcttggcataggtcgccaggccgtcgctatcgaagctggcgctgccgagcgcgccgaccaggtgcggccgctcgtcgatgctcagccactcgggaaacaggcgctggcccagcgcgccttcgaggaaggatga

SEQ ID NO: 8184 - DNA, 783 bp, Pseudomonas aeruginosa
gatcgccccgaggaaatggccgaacaggccaacagcgatttccggagcgaacagcaccggcacttcggcggtctgcaccggccgcgcgcccagtcggctggcggcgcgctcggcggcgcgccggccgatcgactcggcgctggccaaggcctcgccacggcggttgacgtcataccaatagtcacgctgcatctgtccttcgccctcggcgatcatcacgcagctgaggctgtgccgggtgctggcgtaaccaccgatgaaaccgtggctgttaccgtatacccggcagccctggtgggtattcagggtggtgccgtcggccttggtcacccgcttgtcggcggcgaacgccgctgcctcgcaagccagggcacgttccacggcctgctcgggactcaggctccatggatgatagaggtccagctcgggcaactcgcgggccatcaacgcggcatcggcgagaccggcgcattcgtcctcggaggtatggcgggcgatcgccagcgccgccgccaccgtctcgcggatggccgcctcgccggtcgccgaggtgctcgccgagcccttgcgctggcctgcgtagagggtgatgccgaaaccttggtcacggttgaactcgacggtttccacctcgccctggcgcacgctggtggacaggccctgctccagcgacaccgccacttcgcaggcactggcgccctggcggcgggcctcggcgatgatctgctcgacctgctcgcgaaggtccggaagcacggagggaccgactgccgcggcatgtag

SEQ ID NO: 8185 - DNA, 735 bp, Pseudomonas aeruginosa
agacgcgactactcgccgacgatcctctcgcagccctattcctacacccagccggcggcctacatcgccatcaaggggccgggcctgaccgcgccgaccgtcggccaggcgcacgtgggcggcaactggggcggctggtacagcaactggccgggtgccatcgggctgtaccgctacgtgaccctgaaacgctatcccacttgcgcggtgatgacggacaccccgcacgtgcagttcccgtccatcaccctggcagagatcgatagcggcggcgtgcgcgaggcgcccttcgaactcaccttcaagtgccagagcggcatgaccaacggcaccggggccggcgccacggcgctgggcatccgcgtgtccagcggggccctggcggccagcccggcgctgggcctggtcaacgccagtggcggactgtcctacctgctctccgaccgttacggggagccgggcattgcccgtggggtcggcatccgcatctaccgcgacggcacgccgatgacgctcctggccaacgagaactccgccggcggcagcaacgccgaggccaccggctggtaccccgccatcggtggcgcgacccaggccaacggcggtagcggcggcatcgacctgtaccgcgaaaccttccgcgcgcgcctggagaaactcgcgctcggcagccagcccggcgtcacggcggggcgagtcgaggccacggcgcaggtggttatccgtgtccagtag

SEQ ID NO: 8186 - DNA, 1392 bp, Pseudomonas aeruginosa
cggtgccctcgacggcgaaccggataccgcgctggctccgttcctgccgctgccgcccgtattccgcctggagccgggacgccagcgcagcctgcgcctgctggctaccggccaggcccaggcacgggatcgcgaatcgctgtactggctgaacatctacgagatccccccgcaagccaccgccgaggccgctggccggccccggctcacggtcaccctgcgaacccagatgaaggtgctgtaccgcccgcacggcctgcatccgcacgccgaggacgcggccgccgaactgggcttcgcgctgcgcgacgagaccctgcgggtggacaacccgacgccgtacttcgtgtccctggcggggctggcgctggagataggggagacgcgcctggatctgcccggaacgctgctggctccgcgctcgcaacgacgcctcggcttgccgcggcgggtggacggcgggacgcgcggcgaggtggcgttcgactggatcgacgacaacggcgtcagccgccaggaaaggaaagctctacagtgaacagttccccacaggctcgccagcacgagcacccaccggccgttgccgcctccctggccggcgacctgcgcctcgcccggcgtttccatgccgccctggcgcgcggtcgggtgcgcctggactggcaggccgtacggcatgccgggcatccggaatgggagccgctctaccgggaaaccctgctcagggtcacggccgccagcggcgagccgccgttgccgacccaggaactgatcctggcgctggagcggctcggcctggtacgcctgctcgatcgctgcgtgctgggcacggtcctcgaccggctgaacgccgagcctaccttgcgcctggcctgcaacctgtcgcgccagagcgcggcgatggatgcctggtgggaagcggtctgccgatggctggccgcccgtccgcaggtggcacggaggctgacgctggagctgaccgagaccgccgtgggcgagagagtcgcgacccgggagttcatccgacgcctgcgcgaacatggcgtgcgcatcgcgatagacgacttcggcgcggcgcacaacaacctggacttcgttctcgatgcccgtcccgatgtgatcaagatcgattgccggtatacccgcgaagcacgtcgctcggcgaagggcgccgaagtgctgcgccatctgctggccctgtgccgcgaactggcgccctgcgtggtcctggaaggtctcgaggaggacgatgcgttcgcccggctgccgaccggggacgtctatctccagggcaacgcgatcgcgccgccgatgcgggtcgaaccgccgctgtccgtacgccggccgaagagccgggcgcggatcgaggcgctggcgagccgccaggggtga

SEQ ID NO: 8187 - DNA, 1845 bp, Pseudomonas aeruginosa
agcaccacctggaaatggcccgcgcgctggccaaggcgcacccatccaagtaacgcccccgcgggcggagcctggccaggcatgagcttcagcctgtggttgctggtactgggctgcatcctgctgacgctcggcctggcttcggcctacctgcgcctgctgccggtcagcacgtcgttcatctacctgctgttcggcatggccatcggcccggccgggctgcacgcctggcgcagcggcctggcggacatcagcggctggttcgaacacctcagcgaggcggcgttgctgatctcgctgttcatcggcggcctcaagctgcgcctgccgttgcgctcgccggcctggaccgctgcctggctgctggccggaccagtcctgctcggctgtatcctcggccttaccctgggcgcgcatttcctgttcggcctggactgggggctggccttgctggtcgcggcgatcctcgcgcccaccgatccggtgctggccagcgacatccaggtcaaccacgccggcgacgacgaccgcctgcgctacgccgtatccggcgaggcgggactcaacgacggcatcgccttccccttcgtcatcgccgccctgctgctgatcggtcagggcggcggcctgcccggggagttcgaccgcagcggcctggactggctgctgcgcgacgtgctctgggcgattccgctcggcctgctggtgggctattgcctgggccatggtctcggccgcctggccatccacctgcgggcgcggcacaccgacacctcggtgtcggccaacgacttcctcgccctggcgctgatcgcgctgtcctatgtcggcgccgacgcactgggcggctggggcttcctcgccagcttcgccgccgggatcggcctgcgccacgccgaggtggcgacgctggggcgcgcctcggcaccggccgaggcgcaggcggccgccgccgacgtgcgcgaggcagggcaggccagcggcgccatcgagtacggcgccgaccgcagcgaacacccgaaggtggcggccggcgcggtgatgctcgacgtgctctccttcggcaacctgctggagcgctcgctggaagtgctgctggtgaccctgctcggtgccatgctcctaccagcactgggactggcgcgcgctgccgctggcgctgctgctgttctgcgtgtgtcggccggcgatggtctggctgctggtcggccggcggctgatgcacccggcgcagcggcgcctgctcggctggttcggcatccgcggcatcggcggcctgtactacctcagctacgcgctgaaccaggggctgcctacggcgctcgcgcataccgccagcgacctggtgctgaacctcgtcgccctgagcatctgcttgcacggtctgagcatccagccgctgctgatgcgccacgcgcgcagcgtcagtcgccgcgatcgggaatgatcgagatcttgccgttcttctcgaggatggcgaagcggatctgctccatgcgttccaggccctgggtctcgcgggcggccaggagaatgtcttcctcgcgcaggcgggcctcggccaggcgtgcgtgcaatggcctgccgtactcgacgatgagcgtcggggagccctcgatcagggtgtcgagcttcggatggcgcagcttgagcagggacagaccgacgtcgatgacgatcagggtgatgatcaccagtaccgcgttgaccagcgagaagtcgtcgcccagcagcgcctgctgggtggcttcgccgatgatcatcagcagcagcaggtcgaaggtggtgatgtcggtcagtgaacgccgcccggcgatgcggaagagtaccagcaggaccaggtag

SEQ ID NO: 8188 - DNA, 1467 bp, Pseudomonas aeruginosa
gcgcctggaacccctcgcggtccgctccagcccattggcgaaggtgccgccggcgcgcgagaccgggtcggtgcagtgggtgcgcccgcaacagctgtgcgaggtttcctatgcgcagatgacccgtggcgggatcatccgccaggcagtgttccacggcttgcgcgaagacaagccggcgcgcgaggtgaccggcgagcgtcccgccggcccgccgccgctgcgcggcgcgcgcaaggccggcgccggtgcgtcgcgggcggccaccgccggcgtgcgcatcagccatccgcagcggctgatcgacccgtcgatccaggccagcaagctggaactcgccgagtaccatgcgcgctacgccgacctgctcctgcgcgacctgcgcgagcgcccggtgtcgctggtgcgcggccccgacggaatcggcggcgaactgttcttccagaagcacgcggcgcgcctgaagatccccggcatcgtccagctcgacccggcgctcgatcccggtcatccgccgctgttgcaaatccgcagcgccgaggcgctggtcggcgcggtgcagatgggcagcatcgaattccatacttggaacgccagcctggccaacctggagcggcccgaccgtttcgtcctcgacctcgacccggacccggcgctgccgtggaagcgcatgctcgaagcgacccagctgagcctgacgttgctcgacgagctgggcctgcgcgccttcctcaagaccagcggcggcaagggcatgcacctgctggtgccgctggagcgccggcatggctgggacgaggtcaaggatttcgcccaggccatctcccagcacttggcgcgcctgatgccggagcgtttctcggcggtttccgggccgcgcaaccgggtcggcaagatcttcgtcgactacctgcgcaacagccgcggcgccagcaccgtggccgcctactcggtgcgcgcccgcgaagggttgccggtgtcggtaccggtgttccgcgaggaactcgactcgctgcagggcgccaaccaatggaacctgcgcagtctgccgcagcgcctcgacgaactcgccggcgacgatccctgggccgactacgccggcacccgccagcgcatcagcgcggccatgcggcgccagctcgggcgcggctgaccgtccgcgaaaaaggcggaactcccccggcgcacagggcctccaccgtgcaacgagatgccgaggaggcccccgatggataccgcctacctgatcctcgcgctgctggtcctgttgctcctggtggatgcctgggccatcaacagcgtgctccgcagcgacagctccgccagtcgcaagctcggctggtcactgctgatcctgctcctgcccgtgctcggcctggtcctctggggctggaccggcccccgtggcttgcgcccggtgacctcgccggaacacagcaagtgaaccccactggagactgcccatga

SEQ ID NO: 8189 - DNA, 567 bp, Pseudomonas aeruginosa
aggagacctttcccgccagcgacccgatctcgccctgaggagcgtgccatgcccgacctgcaactcgcggacgaggcctctcgcctggtggcctacctgcgtagcgccgacctcagcctgatcactgcggaatcctgtactgccgggcagatcagcgccgaactgtcggcggtggccggcagcggcaaggtgatggaaggcggcttcgtcgtctattcgccggcggccaagcttgccctgctggggctcgacccgaactggctggagcgtttcaacctgaccagcgtggaggtcgccgaggccatggccagggcggccctgcaacgcagtccggcgagcgccgcgctggcggtcacggggttgctcggcagtgaagcgaaggacggcatcccgcccggtaccgtgtgcttcgcctgggccttccggttgcccgccggcctcgccctgttctcgcgccgcgagcgcttccacggcgaccccgcgcggatgcgccgggaagccacccgctgggcgctgcggcgcctgcccgaattccatcaacgcgccttgcgcggcgaacgcgcctga

SEQ ID NO: 8190 - DNA, 2571 bp, Pseudomonas aeruginosa
ccctggccggccacgacctgctcgaccgcctgcgccaggaaagcgcggcggccgccgtgccggtacgcaagagcgcctgagaaaaccccgcaagcaccggcctgcagcggcgggccggaaggaagcccggcgatgcccgacagccaagaccagaccccgagcacggtccagaccctgaaagccagcatcctcgccaagctgcgctacagcgtcggccgcgacccatccaccgcctgcccgcacgactggttcgaagcggtggccctggcggtgcgcgaccacatcatcgaccactgggaggaggccaccccgcaaggcgaagcgcccgcgcgcaagcgggtctactacctgtccctggagttcctcatcggtcgcctgttgctggacaacctcggcaacctcgggctgctcgaggaaacccgccaggcccttgccgagctgggcgtcgacctgcagcggatcgttgccctggagccggacgcggcgctcggcaacggcggcctcggacgcctggcggcatgcttcatggaaagcatggccagcctcgacattcccgcgcatggctatggcatccgctacgagcatggcctgttccgccaggtgctgaccgacggctggcagcaggagcagaccgagacctggctggatttcggcaatccctgggagttcgaacgacccgaggtcagctactacatcgacttcggcggcagcgtgcaggtcgacagcgagcacagtggccgagccatctggcggccggacgagcggatccgggcgatcgcctacgacacgccgatcgtcggctggcggcgtgccagcgtcaataccctgcgcctgtggcgcgcccgcgccgaggaagacctgcaactggaccgtttcaacgccggcgaccatatcggcgcggtggtcgacgtggtcaaggcggagagcatctcgcgggtgctgtatccggccgacagcaccgaggccggtcaggaactgcgcctgcgccaggagtacttcttcgtctcagcctcgctgcaggacctgctcgaccgccacctgcgccatcatcacgacctgcgtagcctgccggaacaggtggcgatccagctcaacgacacccacccggcgatcgccgtcgccgagctgatgcggcaactggtggacgtgcaccaactggcctggccggacgcctgggcgctgagcgtggcgaccttgtcctacaccaaccacacgctgctcccggaagccctggaatcctggccggtggcgctgatggagcgcctgttgccgcgccacatgcagatcatctacctgatcaatgccttccatatagacgcgctgcgtgcccaggacatccacgacttcgacctgttgcgttcggtcagcctgatcgaggagggccacggccgacgggtgcgcatgggcaacctggcgttcctcggttcgcaccagatcaacggggtatcggcattgcacaccgagctgatgcgcgacaccgtgttccatgacctgcatcgcctctatccgcagcgcatcagcaacaagaccaacggcgtgtcgttccgccgctggctgttccaggccaacccggggttgaccgagctgctggtggagaccctcggcgccgacctgctggacaccccggaacggcgcctgccggacctcgaggaacacgtcgaggacgccaggctgcgggcacgcttcgccgagcagcgtcggcagaacaagaccgccctggcgcgcctggtgctggacagcctcggcgtggcgatcgaaccggaagcgctgttcgatgtgcatatcaagcgtatccacgaatacaagcggcagttgctcaacctgctgcacaccgtggcgctgtaccaggagatccgcaacgacccgaccgccgaccgcgtgccgcgggtgaagatcttcgccggcaaggctgccgccagctaccaccaggccaagctgatcatcaagctggccaacgacatcgcccgcaccatcaacgacgaccccaccgtgcgcggcctgctcaagctggtgttcctgcccaactacaacgtcagcctggccgaggcgatcattcccgcggcggacctctccgagcagatttccaccgccgggctcgaggcctccgggaccagcaacatgaagttcgccctcaacggcgcgctgaccatcggcaccctggacggcgccaacgtcgagatgagccagcggatcggcctggaacacatgttcatcttcggcctcagcgcccagcaggtggagcagcgccggcaggccggggagctggagatgggcggggtgatcgcggcctcgccgcggctggaggaagccctggaggcgatccgcagcgggctgttctcggccgacgaccgcagccgctacgaagggctggtggacggcctggtgcacgacgaccgcttcatgctctgcgccgacttcgaggcctactggcatgcgcagtgccgggtcgaggaagtctggcgcgagcccgatcgctggtggcgctcggcgttgctcaacgtggcgcggatcggctggttcagcgccgaccggacgatcagcgaatacgcccgggatatctggaagctatga

SEQ ID NO: 8191 - DNA, 192 bp, Pseudomonas aeruginosa
agagattattcggaggaaatagaaatggcacagcatcaaggtggtaaaggcaacttcgcggaagacccgaaacgtgcttcggaggccggcaagaagggcggccaggccagcggcggcaacttcaagaacgatccgcagcgggcctccgaggctggcaagaaaggtggccagcgcagccacggcgggaactga

SEQ ID NO: 8192 - DNA, 2127 bp, Pseudomonas aeruginosa
  unsure (291): Identity of nucleotide at the above locations are unknown.
gcgagcagaacaacgagcagcgcagccaggcggccggcaccgacaccgtcgaccgtggcaacagcaacgccaagctggaacagctggaggcctatagcagacgacgccaccggagaggccctgagcaccaataccggcacccgcatcgccgataaccagaacaccctgaaggccggcgagcgcggaccgtcgttgctcgaagacttcatcatgcgcgagaagatcacccacttcgaccacgagcgcattcccgagcgcgtggtccacgctcgtggctcggcggcgcatggntacttcgaggcctacgaggacctcagcgacctgaccaaggccggtttcctcgccgaggcgggcaagcgtaccccggtcttcgtgcgtttctccaccgtgcaggggccgcgcgggtctgcggatacggtgcgtgacgtacgcggcttcgccgtgaagttctataccgacgaaggcaacttcgacctggtcggcaacaacatgccggtgttcttcatccaggatgcgatcaagtttccggacttcgtccatgcggtgaaacccgaaccgcacaacgagattcccaccggagcgtctgcccacgacaccttctgggacttcgtttcgctgaccccggagtcggcgcacatggtcatgtggctgatgtccgatcgcgccattccgatcgcctaccgcaacatgcagggcttcggcgtgcacaccttccgcctggtcaacgcggccggcgagagcgtgctggtcaagttccactggcgaccgaagtccgggacctgctcgctggtctgggacgaggcgcagaagctcgccggcaaggaccccgacttcaaccggcggaccctctgggaggacatcgagaagggcgactatcccgaatgggagctgggcctgcaggtgatcccggagaaccagcaggacagcttcgacttcgacctgctcgaccccaccaagctggtgcccgaggagttggtgccggtaagggtggtggggcggatggtactcaaccgcaaccccgacaatttcttcgccgagaccgaacaggtggcgttccacgtcggccacgtggtccccggaatcgacttcaccaacgacccgctgttgcagggtcggctgttctcctataccgacacccaactgctgcgcctgagcgggccgaacttcaacgaaatcccgatcaaccgcccgctgtgtccgttccacaacaaccagcgcgacgcgccgcaccggcagaccatcaaccgcggccgggcttcctatgaaccgaactcgatcgacggcggctggccgaaggaaaccccgccggcggcgcgcaacggcggcttctccacctaccacgagccagtcagcggcagcaagctgcgcaagcgcgccgactccttcgccgatcatttcagccaggccgcattgttctggcacagcatgagcgaggccgagcaggcgcatatcgtcgccgcctacagcttcgaactgtccaaggtcgagcggcaatcgatccttgagcgcgaagtcaaccagatactcctcaacatcgatccgcaactggccgccagggtcgcggcgaacgtcggtgtgcagctcgccgcgccggccaacccgacaccgcagccgaagccgtcgccggcgctgagccagatgaacctgctgtccggcgacatccgttcgcgcaaggtggcgatcctgatcgccgacggcgtcgccgagagcgacgtcagcgacctgcgcgacgcgctccgccaggagggcgcggacgccaagctgatcgcgcccagcgcttcgccggtgcaggctgaaaacggcgccgaactgagccctgagggaacctgggacggcctgccgtcggtagccttcgacgcggtcttcgtgcctggcggcgcggccagcagccaggccatcggcgctgacgggcgcggcctgcactacctgctggaagcatacaagcacctgaagccagtggccttcgccggcgatgcccaggcgctggccagccagctttcgttgcctggcgaccccggcgtggtgctcggcgccacggccaccgatgtcttccccggcctgcgccaggcattgatgcagcatcggatctggcagcgcgaggcggcgaccaaggcgatccccgcctga

SEQ ID NO: 8193 - DNA, 288 bp, Pseudomonas aeruginosa
accgttcgccgccatcttccgatagccattgaggagagttccgtcatgttcaaggacttcgacgcctgtaccgcctggaccgacgcgatgcaggagcgctgccagccggtcggcctgatcctctatcagcccaagcggcgtggcgcggcggtacgcatgctgtgggtagtgaccccgggttgcagttgcctgagcgacgccgagaccgccgccgacaacctgctccagcgcatcaccgacatcgccgccgacggccgcgtgcgttacgcggacggcggcacgctgtaa

SEQ ID NO: 8194 - DNA, 603 bp, Pseudomonas aeruginosa
ccaggaaattcccctgcagcacttcgataccccgtactacctggcccccgaccggcgcggaggcaaggtctacgcgctgctccgggagaccctggagcgcaccggcaaggtcgccctggccaacgtcgtcctgcacacccgccagcacctggcgctcctgcggcctctgcaggacgccctggtgctgatcaccctgcgctggccgtcgcaggtgcgcagcctggatggcctggagctggacgaaagcgtcaccgaggcgaaactcgacaagcgcgagctggagatggccaagcgcctggtggaggacatggcttcccactgggagccggacgaatacaaggacagcttcagcgacaagatcatgaagctggtcgaggaaaaggccgccaagggccagctgcacgcggtggaggaagaggaggaggtggccggcaagggcgccgacatcatcgatctcaccgaccttctcaagcgcagcctgcgttcccgcgccggcggcggcaaggacaagggcagcgaaaaggccggggccgacgcgaagggtcgcgccaagtccggtgcctcgcgttcgcggcgcaaggcctgaggcgagccgctgggtaa

SEQ ID NO: 8195 - DNA, 2121 bp, Pseudomonas aeruginosa
atcaacctgaaccaatcggtcgccggcgggctcggaatcaatgaccgtccgcgccgccggccactcgaggccggcggaagcctcgcgacccatcgccgaacccacgtcccggaggagcgcgcctcgatgagttcgattgtccgcaacagcgacgatgatccgctggtcatcgccattcagcagccccgtatcgccatcgagtcggtcagccctgtggtggaagagggtgcctatcccgcgaagaccgagagcgaccgcgacctgcgcctggccgcgcgaatcttcgccgatggccatgaggtactcggtgccgaggtggtctggcggcgtgtcggggaaaccgcggagcggcgcctgccgctgctgcccgaaggcaacgatttctggagcgcgcagttgcgcacgccgccctgcggccgcctgtacttccgtatcgaggcctggatcgaccgttttgccggctaccgccgcgaattgcgtgccaagcatggcgcacgcctgccgctggacctggagctgcgcgagggcgacgaactgctgcagcgctgcgccgagcgcggcggtccggagatcgccgccgcctgtgcgccgctggccgaacgcctgcaggcctgccagagcgtcgaggagcgggtggcgctgtggctggcggcgcagaccggcgaactgttgcgtctggtcggcccgcgcgagcacctggtgcgcagccgcgaatacccggtggaggtggagcgaccgctggcgcgcttcgccagttggtacgagctgttccctcgctcggaaagcggcgacccgacacgccacggtaccttcgacgacgtgatccggcgcctgccgcagatcgccgcgatgggcttcgacgttctctatttcccgccgatccaccccatcggccgcacccatcgcaagggccgcaacaattccttgcgtgccgaggccggcgaccccggcagcccgtatgcgatcggcagcgaggatggcggccacgaggcgatccatcccgaactgggcgaccgcgaggatttccgccggctgctcgttgcggtgcgcgagcacggcatggaactggcgctggacttcgccatccagtgctcccccgaccacccctggctgcgcgagcatcccggctggttcgcctggcgtccggacggtagcttgcgctacgcggagaacccgccgaagaagtacgaggacatcgtcaacgtcgacttctacgccgaacaggccctgccgagcctgtgggaagccttgcgcgacgtggtgctgggctgggtcgagcagggcgtgacgctgtttcgcgtcgacaacccgcacaccaagccactgccgttctgggagtggctgatcgccgaggtgcgcggccgccatccgcaggtgatcttcctttccgaggcgttcacccgcccggcgatgatggcgcgcctgggcaaggtcggcttcagccagagctacacctatttcacctggcgcaacgacaagcaggaactggcggagtacttcgccgaactcaaccagccaccctggcgcgactgctaccggccgaacttcttcgtcaacaccccggacatcaatccctggttcctgcaacgctccggccgccccggcttcctcatccgtgccgccctggcgaccatggggtcggggctgtggggcatgtactccggcttcgagctgtgcgaggcggcggccttgccgggcaaggaggagtacctcgactcggagaaataccagttgcgtccgcgcgactaccaggcgccgggcaacatcgtcgccgagatcgcccggctcaaccgcatccgccgggaaaacccggcattgcagacgcacctcgggttccaggcctacaacgcctggaacgaccgcatcctgtatttcggcaagcgcaccgcggacctcgccaacttcgtcctggtggcggtctgcctggacccgcacgaagcccaggaggcgcatttcgaactgccgctgtgggagttcggcctgcccgacgacgccagcctccagggcgaggacctgatgaacgggcatcgctgggtctggcacggcaaggtccagtggatgcgcatcgaaccctggcacctgccgttcggcatctggcgcgtgcggcgcgtcgacgcataa

SEQ ID NO: 8196 - DNA, 1929 bp, Pseudomonas aeruginosa
ccggcggcgcatcgagctgctgcacagcctgctgttgtcgatgccgggcacgccgaccctgtactacggcgacgagatcggcatgggcgacaacatctacctcggcgaccgcgacggcgtgcggaccccgatgcagtggtcggtggaccgcaacggcggcttctcccgcgccgacccggcgaagctggtgctgccgccgatcctcgacccgctgtacggctaccagacgatcaacgtcgaggcgcaggcgcgcgacccgcattcgctgctcaactggatgcgccgcctgctcgccgtgcgcagccagcagaaggccttcggccgcggcagcctgaagatgctcgcgccgagcaaccgacggatcctcgcctacctgcgcgaatacgccgagggcgaacggcaggacagcatcctctgcgtggccaacctgtcgcgcgcggcccaggcggtggaactggacctcgccagccatgccggcaaggtgccggtggagatgatcggcggcatgtcgttcccgccgatcggcgagctgacctacctgctgaccctgccgccctacggcttctactggttctacctggccgacgcgacgcagatgccgagctggcacgtggccgccgacgagcgcctgccggaactgccgaccctggtggtcaagcagcgcctcggcgagctgctgcagggcgcatcgcggaacatcctggaaggcgagacgctgccggcctacctgccgaagcgccgctggttcgccggcgagaaaggccagccacggctctgctacatcgttccgctggacgaggcggagccgcgctgtgcgctgtgcgaagtggagatcgacgggctgcgctaccagttgccgctgggcttcctcgacgccgaccagcgcggcgacagcctgcctcagttgctggccctggcgcgcctgcggcgcggtcgcaaggtcggcctgctgaccgacgccgccagcctgccgctgttcgcccgcaaggtcctcgcgcaactccgcgccgaggcggtgatcgcccacggcgacggcgagatccagttcatcccggcggcgggactggcggaaatggacgacatcgccgacgaagacgtcctgccgttctcggtggagcagtccaacagctcgatccgcttcggcgagcgcatggtcctcaaggtgctgcgcaagatccttccggggctgcacccggaaatcgaggtcggcggctacctgacccgccacggttaccccggcatcgccccgttgctcggcgaggtacggcgggtcggcgcggatggcgagccgcacacgctgatgatcctgcagggctacctgaacaaccagggcgacgcctggaactggaccctggacaacctggagcgagccgtgcgcgacgagatatccgcggccagcgaggcgctcgaagggcaatacgacagcctcgccgaactgcgcggcttcgccgccaacctcggcgcccggctcggcgagatgcacagcgtactggccggcgagtcggacgatccggccttcggcagccgcgagagcgacgaagccagcgtccaggcctgggcgctgcgtatcgccgaacagttgcgcgaagccggcaaacgcctgagcgagccgccacgaccgttgcagggcgaggcggcggaacgggcgcggcgcctgctggaacgcctgccggcgctgctcgaacgcctgccgctgctggcccggcaggcagccggcgggctgctgatcagggttcacggcgacctgcacttgggccaggtgctgatggtccagggcgacgcacgcttcatcgacttcgagggcgagccgacgcgcagcctggaagagcgccgccagcgccacagtccgatgaaggacgtcggcggcatgctgcgctcgttcgactacgcggcggcgatggtcctgcgcaacgcgcagagcaccgatag

SEQ ID NO: 8197 - DNA, 2472 bp, Pseudomonas aeruginosa
ctcggaacaggccgacagcgcccggcgcaaggtcgccatgcgctatcgcagcgaagcccgcgatgccttcctggccggctatcgggccgccgcgggggggctcatgcacgcctggcacggtcgcgaaggcgagggggcggcgctggccctggcctgcctggaaaaggccgcctacgaactgctctacgaagccgactaccgccccgactggctggaagtgcctctcgccggtctggccgaactcaccgaacacctcctgaagggcaagaaccgatgagcgaaccgatgtccgaacgcgaacgctggcaactggagctggacaagctgcagcgcggcctgcagggcgatccattcgccttcctcggcccgcagcgcgaccccggcggcgaaggcggcgtgctgcgcgcctacctgcccggcgcgcagcgcgtcgagctgctcgacgaagacggcgcgacgctcgccgaactggagcagagcgaccccggcagcggcttgttccagcgccacctggagcccctgccaccgcgctacagcctgcgcgtgcactggccggacggcgtgcaggaaagcgaagacccctatgccttcgggccgttgctcggcgaactcgacctctacctgttcgccgaaggcaaccaccgccaactggcctcctgtctgggcgcgcaagtgacccgtcacgaaggcgtggagggcgtgcgcttcgcggtctgggcgccgaacgccgtgcgcgtctcggtggtcggcgatttcaacggctgggacgggcgccgtcacccgatgcgacgacgctatccatccggcgtctgggaactgttcgtcccgcgcctcggcgagggcgaactgtacaagtacgagttgcagggccacgacggcctcctgccgctgaaggccgaccccctggcgctggcctgcgagacgccgcccggaaccgcttcgaagacctgcgcggcgttgcgccacgagtggcgcgaccaggactggctggcccggcgcgcggagcgccagggctatgcggcaccgctgtcgatctacgaagtccacgccggctcctggcgccaccgcgacggccggccgccgcactggtcggaactggcggaggagctgattccctacgtgcgccagctcggcttcacccatatcgagctgatgccggtgatggaacatcccttcggcggctcctggggctaccagccgctcgggttgttcgcccccaccgcgcgctacggcacgccggaggacttcgccgctttcgtcgacgcctgccaccaggccggcatcggcgtgatcctcgactgggtgccggcgcattttcccaccgacgcccacggcctgggccgtttcgacggcacggcgctgtacgagtacgaacatcccttcgaaggcttccaccaggactgggatacctacatctacaaccttggccgcagcgaggtgcacggcttcatgctggcctcggcgctgcactggctgcgcacctaccacgtcgacggcctgcgggtggatgcgtgcccctcgatgctcttcgggaactattcgcgcaaggaaggcgaatggctgcctaaccgccatggcggccgggagaacctggaggccatcgacttcctccatcacctcaaccaggtggtcgccagcgaaacccccggcgcgctggtgatcgccgaggaatccaccgcctggcccggcgtcagccgtccggtggcggagggcggcctgggcttcagccataagtggaacatgggctggatgcacgacagcctggcgtacatcggcgaagacccgctgcaccggcgctatcaccaccaccagttgaccttcggcctgctctacgccttctccgagcatttcatcctgccgatctcccacgacgaggtggtacatggcaagcactcgctactggacaagatgcccggcgaccgctggcagaagttcgccaacctgcgcctgtacctgagcttcatgtggtcgcacccgggcaagaagctgctgttcatgggatgcgagttcggccagtggcgcgagtggaaccacgacggcgaactggactggtacctgctgcgctatccggagcatcagggcgtacaggacctggtggcggccctcaaccggctgtaccgcgaactccccgcactgcatgcgcgcgacggcgaggcgctcggcttcgaatggctgatcggcgacgaccaggcgaacagtgtctacgcctggctgcgccacgcggccggcgagccatcgctgctggcggtacacaatttcaccccggtgccgcgccagggctatcggatcggcgtaccgcaaggcggcgactgggacgtgctgctcaatagcgacgcccaggcgttcgccggttccggcgcaggcagccagggccgcgtctccagcgagtcgtgcggcgcccatggccaggcgcagtcggtggtgctcgacctgccgccgctgggcacgttgctgctgcgtccggccggctga

SEQ ID NO: 8198 - DNA, 525 bp, Pseudomonas aeruginosa
ggggatcgagattgctcgagccgatggtcgaccagtcgtcgtcgatcaccgcgaccttgccgtgcagcggacgctggcagtattcgtggatacgcacgccctcgcgcagcaggtagtcgtagagcagccggctgcacaggcgcaccagcggcatgtccggcatgccctgtagtaccaggtcgacgcgcacgccgcggcgcgccgcatcgcgcagctcgcgaagcaggcggtagccggggaagaaataggcgttggcgatcagcaggcgtcgccgcgcctggcggatcgcctgcaggtactcgcgctcgatgtcgtcgctggactggtcgttgtcgcggatcaccaggcgcacccgcgccggctgcccggcgcccgacggccgcaacggcgggtagtcggcgtccggttcgagcagcgccaggcaggcctggcggatatcgcgcaccaccgggccctcgacgcgcaccgcgtagtcctgcttggccatgttgccgcgacgtaccaggtggtcctcgccgtaattga

SEQ ID NO: 8199 - DNA, 873 bp, Pseudomonas aeruginosa
tcagcagttctacgcggttgccgtcgcgccaggggaagttcatggctccacctccaccgccagcggcaggtggtcggacaggtgcgaccagggccgccgcgagaggatgcgcggctggcgcccgcgggcattgcgcaggtaaatgcggtccagcggcagcaccggccagcgcgccgggaagctgcgcgccggccggccctgggcgccgacgaagacttcgcgcaggccgcaaccggcgagcagttggtcagcgcgctggcgccagtcgttgaagtcgccggcgaccaccaccggctcgcgctccggcaggcccgccaccagttcgcagagcagttgcaactggcgctggcgctgcgcctcgcgcaatcccaggtgcacgcagaccgcgtgcagcggacggccgatgtcgatcaccgcatgcaacaggccgcgttcctcgttgcccgccaccgagacgtcgaggttgcggtgggcgaggatcggatgcttggagagcacggcattgccatggtggccttcgggatacaccgcgttgcgcccgtaggcgaactgcggccacatgctgtcggccagatactcgtattgcggcgccggcggccaggacggcaggcgcgcggcgtgcaggctatgggagccgaggacctcctggaggaacaccaggtcggcaccgacgctgcgcaccgcttcgcgcaactccggcaggatgaagcgccgattgaacgggttgaaacccttgtgggtgttcaccgtcagcacctgcaggcgcggcaggatcatgcggcactctcccgcaggtcatcgggcaactgtccgggcaccgtgcgcaggccgccgtcgagttccagcagctgcaggaggcgccgggcgtcgtag

SEQ ID NO: 8200 - DNA, 411 bp, Pseudomonas aeruginosa
acgccgatgatcgacagggtgccggccttggccaggccctgcaccgcccactccagggcctgtgcgggggcgttgccgggactccagctggtgccctcctggcgcggcgccggggtggcggtgccatggctgtgctcggcgtccacgccgacggcgtcgatggcgcggtccacgccgatcccggcggtcagccagcgcagggcctggaccggatcctcgcgctcgaagtcgatcacttcggcgccttgctggcgggccatgtgcaggcggtccgggtggcggtcgatggcgaacaccctggcggcgccgaggagcaacgcgctggcgatggcgaactggccgaccggaccgcagccgaacacggcgacggtgttgccgggggcgataccggccagttcggcgccgaagtaa

SEQ ID NO: 8201 - DNA, 813 bp, Pseudomonas aeruginosa
ctcgaacagcaggaaactgcggccgccgaccaggaactcgctggcgaacgggtagcgttcgccgagcgggtcctccggccgctgggtatccagcaggcaggtccagccgctgccttcggccacctcgggaagacggaaggacaccgcgtcgtggtaggcattgaggatcagcagcagggtggcatcctcaccgctgcgcaggatcccggtgggttgcgcgcggccatcgaggagcacgccgagacagcgggcgtgctcgtcgtgccagtgttcctcggtcatctcctcgccgccgggcgccagccaggtgacgtccttgacacccagcgcctcgttgtactcgccgaccaggaagcgccccctgcgcaggatcggatagcgttggcgcagggccagcaggcgctgggtgaaggccagcagcgaacggccctcgtcgtccagccgccagtcgatccagcccagttcgttgtcctggcaatagacattgttgttgccctgctgggtgcggctgaactcgtcgccggcgaccagcatcggggtgccctgggacagcagcagggtggacagcaggttgcgcatctggcgcaggcgcagggcgcggatctccgggtcgtcggtggggccctcgcagccgtggttccaggacaggttgtggtcgctgccgtcggcgttgttctcgccgttggcctcgttgtgcttgtgatcgtaggaaaccacgtcgcgcagggtgaaaccgtcgtgggcggtgacgaagttcaccgacgcgtagggccgccgtccacgctggtcgtagagatcgccggaggcggttag

SEQ ID NO: 8202 - DNA, 2556 bp, Pseudomonas aeruginosa
tccgcgaaggagcggggctacgctttctgctcatgcactggactcctcattcgcccgcttcgggcttgcggcggctgcgcggcttggccgccgccggtttttcgctggcgggccgcgccggggacgcggccctcggcttgcgcggcttggcggccggcgcttgcagcagggccggggtttccttggcggccttggcccgaccgcgggtcttcttcggtgccgccgcggcggcttccgcttcggccagttgccgggccatggcccagtggcgttcggcctggccgtcggggcagccctcggattcccagatctggtaggcgaactctcgtatgcgtttttcgtcggcgctcatggggtgtcctcctgggcgaggcggtaaagcaggttgacgggaaagtcggcgagcacttcggacaggctcaggtgcccgtcgctgggcagcggcatggtggaaaacaggccgctgtaggtgcattcggagagactcggcggcagcagcaggcaggtgtcgccccaggcctcggccggcacctgcggctgcgtggcgtggccgagcagggcgcaggccaggcgcgggaccaccaccagcaggcaaccgtgacgactgcgccgggcgaaggccaggacccgctcggcatgctcgccgctgacctccaggggcaggtagtcgccgtcgcggaacaggcccggctgcatccgccgcagccccagcacgcgggcgatcagggtctgcttgatgcgaccgtcgcgccagtgctccagcagttccgggaagggcgtcggcgcggccagggcggcggcgtgccgggcgaagtccaccggcctccggttgtccgggtcgaccaggctgaagtcccagtcctcgcgcccctggtagagatcggggatacccgggcaggtcaggcgcagcaggcattgggcgaggccattcagggccccggccggcatcagtcgcaccgccgcgttgcccagcgactggcgcagggcctgggccagtggcgcgcgcaggagctgttccagatagtcggcgcaggcgcgctcgtagtcttcgtcgggcgcggtccagcgcgtgcgcagcttggcttcgcgcaaggccttgcattgccattcgcgcatccgcgcgaggaacgcttggtccagggcggcgccgtcgcaaggcgcgtcgagcggccaactgccgagcagggcctggaacaggatcagctcgtcgccgggactcggcgccggcccctcggcgaggtcgcggcgcaacggcgtggccaggctttgccagtgctcgacgttacgcgcgaaccagggcgccagttcactgagcgccgcaagacgggcgcgggcgtcctcgccgcgcttgtggtcatggctggcggtggccagcagggcgcgtgggctggccaggcgcctggcttcgcaggcggcatggaattcctcggcggaagcggcgaagcgctgcgggtcgaagccgacgtcgttgcgcgagagcagggccgccgagcgatagcaggcggtatcctccacggccttggcggcggtcggcgaactcaactgctggaagcgcgccagcaactcgccgcgcaggcgccgcagcggaccgggcggcagctcgcgcagcggctgcccgccgagccagcgttcgagatggtcgaggaccgcccggtcggcttcgtcgagatcctcgcgggccgcctctgcggcatagcggaacacctcgcgatcctgcaccgagcgaccgcaggccccggcgtaggtacggtagaccggaaagcgcgcgagcaactggaacagcgcgcggcggataccgcccagggtcaggtcgcggctggccaggtcggcccgcgccacccgcaaaagtccctgggcgaggttctccaggtcaccggcgaggcttcccgccaggaccagttggcgagcctggtagacctcgtcgagaaacgcctccgggcgtccgctgacccgctgccagagttcgcgcaacggtcgttcgccgcgcggatcgtgctgcaacaggctgacctggttcatgaagtcgtagccggtggtgccgtcgcacagccaatcctcgggcaggcgctcctcgccaccgaggatcttctcaacgtacagcagcatcggcgcgccgccgcgacgggcgcggatccgctcgctgcggcggcgcaggcgtcggcaatagccgcgcggatcggccaggccgtcgacgtgatcgatgcgcaggccatcgagcagaccgtcctcgagcaactggaaggccttgccgtgcacggcctcgaacacctcgccgcgctcgacccgcaggccgaccagttcgctgatgtcgaagaaacggcgccagttgatgtcgtccgccgcggtgcgccaactggccaggcggtagtgctgcgcctcgagcaggcggtgcaggcgttggcgagcctcctcgtggcgttcctggagttcgcccagcgtgcgctggagggctgcgcgcggagcgctctcggcgagcgcagccgccagttgacgctgcatctcgcgcaaggcctcgcggtcctgccggcactcgcggaaaccgccggccagggctga

SEQ ID NO: 8203 - DNA, 1143 bp, Pseudomonas aeruginosa
caggcgcggctcgccgctgtcttccagcagctccgggtaactgcccggccagagggggaagcgctgctcgccgtggctcgccagcaggcggccggcctcgcggtccaggctcaggccgatctccccggcagccaggacctcgccgtagtcgctgcgcaggaacggcagcagcacctggccgcgcaacgcggcgtcgtgggattcccactgaatgtcgaagaaactcgcgtagggactctcgcgcccccattcgagcacgtcctgccaccagggattggcgccgccgccgatgcccatgtggttcggcactatgtccatgagcaggcccatgccgcgttgccgcagcccctggatcaggcgcagcagcgccggctcgccgcccagttccggattgatccgggtcgggtcgaccacgtcgtagccgtggctggagccgggccgcgcgcggaacagcggcgaggcgtagagatggctgatgcccaggtcggcgaaatagtccagccagggcagggcatcgtcgagggtgaagccggcgtggaattgcaggcgcagggtagcgcggggctcaatcatgggcggcctcctcggcatcccggcggctgcgttcgagcaggcgcaggcgccggtcgacctgcggcgttccgagcatctgcgcggcgttttccggccagcgccgccgccagttcgggtgggcgtcgccggggccgggcaggttcggctgctccaggctgcccagggcgtcctccaggggcagtagcaccaacggcgcgggggttgccccgacatagccgatgcaggcgtccagcggtacttcggcggcggggtcgggatcgaccggcggttcgaggctggcggccagggcccggcgctcctcggcgcgcagttccaggtcggccgcgcattcctcggcgctgcggtgtccggcgcggccgcgccagtggatgtcctggccccgccaccagccggacaggctcggcaggtcgtgggtgctggtggtggccatggcgtccgccggccattgcgccgggggcacgaagcgttcgccgcgccgctcgaagagcagcacgcgggtacccagcacttggcggcgtgccagttcctcgcgcaggccttcgggcacggtgccgaggtcctcgccgatga

SEQ ID NO: 8204 - DNA, 426 bp, Pseudomonas aeruginosa
gcaggacgtgcagcgcatggtggccatcgtcgttccactgtgcgtcgtagccctggcgcagcaggctggcgcggttgtcgtcgttctccaggaccaggtgcacatggcgctcggggccggcggcgccgcgcaggcggcgggccatctcgacgaggaacgcgctatcgggaatcgcgtgcacggcatcgaagcgcaggccgtcgacgcgatagtcgagcagccacatcagggcgttctcatagaagaactcgcggacttcgcctcgacggaaatcgatggcctggccccagggcgtctgccggtcgtcgcggaagaacgcggcggcgtactgcgcgaggtagttgccgtccgggccgaagtggttgtagatcacgtcgacgaagaccatcaggcccatgccgtgagcgctgtcgatcagatgcttga

SEQ ID NO: 8205 - DNA, 2145 bp, Pseudomonas aeruginosa
gttgctcgggcgtgccgtaggccgacgccggggcgaacggcagcacgccgtcgtagccccagttgcggcgaccgggaaactcgcccagtggcatcagctccacggcggtcacgcccagttccaccaggcgcggaaggaagtgctcgacctcggcgtaggagccgaacaggccgacgtgcagctcgtagatcaccgcttcgtgccagggccgcccgcgccactcgtcgacgcgccaggcgtaggcgccatggtccagcacctggctgtgtccatgcacgccgtcgggctggaactgcgaggccgggtccggcaccccggggcgaccatcgatgcggtaacggtagcgggtgccgggcggacagggcagggtcgcctcgaaccagccgctgtcgctgccttccagcggccagtcgcggccgtcggcggtctcgacccggacctcacgggcgtccggagcccagaggccgaagcaggtccggccgttgccttggaactgggcgccgaagcggcgccggatcgccatcactggcgtaccccgcgcagggccggagcggtattcctcaacaggcgccggtacaggcggttgtaaggctccaccgagtcgctccagaacatcggcgcggccatcgccttgcagcgcatggcgttgagcagcgagggacagtggtagacgttgatcgcgcgcatcaccgcatcgaggtagctctgcgcggtttcctcacggaacaggaagccggtgaccccgtcgacgatggtatcggcgaggccgccggtgcagcgcgcgatcggcagcgagccgaagcattgcgcatagagctgactgagcccgcagggctcataacgcgagggcatgagcaggaagtcgctgccggcgtagatacggcgggcctcggtctcgtcgaaaccgatgtgcacgccgacctggccgggatgacgccgggcgagttcgagcatggccttctccaggttcggctcgccacggccgatgctgaccagacggccgccggcctggagcagggcatcgctgatctccagggtcaggtcgatgcctttctgctgcaccaggcgcgagaccaccgcgaacagcggccccttgcccggctccaggccgaaacgctcctccacgtagcgcgtgttggcgcgcttgccggcccattggcgggcgctgaagcatgccaccaggtgcggatcgcagtgcggctgccagctatcgtcgataccgttgacgatgccgctgagctgacgcttctcgaccttgtacttgaggatgccgtgcaggccgcagccgtattccggggtagtgatttcctgggcgtaggtctcgctcaccgtggtgatgtggtgggcatgggcgatgccggccttgaggaacgacaggcgcccgtggaactccatgctttcgtggctcagcgcttcgtcggggaggcccagttcggcgctgcattgcaggtcgcagaggccctggtaggcgaggttgtggatggtaaacaggctcggcgtgcgcacgccgttccaggccatgtaggccggcgtcagcgccgacggccagtcgttggcgtgcaccaggcccggttgccagccctgggcgccgcgtccaccggcgatctcggcggcggccaggcacaggcgggcgaagcgcaggtggttgtccggccagtcgttgccctggtcgtccatgtacggcgtaccctcgcgctcgtagagcagcgggcagagcaccagcatgacttccaggccgtcgtcgagggtcaccaggccgatctcgcagggcgggatcgccgcccggccgggcaggctgccgatgatccgcaagtcgcggcagcgctccagcacctggcgatagccgggcagcaggactcgcaccgaatgctcgcgcttgaggaccctcggcagcgcggcggaaaagtcgccgagtccgccgaccttgacgaaatcgctgagctcggcggtaacgaagagtatccgatccctctgttgcggcgggtcctgcgggtgcagcagcgacggaaaagcggtcagtaccgcgggttcttccaggcaaacgcctgcaacagaatgtcccatgtcatcctccggtcgtacgttgtccttggcgttggtcggtcggactccgtcgcgccgtggcatgggcgaagtccttgctag

SEQ ID NO: 8206 - DNA, 1335 bp, Pseudomonas aeruginosa
aagtcatccctacgatggaggcggacatgcgttttcccacttctgcatcatcgggcgcgacagcgaccactccacgcaacccctcgagggatccggacgaatatccggttcctgaccacgaaagccacgtcccccaggaattcccggaagagattccgatggaacagcccaacgaagagcccctctcgcccataccggagccctgaatgcccggtttccatccaggaggagcggaacatgagcgcagaccctcggcagagactggtggtggcccatagtgtcgatcccgcggccgccgaacacgaagtgcagggcaacctggccctggcgcgctggctggcggaagtccagaagctggagttcggcggccgctacgaacccgaattgcaccagcgaggccccctctacctggtcccgacccgcaccctggtcggcagggagaccgccgtgcgcctgggcgtgaacagtgacgaagatctgctcggcggtttcgtcgagcacgcgttcatcgccggtaaggccatcgtccatccgctgccgcgcggcggcgtggcgccggaaggctggaacccgctgttcgcggagaaggtccgcgacgtcgtgctcaatggcgtcagcgtcttcagcctggccgacgcacaccgcgccggcgctcgcatgctcgccgaaggaccggtgcgggccaagctggcggaggcctgtggcggcctcggccagtacgtggcgcacgacctcgacgaactggacgcttggctcggcgggctggaggagcgtcagttggcgcagggcctggtactggaagccaacctggagagcatcgtcacccacagcgtcggccagctccgggtcaacggtttcctgctgagctaccacggtcaccagcaccagacccgcaacgcgcgcggcgaactggtctatgccggctccgacctgctggtggcgcgcggtggctacgccgagctgctggccctggacctggcccgcgaggtgcgccaggccatcgagtacgcgcggatcttcgacaccgccgcggcgatcttcttccccggctgcttcgcctcgcggcgcaactacgacattgcccagggccgggatggcaacggtcgggagcgcttcggcgtgctcgagcagtcctggcgggtcggcggcgcgagcagcgccgagatcgccgcgctggaagccttccgcgccgatccggggctgcccgcggtgcgcgccgcgtcgttcgagatccacgaagacaagcgcctgccggacaacagccgggtgatctaccgcggtcccgacgaacacggcgacttcctgctcaagtatgcgatgacgggggaggcatga

SEQ ID NO: 8207 - DNA, 525 bp, Pseudomonas aeruginosa
cctgcatcggcgctgggtcgacctgaagtcactggtcaccggcaaggacgaagaggcggtgctcaacgaatgcgagcgcggcgaggatgtcgccaagcaccgctaccaggcggcgctggaaaaatcgctgccggcggagatccaccaggtgatcgagcgccaataccagggcgtactccgtcaccacgaccgggtccgagccctgcgcgacgcccgcgcctgagccgaccccgcgaggaggagcgcgccatgagccagtccctggctttcctgctcatcggcctggccacgctggtgggtttctacgacctgtgggccttcgtcagcgtgttccgcagcgatcgcagcgtgaattcgaaagccctgtggtcgttgctgatcgcggtgctgccggtgctcggcgtgctgatctgggcggtcgcccgcccgcgtgcaggcgaccgcccgtcctcgcgactgaactcggcggaggaacgcgcgctcagccagagagagtgccggagcactcggataacaaaccgatga

SEQ ID NO: 8208 - DNA, 480 bp, Pseudomonas aeruginosa
ggagcgaccatgaacgccatcgaattgctggtccatgaccacgagaccgtgaagaaactgctcaacgaactcagcgagaccaccgaacgggcgctgaagaagcgcagcgagctgctgggcaggctggagctggaactggtgctgcacaccgccatcgaggaagacatcttctatccggcgatcagggaaagcggcggcaaggaagagctgaaaatgtactacgaggccaaggaggaacaccgcacggtggattccctggtccttcccgacctcaagcgcacccgcccggataccgtgcagttcgccggccgggtcaaggtgctcaaggaactcctcgaacaccacatcgaggaggaagagggcgaactattcccacgcgcccggcaattgctcgacgccgccgccctcaagcaactcggccaggccatgcagcagcacaagaaagagctgaaagcgcgcctggaaaaacgggcggcctga

SEQ ID NO: 8209 - DNA, 1080 bp, Pseudomonas aeruginosa
ggcatgcgcgaagaagaccgcgccttgctcgaggaactcctgctggcacgtggccccggtggccaggaagacgaggtcagggccatctgccagcgggaactcgagggctgttgcgacgaggtcggcagcgatgccgccggcaacctggtcgcgcgcatcagcccgccgcacctgccgcgcgagcaggcgcggcgggccgcggtgcggctgctcgcgcacctcgacgagatcgccatgatcgtcaagcgcgtcgaggccgacggtaccctgcgcgtagtggcgctcggcggcgcccagccggtgagcttcggcgtctgtccggtacagatcctggccggcgaggcggtactcgacggcgtgctgtcctacggcagcatgcatgctaccggcgagtcgccgcagggctccgacgtgctctcgggcgcggtgcactggcgcgacgtacacgtggtcacccggcgcagcgccgaggagctggcgaacctgggcgtgcgaccgggtacccgcgtggtgctcaaccgtctgtggcggcgcccgttgtacttccaggattgcgtcgccgcgcacttcctcgacgaccgcgcaccgctgctcgcagtgctcggcgtggctcgcgagatcgcccggcgccgcgatgagttgcacggcgacctctacctggtgctcaccaccatggaggaggagagtaacgccggcgcgctgttcgccgcgcgccgactgccgggcgacatcagcatcgcggtggaagtcggcccaacggtagccgaatacggcacccggctgtgccgcgacccgatcgtcaacagcggcgactccaagggttattacagccgccatgtcaccgaccgcctgttgcgcgccgccgaacgctgccagtaccagccgcaggcggcgctgctggtggacttcgcctcggacgccagcgcgctgctgagccacggcgaggccgcgcaggtcggctgcatcggcattccgaccgagaacacacacggtttcgagatcgtcctggaagagggcatcgaggcttgccggcggacgctggtcgagttcctcgtgcaaccgccggacgacgaagcctga

SEQ ID NO: 8210 - DNA, 450 bp, Pseudomonas aeruginosa
ccgcgaacgaaaacgatgaaggcgctgaaggccagggccagcagcagggtgccgaaggcctggctgagggtatcgggtccggacatggctggttctcctcagggcgccaggcgcaggcactggcgcttgtgcaggccgagacggacttcgtcgagcagcgcttcggcgcaggcgaacaccctggcggcctccacttccgcgacgtcgccggcgcggctgaaatcgtcgatgcgcaggccggcgggcaggctcgggacctccaccagcgtccagtccaggccgctgaccgtgaggctgcgctcgagcccggcacccagttgctcctcgccggcatcgcgcggcgccaccagccattgccaatggccaagcaggaacaggcgcggtacctcggcgcgcagggcgccatcgatcagcgcggcgcagatcggcggcaaggcttcggcggcgtag

SEQ ID NO: 8211 - DNA, 2421 bp, Pseudomonas aeruginosa
tcggacaacggcgcgaacagcaggtcgagaccggcagccgcctggctgacctcgatcgacgacgccaggctggctggcttgcagcgcagcccggggcgcgcctgcaggctgttgagatcggcttgcaaggcgctgacttcgatctgtcgctgcaaggcggcggcgatcagcgcctggctcaggctgtcgtggggatggaatatccccagcttcagggttgcggtttccagattgcgcatgggaactccggggtcggtgcggtggaaaggagatgtccctacctgcatatcgaaagccatactccggacaaggttccggcgaatggaattcgccggccgcgccggggtcttccgaaaggtcggccaagttcctggggcgagccagcgagcggccggaagacgttcttcgtactaccttgctgggtgtgccttgcagcccgggtcgagcagccgacgagtgaacacgtccatgaaaaccacaagaaaaccgaaagtccccttgaaccaggccacgcgcaaccgcctgctcgacgaagcggtcgacgactacgcgatccacaccctggacagcgctggccgtatcgccagctggagcgccggcgcggcgcgcctgttcggccacgacgcgagcgagatcctcggccgcgactacgcctgctttcacacccgcaaggaccgcgacgccggcgttccgcaacaggcgctgcgccaggcggatgtcgagggccgcttcgagaccgagggctggcgggtgcgcagcaacggcaagcgattctgggcgcaggtggtgatcgacgccatccgcgacagccagggccagttgctcggcttcgcccagctgatccacgacctcagcgaagggcgcgcggccaaggaggcgctgcggcgcagccaggagcagttccgcctgctggtgcagagcgttaccgactacgccatctacatgctcgaccaccgcgggcggatcaccaactggaacctcggcgcccagcggatcaagggctacctgccggaagaggtgatcggccggcacttctcctgcttctacacccccgaagaccgcgaggccggcgagccggcccgcggcctggccgccgccgaacgcgaagggcgtttcgagaaggaaggctggcgggtgcgcaaggacggcagtcgcttctgggccaacgtggtgatcgatccgatccgcgacagcgatggccggctgatcggcttcgccaaggtaacccgtgacatcacccaccggatcgaagccgaacgcgaactggaacgggcccgccaggagctgttccaggcccagaagatggagtccctggggcacctcaccggcggcgtggcccacgacttcaacaacctgctgacggtgatcatcggcagcctcgggctgctgaagaaacgcctgcccggcgaccagcgcaccgccgacctcttgcagaacgccctggaggccgcccagcgcggcgccaacctgacccagcggatgctttccttcgcccgcaagcaacgtctcgatccgcagccctgcgcgatccccgacctgttgcgcgggatgaccgacctgctgatccattccctgggaccgagcgtatcgatcgagacgcgctttcccctggatctcgacctcggcctgaccgacgccaaccagctcgaactgtccatcatcaaccttgccaccaacgcccgcgacgccatgcccaacggcgggcgcatcgtcttttccgcgagcaaccagcgggtgccggcggacaatccccatcgcctcgcaccgggcaactatatctgcctgagcatcagcgacaccggcagcggcatggacgaggaaaccctgcgccgtgcggtggaacccttctacaccaccaagggaattgggcgtggcaccgggctgggcctgtcgatcgtcgacggcctcgccgagcagctcggcggccggctcaccctggagagccagccgggcgtcggcaccaccgcgaacatctggatacccgccgtcccgcgaaccccggaaagcgcccgtacgggcaatggcgcgacgccgcagccgcccagcgaaagcgagcgggtgcgcttgtcctgtcgagtactggtggtggacgacgacccgctggtgttgaacaacaccgcggcgatgctggaggacctcggttgctcggtactcaaggccgactccggcagcctggccctggagattctcacggcgacgccggagctggacatcctcctgaccgaccaggcgatgccacggatgaacggcagccagttggtggagcgggtcatggcccagggccggccgctgaagatggccctggccaccggcttcgcggaaaagatcgaaggcgcggcggcacagttgcccaagctggccaagccgttcggccaggaagagttgtacctgttcctgaccggcacgctgaaggccggctga

SEQ ID NO: 8212 - DNA, 462 bp, Pseudomonas aeruginosa
agactccgaacatcgccgcccggtcgccctcgatcaggttccagaaacggctgccgcgcggatcggcatggcgccggatccagccctcttcctcgaggcaggcgagaaacgccgggaaccgcccgggcaccgccagccactggttcaccgtgcgcccgccgatccggcaacgatccgaatgcatgccggcggcgtaggggcgcttgcgctcgaacatggccagcaattcttcctcgagatcgaagccgtcgatcacctgctcggtgctcaggccgacctcgttcaggcggtagccgttcctcacccgttcgaggaaggccgcgcgcccgccaagctgcggcaggttgtcgtagagcgcgcgcagggccttgcgcgcatgtccgctggcggcgttgtcgatggtcacgtgcaactggaagtagtaggggtcgaagcccagctcgcgcagctcctgagtggtga

SEQ ID NO: 8213 - DNA, 1620 bp, Pseudomonas aeruginosa
agtgcatcgcctgggagggaacctggaagtagcgtcgcccttcgccgcgccgacgtgcccggaggtattcggcatgcgcctcggcggtgcgccgggccccggcgtcgagccaggccggccaatcggcggggtcctccggcaggtcgtcgtcatgggtggcggccaggctcaattgctggtcgaggaactcgccggcggcttcgaggtgctcgcggggctcgtcgagcagggcgtggtacaggtcgcggaccctgggcgaagggcttgcactggaggcagggaggggtgaagacaggctcatgtcgcgttccttgtcgtgggtttgcgggggcggccggggcgaccacacatatgggtgcgagtgacaccaggggaaaaaggtttcactggcaggatcggcggcgcgccggggaacctcacggcggaaaaaacgaacctcgacggcactccggcgtcttcccgagacaatccccgggagctgcgccgatgacccacgacctggccgccagcggccttcgcttcggcatcgaggaagaattcttcctgctcgatgcctccgacctggacatcgtccgctccgcccccgccggattcgtcgcggcctgccgtgacacgctcggcgagcatttcgccgaggagatgttcgaatgccaggtcgaggtggccagcccggtgttctccaccctggccgaggccgcgcgcttccacggtcaggcccggcaacgcctggcgcatctggccatggacttcggcctgcgctcgctctgcgtcggcacccatcccttcgccgactggcggcgggcgcgaagcaacccggcggcgcacttcgcccgcctgttcgaggaccaggggcgggtggcccggcgcagcctggtctgcggcctgcacgtgcatgtggagataccgccgagccacgaccgcatggctgtgctccagcgcgtgttgccgtggctgccgctgctgctggcgttgagcgcatcctcgccgttccgcggcggccggcgcagcggcctggcgagctatcgacgggcactctgcggcgagtggccgaggatgaacattcctcctgccttgcccgacgaggacgcctatcgccgccacctggcgctgctgcgcgagaccggctgcatccgcgaggatggccaggtctggtggatgatccggccgtcatcccatgtgccgaccctggagctgcgtatctgcgacgcctgcccgcgcctggccgacgcgctgagcctggccgggctgttcagggcgctggtgggcgaagcgctgggcgcggacccgcgtgcgttgccggtcgcgcgcgacgcctgcctggaggaaaactattggcaggcgctgcgttacggttgcgccggccgctatctcgtcgacggccgctgcgtaggtgccggggactggctggaaatggcctggcgacagtgccggccgcaggcccgccagggcaacgagtgggcctaccagcatgcctgcgggttactcgaagagacctccgccgcccgccagttgcggcgttaccggaggttgcgcgaagcgggccaggagcgccatccggcactgcgccggctggtggaggagctgctggaggaaaatctccagccggccttggccggctag

SEQ ID NO: 8214 - DNA, 699 bp, Pseudomonas aeruginosa
gcaggggcgcctgcgggtccgatcgcccgcagcacgccccgatcacccttgggttcatcgcttggcctcggtgtccggctgagagtcgcgggcaaggaaggcctgggtgagttccggcagatggtcgcgcaaccagtccgccatggcttgttcctggggcaggatgcgttccagcgcggcaagggtttcggcgtcgccgacctcgcgggcggcggcgatcagcacggtgtaggcggcgatctccatgttttcgaacacatagccgctcatggcgcccttgaccacttcgtcgctgactgtcatgccagccaccgcctggccgaaggccatcagcttggcgccgatgtccttcagcgtcgacggactgctgtccaggcgcttcagacactcctcgagcagacgctgctggccatgggtttcctcgatgtgctgttcgatccgcgtcttcagttgcggatagtgttccagccgcgcggcttgcgctttcagcatctgctcggcctgttgctccatggcgtgggcatcgcgcagccagtccagcaggttttcctgtttgctcgtcatcgcggttctcctcggtgtgtatgtgtctgctcagaggtggccgccgggcgcagcgttcagtttcttttccgaccggtagcagtcagcgcagcggcgccgttgcgccaggcgagacgcgttggggaaaagttctga

SEQ ID NO: 8215 - DNA, 363 bp, Pseudomonas aeruginosa
gcaggaggtgttgcagcgaatggcagaccgcacccgctccgaccccatggccgatccgctgacaggtgcggacctgggcgctggcgcggctgccgacaaagcgccttgagcgcggatgcccgacgtcggcgggcgagtcccggcctccacgcccggcaccttagcgtggaggcacggcagaggagcctcgagatgaccgccaagcgcgaaacacccgagacagaaaacaccccgctgagccccgcctcgccgacgctacgtcccgagcggggcaagcgcgaccaggcgagcgaggcgcaaccggaattcgccccggacgatcccgacgtagcgggccccggcgaagcccgtcgtcccgcctga

SEQ ID NO: 8216 - DNA, 603 bp, Pseudomonas aeruginosa
tcaatacctcgaccaccattgtcaccttcctcatggtcttcctcatccagaacacccagaaccgcgataccgacgcgctgcatatcaagatcgacgaactgttgcgcagcacccgacgtgcccacaatgcgctgctcggtctggacgacctggacgccgatacccttcgcgaactgcgtcagcgctaccagcacatgggcgagcaggacggcgagacgccggaaagcgtcgccgccgaggaagagcgccagtgcggatgcggcgaggagcgacggcgcgccgactgaaccgccgcgccgcgatggctcatgggcgcaggacgaccttgcggcaatcctcgcgtttttcgtcgaacagggcgtagccctccggtgcgtcgtccagacgcaggcggtggctgatgatcgcctcgggatgcaggtcgccgttgccgatgtgttcgagcaaggccggcagcagtgcctgtacatgggtctggcccatcttgaaggtcaagcccttgtcgaaggcatcgccgaacaggaagccatggatgaagccggcatacacgcccggcacgctcaccgtgccaccccgccggacagccgcgatgcactggcgtag

SEQ ID NO: 8217 - DNA, 747 bp, Pseudomonas aeruginosa
tgccttgccgctgctggcttcgagcttgagcgcggtgagcacggtttcggtgacgctgcccttggcctcaaagcccaccgcgtcgatcaccgcgtcgacgccgcggtgcccgtcggtgcgctcgatgatcgccgcggcgggatcgtcctcctggtcgaagtcgatgggaatcgcaccgtaggtgcgcgcggcgaagtccagccggtagggatggtggtcgacgatgaagatccgctcggcgcccaacatccgcgcgcaggcggcggccatcaggccgaccgggccggcgccgtagatcgccacgctactgccctggcggacgccggcattgcgcaccgcctggtagccggtggggaggatgtcgctgaggaacagcacgcgttcgtcttccattacgtcgggaatcacgaaaggcccgctgttggccttgggcacccgaacgtattcggcctggccacccggcacgccgccgtacaggtggctgtagccatagagcgccgcgcccggcggaatctgcttcttgttgaggatcgcgccgcgccccgggttggtggtctcgcaggcggcgtgcaggttcaggcggcagaagaagcactcgccgcaggcgatgacgaagggcaccaccacccggtcgcccggacgcaccgcggtcacggccgagccgacttcctcgacgacgcccatgaactcgtggccgaggatgtcgccctgctcgaccatcgggatcttgccccggtagagatgtag

SEQ ID NO: 8218 - DNA, 567 bp, Pseudomonas aeruginosa
gcaccagcgaagccgggcagaaaggcggcgcagctacctccaggagccacggcaaggagttctaccaggagatcggccacaagggtggccaggccagcggcggcaacttcgccaatgacccgcagcgcgccgccgaagccgggcgcaagggtggccagcagagcggaggcaatttcgccaatgacccggaaagagccgccgaggcgggccgcaagggcggccagcagagcggcgggaacttcgccaacgatcgggaaaaggcctccgaggcaggacgcaagggtggccagcacagccacggcggcggacgctcgtcctgaccgtgccgaaccgctgaagcgtacggcgcatccccaacgggatgcgccgttttcacatcggccgaagagagccggtccggggcttcggaaagtcccgttcgaacaggcggcaggatgcccatgccgccggggaaagcgggccttgccaacgaccttcgcacatcagaccttacgttggaaaaagtcgagcgcctcctggaagctgggccgcagcggcacgttccagtcgggatgggcggtgaagtga

SEQ ID NO: 8219 - DNA, 609 bp, Pseudomonas aeruginosa
ccatccacctcaatggccagcccgtcgcggcggctgccggtgagaccgtgctcaacgtgctcaatgccgtgggcctgcgccggctcgcgcgcaacgaccatggccaggccagcggcgccttctgcggcatgggcgtatgccactgctgcctggtcgccatcgacggccggcccaagcgccgcgcctgccagaccgtcgtccggccgggcatgcgggtggaaaccgaaagcaaccgcttcgaccaggaggaacggccatgaacctgcgcccggtgatcgtcggcggcggctcggccggcatggccgcagccatcgagctggccaggcgcggggtcccctgcgtcctcttcgacgaggcctcgcgtcccggcggggtggtctatcgcggccccttgcgggccggcgtcgatccggcctacctcggcgcgcgctacacccggatgctggaaaaactgcggcgcgatttctccgcctgcgccgggcacatcgacctgcgcctgaacagccgcgtggtcggtggcgacggccagcgcctgatggtcctcgacgaggcggaacggctgcacgaggtggagtattcgcacctgctcctggccaccggctgccatga

SEQ ID NO: 8220 - DNA, 2298 bp, Pseudomonas aeruginosa
gcgcagcgtgccgttccccggctggaccctgcccggggtgatgctcctcggcggcctgcaattgcagatcaagagcggcgtggtgaagcccctgggcgataccctgatcgccggcagcggcccgctgctgccactggtggcctgccagctgcatgcggccggggtacgtgtcgccggggtctacgaggcctgcgcgttcggccgcatggccagggaaagcctggcgctgctgaacaagccgcaactgttcctcgacggcctgagcatgctcggctatctcaagctcaacggcattccgctgcactatggctggggcgtggtggaggccagcggcgagggggaactgacggaagtgacggtagcgccctacgacgaagagtggcggcccgacctggaaaacgcgcgaccggtgaaggccagcaccctggcggtcggctatggcttcatcccgcgcacccagctcagccagcagttgggtctggagcacggcttcagcgacgacggatacctgcgcgcggaatgcaacgtctggcagcagagcagccaaccgcacatccacctggccggcgacatggcgggtatccgcggcggcgaggcggcgatgatcggcgggcgcatcgcggccttgtcgatcctcctgcaacgcgaggccatcgcgcccgccgaggccatcgaacgccgagaatcccatctcgcccgcctggaggcgatcaagcgcttccgcgccggagtcgagcgctacacccagcgcggcgcccgccaggtcgaactggcgcgggccgatacggtgatctgccgctgcgaacaggtcacccgtggcgacatcgagcgcgcgctcgaacagggcgtgcaggacatcgccgggctgaagatgcgcacccgcgccggcatgggcgactgccaggggcggatgtgcatcggctactgcagcgatcgcctgcgccgcgccaccggacgccacgacgtcggctggctgcggccgcgtttcccgatcgatccgatcccgttttccgcattccagaacctcggtacggaagcctgaacatgaacagaacctatgacatcgtgattgccggcggcggcgtgatcggcgcgtcctgcgcctaccaactgtccaggcgcggcaacctgcgcatcgccgtggtcgacgacaagcgcccgggcaacgccacccgcgcctcggccggcggcctctgggccatcggcgaatcggtgggactgggctgcggggtgatcttcttccgcatgatgtcctcccgcaaccggcgcgaggcccagggcgcggcggtggcggtggacgcgagcacgccgcacatcctgccgccggcgttcttcgacctcgccctgcaatccaacgcgctgtacccggaactgcaccgagaactgatcgaacgccacgggatggacttcaagttcgagcgcaccgggctgaaatacgtgatccaggacgacgaggatcgccagtacgccgagcacatcgtggcgcagatcccgcatctggccgagcaggtgcgctggctggaccgcgaggaactgcgtcgtgccgagccggcggtcagccacgcggcccacggcgcgctggaattcctctgcgaccaccaggtcagcccgttccgcctggccgacgcctacctggaggcggcgcgccagaacggcgtcgagctgttgccgggaaccaacgtcaccggcgtgctgcgccagggccggcggatcagcggggtgcgcacggacaatgccggggtgctgcattgccggaccctgatcaacgccgccggcgcctgggccgcggaactcagcgaaatggccaccggccggcgcatcccggtgaagccggtgaagggccagatcgtcctcaccgagcgcatgccacgactgctgaacggttgcctgaccaccagcgactgctacatggcgcagaaggacaatggcgagatcctgatcggcagcaccaccgaggacaagggcttcgacgtcagcaacaccttcccggaaatcgccggcctggtgcagggcgcggtgcgttgcgtgccggagctgcaacaggtcaacctcaagcgcacctgggccggcctgcgcccgggctcgccggacgaactgccgattctcggtccggtggctgaagtggagggctacctgaatgcctgcgggcatttccgcaccggcatcctcacgtcggcgatcaccggggtgctgctcgaccggctggtccacgaagagacgctgccgctggacatcgcgccgttcctcgccgcgcgcttccagccggagcctgccgccgtggcggtcgcggcctgctag

SEQ ID NO: 8221 - DNA, 618 bp, Pseudomonas aeruginosa
acgactggtctaattcaagctaacgtgcgccccatgaaaaccagctacgacgacacccgccagcatctgctcgataccggataccggatcatggcggtcaaaggcttctccggagtcggcctcaacgaaatcctgcagaccgcgggcgttcccaagggctcgttctaccattacttcaaatccaaggaacagttcggccaggccctgctggaggactacttccgcgtctacctggcggacatggaccaacgcttctccgcgccagggctgaatgcccgcgaacgactgatgagctactggcagaagtggctggacaacgcctgcccgccctgcgacgagcagcgctgcctggtggtcaagctcagcgccgaggtcgcggacctttcggaaagcatgcgcatcaccctgcgcgacggctccgacgggatcatcgaacgcctggtcggctgcctcgggcagggccgcgacgacggctccctcgcgccctgcgatgcccggcacatggccagcgcgctgtaccagttgtggctcggcgcgagcctgctgagcaagctgcaccgcagcccgggaccgctggagacagccatgcagaccacccgcagcctgctggaaatctga

SEQ ID NO: 8222 - DNA, 777 bp, Pseudomonas aeruginosa
gcccggcgcgggccaggtgctgctgcgcaccgtctacctgtcgctcgatccctacatgcgcggacggatgagcgacgcgccgtcctacgcgccgccggtggagctcggcgcggtcatggtcggcggcacggtcagccgggtggaagcctcgaaccatcccgggttcaaggtcggcgactgggtactctcggccaacggctggcaggactacgcgctttccgacggcagcggcctggcgcgcctgggcgagtcgccggagcatccgtcctacgccctgggcctgctcggcatgcccggcttcaccgcctacatgggcctgctcgacatcggcaagccccaggccggcgagaccctggtggtggccgccgccaccgggccggtcggcgccaccgtcggacagatcggcaagctcaagggctgccgagtggtcggcgtcgccggcggtgcggaaaaatgccgccacgccgtgcaggtgctcggcttcgatgcctgcctcgaccaccatgccgcggacttcgccgaacgactggccgaggcctgcccggacggcatcgacatctattacgagaacgtcggcggcaaggtcttcgacgccgtcttcccgctgctcaacgccaaggcccggatcccggtctgcggcatcgtcgcccactacaacgacaccgagctgccacccgggccggaccgcttgccggcgctgatgggcacgatcctgcgcaagcgcatcaaggtgcagggcttcatcatcttcgacgactacggccatcgctacgatga

SEQ ID NO: 8223 - DNA, 498 bp, Pseudomonas aeruginosa
attccagcgcgacatgtcgaagtggttcgccgacggcctcatccagtaccgcgaagagcgggtcgacggcctggagaatgcccccgaggccttcttcggcctgctccagggacgcaatttcggcaagctggtggtgcgcgtcggagccgacgcatgaaccaggcggtccgtgtggtagcgctgttgcaggcgcgcgagggcagggcggcggaggtcgagcggctgctgctggcctgcgtgcagccgtcgcgggccgaggacggctgcctgtcctatgtcctgcaccggagcctcgacgaggccgggcgcttcgtcttcgtcgagcgctgggccgaccgcgacgccatcgagcggcaccgacggatgccgcactacagggcgatggccgatgccgtcgccgatctcctggcggaccgccaggtgttcctcctcgaggaactgccagcggccagcctgtctccggtagatccggaacctacaagaccccatgaggagtga

SEQ ID NO: 8224 - DNA, 975 bp, Pseudomonas aeruginosa
  unsure (948): Identity of nucleotide at the above locations are unknown.
catcggccgtccataccggatgcggcctggacggccgcactccggatcgcacggaacggccggaaacggccgcgatcaccacaggccgccatgcacgcattccccctcaccctggacaaccgactcgccgaagccctgccgctatggcgcaacctggcccgcaccgaccgggcgccgcgaaggaacatcgacctcgccgactggaaagccgactggcgcgaactgatcgccgcgctcgacaggttttcccggagccacggctatcgccagccgttcgccgcgcaagggcacgcagccctggaaaacgcctgggcctggggccaggccgcggaaaacgccagtacgctgctgctcaaggccatcgaccggggcctggccggcgccgaactgcgctccatctacctggagaccgccgcgctgtggctggactacagccggctgctcggcgccgcccgcgacagcctgcgcgagcagggcgaggtcgacttcgagacggtgccggccctggcgccgcgcacaggccagtatccgttcgcgctgcaactgctcgccatgggcgtgctgctcgatgcccaggagctcatcccggcgctggtcgaggaggtcctgcagttcgataccgaccgcctgctcgactatctcggcgcggccgccctcggcctgacttccgccagcgaggaaaccttccatccaaggccgttcgggcagttgcgggcgttcttcgaagaggcggacggcagcgacgcccaggcgctggcgccttacctgcaaagccagtaccgggagtttttccagctttcccccaaggcgcagaagaagacccgccgcctgaccggcccctacgcctggggctggtgggccatggaggtgtcggcgctgggcgtgctctacggctgggacgatggcgtcctgcgcgcctcgccgcattacctcggcgacctggtcgantacgcgcgggcgcgcggcgacgcctga

SEQ ID NO: 8225 - DNA, 663 bp, Pseudomonas aeruginosa
  unsure (651): Identity of nucleotide at the above locations are unknown.
gccaccggccgccgctcaggcccgccggcggcgggcgaggaacgcggcggccaggtcgaggctggtgcagagcaggaagtagagcagggcgacgaacaggaagatctccgtcgggtggaccatcacccggttgctcacctgggtggcgacgaaggacagctcgccgacgccgatcacgtaggccagggaagtgtccttgatcagcgacacccactggttgaggaaggatggcagcatcaccggcagcgcctgcggcaggatcaccaggcgcaatacctgccacggccgcagtccgagcgcgcgggcggccgcccactgcccggcggggaggctgtggatgccggcgtacaccgagtgggcgaggtaggcgccgccgatcagcgacagcgcgcagaccacggtggccagcgccggtacgtcgacatggaagacgatcggcagcaggaagtaggtccagaagatcagcatcagcaccgggatcgcgcggaagaagccgagcagcgccaccagcagcaggcgcggcttgccgggcagcaccgcgagggccacgccgaggaccaggccgagcaccgccgaagccagtccggagagcgacgccagcagcagggtcagcgccgctccgccgagcgggccgtccgggtatgcgccgancagcaggtatga

SEQ ID NO: 8226 - DNA, 519 bp, Pseudomonas aeruginosa
aggtctcggtttccacctggcgcgaagcgtaggacagctcggccaggccgatggccatcgccagcgaggagttcttcagcgcattcatgtactgcccgagcagcggcggcagagccgtgcgcagggcctgcggcagcaccaccacgcgccatacctggcgctgggtcagccccagggcgaggccggcggcgcgctgctcggggcgtaccgaggcgatgccggcgcggaactcctcggcgacgaaagccgaggtatagagggtcagcccccaggcaccggcgaggaactcgaaggacggccagtcgagcaagggcgtctcgtgcggcgtgttcagccagctcaccagcgcctccggcagcagcgcgggaacgccgaagtaccagaagaacagctgcaccagcagcggggtattgcggaacagcgccaggtaggcgcgcgccggccaggacagcaggcgccggcgcgacagccgggcgatggccaggggggcgccgatcagggtggcgagcaggcaactga

SEQ ID NO: 8227 - DNA, 1194 bp, Pseudomonas aeruginosa
gcagggcaagaccgagggtcagcaggaagccgtcgagcaaccagcgcaggtactgcggggcgagaagttcgccgaacatgtgcgggattccgtcgggtagaacgaaaaacgcgcctcagcgaagtgaggcgcgcgggtcgtgcgggcgaagcgggccgctcagctcttgtcgccgatcttgtacaggcgcgccagcggggtcttggtctgcggaccgaaccaggtgtcgtagatcttctgcgcctggccgtcctgctccagctcgcgcaggctcttgtcgacgaactcggtcagggacttctcgcccttgggaataccgacgccgatcaggtcgttggaaatggtgaagggcggcacttcgtacttgtcgcggtcgggcacgttggccagcaggccgatcagcttcggaccgtcctgggtgatggcctggacctggccgttgcgcagggcggtgaaagcgaagggcgtgtcgtcgtaggcgatgaccttggctccggggaacttctcgcgcagcacgccttcgttgaccgtgcccttgtccacgccgacccgccacttgttgaggacttccggcgaggtcagggtgcctttcttgacgatgaactgctggccggaggagaagtaggggatgctgaagtccacctgctgcgcacgctccggggtgatggtgaagttggccaggaccaggtcgaccttgttcgccgtcagcagcgggatgcggttggccgggttggtcggcagcacttgcagccggacgcccagcttgtcggccagggccttggcatagtcgacgtcgaggccttcgatctgcttgctcttggcgtcgacgaagccgaacggcgggttgctgtcgaaggacgcgacgcgcaatacgccggccttgcggatgtcctccaggcggtcggcctgggccaggccggagatcagggcgagggcgagggcggtgatggcggggagtttcttcatgaaagttccagctccttgtcggccgcgatcgacgatcagggccttgcaatgtggggcggacattccggatgggaatgccgccatgtcggcgcgggggtatcccgtggcgaagggagtttggcaggggccaagggtcgggagaaaagaatgaatcgatctatcttatttccagacgaaataagaggtatgaaaacaaggattcaaggaaataaaaaaacgatagcgtaa

SEQ ID NO: 8228 - DNA, 1050 bp, Pseudomonas aeruginosa
ccgatgattattcaatatgattggcaaaaacggctgcttcgcggtcgtttcccagtacacaaagggcacgcacgggcgatgaaggacgtcgagcgctacctgcaagccggcacgcgggaaaacacccggcgtagctaccagtcggccgtcgaacatttcgaggtgacctggggcggcttcttgccggccacgagtgactccatcgtgcgttacctggtggactacgccgacacgctgagcctcaacacgctaaagcagcgcctcgccgccctcgcgcagtggcatatcaggcacggcttccccgatcccaccaagaccccgaccgtacaccaggtactgaagggaattcgcaccctgcacccgagccagacaaagcaggccgcgccgctgcaattacagcatctggagcatgcggttgagtggttggagcaggaggctatgtgtctgtttcaagccgaagacctggcgggatatttgcgctgtcggcgggatacggcattgctactaatcggcttctggcgaggctttcgtagcgatgaactgtgccgcttgcaggtggagcacattcaagccgaagccggtgctggcatgacgctgtttttgccttggagcaagggtgaccgggacaaccttggcaccactcactacgtacctgcgctgaggcggctgtgcccagtacaggcctatctcgactggatcggtgcagcagggattgctcgagggatggtttttcgtcggctggaccgttggggcaacttgaacgaggctggcttgaatcctggcagtctgatcgtcctactgcggcagatactccagcgtgcggggatccaggctgacctttataccagccactcattgcgtcgaggcttcgccacctgggccacggccaatggctgggacattaaggcgttaatgacctacgtggggtggaaggacatcaaatcggcgatgcgctacatcgaccctgccatctcctttggcggcctcgctgcgaggcctgctctcgaactaaatgccagcactttgactcaagtgccagcttctcactaa

SEQ ID NO: 8229 - DNA, 219 bp, Pseudomonas aeruginosa
gtcattcaaggtcgaataggcgggcagctcgtagttttggcgcagcaactcgtcaatgatcgcattaataatgtcagcgcgctgttcgaggaggggagccatcaactgtgcatgcgtggatgctatgtcttgaccatccgagccgtagaacggtcgaaccccaagtttttcccgaacggcactcatatggcggtaaagctgcatccacttgtagggtga

SEQ ID NO: 8230 - DNA, 213 bp, Pseudomonas aeruginosa
cgtccccccgctgatttgaatcgatcaaatcacagcaaggtcgatgccaacgtttttacacagtctgggccgttcgtgaccagcaacatcatcggcgccacctcgctggaacagctggaaaccaatctcggcagcgtcgacctgaggctggacgaggaattgctcgccggtatcgatgcaatccaccgggagcaaccgaacccggctccctga

SEQ ID NO: 8231 - DNA, 2055 bp, Pseudomonas aeruginosa
gcctccaggggcctggcgctgccgcgggttcggcggacaaccgcgcgatgcggtcgtccgcccctcccggtgaccaggcgcgcctcacagggcccgcgcgatgatctccttcatgatctcgttggtaccggcgtagatccgctgcacccgggcatcggcccaggcccgcgccaccggatattcccacatgaagccgtagccgccgtgcaactgcacgcattcgtcgagcaccttgcattgcaggtccgtcgtccagtacttgcacatggcggcggtgggtacgtccagcttgccctggagatgctgctccatacagcgatcgacgaagacccggccgacctggatctcggtagccatctcggcaagcttgaagcgggtattctggaagtccgccaccgacttgccgaacgccttgcgctcgcgagtgtagtcgagcgtccattgcagggccgcctcggccgacgccagcgcgccgataccgacggtcaggcgctcctgcggcagctcctgcatcaggtagatgaatccctggccgtccttgccgagcaggttctcccggggaatccgcacatcctggaagaacagctcggaggtgtcctgggccttcatcccgaccttctccaggcgcttgcccttgctgaagcccggcgtacccgcctcgaccacgaacaggcttatgcccttggcgccagccttcggatcggtcttcgccaccacgatcaccaggtcggcgaggaagccgttggtgatgaaggtcttcgagccattgatgacgtactcgtcgccatccagtaccgcagtggtcttcaccccttgcaggtcggaaccggcccccggctcggtcatggcgatggccgcgaccatctcgccggataccagcttcggcaggtacttgcgcttcagcgcctcgctgccgtagtggaggatgtagggtgcagcgatgtccgaatgcagggagaaaccgatcccggtcaggccggcccgaccgatctcttcgatgaccacggcgctgtagaggaagtccgcgcccatcccgccatactcttccggcaggtgcgaacagagcattccggcctcgccggccttgttccagagcgcgcggtcgacatgcccatccttttcccattggtgatggaaaggcacggcttcctgttcgaggaacttgcgcacgctgtcgcgaaacagttcgtggtcggagctgaacagggttctcggtatcatcgtggtcacctggaaacagtctgggatcgggttggctgcacgcggcaggtcttcgactgtagggaaatgccccgaccgacgcactggacagttgcgccaaaaaataagacgatccagccgccttttgaccgctttcccttactcacaacaacgataaaaatccatgcgcgctcaatccgctccggtgctgaaacatgtcggcatcgtcgccatcgacggcgtcttcgcctcgaccctgatgcaggccaaggacttcttccacatggccagcctgcgccacggcaagcagcagggcctcggtctccagccggccttccgcacccgcatcctcagccccgacggccagccggtacgcagcttcagcggcgacagcatcgccgtcgacggtcccctcgccgcctgcgatatcgtggtcctgcccgccttctggggcgatttcgacgcgctcgaacggcgctatccgcaaatcgttccctggttgcgccgcagccatgccgagggaaccgccctctgcggcgaggcgaccggggtcttctggctggcccaggcaggtctgctggatggcaaggaagcgaccacctactggcgcttctatcgagaattcgccgaacgcttcccgaacgtgctgctcaaccaggagaagcacctgaccgatgccgacgacctgttctgcgccagcggcgtcacctccgcctgcgacctctacatctatctgatcgagcgtttctgcggcggatcggtggcccaggcggtggcccgggataccctctacgaagtacagcgcagctacaccccagggcgtatcggcttcggcggacagaagctgcaccatga

SEQ ID NO: 8232 - DNA, 1050 bp, Pseudomonas aeruginosa
ccaggtcggccttcgcgggttctcatgaatccgcaggcccgccgcagacgcgggcgttccgaacaacgacaagaacggacctttgccatgcgcctttatctgctcgccttcctggccctcttcggtatgaatgctatggccgccgacaactggaaagccttcccctacgaccagagcgcctatgactatccaggcgacaagttgaaggaagcctggccgcgcctgacccgcggcttcggcgactatccctatccggacgccgactgggtggtgaacatggcgaccgcccatccggatgccctggaaaagaccgtgaaggccggcaccggcttcaccggcaagccggaagaggccacgcaatatgcggcacgactgcaggatgtctggcgcctgctgttccgcggcgactacgccaaggccaaggagcagggactggccctgggagtcggcggccaggtaccggcgatgttcgcccaggtgctctacgccatgttcctggctcccgaccaggcggagaaacagcgcctgctcgaagaggtcatcgactacaccgaacaggccggcccgctggtcaaggccgatatcgtcgcccagttcggcagcgtctacgccaaggcgcgcctggccgaggagctatcggtaccggtagtgctcaagcgcggctataccagcgaaatacccaaggaactggacgctctcctggccaggcaacccaaccagccgttcgccctggcgctctacggcggctacgaggcgggagtgatccgcaaggtcggcaagctggtcggcaagatgacctacggggtcagcgccgacaagatggagcagtacttcgcccgctccttccgccaggccaacgacctgccgatcggccactacgagtacgccaacgcgctcacctacgtatacggcgacgacgagcgggagaaggccatcgcccaactgaagcaggccgtggcgatcaagccgatcaacgccatggaagccctcgaagtggcccatgcgaagaagctcctcgccggcttcgagcagcacaccgcgcagcgctga

SEQ ID NO: 8233 - DNA, 558 bp, Pseudomonas aeruginosa
tcggtagcaatgcaacgaaaacggggccgtcactttagcgacgaccccgtctcttggcaatcggccatccgtcgaggatgtaccggggctgcctactcctgcggtgccagcgcttcgcgggtgcgctcgatggcggcgtcacgggcggcggcgtcggcgaaggccgggatatgcgccaccgcctcgccatccagccacaggccaaaggcattgccctcggcccgcaggtcggcagtctcgccagccagcaggcgcttgctcaccgcaccggcggccttgccatcggcgaaggcgcgggacagcagtagctgttcgccggcggcgtccagcaggcggaagcggaagctgccgtcgtcgtcgcggaagctgaccaggcgcgcagccttggcggccttcttcttgccgctctcggcacttttcagcggctcgcgcagggagcgcaggccgactgcctcgcgcaactcggcgatgaatggggtggcgatgcggcgcgccttggcggcgccggcgaggagaatgtcctcgatatcgtcgggcttggcgatcagcgcctggtaa

SEQ ID NO: 8234 - DNA, 531 bp, Pseudomonas aeruginosa
ctggtagcgcgcttgatatcgtacttcttgcccggaagcatcggctcctcggccatccacaccagcatggcatcgaagccgtcggtgaccagcgggcgattgtcggcatgcaccagcatgtcgccgcgggaaacgtcgatctcgtcttccagggtcagggtgacggcctggccgggaccggcctgctccagttcgccctcgaaggtgacgatggatttcaccttgctgcccttgcccgacggcaatgccaccacttcgtcgcccttgcgcaccacgccgctggccagggtgccggcgaaaccgcggaagttcaggttcggccggttcacgtactgcaccgggaagcgcatgtcatcgaggttgcggtcggcggcgatctcgacggtttcgaggatttccatcagcgactggccggcgtaccagggcgaacgctcggacttgttgaccacgttgtcgcccttgagcgccgacatcggcacgaagtgcagcgaactggtcttcagaccgatcttctcggcaaaggccaggtag

SEQ ID NO: 8235 - DNA, 888 bp, Pseudomonas aeruginosa
tcacccgctacaaccacagcacccactacgcgatggccgtctgggaactgggcaaggaagtcgaccgggtgcgtcaccgctccgtcgtcaggcaggattaggacagtcgatgaacaagtgctcgatggcgaagcgcttgcccaggtagtcgcccaacgcctgtaccccgtagcgctcggtggcatggtgtccggcggcgatgaagctgatgccgttctcccgcgcgctgtgcacggtctgctcggaaacctcgccggtcaggtaggcatcgacgccagcggcgatcgcctggtcgatatagccctgggcgccgccggtgcaccaggcgatgcgccggatcggctgaccggcatcgaccagcagcggctcacgccccagcgcatcgcgcacatgccgagcgaaatcggcaggctgcatcggctcggcaagcgaaccgaggaggacgatggaacgcgggttgcccggctccaacggcccttccacttcgaagccgagctgccgggcgagctgcacgttgttgcccacctccggatgcagatccagcggcaggtggtaagcgagcagactgatatcgttgttcagcagggtcttcaggcgccgttgcttcatgccgaccacgcaggggttctcacccttccagaagtaaccgtgatgcaccagcaccacgtcggcgtcggcctccacggcggcatccagcagcgcctggctggcagtgaccccgctgacgatccgccgcacctgcggccggccttcgacctgcaggccgttcgggcagtagtcctggatgcgcgcggcatccagataacggtcggcctcttcgaccagggtgctcagggcgatagccatgcaaattcctcttcattcaggcagggcgcgccgctcctctaa

SEQ ID NO: 8236 - DNA, 1506 bp, Pseudomonas aeruginosa
tcagcttgcggctcttgtccgggttctccgacggtacgatgcccgccgctgcgagcagcggcagggtatcgtcgagaatccggcccttggacaaggcgatggtcagcatttgcgcgacagcctccgctagcccggtacgcggcggatcttggcgccgagcagctggagtttctcttcgatgcactcgtagccacggtcgatgtggtagatgcgatcgatcagggtgtcgccctcggccaccaggccggcgatcaccaggctcgcggatgcgcgcaggtcggtcgccatgaccggagcgcccttgagcttgggtacgccggtgacgatggcggtgttgccttcgacgaggatctgcgcacccatgcggttcatttcgtaaacatgcatgaagcggttctcgaagaccgtctcgatgaccgcgccggtgccttcggcaaccgcgttcatggagatgaactgggcctgcatgtcggtggggaacgccgggtacggcgcggtacgcacgttgaccgccttcggccggttgcccttcatgtccagctcgatccagttgctgccggtgctgatgtgggcaccggcctcttccagcttctgcaggaccgcctcgaggatggtcggatcggtatccttcaacttcacccggccgccggtcgcggccgcggccaccaggtaggtgccggtctcgatacggtcgggcagtacgtcgtagcgagcgccgccgaggcgcttcacgccttcgatgacgatggtatcggagccagcgccttggacgttggcgcccatggcgttcaggcagttggccaggtcgaccacctccggctcgcgagcggcgttctgcagcacggtgcggccgttggccagcgcggcggccatcatcaggttctcggtgccggtcacgctgacggtatcgaagaagaagtgaccgccacgcaggccgccggcgggcgccttggccttgatgtagccgccttcgacctcgatctgcgcgcccatggcctcgagaccgcggatatgcaggtcgaccggacgcgaaccgatcgcgcaaccgcccggcagggccacttcggcctcgccgaagcgcgccagcatcgggcccagcaccaggatcgaggcacgcatggtcttcaccagttcatacggcgcgaccagggtcttgatgctgctggcatcgacttcgacgttgagcttctcgtcgatgatcggctgcacgcccatgcggccgaacagttcgatcatggtggtaatgtcgtgcaggtgcggcaggttgcagacggtgaccggagtatcggccagcagggtcgcggccaggatcggcagcgccgagttcttcgcgccggaaatgcggatttcgccatcgaggcggttaccgccggtaataatcagtttatccattgcaatgatcccccgtgggctcaggaacgctcggcccaggcggcgcggctgaagaatttcatggtgacggcatggatgctgccatcggcgatccaggcgttcaaatgggcgtag

SEQ ID NO: 8237 - DNA, 414 bp, Pseudomonas aeruginosa
accgcgatccaggtcaccacgaaggcgaatacgatacttttgatcacgccgttgagcacatcctcggtgaactgcacgctgttctgcatgttcgcccagaacgacccctcgtatacgcccagccagtcgaccgcgaccatcgccccgccccagatgccgaccacgctgaagatcgcggcgagcagcggcatggagatgaaaccggcccacaggcgcggcgcgacgatgtacttgagcgggtcgacaccgatcatttccaggctggaaagctgttcggtggccttcatgttgccgatttccgcggtaagcgcagagccggcacggccggcgaacagcaggccggtcaccaccggccccagttcgcgcagcagggtcagggccaccatctgcccgaccgcctgctcggaaccatag

SEQ ID NO: 8238 - DNA, 1116 bp, Pseudomonas aeruginosa
cggcggcgtaacagagcattgcagtccatacaacattgcgccgcgggggatgcggaccgacttcacagcatggctggtgtaagcgggacacgctttcccgttataatcccgcctttaatccaggcgccacattcgttgaacatgagccagaacctcgatttcatccattccgcccagcgcaccatcggcctcgagcgcgacgcggtagacagcctgctggcgcggattggcgacgatttcgtcaaggcctgcgaactgctgctggccggcaagggccgggtcgtcgtcgtcggcatgggcaagtccggtcacatcggcaagaagatcgccgctaccctggccagcaccggcaccccctccttcttcgtgcatccggccgaggccagccacggcgacatgggcatgatcaccaaggacgacgtggtcctcgccctgtccaactccggctcgactgccgaaatcgtcaccctgttgcctctgatcaagcgcctgggcatcaccctgatcagcatgaccggtaaccccgagtcgcccctggccaaggctgcggaagtgaacctggacgccagtgtcggccaggaagcctgtccactgaacctggccccgacctcctccaccaccgtaaccctggtcctcggcgacgccctggcgatcgccctgctcgaagcccgcggctttaccgcggaagacttcgccttctcgcacccgggcggtgcgctgggccgccgactgctgctgaaggtggaagacgtcatgcacgtgggcgaagggctgccgcaggtgctgctcggcacctcgctgaccggcgcgctgatggaaatgacccgcaagggcctgggcatgaccgtagtgctcgacgaacatggcaagcttgccggcattttcaccgatggcgacctgcgtcgcgccctggatcggggcatcgacgtccgccaggtcaccatcgaccaggtgatgaccgtccacggcaagaccgtccgcgccgaaattctcgccgcggaagccctgaagatcatggaagacaacaagatcggcgcactggtggtggtcgacgcggacgaccgtccggtcggcgccctgaacatgcacgacctgttgcgcgcaggagtgatgtaa

SEQ ID NO: 8239 - DNA, 531 bp, Pseudomonas aeruginosa
cgggcagatcgtcggcctgctcggtccgaacggtgccggcaagaccacctgcttctacatgatcgtcggcctggtccaggccgaccagggcgtggtccgcatcgacgagcagaacgtcacccacctaccgatgcacgggcgcgcccgggccggcatcggctacctgccgcaggaagcctcgatcttccgcaagctgtcggtatccgacaacatcatggcgatcctcgagacccgcagcgacctcgatcgcaacggtcgcaaggaagccctggaaagcctgctgcaggaattccacatccaccacatccgcgacaacctcggcatgagcctgtccggcggcgaacgacgccgggtggaaatcgcccgcgccctggccagcgcgccgaaattcatcctcctcgacgagcccttcgccggcgtggacccgatctcggtcggcgacatcaagcagatcatccatcacctcaaggcgaagggtatcggcatcctcatcaccgaccacaacgtccgcgagaccctggacatctgtga

SEQ ID NO: 8240 - DNA, 1383 bp, Pseudomonas aeruginosa
catcaacaacgatggctacctcgaagagtccctcgaagaaatcctcgccgccatcgatccggaactggacgtcgagctcgacgaagtggaagtcgtgctgcgccgcatccagcaactggaacccgccggcatcggcgcccgcaacctgcgcgagtgcctgctgctgcaactgcgccagttgccgtccaccacgccctggctgaacgaagcgctgcgcctggtatccgactacctcgacctgctcggcggccgcgactacagccaattgatgcggcgcatgaagctcaaggaagacgaactgcgccaggtcatcgagctgatccagtgcctgcatccccggcccggttcgcagatcgaatcgagcgaagccgaatacatcgtccccgacgtcatcgtgcgcaaggacaacgagcgctggctggtcgagctgaaccaggaggcgatgccacgcctgcgcgtcaacgccacctacgccggcatggtccgccgcgccgacagcagcgccgacaataccttcatgcgcaaccagttgcaggaagcccgctggttcatcaagagcctgcagagccgcaacgaaacgctgatgaaggtcgccacccagatcgtcgagcaccagcgcggtttcctcgactacggcgaagaagccatgaagccgctggtcctgcacgacatcgccgaagcggtgggcatgcacgaatcgaccatttcgcgggtcaccacgcagaaatacatgcatacgccgcgcggcattttcgagctgaaatatttcttttcaagtcacgtcagtaccgccgaaggcggggaatgctcgtccaccgcgatccgcgcgatcatcaagaaactggtggccgcggaaaatgcgaaaaagccattgagcgacagcaagatcgctggtttactggaggcacagggcattcaagtggctcgccgcaccgtcgccaaataccgcgaatccctgggcatagccccttcgagcgagcgcaagcgactggtgtgacgttgatccacgccaaggtgttccggaggcaggttgctaacctgccacttacacacgggcaacaaggagaacgcggtatgcaagtcaacatcagtggccatcaactggatgtgaccgacgccctgcgcgactatgtcggcgagaaactgagccgtctggagcgccatttcgacaagatcaccaatgttcaggtgatcatggaggtcgagaaactgaagcagaagatcgaagccaccctgcgcatcgccggtggcgagatcgtagccaatgcggaacatgaggacatgtacgcggccatcgacctgctgatcgacaaactcgaccgtcaactgatcaaacacaaagagaagtatctcgaacggcagcaaggcgtaggcgcccgctga

SEQ ID NO: 8241 - DNA, 246 bp, Pseudomonas aeruginosa
agtcgccctccaggccgtggccgaccgcttcgtggagcaggaccccggaccaacccgcgcccatcaccaccggcagggtgccggccggcgcgggaatcgcctcgaggttcaccagtgcctggcgcagggcctcgcgggcgtagcccatggcgcgatccccctggaggaaatagcgatagtcggtgcgaccgccgccgccgtggccgccgcgttcgcgtcggccgttctgttcgacgatcacgctga

SEQ ID NO: 8242 - DNA, 360 bp, Pseudomonas aeruginosa
agctgtcgatgcgcaggtcggcgccgcgcagcaggcccgcagcgctactggcggcctggtcgccgctgccgtagcgcttcagggtggcctgccaggcgtcccagtccagttccgccagacgcccgcgcacccgcagcccctgtgccgagggcagcaacgccgggtcaccgcccaggcgcagggcgccgcgtccgttcagcggcttgtccgccggggccgcataggccaagctggcgaggccgtcgtaacgcgcccagtaacgccgttcggcgccatccagggtcatccgccattgggtcggccgcgcctgggcggccgtcttgccgaacggcgccggcaggtcgacgacggcgcccttga

SEQ ID NO: 8243 - DNA, 999 bp, Pseudomonas aeruginosa
cgtacagcgccagcagcaccagtaccagggcgcacaaacccaggacgatccgtagcagtcgcgttccgaggcttcccacatccgccatttcagccatacgcctcagagcaggaccacgtcatattgctcctgcgagtacatcgcctcgacctggaacttgatggtgcggccgatgaacgcctcgagatcggcgacgttacccgactcctcgtcgagcagccggtccaccaccttctggttggccagcaccaggtaggagtcggcctggtaggcacgcgcctcgcggagaatctcgcggaaaatctcgtagcaggtggtttccgcagtcttcagcatgccgcgtccctggcagcaggggcacggctcgcagaggatctgtaccaggctttcgcgggtgcgtttgcgggtcatctgcaccaggcccaactcggtgatgccgatgatgttggtcttcgcgtggtcgcgctccagttgcttctccagggtgcgcaggacctgccggcgatgctcctcgtcctccatgtcgatgaagtcgatgatgatgatcccgcccaggttgcgcaggcgcagttggcgggcgatcgcggtggccgcctcgaggttggtcttgaagatggtttcctcgaggttgcgatggccgacgaaggcgccggtgttcacgtcgatggtggtcatcgcctcggtcggatcgacgatcaggtagccgccggacttcagcagtaccttgcgctccagggctttctggatttcgtcctcgacgccgtagagatcgaagatcggtcgctcgcccgggtagtgttcgaggcgatcggaaatctccggcatcaattcttcgacgaaggaagtgatcttctggaagttctctcgcgagtcgatgcggatcttctcgatccgcgggttcaccaggtcgcgcagggtacggatcgccagggacaggtcttcgtagatcaccgaaggcgcgccgacggtctggatctgcgcggcgatctggtcccatag

SEQ ID NO: 8244 - DNA, 591 bp, Pseudomonas aeruginosa
  unsure (205): Identity of nucleotide at the above locations are unknown.
ccggcgaaggtagcggatgtcggcgagaatctcgtcctcgcccgcaccttccgcagcggtgcgcagaatgaagccgccctgcccctcgatgccttccgccgccacgcagtcggccaccaccttcttcaggcgctcgcgctcgacttcgtcctcgatccgcagggatatcccgacatgactggtgcgcggcatgtacaccacatancgcgaaggaatcgacaggtgggtggtcagccgtgcgcccttggtgccgatcggatccttggtcacctgcaccaccagcgcctgcccctcatggaccagggcactgatgctttccacggcgctgccttcgcgattggatatctcggcggcatggatgaacgccgcacgttccaggccgatgtcgacgaacgccgcctgcatccccggcagtacccgtaccacccgccccttgtagatattgccgacgatgccgcgccgctgggtgcgttcgacatgcacttcctgcaggacgccgttttccaccaccgccacgcgcgactccatcggcgtgatattgatcaggatctcttcgctcatgcgtccactgtccttatttcggcgcgttag

SEQ ID NO: 8245 - DNA, 927 bp, Pseudomonas aeruginosa
cgctcctggccaacgagaactccgccggcggcagcaacgccgaggccaccggctggtaccccgccatcggtggcgcgacccaggccaacggcggtagcggcggcatcgacctgtaccgcgaaaccttccgcgcgcgcctggagaaactcgcgctcggcagccagcccggcgtcacggcggggcgagtcgaggccacggcgcaggtggttatccgtgtccagtaggcgcgcgctcgcgctgctggccatgctttgcctcgcgccgacgagcgaggccggagtgaccgcggagcgcacccgcctggtgttcgtggagggccagcgcgaggcctcgttgctgctggtcaaccagaatccctacccggtgctggtgcaggcgtgggtcgatgacggtgccctcgacggcgaaccggataccgcgctggctccgttcctgccgctgccgcccgtattccgcctggagccgggacgccagcgcagcctgcgcctgctggctaccggccaggcccaggcacgggatcgcgaatcgctgtactggctgaacatctacgagatccccccgcaagccaccgccgaggccgctggccggccccggctcacggtcaccctgcgaacccagatgaaggtgctgtaccgcccgcacggcctgcatccgcacgccgaggacgcggccgccgaactgggcttcgcgctgcgcgacgagaccctgcgggtggacaacccgacgccgtacttcgtgtccctggcggggctggcgctggagataggggagacgcgcctggatctgcccggaacgctgctggctccgcgctcgcaacgacgcctcggcttgccgcggcgggtggacggcgggacgcgcggcgaggtggcgttcgactggatcgacgacaacggcgtcagccgccaggaaaggaaagctctacagtga

SEQ ID NO: 8246 - DNA, 234 bp, Pseudomonas aeruginosa
acagttccccacaggctcgccagcacgagcacccaccggccgttgccgcctccctggccggcgacctgcgcctcgcccggcgtttccatgccgccctggcgcgcggtcgggtgcgcctggactggcaggccgtacggcatgccgggcatccggaatgggagccgctctaccgggaaaccctgctcagggtcacggccgccagcggcgagccgccgttgccgacccaggaactga

SEQ ID NO: 8247 - DNA, 654 bp, Pseudomonas aeruginosa
acggtcggccggcggcgccgtcacagcagcgacgatgccgaggtgcgttgtgccgaagtcccggcattttttccctgtcacgccaacggagtcgaccatgaacagagcaatcagccttcccctcaagggagccgcctggctcctgctggtcctggccctgcctttcgccaacgcccaggacatgaacaagaccgcgccacagaccttcgtcagcgaggcctcggcggccggcgtagcggaaatcgaagccggcaagatggcgctggaaaagagcaccgccgccgatgtgaaggtattcgccaagcagatgatcgacgaccacggcaaggtcaacgccgaactgcgcagcctggccgagcgcaagaaactggaggtcgaagacgacgccagcctgaccgacaaggccaaggcgaccctgctcgacctgcgcgacgcctccttcgacccggcctacgccaacaaccaggtggcggcccacgagaaagccgtggaactgttcacccaggccgcggacaacctgaccgacccggaactgcaggccttcgccaagacccacctgccggccctgaagcaccacctggaaatggcccgcgcgctggccaaggcgcacccatccaagtaacgcccccgcgggcggagcctggccaggcatga

SEQ ID NO: 8248 - DNA, 345 bp, Pseudomonas aeruginosa
ccctgctcggtgccatgctcctaccagcactgggactggcgcgcgctgccgctggcgctgctgctgttctgcgtgtgtcggccggcgatggtctggctgctggtcggccggcggctgatgcacccggcgcagcggcgcctgctcggctggttcggcatccgcggcatcggcggcctgtactacctcagctacgcgctgaaccaggggctgcctacggcgctcgcgcataccgccagcgacctggtgctgaacctcgtcgccctgagcatctgcttgcacggtctgagcatccagccgctgctgatgcgccacgcgcgcagcgtcagtcgccgcgatcgggaatga

SEQ ID NO: 8249 - DNA, 2949 bp, Pseudomonas aeruginosa
caatccgacagggagaaccatggtgaacggagaaaacaagatcgtcctggtcctcgaagaacacgccgaccagctctggcggatcgaggaattcctcctcgatcgaggctacgcggtgctcagcgcggcgagtcgcgacgaagccctcgaccacctggcctcggacgcggtgatcgacctgttcctgctcagcgagcagctcgaaggtcctctgagcggcagcatgctcatcgaaaccagcctgccggtgcgcccgcggatgcgggtgatcctgctcagcgacagcgctcgcgtcggcatcgacccggcggcaccctatccggtgctgctcaaaccggtgaccctggaggaactggggaaagccatcgacatggtcctgcacagcgcgccggtctgccccggcgtctgagcaccgaggagcccaccatgcccagcagcaagccgctcgccgagtacgcccgcaagcgcgatttccgccagaccccggagcccagtggccgcaagcctcgcaaggacagcaccgggctgctccgctattgcgtccagaagcacgacgccagccgcctgcactacgacttccgcctggagctggatggcaccctgaagagctgggcggtgcccaaggggccgtgcctcgacccggcggtgaagcggctcgcggtgcaggttgaggaccatccgctggactatgccgatttcgaaggcagcatcccccaggggcactacggcgccggcgatgtcatcgtctgggaccgaggcgcctggacgcctctggacgatccgcgcgagggcctggaaaagggccatctcagcttcgccctggatggcgagaaactctccgggcgttggcacctgatccgcaccaacctgcgcggcaagcagccccagtggttcctggtcaaggccaaggacggcgaggcgcgcagcctggatcgcttcgacgtgctgaaggagcgtcccgacagcgtgctcagcgagcgtacgctgctgccccgccatggcgaagccgccacgcccgcggccaggccggcgcgactcggcaagagcggggggaagacgccgatgcccgaatggatcgcccccgagctggccagcctggtcgagcagcctccgcgaggggagtgggcctacgaactcaagctggacggctatcggctgatgagccgcatcgaagacggccacgtgcgcctgctgacccgcaacggccatgactggaccgaacgcctgccgcacctggagaaggccttggccgggctcggtctgcagcgcagttggctggacggcgaactggtcgtcctcgacgaggagggtcgaccggacttccaggccctgcagaacgccttcgaggaaggtcgcggcgagaacatcctgtacgtcctcttcgacctgccgtaccacgaaggcgaggatctgcgcgatgtcgccctggaggagcgccgcgcgcgcctggaggcgctgctggaagggcgagacgaagacccgctgcggttctccgcgacgctcgcggaagacccccgcgacctgctggccagcgcctgcaagctcggtcttgaaggcgtgatcggcaagcgtctgggcagcgcctaccgttcgcgccgcagcaacgactggatcaagctgaagtgccagttgcgccaggagttcgtgatcgtcggctataccgagccgaagggctctcgccggcatatcggcgccttgctgctcggcctctacagccctgacgaggagcgccggctgcgctatgccggcaaggtcggcagcggcttcaccgcggccagcctgaagaaggtccgtgagcgcctggaacccctcgcggtccgctccagcccattggcgaaggtgccgccggcgcgcgagaccgggtcggtgcagtgggtgcgcccgcaacagctgtgcgaggtttcctatgcgcagatgacccgtggcgggatcatccgccaggcagtgttccacggcttgcgcgaagacaagccggcgcgcgaggtgaccggcgagcgtcccgccggcccgccgccgctgcgcggcgcgcgcaaggccggcgccggtgcgtcgcgggcggccaccgccggcgtgcgcatcagccatccgcagcggctgatcgacccgtcgatccaggccagcaagctggaactcgccgagtaccatgcgcgctacgccgacctgctcctgcgcgacctgcgcgagcgcccggtgtcgctggtgcgcggccccgacggaatcggcggcgaactgttcttccagaagcacgcggcgcgcctgaagatccccggcatcgtccagctcgacccggcgctcgatcccggtcatccgccgctgttgcaaatccgcagcgccgaggcgctggtcggcgcggtgcagatgggcagcatcgaattccatacttggaacgccagcctggccaacctggagcggcccgaccgtttcgtcctcgacctcgacccggacccggcgctgccgtggaagcgcatgctcgaagcgacccagctgagcctgacgttgctcgacgagctgggcctgcgcgccttcctcaagaccagcggcggcaagggcatgcacctgctggtgccgctggagcgccggcatggctgggacgaggtcaaggatttcgcccaggccatctcccagcacttggcgcgcctgatgccggagcgtttctcggcggtttccgggccgcgcaaccgggtcggcaagatcttcgtcgactacctgcgcaacagccgcggcgccagcaccgtggccgcctactcggtgcgcgcccgcgaagggttgccggtgtcggtaccggtgttccgcgaggaactcgactcgctgcagggcgccaaccaatggaacctgcgcagtctgccgcagcgcctcgacgaactcgccggcgacgatccctgggccgactacgccggcacccgccagcgcatcagcgcggccatgcggcgccagctcgggcgcggctga

SEQ ID NO: 8250 - DNA, 291 bp, Pseudomonas aeruginosa
ccgtccgcgaaaaaggcggaactcccccggcgcacagggcctccaccgtgcaacgagatgccgaggaggcccccgatggataccgcctacctgatcctcgcgctgctggtcctgttgctcctggtggatgcctgggccatcaacagcgtgctccgcagcgacagctccgccagtcgcaagctcggctggtcactgctgatcctgctcctgcccgtgctcggcctggtcctctggggctggaccggcccccgtggcttgcgcccggtgacctcgccggaacacagcaagtga

SEQ ID NO: 8251 - DNA, 1023 bp, Pseudomonas aeruginosa
ccagcgtggaggtcgccgaggccatggccagggcggccctgcaacgcagtccggcgagcgccgcgctggcggtcacggggttgctcggcagtgaagcgaaggacggcatcccgcccggtaccgtgtgcttcgcctgggccttccggttgcccgccggcctcgccctgttctcgcgccgcgagcgcttccacggcgaccccgcgcggatgcgccgggaagccacccgctgggcgctgcggcgcctgcccgaattccatcaacgcgccttgcgcggcgaacgcgcctgaggcgtccgacagagaggaaaccaccatgagcgaacagcgacagaccctgccggcgcagcaccaggatcaacgtcccggccacgaaagcgagatgcagccgaagccggagttcgtttccgccgattaccgtccggcggccaagctggagggtaaggtggccctggtcaccggcggcgacagtggtatcggccgcgcggtggcggtggctttcgcccgcgaaaaggcggatgtgctgctggtctacctggatgagaacgaagacgcggcgaagacccgcgagatcatcgagtcgctcggccgccagtgcctggcgttcgccggcgacgtcgccgacgccggcttctgccgccaggtggtggacacgctaaggcagaaatgggggcgcctcgacgtgctggtcaacaacgccggcgagcagcatccgcaggcgcgcctggaggacatcagcgaagagcagtgggagaagaccttccgcaccaacatcttcggcatgttccagttgaccaaggcggccctgccgctgatgggcaagggcggggcgatcatcaacaccacctcgatcaccgcctacttcagcgccgagaaggtcgcccacttcggcgcggatacgccgatgggccggcccggccagccggaagagctggccgccagctacgtctacctggcctgtaacgactcgtcctacgtcagcggccaggtgctgcacgtcaacggcggtacggtggtcaacggctga

SEQ ID NO: 8252 - DNA, 429 bp, Pseudomonas aeruginosa
gtagccggaacggctggccgcgacgcagacaaggagcacggcgatgaaacgcgactgggggttgatcagggatctgctggagcatctggaaagccttggcttcggccagcactgggaagcgcgcgagctgcccggtcattgccgcgaggcggtggcctaccacttgcagttgctcaaccaggcgcaactgctctgcggcagcgtccagcattcctggaccggccaggagcactgggtggtccaccacctgaccctggccggccacgacctgctcgaccgcctgcgccaggaaagcgcggcggccgccgtgccggtacgcaagagcgcctgagaaaaccccgcaagcaccggcctgcagcggcgggccggaaggaagcccggcgatgcccgacagccaagaccagaccccgagcacggtccagaccctga

SEQ ID NO: 8253 - DNA, 522 bp, Pseudomonas aeruginosa
ccgacggctggcagcaggagcagaccgagacctggctggatttcggcaatccctgggagttcgaacgacccgaggtcagctactacatcgacttcggcggcagcgtgcaggtcgacagcgagcacagtggccgagccatctggcggccggacgagcggatccgggcgatcgcctacgacacgccgatcgtcggctggcggcgtgccagcgtcaataccctgcgcctgtggcgcgcccgcgccgaggaagacctgcaactggaccgtttcaacgccggcgaccatatcggcgcggtggtcgacgtggtcaaggcggagagcatctcgcgggtgctgtatccggccgacagcaccgaggccggtcaggaactgcgcctgcgccaggagtacttcttcgtctcagcctcgctgcaggacctgctcgaccgccacctgcgccatcatcacgacctgcgtagcctgccggaacaggtggcgatccagctcaacgacacccacccggcgatcgccgtcgccgagctga

SEQ ID NO: 8254 - DNA, 594 bp, Pseudomonas aeruginosa
gcggttgcgactggtgccggcaaccggcgttgcgactgggtgaggaaaccttcgactgcgagcgctgcctgcgttgcggtgccctgcgctacagcgagatacaacgccgatgagcgcctgggagacgttgtggaagatcctcggcgaggagttcgccgatctcgccgacttcgagcagaccgcccgcgccgcgttgcgcctgctgctggcggcggcgctcggcgcggtactcggctacgagcgcgagcagagcggcaaggccgccggcctgcgcacgcacatgctggtaaccctcggcgcggcgctgttcgtcatgccgctgcaattgcagagtggcggggcggacgcgctgagccgggtgatccagggcaccgtcgccggcatcggcttcctctgcgccggcaccatcctcaaggcaggtcgggaaagccgggtcaggggcctgaccaccgcggcgggtctctgggccagcaccgccataggcgtcgcggtcggactcggtcaccagggtaccgcggtgctcgggacggtcctggcgctactggtgctgcatgtcctggcctgcctgaaccgttcgccgccatcttccgatag

SEQ ID NO: 8255 - DNA, 999 bp, Pseudomonas aeruginosa
gcgacgccgagaccgccgccgacaacctgctccagcgcatcaccgacatcgccgccgacggccgcgtgcgttacgcggacggcggcacgctgtaaccatcaagaggaggaaaccggcatggcgcgtgcgatctggaaaggcgcgatcagcttcggcctggtgcatataccggtgagcctgtcggcggcgacctcgtcgcagggcatcgatttcgactggctcgaccagcgcagcatggagccggtcggctacaaacgggtgaacaaggtcaccggcaaggagatcgagcgcgagaacatcgtcaagggcgtggagtacgaaaagggccgctacgtggtgctgagcgaggaagaaatccgcgcggcgcatcccaagtcgacccagaccatcgagatcttcgctttcgtcgatagccaggaaattcccctgcagcacttcgataccccgtactacctggcccccgaccggcgcggaggcaaggtctacgcgctgctccgggagaccctggagcgcaccggcaaggtcgccctggccaacgtcgtcctgcacacccgccagcacctggcgctcctgcggcctctgcaggacgccctggtgctgatcaccctgcgctggccgtcgcaggtgcgcagcctggatggcctggagctggacgaaagcgtcaccgaggcgaaactcgacaagcgcgagctggagatggccaagcgcctggtggaggacatggcttcccactgggagccggacgaatacaaggacagcttcagcgacaagatcatgaagctggtcgaggaaaaggccgccaagggccagctgcacgcggtggaggaagaggaggaggtggccggcaagggcgccgacatcatcgatctcaccgaccttctcaagcgcagcctgcgttcccgcgccggcggcggcaaggacaagggcagcgaaaaggccggggccgacgcgaagggtcgcgccaagtccggtgcctcgcgttcgcggcgcaaggcctga

SEQ ID NO: 8256 - DNA, 465 bp, Pseudomonas aeruginosa
tccggcgcctgccgcagatcgccgcgatgggcttcgacgttctctatttcccgccgatccaccccatcggccgcacccatcgcaagggccgcaacaattccttgcgtgccgaggccggcgaccccggcagcccgtatgcgatcggcagcgaggatggcggccacgaggcgatccatcccgaactgggcgaccgcgaggatttccgccggctgctcgttgcggtgcgcgagcacggcatggaactggcgctggacttcgccatccagtgctcccccgaccacccctggctgcgcgagcatcccggctggttcgcctggcgtccggacggtagcttgcgctacgcggagaacccgccgaagaagtacgaggacatcgtcaacgtcgacttctacgccgaacaggccctgccgagcctgtgggaagccttgcgcgacgtggtgctgggctgggtcgagcagggcgtga

SEQ ID NO: 8257 - DNA, 603 bp, Pseudomonas aeruginosa
tggcgcgcctgggcaaggtcggcttcagccagagctacacctatttcacctggcgcaacgacaagcaggaactggcggagtacttcgccgaactcaaccagccaccctggcgcgactgctaccggccgaacttcttcgtcaacaccccggacatcaatccctggttcctgcaacgctccggccgccccggcttcctcatccgtgccgccctggcgaccatggggtcggggctgtggggcatgtactccggcttcgagctgtgcgaggcggcggccttgccgggcaaggaggagtacctcgactcggagaaataccagttgcgtccgcgcgactaccaggcgccgggcaacatcgtcgccgagatcgcccggctcaaccgcatccgccgggaaaacccggcattgcagacgcacctcgggttccaggcctacaacgcctggaacgaccgcatcctgtatttcggcaagcgcaccgcggacctcgccaacttcgtcctggtggcggtctgcctggacccgcacgaagcccaggaggcgcatttcgaactgccgctgtgggagttcggcctgcccgacgacgccagcctccagggcgaggacctga

SEQ ID NO: 8258 - DNA, 3414 bp, Pseudomonas aeruginosa
acgggcatcgctgggtctggcacggcaaggtccagtggatgcgcatcgaaccctggcacctgccgttcggcatctggcgcgtgcggcgcgtcgacgcataaggagaaacccatggccagacgcgagaaaccggtctttctcaacgacccgcaatggtacaaggacgcggtgatctaccaggtccacgtgaaatccttctacgacgccaacaacgatggtatcggcgacttcgccgggctgatcgagaagctcgactacatcgccgacctcggcgtgaacactctctggctgctgccgttctacccgtcgccacgccgcgacgacggctacgacatcgcccagtaccgtggcgtgcacagcgactacggcagcctcgccgacgcccgccggttcatcgccgaggcccatcgacgcggtctgcgggtgattaccgagctggtgatcaaccacacctccgaccagcatccctggttcatccgcgcccgccacgcgaagaagggatcgcgcgcccgcgactactacgtctggtcggacagcgacgagaaataccagggtacgcggatcatcttcatcgacaccgagcagtccaactggacctgggacccggtagcccaacagtactactggcaccgcttctattcccaccagccggacctgaacttcgacaacccgcaggtcctgcgcgaggtgctcggggtgatgcgctactggctggacatgggcgtcgacggcctgcgcctggacgcgattccctacctgatcgaacgcgacggcaccagcagcgagaacctgccggagacccaccaggtgctcaagcgcatccgcgccgagctggacgcgcactatcccgaccgcatgctgctggccgaggccaaccagtggccggaagacacccggccgtacttcggcggcgaggatggcggcgagggcgacgaatgccacatggccttccacttcccgctgatgccgcgcatgtacatggccatcgcccaggaggatcgctatccgatcaccgacatcctgcgccagaccccggacatcccggccaattgccaatgggcgatcttcctgcgcaaccacgacgagctgaccctggagatggtcaccgacgacgagcgcgactatctctggaaccactatgccgccgaccgccgcgcgcgcctcaacctgggcatccgccggcgcctggcgccgctggtggagcgtgaccggcggcgcatcgagctgctgcacagcctgctgttgtcgatgccgggcacgccgaccctgtactacggcgacgagatcggcatgggcgacaacatctacctcggcgaccgcgacggcgtgcggaccccgatgcagtggtcggtggaccgcaacggcggcttctcccgcgccgacccggcgaagctggtgctgccgccgatcctcgacccgctgtacggctaccagacgatcaacgtcgaggcgcaggcgcgcgacccgcattcgctgctcaactggatgcgccgcctgctcgccgtgcgcagccagcagaaggccttcggccgcggcagcctgaagatgctcgcgccgagcaaccgacggatcctcgcctacctgcgcgaatacgccgagggcgaacggcaggacagcatcctctgcgtggccaacctgtcgcgcgcggcccaggcggtggaactggacctcgccagccatgccggcaaggtgccggtggagatgatcggcggcatgtcgttcccgccgatcggcgagctgacctacctgctgaccctgccgccctacggcttctactggttctacctggccgacgcgacgcagatgccgagctggcacgtggccgccgacgagcgcctgccggaactgccgaccctggtggtcaagcagcgcctcggcgagctgctgcagggcgcatcgcggaacatcctggaaggcgagacgctgccggcctacctgccgaagcgccgctggttcgccggcgagaaaggccagccacggctctgctacatcgttccgctggacgaggcggagccgcgctgtgcgctgtgcgaagtggagatcgacgggctgcgctaccagttgccgctgggcttcctcgacgccgaccagcgcggcgacagcctgcctcagttgctggccctggcgcgcctgcggcgcggtcgcaaggtcggcctgctgaccgacgccgccagcctgccgctgttcgcccgcaaggtcctcgcgcaactccgcgccgaggcggtgatcgcccacggcgacggcgagatccagttcatcccggcggcgggactggcggaaatggacgacatcgccgacgaagacgtcctgccgttctcggtggagcagtccaacagctcgatccgcttcggcgagcgcatggtcctcaaggtgctgcgcaagatccttccggggctgcacccggaaatcgaggtcggcggctacctgacccgccacggttaccccggcatcgccccgttgctcggcgaggtacggcgggtcggcgcggatggcgagccgcacacgctgatgatcctgcagggctacctgaacaaccagggcgacgcctggaactggaccctggacaacctggagcgagccgtgcgcgacgagatatccgcggccagcgaggcgctcgaagggcaatacgacagcctcgccgaactgcgcggcttcgccgccaacctcggcgcccggctcggcgagatgcacagcgtactggccggcgagtcggacgatccggccttcggcagccgcgagagcgacgaagccagcgtccaggcctgggcgctgcgtatcgccgaacagttgcgcgaagccggcaaacgcctgagcgagccgccacgaccgttgcagggcgaggcggcggaacgggcgcggcgcctgctggaacgcctgccggcgctgctcgaacgcctgccgctgctggcccggcaggcagccggcgggctgctgatcagggttcacggcgacctgcacttgggccaggtgctgatggtccagggcgacgcacgcttcatcgacttcgagggcgagccgacgcgcagcctggaagagcgccgccagcgccacagtccgatgaaggacgtcggcggcatgctgcgctcgttcgactacgcggcggcgatggtcctgcgcaacgcgcagagcaccgatagctcggaacaggccgacagcgcccggcgcaaggtcgccatgcgctatcgcagcgaagcccgcgatgccttcctggccggctatcgggccgccgcgggggggctcatgcacgcctggcacggtcgcgaaggcgagggggcggcgctggccctggcctgcctggaaaaggccgcctacgaactgctctacgaagccgactaccgccccgactggctggaagtgcctctcgccggtctggccgaactcaccgaacacctcctgaagggcaagaaccgatga

SEQ ID NO: 8259 - DNA, 1362 bp, Pseudomonas aeruginosa
gaggaaatacagcacccggtagccgatcaacgcggccagcagcacgccctgggacaggcgcccctggagcagggcgatgaacaccgcttcgagcaccccgagcccggccgggatatgggtgatgaccccggcgatgctgctgatcaggaggatcgccaggacgctcgggtaatccacgctgtgcggcagcaggctgtacagcaggagcgccatcagcgaccagttgctcgctccgagcaggccttgcagggccgccagccgccaggacggcagggtcagccgatgctcgcgccagccccaggcgcggcgtcgggcgaaacggcaggccagcaggtagcctgcggccagcgccaggagcagggcgccgatcaggcgcaggccgtcgctgccgagcttccagcccggcggcaaggccggcaggccgcagctgaacaggatgccggcgagcagcaggtagccgaaccagttggtcaccaggctgaaggtgaggatccgggtgatatcggcgatgtccaggccgagccgactgtacaggcgatagcgcagcgccacggcgccgacccaggaactcaggttgaggttgaacgcattgcacacgaacgccacggtgaagacccgccgcttgggcagcgagtggccgatgtagtagcggctgagcaggtcgaagctgctgaacaccgtatagccggcggccgccagcagcagcccgaggaacagggtcgcggggcgatactcgtcgagggcgtggcggacttcctgccagtcgagattcttcaccagcaggaacagcagcaccgggaccagcacgaagaacgccagggtcagcagcctgcgcagccagcgccagtgagagcggcgcggcggcgtcgaggtggcttcgtgaccgctgccgttcatgggttgccccgctggccctggcgttcctgccagcgccgcgacggacgcggctccagcgatttcaggcgtggcagatgggcgggtacccaaccggcgatagccggaaagtgcctggaaaagtggaagccgaggaaaatcagcgggcgctcgccaccagtagccgcgcctcgcgtggcggcggctgatgcgccggcagtggcggcgcgccagctcgcgcaggtgctggtagagctggccgttgaaggcgacgtcgcggatcaccaggttggcctccaggttcagcgacaggctgaggggatcgagattgctcgagccgatggtcgaccagtcgtcgtcgatcaccgcgaccttgccgtgcagcggacgctggcagtattcgtggatacgcacgccctcgcgcagcaggtagtcgtagagcagccggctgcacaggcgcaccagcggcatgtccggcatgccctgtag

SEQ ID NO: 8260 - DNA, 837 bp, Pseudomonas aeruginosa
taccaggtcgacgcgcacgccgcggcgcgccgcatcgcgcagctcgcgaagcaggcggtagccggggaagaaataggcgttggcgatcagcaggcgtcgccgcgcctggcggatcgcctgcaggtactcgcgctcgatgtcgtcgctggactggtcgttgtcgcggatcaccaggcgcacccgcgccggctgcccggcgcccgacggccgcaacggcgggtagtcggcgtccggttcgagcagcgccaggcaggcctggcggatatcgcgcaccaccgggccctcgacgcgcaccgcgtagtcctgcttggccatgttgccgcgacgtaccaggtggtcctcgccgtaattgatgccgccgacgaaggcctgccggcgatcgatcaccaccagcttgcggtgcaaccggcgaaacaggttggtgcgcatgccgagcaggcgcgggcgcgggtcgaacaggtgcacgcgaaccccggaggcggccagcctggccaggtagtccgggctgagcgaggcggtgccgtagccgtccaccgtgacctgcacctcgacaccgcgctcggcggcggcgctgagggcttcctgcaactgccggccgacctcgtcctcgaagatgatgaaggtttccaggaggatctcccggcgcgcctcggcgatgcactggaacaggcgcggaaagtactcttcgccgttgatcagcagttctacgcggttgccgtcgcgccaggggaagttcatggctccacctccaccgccagcggcaggtggtcggacaggtgcgaccagggccgccgcgagaggatgcgcggctggcgcccgcgggcattgcgcaggtaa

SEQ ID NO: 8261 - DNA, 1671 bp, Pseudomonas aeruginosa
agatcgccggaggcggttaggcgtcgcgccagttccggcagcatgcccgtcgtcgccgcgccagtaggcgcgcacgcaatcgcggaaacggtcgttccattccgcccagccgggcgggaagccgcctacctggtagccgccggggccgcaatcccagggttcggcgatcagcttgcacttgctcagcaccgggtcctggcggcaggcgacgaggaagccgtggcgctcgtcgaaaccgtccggatggcggccgaggatggtcgccaggtcgaagcggaagccgtccacgcgcatttccgtggcccagtagcgcagcgagtcggtgaccatctgcaacacgcaggggtggctgaggtcaagggtgttgccggtgccggaatcgttgatgtagtagcggcgctggtcgggcatcaggcggtagtacgaggcgttgtcgatgccgcgcatgcacagggtcggacccagctcgttgccttccgcggtgtggttgtagaccacgtcgaggatcagctccagtccggcgtcgtggaggtgcgcgaccatctccttgaactcgttgacctggccgctggcgaggtaggccgggtgcggggcgaagaaggcgatgctgttgtagccccagtagttgctcatgccgttttccagcaggtgcttgtcgtcgacgaagccgtggatcggcagcagctcgacgctggtcaccccgagccggcggatgtgcgccagcaggtcggcgttcatcagcccggcgaaggtcccgcgaaccgcctccgggacctgtggatggcgcatgctgaggccgcgcaggtgggcttcgtagatcaccgtgcggtcccaggggacgcgtaccggcgggcgctcggcccaggtgaaggccggatcgatgaccttcgacttgggcacgaagggcgcgctgtcgcgctcgtcgaagctgaggtcggcgtcggccgagccgatggtgtagccgaacagcgcctcggaccagcgcaggcggccgaccaactgcttggcgtagggatcgaggagcaatttgttgggattgaagcggtggccggcatccggctcgtagggaccgtgcacccggtagccgtagatctgccccgggtgggcgtcgggcaggtagccgtgccagatctcgtcggtgtactcgggcaattcgatgcgctcgatctccttttccccgcgcgcgtcgaacaggcacagctcgaccttggtcgcgtgggccgagaacagcgcgaaattgacgccgaggccgtcccaggtggcgccaagggggaaggggtgcccttcgctgatccgcgaaggagcggggctacgctttctgctcatgcactggactcctcattcgcccgcttcgggcttgcggcggctgcgcggcttggccgccgccggtttttcgctggcgggccgcgccggggacgcggccctcggcttgcgcggcttggcggccggcgcttgcagcagggccggggtttccttggcggccttggcccgaccgcgggtcttcttcggtgccgccgcggcggcttccgcttcggccagttgccgggccatggcccagtggcgttcggcctggccgtcggggcagccctcggattcccagatctggtaggcgaactctcgtatgcgtttttcgtcggcgctcatggggtgtcctcctgggcgaggcggtaa

SEQ ID NO: 8262 - DNA, 531 bp, Pseudomonas aeruginosa
caccaacggcgcgggggttgccccgacatagccgatgcaggcgtccagcggtacttcggcggcggggtcgggatcgaccggcggttcgaggctggcggccagggcccggcgctcctcggcgcgcagttccaggtcggccgcgcattcctcggcgctgcggtgtccggcgcggccgcgccagtggatgtcctggccccgccaccagccggacaggctcggcaggtcgtgggtgctggtggtggccatggcgtccgccggccattgcgccgggggcacgaagcgttcgccgcgccgctcgaagagcagcacgcgggtacccagcacttggcggcgtgccagttcctcgcgcaggccttcgggcacggtgccgaggtcctcgccgatgaccagcgccgaggcgcgactggcctccagcgccagcaggcgcagcagctcgcgttgcgggtagcgcaggtaggcgccggcgtggggcggctggccgcgcgggatcagccagagacgttgcaggcccatcacatggtcgatgcgtag

SEQ ID NO: 8263 - DNA, 1770 bp, Pseudomonas aeruginosa
gcggccgcggcgatactcggcacaggcgaggttgtcgaggaacagcacccaggtggcggccgccggcggctcgacttccgcttcgagcggagaagggttgaagtcgattcgccagtcactgccgtcaccgagtcgccagcgcgccgacagcgcggcgccggcgatggtggtaacgcccagcgaacgggcgccgcgcaggcgcgggatcaggtgttcatgacggatttccagcagttgccggtagaagccgcgccaggccgggtcgcaatcggccaggccgggacgcgagcgctcgaaggtctccaccgcgtttgggtcggggagcgaagccagggtggcgccctcgccgaagcggccgaactcgccgaactccttgcgtcgtccctcgcggaccgcgtccgccagttcgccctggtgatcggtgaaatacaggaacggttcgcgcgcggcgcattcctcgcccatgaacagcagcggaatcatcggcgcgagcagttgcagcgctatcgccaggcgcaacgcctggggttcggcgaggacgctgagacgctcgccgaaggcgcggttgccgacctggtcgtggttttgcagaaacagcacgaaggcgtccggcgccaggtcggcactcggttcgccgcgcggccggccgtggcggttggcttcgccctggtagacgaagccttcggccaggcagcgcgccaggcagcgcagcggctcggggtagtcctggtagtagccgtcgttctcgccggtgagcaggacgtgcagcgcatggtggccatcgtcgttccactgtgcgtcgtagccctggcgcagcaggctggcgcggttgtcgtcgttctccaggaccaggtgcacatggcgctcggggccggcggcgccgcgcaggcggcgggccatctcgacgaggaacgcgctatcgggaatcgcgtgcacggcatcgaagcgcaggccgtcgacgcgatagtcgagcagccacatcagggcgttctcatagaagaactcgcggacttcgcctcgacggaaatcgatggcctggccccagggcgtctgccggtcgtcgcggaagaacgcggcggcgtactgcgcgaggtagttgccgtccgggccgaagtggttgtagatcacgtcgacgaagaccatcaggcccatgccgtgagcgctgtcgatcagatgcttgagttgctcgggcgtgccgtaggccgacgccggggcgaacggcagcacgccgtcgtagccccagttgcggcgaccgggaaactcgcccagtggcatcagctccacggcggtcacgcccagttccaccaggcgcggaaggaagtgctcgacctcggcgtaggagccgaacaggccgacgtgcagctcgtagatcaccgcttcgtgccagggccgcccgcgccactcgtcgacgcgccaggcgtaggcgccatggtccagcacctggctgtgtccatgcacgccgtcgggctggaactgcgaggccgggtccggcaccccggggcgaccatcgatgcggtaacggtagcgggtgccgggcggacagggcagggtcgcctcgaaccagccgctgtcgctgccttccagcggccagtcgcggccgtcggcggtctcgacccggacctcacgggcgtccggagcccagaggccgaagcaggtccggccgttgccttggaactgggcgccgaagcggcgccggatcgccatcactggcgtaccccgcgcagggccggagcggtattcctcaacaggcgccggtacaggcggttgtaa

SEQ ID NO: 8264 - DNA, 405 bp, Pseudomonas aeruginosa
gctaccacggtcaccagcaccagacccgcaacgcgcgcggcgaactggtctatgccggctccgacctgctggtggcgcgcggtggctacgccgagctgctggccctggacctggcccgcgaggtgcgccaggccatcgagtacgcgcggatcttcgacaccgccgcggcgatcttcttccccggctgcttcgcctcgcggcgcaactacgacattgcccagggccgggatggcaacggtcgggagcgcttcggcgtgctcgagcagtcctggcgggtcggcggcgcgagcagcgccgagatcgccgcgctggaagccttccgcgccgatccggggctgcccgcggtgcgcgccgcgtcgttcgagatccacgaagacaagcgcctgccggacaacagccgggtga

SEQ ID NO: 8265 - DNA, 1365 bp, Pseudomonas aeruginosa
cgggggaggcatgacggcgaacagcgaacgcatccgcatcggggtcggcgacgaccggatcgaaggcaccttcctcagcccccgggcgaaggttcccggcgtgctcttcgtgcacggctggggcggcagccagcagcgcgacctgaagcgcgcccagggcatcgccgggctcggctgcgtgtgcctgaccttcgacctgcgcggccacggcgcggaaagcgggcgccaggcactggtgacgcgcgaggacaacctgcaggacctgctcgccgcctacgaccggctggtggcccacccggccatcgacagcgaggcgatcgcggtggtcggcaccagctatggcggctacctggcggcgatcctcagccagttgcgcgcggtgcgctggctggccttgcgggtgccggcgatctaccgcgacgaggattggctgacgcccaagctgctgctcgaccgcgaggatctcagcgaataccgcagcagcctgatcccggccgccagcaaccgagccctgcaggcctgcgcgggattccgcggcgatgtgctgctggtggagtcggagttcgacagctatgtgccgcactcgaccatcatgagtttccgcgccgccttccagcagacccattcgctgacccaccggatcatcgaccacgccgaccatgcgctcagcagcgaggcggcgcaggacgcctatacctcgatcctggtggactggatcaccgagatggtggtcggcgaacgtctcagcatcaccccggcctacgccaccatccatccggctttctgaacgctccgcgacggcgagcctcccaccttccgtgggcactggttgctgcccacgttccgtgccggcaggcgccggcgccgacagacgcgagaaatcccggacagctccgggccaaggagagcgaaatgaaccagaccaacctcgacgacaccctcgacgtactcaacgacctgctgcaaaccagcaaggatggcgaggccggtttccacgcctgcgccgaggacctgcgcgacccgcagttgaaggcggcgatgctggagcagagccgcgactgcgccgcggccgccgacgagctggagcggatcgtcctggaactgggtggcaaacccaaggacagcaccagtttcgccggtgacctgcatcggcgctgggtcgacctgaagtcactggtcaccggcaaggacgaagaggcggtgctcaacgaatgcgagcgcggcgaggatgtcgccaagcaccgctaccaggcggcgctggaaaaatcgctgccggcggagatccaccaggtgatcgagcgccaataccagggcgtactccgtcaccacgaccgggtccgagccctgcgcgacgcccgcgcctga

SEQ ID NO: 8266 - DNA, 372 bp, Pseudomonas aeruginosa
ccgacgcaaggagaattccatgaacgaatacctgcccacttcgacggcccaatggcctgccgcacaacctgcagcgccggcgagcgactcgcttccatcggcgccggactggtcctggccggcttcggcctggcccgcggtggcttgccacgcgcctgcaaggcggtcgccggcggcctgctggtcagccgcgggttgagtgggcattgccatgtcaagggcctgctcaatgaaccgcgggaagagttgcagttgctgcgcgaggaggtgcagcacctgacccgccgcctgcagcgcctgcaggagcgccagcgcgacgactcgcggcaggacgctgcgctggacgccgaactgccgccgaacctgccgtga

SEQ ID NO: 8267 - DNA, 489 bp, Pseudomonas aeruginosa
tcctggcgcagacgaggccaggcattggagggactgatcagtagccgagccatttcgcgggtcatgacgggcacctcttttctgtggcgttcaggagtctggaccggcccggcgcgagggggttcaggtggcgtgccgggcggtccgcgaccgcccatccagggccttgaaccggaagacgcggggagcgccgaaagacaaacgtccctgtcttccggaggagcccatgaccacctacgaaatccagcacatgcgcggctggcggcgtttcgcccgcaccgtgcgcgccgccagccgggccgaggcggaacgcctgtgcctgccctgggagtgggtggatggcgaggtcctcgcggtgattccggccgaggccgaggtggccgagcgctggcagcgcctgaacgaggatctggtggaaggcctggagcgcctcaggcgggacgagtgacccgcaggccgaccacggcgatccgctcggcttcgcggtag

SEQ ID NO: 8268 - DNA, 1233 bp, Pseudomonas aeruginosa
ccgcagcagctcgcgtcgcagcgcgacctgctcggcgtccacgtctccgcccgccgtcgccggctccgccagcggcgcaagcgggtccctgtccgccggagcgggggcttgccagtcgccagcgatccagtcgtacagcaactgccgctcgtagggagtgaagactccgaacatcgccgcccggtcgccctcgatcaggttccagaaacggctgccgcgcggatcggcatggcgccggatccagccctcttcctcgaggcaggcgagaaacgccgggaaccgcccgggcaccgccagccactggttcaccgtgcgcccgccgatccggcaacgatccgaatgcatgccggcggcgtaggggcgcttgcgctcgaacatggccagcaattcttcctcgagatcgaagccgtcgatcacctgctcggtgctcaggccgacctcgttcaggcggtagccgttcctcacccgttcgaggaaggccgcgcgcccgccaagctgcggcaggttgtcgtagagcgcgcgcagggccttgcgcgcatgtccgctggcggcgttgtcgatggtcacgtgcaactggaagtagtaggggtcgaagcccagctcgcgcagctcctgagtggtgatcaacaggtgcagcggcggttgctcgtagccgaggttgtagccgatcacttcgggcaggtagtccgcggcgaggtggccgagggcgagttgctgggtgccctgcaggtagtggaggtcgctgaggccttcgacttcctcgctgccgatgctggccagcaggcgccggtagagcaggacgtggttgcgtgccgggacgccgtcgccgagttcttcgaggaaggtctccagcagcggccgcaggcgttcctcgccatgatgcggcaacagcccatagagccaggcgccgtcgaccagcttggtcggggccacgctgcgaatgaagtgcatcgcctgggagggaacctggaagtagcgtcgcccttcgccgcgccgacgtgcccggaggtattcggcatgcgcctcggcggtgcgccgggccccggcgtcgagccaggccggccaatcggcggggtcctccggcaggtcgtcgtcatgggtggcggccaggctcaattgctggtcgaggaactcgccggcggcttcgaggtgctcgcggggctcgtcgagcagggcgtggtacaggtcgcggaccctgggcgaagggcttgcactggaggcagggaggggtga

SEQ ID NO: 8269 - DNA, 1059 bp, Pseudomonas aeruginosa
cagtcagcgcagcggcgccgttgcgccaggcgagacgcgttggggaaaagttctgaaccatcgcccgctgcgggattccgagcttccgtgcgcaggatgaaagcgccgcttcgaatagccgttgttcgaatgtccgtcggagggaaggtccacgaacccacagaggaacgaaccatgttcgtacatgacaagcgactgcagtacaccgtcagggtcgccgcgcccgatcctggcctggccaacctgctgctggagcagttcggcgggccgcagggcgagctggccgccgccatgcgctatttcacccagggcctcggcgagtgcgatcccggtcgcaaggacctgctgatggacatcgccaccgaggaactcagccacctggaaatcatcggttcgatcgtcggcatgctcaacaagggcgccaaggggcgtctggccgaagcggtggaggaggaggccgagctgtaccgttcgttgaccggaggcggcaacgactcgcatatcacctcgctgctttacggcggcgggcccgccctggtgaactccggtggcgtaccctggagcgcggcctacatcgataccatcggcgagccgaccgcggacctgcgttccaacatcgccgccgaggcgcgtgcgaagatcgtttacgaacgactgatcaacctcaccgacgatcccggcatcaaggatgcgctgaccttcctcatgacccgcgagctggcgcaccagctttccttcgaaaaggccctgcactcgatccagccgaacttcccgcaaggcaagctgcaagggatgccggagttcgcccggcgttacctgaacatgtcgcgcggcgagggcgacacgcgcggttcctggaacgagggtgatggctgggaatacgtggaggcgccacagccggccatggatggaggcgacggcacggccagcgtgaacctgtccgagactgagcaggaggtgttgcagcgaatggcagaccgcacccgctccgaccccatggccgatccgctgacaggtgcggacctgggcgctggcgcggctgccgacaaagcgccttga

SEQ ID NO: 8270 - DNA, 420 bp, Pseudomonas aeruginosa
ccctccggtgcgtcgtccagacgcaggcggtggctgatgatcgcctcgggatgcaggtcgccgttgccgatgtgttcgagcaaggccggcagcagtgcctgtacatgggtctggcccatcttgaaggtcaagcccttgtcgaaggcatcgccgaacaggaagccatggatgaagccggcatacacgcccggcacgctcaccgtgccaccccgccggacagccgcgatgcactggcgtagtgccttgccgctgctggcttcgagcttgagcgcggtgagcacggtttcggtgacgctgcccttggcctcaaagcccaccgcgtcgatcaccgcgtcgacgccgcggtgcccgtcggtgcgctcgatgatcgccgcggcgggatcgtcctcctggtcgaagtcgatgggaatcgcaccgtag

SEQ ID NO: 8271 - DNA, 246 bp, Pseudomonas aeruginosa
agcgccgcgcccggcggaatctgcttcttgttgaggatcgcgccgcgccccgggttggtggtctcgcaggcggcgtgcaggttcaggcggcagaagaagcactcgccgcaggcgatgacgaagggcaccaccacccggtcgcccggacgcaccgcggtcacggccgagccgacttcctcgacgacgcccatgaactcgtggccgaggatgtcgccctgctcgaccatcgggatcttgccccggtag

SEQ ID NO: 8272 - DNA, 945 bp, Pseudomonas aeruginosa
agatgtaggtcggagccgcagatggcggtggcggtcacgcgaagcagcaggtcgtcgggttcctgcaggcgcggttcggcaacccgatcgatacggacatcgtggctgccgtggaaggtgagggcgcgcatggcattgctcctggctgtgggtcgtgcaggtggggcgtgcgcagcagcaccggagttcattcggcgggatgggtggcgctcgataccggcccccggaggccactgcaccacgttgagtcgtggaggccggcgaggaacgcaggccctcgctccctgggtgccattcgtcgcgacgatggctcacggcggacgtacggcaatcctctgtagggaaagcattgcagaccgtcgaggaaccgatacggaaagagaggcgagcatgtccaagcagcacatcatccatttcaccgggccgatcaattcgtccacctgcggcaatttgatcaacacttgcgccaaggtcctgccacaggaggccgaggggttgcggatcaacatcgccaccatgggcggggaatgcagctacggctttaccctgtacaacttcctgcgcgcgctgccggtgccgatacatacccacaacctgggtacagtcgagtcgatgggcaacatcctgttcctcgccggcgagcgacgcagcgccagtgcccacagcaagttcctgttccatcctttccactggaccctgcatggcgcggtggaccatgcgcggatggcggaatatgcgatgagcctcgactacgacctggagctttacgcccggattgtcgccgagaacacccgtgatgcgccggaacgcctggacatcccgcgatacctgatggcctatccgcgcatccttggtccggaagacgccctggcttgcggactgatccatacggtggacgattcgcctatacccgctgccgcctgccagtggagtatccattcttag

SEQ ID NO: 8273 - DNA, 519 bp, Pseudomonas aeruginosa
atggctgcgacgccgggaagaaacttcgaactccccgtatgcgggcgattcacaagcagggagagccgcgccgaaaacggcgcgccggaagaaagagacagaacgatgaaagtccgggaaatcatgagtcgcgaagtacgtaccgtcaccccccagaccaccctcggcgaggcggcgcagcagatgcgccaagccgatatcggcgccttgctggtcaacgagggcgagcgcctgaccggcgtggtcaccgaccgcgacctggcggtgcgcggcatcgccgatggactcggagccgaccgcccggtgcgcgaggtgatgagcggtgaactgcgctactgcttcgaggacgaggaagtggaccatgtggcgaagaacatggcgcaactggagaagcgccgcttgccggtaatggatcgcaacaagcgcctggtaggcatcgtctcgctggccaacatcgcgacctgcaacgccgacaagctcagcgccaacctcttgcgcggcgtggcccgcgcgcactga

SEQ ID NO: 8274 - DNA, 1608 bp, Pseudomonas aeruginosa
gaccgtgctcaacgtgctcaatgccgtgggcctgcgccggctcgcgcgcaacgaccatggccaggccagcggcgccttctgcggcatgggcgtatgccactgctgcctggtcgccatcgacggccggcccaagcgccgcgcctgccagaccgtcgtccggccgggcatgcgggtggaaaccgaaagcaaccgcttcgaccaggaggaacggccatgaacctgcgcccggtgatcgtcggcggcggctcggccggcatggccgcagccatcgagctggccaggcgcggggtcccctgcgtcctcttcgacgaggcctcgcgtcccggcggggtggtctatcgcggccccttgcgggccggcgtcgatccggcctacctcggcgcgcgctacacccggatgctggaaaaactgcggcgcgatttctccgcctgcgccgggcacatcgacctgcgcctgaacagccgcgtggtcggtggcgacggccagcgcctgatggtcctcgacgaggcggaacggctgcacgaggtggagtattcgcacctgctcctggccaccggctgccatgagcgcagcgtgccgttccccggctggaccctgcccggggtgatgctcctcggcggcctgcaattgcagatcaagagcggcgtggtgaagcccctgggcgataccctgatcgccggcagcggcccgctgctgccactggtggcctgccagctgcatgcggccggggtacgtgtcgccggggtctacgaggcctgcgcgttcggccgcatggccagggaaagcctggcgctgctgaacaagccgcaactgttcctcgacggcctgagcatgctcggctatctcaagctcaacggcattccgctgcactatggctggggcgtggtggaggccagcggcgagggggaactgacggaagtgacggtagcgccctacgacgaagagtggcggcccgacctggaaaacgcgcgaccggtgaaggccagcaccctggcggtcggctatggcttcatcccgcgcacccagctcagccagcagttgggtctggagcacggcttcagcgacgacggatacctgcgcgcggaatgcaacgtctggcagcagagcagccaaccgcacatccacctggccggcgacatggcgggtatccgcggcggcgaggcggcgatgatcggcgggcgcatcgcggccttgtcgatcctcctgcaacgcgaggccatcgcgcccgccgaggccatcgaacgccgagaatcccatctcgcccgcctggaggcgatcaagcgcttccgcgccggagtcgagcgctacacccagcgcggcgcccgccaggtcgaactggcgcgggccgatacggtgatctgccgctgcgaacaggtcacccgtggcgacatcgagcgcgcgctcgaacagggcgtgcaggacatcgccgggctgaagatgcgcacccgcgccggcatgggcgactgccaggggcggatgtgcatcggctactgcagcgatcgcctgcgccgcgccaccggacgccacgacgtcggctggctgcggccgcgtttcccgatcgatccgatcccgttttccgcattccagaacctcggtacggaagcctga

SEQ ID NO: 8275 - DNA, 321 bp, Pseudomonas aeruginosa
tccaggacgacgaggatcgccagtacgccgagcacatcgtggcgcagatcccgcatctggccgagcaggtgcgctggctggaccgcgaggaactgcgtcgtgccgagccggcggtcagccacgcggcccacggcgcgctggaattcctctgcgaccaccaggtcagcccgttccgcctggccgacgcctacctggaggcggcgcgccagaacggcgtcgagctgttgccgggaaccaacgtcaccggcgtgctgcgccagggccggcggatcagcggggtgcgcacggacaatgccggggtgctgcattgccggaccctga

SEQ ID NO: 8276 - DNA, 1239 bp, Pseudomonas aeruginosa
gcaagctgcaccgcagcccgggaccgctggagacagccatgcagaccacccgcagcctgctggaaatctgaggtaccgccaggaaatacccgccccgcgagaggcgggtattttttcgacccgtcagtagttgactggtctaatttgcccggcgcacggtatgagccgttcgccacattcgtcagacagaggagtctggaaatgtcccaatccacgcaggtcaaccgccgcatcgtcctcgcctcgcgcccccacggcgccccgacccgggataacttccgcatcgagcaggttccgcttcctgagcccggcgcgggccaggtgctgctgcgcaccgtctacctgtcgctcgatccctacatgcgcggacggatgagcgacgcgccgtcctacgcgccgccggtggagctcggcgcggtcatggtcggcggcacggtcagccgggtggaagcctcgaaccatcccgggttcaaggtcggcgactgggtactctcggccaacggctggcaggactacgcgctttccgacggcagcggcctggcgcgcctgggcgagtcgccggagcatccgtcctacgccctgggcctgctcggcatgcccggcttcaccgcctacatgggcctgctcgacatcggcaagccccaggccggcgagaccctggtggtggccgccgccaccgggccggtcggcgccaccgtcggacagatcggcaagctcaagggctgccgagtggtcggcgtcgccggcggtgcggaaaaatgccgccacgccgtgcaggtgctcggcttcgatgcctgcctcgaccaccatgccgcggacttcgccgaacgactggccgaggcctgcccggacggcatcgacatctattacgagaacgtcggcggcaaggtcttcgacgccgtcttcccgctgctcaacgccaaggcccggatcccggtctgcggcatcgtcgcccactacaacgacaccgagctgccacccgggccggaccgcttgccggcgctgatgggcacgatcctgcgcaagcgcatcaaggtgcagggcttcatcatcttcgacgactacggccatcgctacgatgaattccagcgcgacatgtcgaagtggttcgccgacggcctcatccagtaccgcgaagagcgggtcgacggcctggagaatgcccccgaggccttcttcggcctgctccagggacgcaatttcggcaagctggtggtgcgcgtcggagccgacgcatga

SEQ ID NO: 8277 - DNA, 1398 bp, Pseudomonas aeruginosa
cttcatgatcgccagcgccatcgaaagcatgggcgaaagcgtcgccctggtgaagcgcctgggcgtcgagcccggccggttcatggagctcatgtcctcgacgcttttcgatgcgcctgtctatcgcaactacggcccgcagatcgtcgagcagcgtttcaccccggccaggttccgcctggtcctcgggttgaaggatgtcgacctggcgctgtccgccggcaagcgccacaacgtgccgctgccgctggccagcctgttgcacgacgtgttgctcgaagccatcgcccatggcgacggggaatcggactggacggcgctggcgaaggtagcgttgtcacgatcgggacaaatctgaaaaggttctgcgcacggcccggcagggcccgtgaagctgttcggcaatctggcgtgctttccatggattcattaggcggaagaaggtatgtccgagcgtggaacggctgcagaaggccggatcaactggcgacgcatcctgccgatactgctcaccaccaccctggtgggcggtatctgtgggatcttcgtcatcaacgaactggatcgccagcacgacggcgcgcacctgcgctcgtacaccgagagggcgctggagcgggcactggagatttcctccgcggcggaccagatgctccgcgagatgaacgccggcagcgcgccggcctgcagcgaccgggacctggaaatgctgcgttccatcgtgctcgagtcgcgcttcatgagcgacgttggcaggatcagcggcgaccgggtcatgtgcacgggcgtccggggccggctgcgcgcgccctggggattgtccgcgcccgaccgggtagatgccgccggcacccgcttctggacggagggcatgcccctgccgttgcaggcgctgcccaccgggctggtcagtcgcggcaacgccgtcgtattcattgccccgcacgcctatttcgatgtcgaccacccggacccgggcatttcggcggcggccgtcagcagtggcggcgactacatctaccaccgtttcgcctgggacgacgaccagcccctcgaggcgctcggccggcccggctggccgcgcttcatcggcgcccggcagataagcctgtgcgacccgacgcaggacatctgcgtggtctcccttctccgcgaacgcggcctgcttggcaccgagcccggacgcgcggccatggccgcggcgatcggcggcgggctgttgttcggcgtcatgctgctgctcagctacctgttcggcttcctcaacgacgaaaaactgccggccaggctgctgcgcgcgttgaagcgcgaggccctggaggtgcactaccagcccatcgtgcgcctggccagcggccgctgcgccggggtcgaggccctggcgcgctggaccgatag

SEQ ID NO: 8278 - DNA, 981 bp, Pseudomonas aeruginosa
  unsure (200): Identity of nucleotide at the above locations are unknown.
gtccagaagatcagcatcagcaccgggatcgcgcggaagaagccgagcagcgccaccagcagcaggcgcggcttgccgggcagcaccgcgagggccacgccgaggaccaggccgagcaccgccgaagccagtccggagagcgacgccagcagcagggtcagcgccgctccgccgagcgggccgtccgggtatgcgccgancagcaggtatgacaggttgtccgagatgaccgagaaatccatctcaggcacctccctggcggtagcggcgggtctgctgcaacgcctggccgaaagcttcgatcagggcgatggcgccgatgtagagaagggtggcgataccgaaggcctggaaggtcttgaaggtctcggtttccacctggcgcgaagcgtaggacagctcggccaggccgatggccatcgccagcgaggagttcttcagcgcattcatgtactgcccgagcagcggcggcagagccgtgcgcagggcctgcggcagcaccaccacgcgccatacctggcgctgggtcagccccagggcgaggccggcggcgcgctgctcggggcgtaccgaggcgatgccggcgcggaactcctcggcgacgaaagccgaggtatagagggtcagcccccaggcaccggcgaggaactcgaaggacggccagtcgagcaagggcgtctcgtgcggcgtgttcagccagctcaccagcgcctccggcagcagcgcgggaacgccgaagtaccagaagaacagctgcaccagcagcggggtattgcggaacagcgccaggtaggcgcgcgccggccaggacagcaggcgccggcgcgacagccgggcgatggccaggggggcgccgatcagggtggcgagcaggcaactgagcagggcaagaccgagggtcagcaggaagccgtcgagcaaccagcgcaggtactgcggggcgagaagttcgccgaacatgtgcgggattccgtcgggtag

SEQ ID NO: 8279 - DNA, 939 bp, Pseudomonas aeruginosa
tcgcgataccatattagaggtacttcgaggaaaatgacctggttagttatggcacttatggctccactgctgtggagcctttcaaatatcctggacaagctggcagtgatccatcatgcgaatcactggactacatttatatttctcctgagcattggaaatcttctttattctgcgctgatttttcttctctttacaccatctgactttgacacaacctcagcgcttctgaacctgctgtcaggattatgcatttttggaatgtatttcctatacgcaatgccgctgaagtcggtcgatatctctactgcgattgcgcttcatcagttaactcctttgctggtgcttgtcgtatcgatcctcttgcttggttattcgccaacagggattgagctgctcggcattgccttggtttttgtcggggtttactttgctgtggcaatcggcaaagggagaccaggctcgataagtttatcagcagtattgcttctaataggttcagcagtttttggggcggtggctacgctactatacgatcacctgctcctgagtcacagcctgccctcggttcttatgtttaactatgcaggctacggtcttggcgggactctgatgctgctggttccgaaatggcgccattccatcgcaaaggatgtctccgaaatgccaccaaagggctgggcggtgtatgcgctgagcaatctcttcgacgccggtggatacgcgctttttattggcgcattatctgctggtggaaacgttgcggtggtctcggttttggtcagtcttcacccggtatatgtgctagccttaagtcattggctagcaatagttaacccaaagatactcagcgaaaactttagctcgtcggacgcatataagcgcatgagcgccatagtcgtaatcgttgccggcgtaataatgatgaccaagatctga

SEQ ID NO: 8280 - DNA, 1005 bp, Pseudomonas aeruginosa
aaatccatgcgcgctcaatccgctccggtgctgaaacatgtcggcatcgtcgccatcgacggcgtcttcgcctcgaccctgatgcaggccaaggacttcttccacatggccagcctgcgccacggcaagcagcagggcctcggtctccagccggccttccgcacccgcatcctcagccccgacggccagccggtacgcagcttcagcggcgacagcatcgccgtcgacggtcccctcgccgcctgcgatatcgtggtcctgcccgccttctggggcgatttcgacgcgctcgaacggcgctatccgcaaatcgttccctggttgcgccgcagccatgccgagggaaccgccctctgcggcgaggcgaccggggtcttctggctggcccaggcaggtctgctggatggcaaggaagcgaccacctactggcgcttctatcgagaattcgccgaacgcttcccgaacgtgctgctcaaccaggagaagcacctgaccgatgccgacgacctgttctgcgccagcggcgtcacctccgcctgcgacctctacatctatctgatcgagcgtttctgcggcggatcggtggcccaggcggtggcccgggataccctctacgaagtacagcgcagctacaccccagggcgtatcggcttcggcggacagaagctgcaccatgacccgacgatcctgcagatccagcaatggctggaagaccacttcgccgacaagttccgtttcgaggacgtcgcccgcgaccacggcatgagcatccgcaacttcatgcggcgcttccaggccgctaccggcgacaagccgctgcactatctgcagcgactgcggatcgagaccgccaagggcatgctctcgagcacgcgcaagagcatcaagacgatcagctacgaggtcggctacgacgacgccagcttcttcgcccgcctgttccgccagcacaccgaactctctccccaccattaccgtcgccagttcatgcagaaggaaagctga

SEQ ID NO: 8281 - DNA, 477 bp, Pseudomonas aeruginosa
agcaaagccgtctatagaggaaggattcgcgtggaacagtcgctcaccgcctggctgctgccggccctcgccctggtcgccggggtcgccatcggttttctgatcgcccgcctgctgcccaacgccgcgccgaacaaggtgcaacgccagatggacgacctgcaggaccgcttcgacagctatcagcgcgaagtcgtgacccatttcaacaccaccgccagcctcgtgaagaagctgacccagagctaccaggacgtgcaggagcacctctccgacggcgcccagcgcctggccctggacgaacagacccgccagcgcctgctggctgcgctgcatgccgacgaggcctatccggccgagcgccgcgagcgcctgactccgccggcctccggcgaagtgccgaaggactatgcgccgaaaagcccggacagccccggcaccctcgacgccacctacggcctgaaaggcaagtactga

SEQ ID NO: 8282 - DNA, 993 bp, Pseudomonas aeruginosa
tcagatcggattgatgagacatgctgcgtatcctcagaaatagccctgacgtttcttttcttccatcgaaccggcctggtcatggtcgatgacccgaccctggcgttcggaagtacgcgtcaggagcatttcctggatgatttccggcagcgtggtggcgctggactcgaccgcgccggtgagcgggtagcagccgagggtacggaagcgcaccatgcgcttctcgatgcgggctttctcttcgtcagagagatgctcgaggatgcgctcgtcgtcgatcatgatcagcgtgccgttcttctcgataacctcgcgctcggcggcgaagtacagcgggacgatcgggatgccttccaggtagatgtattgccagatgtccagctcggtccagttggacagcgggaatacgcggatcgactcgcccttcttcaccttgccgttgtagatgttccacaactcgggacgctggttcttcgggtcccagcggtgcttgctgtcgcggaacgaatagacccgttccttggcccgcgacttctcctcgtcgcggcgcgcgccgccgaaggcagcgtcgaaaccgtacttgtccagggcctgcttgagtccctcggtcttcatcacgtcggtgtgcttggcgctgccgtgggtgaacgggttgatgccctgggcgacgccgtccgggttgacgtgggtgatcaggtccaggcccatttcctcgaccatccgatcgcggaacctgtacatctcctggaatttccagcgggtgtccacgtgcatcaccgggaagggcagcttgccggggaagaaggccttgcgggccaggtgcagcatgaccgcggaatccttgccgatcgagtacagcatcaccgggttatcgaactcggcggccacctcgcggatgatgtggatgctttccgcctccagctgtttcaggtgcgtcagtttgtcgaccatggctactcacggaattgcttatggacggccgtcgggccgtag

SEQ ID NO: 8283 - DNA, 891 bp, Pseudomonas aeruginosa
gaacctgccggcgatgaccctcggccgctccgacggcattcgcaccggcgacgtctgcctcgccatcggcaacccgttcggcgtcggccagaccgtgaccatgggcatcatcagcgccaccggacgcaaccagctcggcctgaacacctacgaaaacttcatccagaccgacgcggcgatcaaccccggcaactccggcggcgcgctggtggacgctgccggcaacctgatcggcatcaacacggcgatcttctccaagtccggcggctcccagggtatcggcttcgccatcccgaccaagctggccctggaggtcatgcagtcgatcatcgagcacggccaggtgatccgcggctggctcggcgtcgaggtcaaggcgctgaccccggaactggcggagtcgctgggcctcggcgaaaccgccgggatcgtcgtcgccggcgtctatcgcgacggtccggcggcacgcggcggcctgctgccgggcgatgtgatcctgaccatcgacaagcaggaagccagcgacggccgccgctcgatgaaccaggtggcgcgcacccgtccgggacagaagatcagcatcgtggtgctgcgcaacggacagaaggtcaacctgaccgccgaggtcggcctgcgtccgccgccggcaccggctccacagcagaaacaggacggcggcgagtaatccccgccattgaaaacggccgccctcgggcgccgttttcgtatcacttgaggaagtgcagggcgtccagtagcgcctggttctgctccggactgccgatggtgatacgcaggaactggtcgatccgcgcctgcttgaaatggcggacgatcactccctgctcgcgcaaggtcgacgcaatctgcccggcatcgtgccgcggatga

SEQ ID NO: 8284 - DNA, 294 bp, Pseudomonas aeruginosa
acatgcatgaagcggttctcgaagaccgtctcgatgaccgcgccggtgccttcggcaaccgcgttcatggagatgaactgggcctgcatgtcggtggggaacgccgggtacggcgcggtacgcacgttgaccgccttcggccggttgcccttcatgtccagctcgatccagttgctgccggtgctgatgtgggcaccggcctcttccagcttctgcaggaccgcctcgaggatggtcggatcggtatccttcaacttcacccggccgccggtcgcggccgcggccaccaggtag

SEQ ID NO: 8285 - DNA, 213 bp, Pseudomonas aeruginosa
cgagcgccgccgaggcgcttcacgccttcgatgacgatggtatcggagccagcgccttggacgttggcgcccatggcgttcaggcagttggccaggtcgaccacctccggctcgcgagcggcgttctgcagcacggtgcggccgttggccagcgcggcggccatcatcaggttctcggtgccggtcacgctgacggtatcgaagaagaagtga

SEQ ID NO: 8286 - DNA, 480 bp, Pseudomonas aeruginosa
ccgccttcgacctcgatctgcgcgcccatggcctcgagaccgcggatatgcaggtcgaccggacgcgaaccgatcgcgcaaccgcccggcagggccacttcggcctcgccgaagcgcgccagcatcgggcccagcaccaggatcgaggcacgcatggtcttcaccagttcatacggcgcgaccagggtcttgatgctgctggcatcgacttcgacgttgagcttctcgtcgatgatcggctgcacgcccatgcggccgaacagttcgatcatggtggtaatgtcgtgcaggtgcggcaggttgcagacggtgaccggagtatcggccagcagggtcgcggccaggatcggcagcgccgagttcttcgcgccggaaatgcggatttcgccatcgaggcggttaccgccggtaataatcagtttatccattgcaatgatcccccgtgggctcaggaacgctcggcccaggcggcgcggctga

SEQ ID NO: 8287 - DNA, 1173 bp, Pseudomonas aeruginosa
tcgccagcgacagcacgcctaccgaatagagttgcttcaccagcaggtgcaacccggtgcctggcgtgcgccggccgagcagggcgtggccgaggaacagggtcgagcggccgagcgcggcgaccacgtccaggccggcgcggccgaacaggcggatacgctcgaggggagagactctacgcatcagcgctctcccagcaggtcggcccggtagtcgcgggccggataatggaacggaacgggaccatccgggattcccttgacgaactggcggatacgaggatcgtcggtttccttgaggacgtccggcgtcccgtggccaagtacccggccgtcgccgacgatatagatgtagtcggcgatgctggcggtctcggccaggtcatgggaaaccacgatgctggtgatgccgagggcatcgttgagcaggcggatcaggcgcaccaggacgcccatggcgatcggatcctgccccacgaacggctcgtcgtagagcaggatctgcgggtccagggcgatcgcccgggccagggcgacgcggcgcttcatgccgccggaaagctcgtccggcatcagttccacggcgccgcgcaggccgacggcctgaagcttcatcaggacgatgtcgcggatcatttcttccggcagctgggtatgcacgcgcagcggaaacgcgacgttctcgaagacgtcgagatcggtgaacagcgccccgctctggaacagcacgccgaactgcttgcgcatgtcgaacaggtcgccgcgcgaaagctgcggcaggttctgcccgttgacccagacctcccccttcgaaggacgcaactgggaggcgatcagccgcagcaacgtggtcttgccgcaaccggacgggcccatgatgccggtcacctttccgcgcgggatacgcacatcgatgttgtcgaaaatcgcccgcgatccgcgcttgaaggtcaggcccttcaactcgaccgcgtaggcactatcggtgctcatcaggactccttgcgatgcgacccgtccatgctggacgccttgccccgttgcaaaggcacgcatccgggaggggtcgaatgggcgcggactatagcactgcggcgggttctggcccaaggcctggcaccatgccgttcagcttggattcagcttgttcggagcgttctctcagccctttag

SEQ ID NO: 8288 - DNA, 795 bp, Pseudomonas aeruginosa
gcaagtcgcctaccttggcgacgacctgcccgatctgccggtgatccgccgcgtcggcctgggcatggcggtagccagtgccgacccgttcgtgcgccagcatgcccatggcgtcaccgcggcccgcggcggcgaaggcgccgcccgcgagttctgcgaactgatcatgcgcgcccagggtacgctcgaagccgcccagggcgcctatctgtagagccgaccatgccgaagacactacgccagaaactgctgctcgccctgatcgccctgctgctgatcgtcgcgggctactactggaacgtcgggctcgagctgttcaacgaacagccgacccgccccggccaggacaacaccatcgactactatgccgagaatgcccatagcctccagtaccaggaggacggcagcctcgactacgagatgaccgcggtgaagctggagcaccagaaagccacggacatcactttcgtcaccacccccgacctgctgctcttccgtggcaacgtgcaaccctggcacatccagagcgcccgcgccgaagtcggaccgaaaggcaaggaggtcgaactcatcgacgacgtgcgcgtcgcacgtaccgatgccaagggccaaccaagcatcctgaccaccactcggctgaccgtattccccgacaagaattatgcacagaccgagcaagccgttaaaatcgacgcggccaatggagtgacgacggctgttggaatgaaagcgtatctgaaagacagccggatgcacctgctgtccaacgtaagaggtcagcatgaggttcgttaa

SEQ ID NO: 8289 - DNA, 1239 bp, Pseudomonas aeruginosa
taccctcccccttattttcggtctgactgccgccctcggcagctccatggccttggccctgccttcggaccgcgaacaaccgatccgcgtccaggccgacagcgccgaactggacgacaagcagggcgtcgcggtctaccgcggcgacgtcgtggtgacccagggcagcaccaagctgaccggcaacaccgtgaccctgaagcaggacaagaacggcgacatcgaggtcgtgacctcggtcggcaagcctgcctactacgagcagaaacccgctccggacaaggacgtgaccaaggcctatggcctgaccatccagtacttcgtcacgcagaaccgggtcgtgctgatcgaccaggccaaggtgatccaggaaggcaacaccttcgaaggcgagaagatcgtctacgacacccagcgccagatcgtcaacgcgggtcgtgccaccggctcccaggtgaccagcccgcgcccgcgcatcgacatggtcatccagccgaagaaaaaggcccagtaatggcaacgctcaaagcccagcacctggccaaaagctataaaggccggcaagtcgtccgcgacgtcagcatgtccatcgatagcgggcagatcgtcggcctgctcggtccgaacggtgccggcaagaccacctgcttctacatgatcgtcggcctggtccaggccgaccagggcgtggtccgcatcgacgagcagaacgtcacccacctaccgatgcacgggcgcgcccgggccggcatcggctacctgccgcaggaagcctcgatcttccgcaagctgtcggtatccgacaacatcatggcgatcctcgagacccgcagcgacctcgatcgcaacggtcgcaaggaagccctggaaagcctgctgcaggaattccacatccaccacatccgcgacaacctcggcatgagcctgtccggcggcgaacgacgccgggtggaaatcgcccgcgccctggccagcgcgccgaaattcatcctcctcgacgagcccttcgccggcgtggacccgatctcggtcggcgacatcaagcagatcatccatcacctcaaggcgaagggtatcggcatcctcatcaccgaccacaacgtccgcgagaccctggacatctgtgaaacggcgtatatcgtcaatgatgggcagttgatcgcggagggggatgccgagagcatcctcgccaacgacctggtcaaggaagtctacctggggcacgagttccgcctctga

SEQ ID NO: 8290 - DNA, 1512 bp, Pseudomonas aeruginosa
ggtactaagccctcagccatgaaaccatcgctagtcctcaagatgggccagcagctgacgatgacgccgcagctgcaacaggccatacgcctcctccagctatccaccctggacctccagcaggaaatccaggaagcgctggaatccaatcccatgctcgaacgccaggaagacggcgacgatttcgacaacagcgaccctctcgccgatggcgccgaacaggcggccagcgcgccccaggagagccccctccaggaaagcgccacgcccagcgtcgaaagcctcgacgacgaccagtggagcgaacgcatacccagcgagttgccggtggataccgcctgggaagacatctaccagaccagcgccagcagcctgcccagcaacgacgatgacgaatgggacttcaccgcgcgcaccagcagcggcgagagcctgcacagccacctgctctggcaggtcaacctggcaccgatgtcggacaccgatcggatgatcgcggtgaccatcatcgatagcatcaacaacgatggctacctcgaagagtccctcgaagaaatcctcgccgccatcgatccggaactggacgtcgagctcgacgaagtggaagtcgtgctgcgccgcatccagcaactggaacccgccggcatcggcgcccgcaacctgcgcgagtgcctgctgctgcaactgcgccagttgccgtccaccacgccctggctgaacgaagcgctgcgcctggtatccgactacctcgacctgctcggcggccgcgactacagccaattgatgcggcgcatgaagctcaaggaagacgaactgcgccaggtcatcgagctgatccagtgcctgcatccccggcccggttcgcagatcgaatcgagcgaagccgaatacatcgtccccgacgtcatcgtgcgcaaggacaacgagcgctggctggtcgagctgaaccaggaggcgatgccacgcctgcgcgtcaacgccacctacgccggcatggtccgccgcgccgacagcagcgccgacaataccttcatgcgcaaccagttgcaggaagcccgctggttcatcaagagcctgcagagccgcaacgaaacgctgatgaaggtcgccacccagatcgtcgagcaccagcgcggtttcctcgactacggcgaagaagccatgaagccgctggtcctgcacgacatcgccgaagcggtgggcatgcacgaatcgaccatttcgcgggtcaccacgcagaaatacatgcatacgccgcgcggcattttcgagctgaaatatttcttttcaagtcacgtcagtaccgccgaaggcggggaatgctcgtccaccgcgatccgcgcgatcatcaagaaactggtggccgcggaaaatgcgaaaaagccattgagcgacagcaagatcgctggtttactggaggcacagggcattcaagtggctcgccgcaccgtcgccaaataccgcgaatccctgggcatagccccttcgagcgagcgcaagcgactggtgtga

SEQ ID NO: 8291 - DNA, 489 bp, Pseudomonas aeruginosa
gcgcccgctgatctcccctcccctatgatccgacttgagcaaatcctgacccccggccgttccctcgtgaacgtgccgggcggcagcaagaaacgcgtactcgaacaaatcgccaacctggtagccagggagctgccggagttcgacgcccagaccatcttcgaaaacctggtggcccgggaaaaactcggttccaccggcttcggcaatggcatcgccattccgcactgccgcctgtctggctgccagagccccatcagcgccgtgctgcacctggatgctcccgtggacttcgacgcgctggacggcgcgccggtcgacctgctcttcgtcctgctggtaccggaggccgcgaccgaagaacatctcgaactgctccggcagatcgccgccatgctcgaccgtgccgacgtacgcgaccgcctgcgcagcgctcccaccgccgaagcgctttatcagatcgtggtagacgtacagaacgggcaatga

SEQ ID NO: 8292 - DNA, 438 bp, Pseudomonas aeruginosa
ccgctcatatgtaacagttgcgataggctgtaccggcgggcaccatcgttcggtctacctcgccgagcggattggcgctgcactcagggattccctgaagaacgtgcagattcgccaccgcgatctcagcagctagcccataacaagaaggacagactccccaagatgcccgccctcgagatcaccatcatcaacaagctcggtctgcacgcccgcgcggcggccaagttcgtcggcgtcgcggggcgctacccttgccaggtccgggtcggccgcaatcctgaaagctgcgtcgacggcaagagcatcatggccgtgatgatgctggctgccggcaagggcaccaacctgcacctgcataccgaaggcgaacaggaagacgaggcgttgaacgcgctggtcgaactgatcaacaacaggttcgacgagggcgagtag

SEQ ID NO: 8293 - DNA, 423 bp, Pseudomonas aeruginosa
gctcttcccagcgacagcgaaaaagccgccaactggcggcttttcctttccggcgattgcggccggcgtcaattcagcgcgcgtcggatgaatcccctagcccagcgcggtatccagcaccatcatcaggcagaaaccgaacaccaggcccagcgtagcctcggcggcatgtccctggcggtgggactcgggaatgatctcgtgggtgaccacgaagagcatcgctcccgccgcggcggccagcccccagggcaggagcagcgcagagaggccgaccagccaggcgcagagcaccgcgaacagcggctcgaccaggcccgacgcggcaccgaccagcatcgccttgaaacgcgacataccgactccggccagcaccagcgccaccaccagaccttccggcacatcctgcagagcgatgcctag

SEQ ID NO: 8294 - DNA, 999 bp, Pseudomonas aeruginosa
cgccggcatgatcagcgagaaggccgtcgccgagagcatcacgccggcaccgaagcccagcagcgcatccgacaggcgcgccggcatggtcttcaccaccagcaccggcatcgccccgagagcggtaccgaaggcgcagagcaggccgcctttcaacgccagcacgatgggcgccggcaggttgagctcggccagcaacagcgcgtggcggccgagcaggtagccgccgccgatgaagatcagcaggcccagcaggttgcgcagcgtccgcccgttaccttcggcgatgccatggagcaacgccttcatcgctgcaccgccaggctgccggccagccatctcgcatcacgggtaacactaggccagggcttgcgcatagcgacgcgcgacctcccgccagtcgatcacgttgtagaaagcgccgatgtattccgggcggcggttctggtacttcaggtaataggcgtgctcccatacgtccaggccgaggatcggcgtattgccgttcatcagcgggctgtcctggttaccgctgctctccaccagcaagctgccctggggagtcacgctgagccaggcccagccgctgccgaagcgggtcagcgcagccttggtgaacgcatccttgaacgcctcgaagcccccgagctgctcatcgatggcccgccccaggtcgccatcgggacggccaccgccctggggcgacatcacggtccagaacagcgagtggttggcatgcccaccgccattgttgacaaccggggtgcgcagcttctccggcagaccagccagttgccgcagcagattttccaccggctgctcggcatagggcgtgccttccagcgcggcgttcaggttgttcacataggtctggtggtgcttgctgtggtggatctccatggtcagcgcatcgatgtgcggttccagggcatcgtaggcgtaaggcaagggcggcaaggcgtggggcatggaaactctccgtcagtgatagcgaagtga

SEQ ID NO: 8295 - DNA, 2499 bp, Pseudomonas aeruginosa
ggggggcggagcgaggaactcgggtcggacctccgcgttcggcggtcccttgagcaggcgctcggtgcgcggataggcaccgtgttcgccgatgaacgacagcagttcgacataggtgcgccggctgtgatgctgggccgcctggcgcagggccagcggcagcttctggtcggcgctgacccgcaacaggcgctcgtggcaggcgcacaggtattctgcggtctcctccggttgctccagttgcaggtgcaagtcgggcaggttgtgatgggaaatcacgaacgccatcaccgcctcgtcggcgtcgccccagcgttccagcagcacctgggccagggccagggcatggaggtagtgctcacgcgcatcgatcaatgcgccggtgacgaaacagcggttgccctgttcgatcgttcgttgccaatgacgcatggcggtacctccagtggtggggcggcctcagaggccgccagccgtgagtttttccggatccagcaacacctccaggcgcgcacggtccagatcggtgttttccagcgccacatcgatgatcggccgtccctcgcgataggcctgcttggcgatttccgcagccttctggtagccgatgatcgggttcagcgcagtgaccaggatcgggttgcgcgccaacgcctcgctgagcttgccctggttgaccttgaagctggcgatggccttgtccgccagcagccggctgacgttggccagcaactggatgctgtgcaacaggttgtccgccaccagcggcagcatcacgttcagttcgaagttgcccgattggccagcgacggcaatggcggcgtcattgccgatcacctgggcggcgaccatcgcggtggcctccgggatcaccgggttgaccttgccgggcatgatcgaggagcctggttgcagcgcttccagctcgatttcgccgagcccggcaagcggcccggagttcatccagcgcaggtcgttggccagcttcatcagggtcacggccagggtcttcaactggccggacgcagcgaccgcggtgtcctgcgaaccgatcagggcgaagaagtcgtcgccggggcggaacgccagcccggtcaggtcgttcagctcctggctgaaacgttcggcgaaccgaggatgggcgttgatcccggtgcccaccgcggtgccgccctgtgccaactgctgcaaggcaggaagtacgctctcgatgtgcacgccggcctgtcgcacctgctgcgcccagccaccgagcacctggctcatgcgtaccggcatcgcatccatcaggtgggtgcggccggtcttcacataggcatgcacttcgccggccttgctctggatagtctgctccaggtggcgcagcgccggcagcaggcgttcgctgatctcgagggcggcactgatgtggatggtcgagggaatgatgtcgttgctgctctgcccgcagttcacatggtcgttcggattgaccttgccgcccaggcgacgactggccagggtcgccaccacttcgttggcgttcatgttggaactggtgccggagccggtctggaacacatccaccgggaaatgctgcatgaagtcctcctgcagcagttgcaggcaggtctcggcgatcgcctcgcccatcggtgcatccagttgctgcagggagacgttcgcccgcgccgccgcggccttggccagcagcagggcgcggacgaaggcctggggcatgcgttggccgctgaccgggaagttgttcaccgcgcgctgggtctgggcgccatagagggcggtcgccgggaccgccagttcgcccatgctgtcgcgttcgatgcgggtgtcagtcatcttggtttccttgttgcgggtgatcgaagctcatcgacggcgccaggtcctgcctggccattcgtacggagagctggcgcagccggcgtcgctggctgccgttggtggtcagtcgctgaagttcgcagaggggccggtaggcgtagtcgaggcagaggctgcgccagtgccagggcaatatcggatcgcgaccggtatcgagcaggaggttgtaggctttctcgaacagcggccaggcggccacaccttcccaaccggcgagatagcgcgcctcgccgaggtactggtcgagcaggcgcggttcgtcgggatcgagcgcgcagcggatctgcgtgcccagccagtaccagtgatccaatgcttgcgggtcgtgcgcctcgaaggacatggcaacctcaccagacgataatgagattgattattgttttcttcttggcaaaagacaagcatggtccccatagaggcggacaattgaacaggcggaaacgaaaacgccagcgacgagcgctggcgatttatagagggaaacccggcctcagcgcccggccaccatcatcgactcgaccagtacagaaccggtatgcaggttgccgcgccgttcgatgtccttgccgaccgcgacgatacggcggaacaggtcgcgcaggttggcggcgatggtga

SEQ ID NO: 8296 - DNA, 690 bp, Pseudomonas aeruginosa
tctgctcgacctgctcgcgaaggtccggaagcacggagggaccgactgccgcggcatgtagactcatctgttgactctcctgttgacgtggccgcccacgcggccgggccggacaagcggcccctgactcgttatcatggcggcgttttccactggaccaccaccatggctgaatttcacgacgacgactcgcaattcgaagagaagagcaagtcgcagatcaaacgcgagctgcatgccctgcaggacctcggcgagcgcctgaccaccctgcaaccgcagttgctggagcgcctgccgctcaccgacccgctacgcaaggcgctgctcgaggcgccgaagcacaaggcgcacatcgcccgcaaacggcatatccagtacatcggcaaactgatgcgcgaccaggacgtggacgccatcgtcgccctcatcgaccaggtggactcctccacccgccagtacaacgaacgtttccatgccctcgaacgttggcgcgaccagttgatcgccggcggcgacgcagcgctcgacgccttcgtcggggagttccccgagtgcgatcgccagcacctgcgcggcctggtccgccacgcccagcacgaggccgcgcacaacaaaccgccggccgccgcacgcaaagtgttcaagtacatccgcgaactggacgaaaccaagcgcggcctgcgctag

SEQ ID NO: 8297 - DNA, 1458 bp, Pseudomonas aeruginosa
gtttcgccgcgccggcgcccgggccatgcctcaggcgccggtgccgccgacggtgatcgcatcgatcttcagggtcggctggccgacgccgaccggcaccgactgaccgtccttcccgcaggttcccacgccactgtccagggccaggtcgttgccgaccatggacacccggctcatcgcttccggaccgttgccgatcagggtggcgcctttcaccggggtggtgatcctgccgttctcgatcaggtaggcctcgctggtggagaacacgaacttgccgctggtgatatcgacctggccaccgccgaggttggcgcagtagatacccttctccaccgaggcgatgatttcctgcggatcgctctcgccggccagcatgtaggtgttggtcatgcgtggcatcggcaggtgcgcgtaggactcgcggcggccgttaccggtgcgcgccacgcccatcaggcgggcgttgagcttgtcctgcatgtagcccttgagcacgccgttctcgatcagcacgttgcagttgctcggcgtgccttcgtcatccacgctcagcgagccgcgacgcccggccagggtgccgtcgtcgacgatggtgcacaggctcgaggcgaccttttcgccgacccggccgctgtaggcggagctgcccttgcggttgaagtcgccctccaggccgtggccgaccgcttcgtggagcaggaccccggaccaacccgcgcccatcaccaccggcagggtgccggccggcgcgggaatcgcctcgaggttcaccagtgcctggcgcagggcctcgcgggcgtagcccatggcgcgatccccctggaggaaatagcgatagtcggtgcgaccgccgccgccgtggccgccgcgttcgcgtcggccgttctgttcgacgatcacgctgacgttgaaacgcaccagcggacgaatgtcggcggccagcgaaccgtcgatggccgctaccaggatctgctcccagacgccggccatgctcaccgtgacctgctggatgcggggatcgagcgcacgggtagcggcgtcgatctgcttcagcaactcgaccttctcggcacggctgagcacgtccagcgggttctcgccggcgtacaggcgagccggcaccacggccttgaacgcctgcacgctgccgttctgtcccgcacgggaaatcgaacgggccgccaccgcggcctgtttcaacgcctcggcggtgatcgcattgctataggcgaagccggtcttctcgcccgactgcgcgcgtaccccgacgccctggtcgagattgaagctgccttccttgacgatgccgtcctcgagcatccacgactcggagacctggctctggaaatacaggtcggcggcatcgatgcccgggccgttcagttcatgaagaatgccgggcaggctgtccagttccagaccaccgggggccagcaattgctggctgacggatga

SEQ ID NO: 8298 - DNA, 3657 bp, Pseudomonas aeruginosa
cgggcgacccgctctccgtgctcgtcgatcagcagcgaacaggcattcgccttcgcctcgggttgcccatccggcggcagcggcaacgttccggcgactatccacaacctgaggtcgcgagcggcggaattcaaccacggcaggataggcccgttcccccgcgcctcggcgcgccccagttcggccaggtcgcgccggcccatggcggcgaagttttccggtagcacggcgagccgcgccccgccctcggcggcctgttccagcaggcgacgggcggcggccaggttggccgtcacgtcgtcctggctgaccatctggatcacggcaatggacatggtttcctccttgcggacgaaagcgccgcgtcgcggcaccgggcgccgctcagcggggcttctcgaatggcttgtcgaagctgatcttcggatcctgccaggggcccttgacgctgtattgcacgctggcgaagcgcgagacccggtcgccgagcagcttgtcgacgacgaagaccgcgccgccgaccgccggaccgccgactatcagtgccgccagggtcaggttgttggtcaatggcaaggtcaccagcagcttggcgtcgatccgatcgtgagccaggtccagggtaccgttcaactccaggttgctcgacggtccttccagcttcagcggctcgcgggtgacgtagacgccgtcggtggcggagagaacccccttcacccggtcatagctcagtcccttgccgaggatgtccgagaaatccaggcgcagccggcggttgatcgcgttgaaattgagcaggccaaacactcgcagcgcctgggcgctgccctcgacctcgacgaactgccccttgcgcagcgatgcatccatgctgccgctgaagcgcttcagggccatgtaggccggcgatcccggccactggccgttgatatccatgcggaaacgttcgctggtggcactcggcgcgaaattccaggccttgagcacatccgccaggttcttgccctcgatccggccctgataggtgctgcgggtattgcccggactgccgtcccaacgcaggctgccgttgacgtgcaggccacgcaggtcgaggtccaggtcgttgaacgccacgccgttgctgcccggccgtaccttcaggctccaggcgcccagcggctggccgccgagggcgacctggccgatcttcacgtctaccgccggcaggctgcgcggatcgacggcggccagcgggtccgagtcctccaccttgttctcgtcgggaagggtcgacttcggcaggttcaggcggtccagatcgaccacgatcggcgcgcccctggcatccggcaggaccaggcgccccgatgcgaggtcgctgaccagcaccagttgccaggcccgctcctggcgggccaggtcgacggtcaggttcttcagctcctggccgaagcccttgaagctgtcgatgcgcaggtcggcgccgcgcagcaggcccgcagcgctactggcggcctggtcgccgctgccgtagcgcttcagggtggcctgccaggcgtcccagtccagttccgccagacgcccgcgcacccgcagcccctgtgccgagggcagcaacgccgggtcaccgcccaggcgcagggcgccgcgtccgttcagcggcttgtccgccggggccgcataggccaagctggcgaggccgtcgtaacgcgcccagtaacgccgttcggcgccatccagggtcatccgccattgggtcggccgcgcctgggcggccgtcttgccgaacggcgccggcaggtcgacgacggcgcccttgagatccgaatcgatctgcaattggctgtccttgccatccagcagcaggttgagctggaacggcaggcgtcccgagaccggcaacggacgctggccagcgccgagccagtcgctcagcgacttgaccgccacctggccgttgagcagcaagcgcgtgcgcgcatcgccgcgcccctcggcgacgatccgcccgcgtacctcgctgcccagcacccgggcctgcaccgccggggcgctcagtcccttggccaggtcgaaacggaagtcgcccttcacttcgctcatatccagcttcggactgggcatcttcagggtcgcgcccacggtggagaaatccacgaccaccccggtcttgccggcctcgtcgtggtccagcggaatatccagcttcaggtggccctgcaagggcccatcgccctcccagccggcgaagatcttgcgggtcgggatcggcgcttcctggagcagcttgatgccgtccttcaggttactgtcgacggccccatccacatacaggtgcggcgtctgtcccggacggccgaggggaatgtcgaccttgacgtcgctgacccgggaattcagcagattcccgctggaggccagcacgcggactccggaatcctcgacgaacacctcgccgaccgttttgctcaaggcgggccagccgggctggtaggccagctcgccgtcgcggaccttgaagtagaggttcatgacgtgggcttcggccgccgcgccgcgattcagcgagccctgccactggaagtagccctgctcgacatggccactgcggatcgccgtcttcaaccagttcgccaggcttttgttcattcccggcaactgggtcggcaggtacttggcggtgaagcgcgcgtcgccgtcgctgaggccgacctgcaggtccatgtagtcttcagcgccgggatcgcgcatcaggcggatcagcatgtcgccggccaggcggccctcctcgccctcgacccgcatcaggtggctgccgagggtgaaggcgcggtcgtccaggctccagaacatccgcgtgcgagcctcgcggtagcgccacggctcgggaaacaccttggccaggtgcagcatgaaatcctgcgccgatgcgtcgagctggcctccagccagggtgccggtcaaggtgccgctgacattttccactgccggaacctcatggaacgccgagataccgaccttttccaggttggtcgcgtagctgacccgctcgggcacctctcgctgcggccagaaatcggcgttcaggttgtgcaggatgcccttcggcttcaggcccgccacccactccgccgccgcgtccggcagcggcgccagcgcttctatcgccggcaccaggggcgtcaggtcgacgcggtcggcctgcagcttccagtgtggctcgttgttctgctggtcgcgacgcaacagcaactccacctcgccccagcgctgctcgccgaaattcgccgccaggtcgccgacccgaaccttccagccctgcgcttcgcgatcgaagaacaggttcatgcccaggtcgttgatttccaccggcttgcgcgcggcatacgacgccttcaactgcggcgccagcagccgtgccaccagccgttgcgccttgccgtcgcgccagtcgaaccagaagtctccgccggccttggcccggacgatcttccattcctgggtcagaccagccggcaaccattgcgcccagtcgctctgcggcaggctgagatagaacctggcgctgctgcgcggccagtcctcgctgtcgatccgcccttcggcgtgcagcgccagaggttggccatccggcagttgcaggcgggcatcgagactctgcccaccaaccgatga

SEQ ID NO: 8299 - DNA, 798 bp, Pseudomonas aeruginosa
  unsure (633): Identity of nucleotide at the above locations are unknown.
gcggcgggcgcttcgttcggcaagggggactcgtcgatagcggtggcgagcacggacagcggaacgccgatctgggtcagcagttcacggcgacggggcgaggcggaggcgagatacagcgacggcatggaggctcccgggaaacgcgtcgggcgatgcgccgatcacccgtttcgaagaatgacgtatccgccgcagcatagctgcgaagcggacctacctcacgttgagacgcaggcggacgaactgcagcagggcgtacacccagggccagagcagcgcgctgaccagggccggaagcaggaaggtcagggtcggcgggcgattgccggtcagggcgttgagccagagctggagcagttgcgccaggccgtagaccaccaccagcaccaggcactgctgccatgccgggaacatgcgcaggcgctggtgcagggacagcacgaggaaggtgatcaggccgaggatcagcgcgttctgcccgagcaggttgccgtagagcacatcctgggccaggccgagcagccaggcggtgaccatcccgacgcgctcgggcagcagcaacacccagtaggtcagcagcatcgccagccacagcgggcggccgatctcggtgaaggtaggcatcggcgntacggccagcaccagcccgaccagcaggctcagccagatcacccagacattgttcgaaccctgggtcgcgcgagccatcagcggcgccccccgttggccgccggagcggcaggctgcgtgggagctggcgagggcgcggcggcgggctgctgcgcagcgccctgg

SEQ ID NO: 8300 - DNA, 360 bp, Pseudomonas aeruginosa
acccctccaagcgtcaatcccgggaaggcatcacgggaattcagcacagtccaaaagcaagtctcggacggcccagggttgcaccctggacgcaagcaagatggtagggcgtgccctaacaacccgttttgcccgccgagggctcaggaggcagggacggaagagctgtccttccttcccgagctgaggctgttgtccgaggtggttcaagggttcgctccgcccgggactccgtttgtcaccgcaagcgctgacaagccggggtcgcggcccttgacctgccggggcttccgaagggcggaggatccaaaaagcggggcggcgttatttatcgtgacgggccgcggtgcgtcacattaa

SEQ ID NO: 8301 - DNA, 216 bp, Pseudomonas aeruginosa
caactcccagaaataatcgaacgcatcctgagcccacttaaagaaatcctcgatagctttaagtgcacgctgaaagaagtctgttgcagtctgaataagctgcttaatcgcactaagaataccgtccatatatcacctcatgccgacaagaatacgcgcacagacagcagcgcccaaaacgccaggaataccgctttcaagatcggttcaatctga

SEQ ID NO: 8302 - DNA, 429 bp, Pseudomonas aeruginosa
gtcggacaacttcccccggtcgggaacgtaatcttggccagggcctgcccaatcggcgcattcttgatatccgtccaagccttttgcagcgattcgtcaaagcccggaaccttgtccttgccgaacgggttgttcttcacgaacgcgcagctatcgtccttacagccgccttgcaaacccgtcccgccaccggtaccaccgccctcccctgagccgtcgccaccaccacccgtaccgccaccatcgccgccagtaccgggcgtgccaccaccatcgccaccgccaccggttccaccatcgccaccaccatcaccacccccgccagtgccaccgtcgccgccaccatcaccaccgccacccgtaccgccatcaccgcccggaccacctgaaccgtcagacttcacgcacgtggtcccggaccagctgtag

SEQ ID NO: 8303 - DNA, 207 bp, Pseudomonas aeruginosa
attcagagaagagttcggcgggaaggaatagcgatgcgggcagagagggacgacgactttccgcccgtcagaagggcaacagaacgacggctagcctatgagatcgctctagggatatggctgggtggaatggctctagggcttacatcgttcgttctgtggttcttcgcactcagcgcaatggtcggagcgctaaagctcggctag

SEQ ID NO: 8304 - DNA, 489 bp, Pseudomonas aeruginosa
cccatgcccagccagcatggagacgcaaccatgatcgacccagcagacaagcaaacccaagccctccccctggagcagccgaagcgcgggcgcggtcggccagccaccggcaaagccctgtccgacgcagagcgggcgcggcgctacagggcgaacaagaaaaatcgtgacgcccaatcgtcacgaaaagaggccccatcgatccccgctgatggcgtaaatgaaatcctcgacggctggcagcgcacccaagaggaactcgaccaggcactgcaacgaattgccgagctggaagccgaattagcgtcacgcgtcacgaaaaaagaagaagccgaggcgaaaacttgggcaattcaagagcgcaagggcaaagcgcgctggcagaccatcagcaagggcctgacccggaaggccggcgagcgccagttcgacaagctgctgtcgggcctgacagatccgcgctacacctaccgcatgattgaagaataa

SEQ ID NO: 8305 - DNA, 243 bp, Pseudomonas aeruginosa
cagcgcaacacgtgcaagaataacgaccaccccttgttacaggtaaccgtcatgtcaaagccctaccgggttcgagataaattcgtcgaggaagtgaaggagcgccgcgtcaaaatgatcatcgagacaaaggacgacgtccgggagtccgaccttgtgaacgccacgctgtggaaatacctgagcaagatcacgacgaaagacgttcttgaattcagagaagagttcggcgggaaggaatag

SEQ ID NO: 8306 - DNA, 417 bp, Pseudomonas aeruginosa
agctcggctagcagaaagaccgcagaagtgtgcggtaaattgggggtgttacagcacccccacccctccagcgtcattcccgtgacgcatcacgcgaattcagcacagtcaaaagcatgtctccgacggccagggttgcaccctggacgcaagcaagatcgtagggcgctgccctacaacccgctcttgccgccgagggctcaggaggcagggacggaagagctgtccctccctcccgagctgaggctgttgtccgaggtggttcaagggttcgctccgcccgggactccgtttgtcaccgcaagcgctgacaagccggggtcgcggcccttgacctgccggggcttccgaagggcggaggatccaaaaagcggggcggcgttatttatcgtgacgggccgcggtgcgtcacattaa

SEQ ID NO: 8307 - DNA, 1296 bp, Pseudomonas aeruginosa
aaatacatatcaggccaccaaccgcaggtgacgcgggcgcggtgcatgccgatagaactccggcagctccagcacgtcgctggtgacgatttcctcagcacgacgaatcatcacgaccgaatgacgggtcacgtcgtagggctgggcgatgttgatgccgatccggttcaagcgcgcccggtaggtctgattcatgcgtttcttgaagtcgaaactgatgcccgggcagtgcatccatttcatcgcaatattggcggtcgcattagccgcttgagtgctgcctacaaccccttcagaaagcagcctttccgcaatcgtctcgtaatccatcgccatcacctcgagcttgtcgaatcccctcagaaactccccatggatcgccgcaaagcggccttcatcaaaaagcccccaccactccagccgctcacgggccagatattcactcttgagttcctgctccatgcgcacgacgccctgctgatcgcagtacgcggccagatcgagcaggtagcggaattcgggggagtcttcgccaaagttccgtttgcacttcggaaacaggaacttgcggatggcctgagccttgccgtaggccttgtaatagtggtcgcgggcctgccagtcgcaggtccaaccatcttcgtagaggtggccgttcttgtagcccacacgctgagtactcagggcgcggatgtaggccaattcattgcccttccccaccgtccgattcgtcgtcaagtcaacccggcgcaggcgcgcaccgttgccgatcatccgagttttcgagccgtcctcggtctggaggtggccccaatcagtgcaagccgtgaacggcggcagacggttgcccttggcgtccttgatctcatgaaggatgtcgttatagaccgcgacgcactcagcaatggactggaatccatgcaggttgtccaaacggttgactgcactcggattcccttcaacgcggagcttgttcccatcgacccgaacccgaatcgacgtcgagtgactgccctcaaccttgaagctaggagacgtgtcgcgcagttgctcgccggtcttccggtcgtagtagcagatgccagtgtcgccaacctgcgggagctggtacgggaatgcctgctctaccgtgaggtagtcgtagaacatcctgctctgatgatcggtcggaggaaacatccctacccctgcatgcctgtaacaacgttacacgttacgtacggggcaatttataccgcagtaactcgtaacagcgcaacacgtgcaagaataacgaccaccccttgttacaggtaa

SEQ ID NO: 8308 - DNA, 489 bp, Pseudomonas aeruginosa
atccgctgctcgaaccgagcggcaacacctgcgccgggccttcgtgacggctcgtcgttcaccagtatcaccggcccggccggggatcacgtatgcgcctgctcggcgctggagaaagagaccatgaagattctgaaagggtacgtcctgggcgtagtggacaagggggaaggggacaagcgttgggccatcgttggcatcaaggcgaccgacaaggaccgtgacggctttgacgtggacactacgtacaagctgcgcgttttcggcgatgccgtgaagaacggcctgcataacgcctatcgcaacctcgctggtgtcgaggtctacgcgccctacaacgatgagttcgacgagaagtacaagcgcattagctactcgctagcaggcgcgcccttggccctgatggaaaagcccctggggaccgcccaggcgaagccggctgctccggcccagccgcaggcggcgcagcccgttaagcaggcttcctga

SEQ ID NO: 8309 - DNA, 363 bp, Pseudomonas aeruginosa
tatatggacggtattcttagtgcgattaagcagcttattcagactgcaacagacttctttcagcgtgcacttaaagctatcgaggatttctttaagtgggctcaggatgcgttcgattatttctgggagttgctaccggttctgcctgagtatgtattccataggcttgtgtcaggcattgtgaagttctttcagtggctgccggtgccggagttctttacgcaggcaggcaatgcgttccaggcgataccgccgtcggtggtgtatttcgccaatgcgtttcagattggccctggcgtgacgatggtcctgggcgcgtatctgctgcgattcattctccggcgcattccaattattggttga

SEQ ID NO: 8310 - DNA, 1197 bp, Pseudomonas aeruginosa
cgttgttacaggcatgcaggggtagggatgtttcctccgaccgatcatcagagcaggatgttctacgactacctcacggtagagcaggcattcccgtaccagctcccgcaggttggcgacactggcatctgctactacgaccggaagaccggcgagcaactgcgcgacacgtctcctagcttcaaggttgagggcagtcactcgacgtcgattcgggttcgggtcgatgggaacaagctccgcgttgaagggaatccgagtgcagtcaaccgtttggacaacctgcatggattccagtccattgctgagtgcgtcgcggtctataacgacatccttcatgagatcaaggacgccaagggcaaccgtctgccgccgttcacggcttgcactgattggggccacctccagaccgaggacggctcgaaaactcggatgatcggcaacggtgcgcgcctgcgccgggttgacttgacgacgaatcggacggtggggaagggcaatgaattggcctacatccgcgccctgagtactcagcgtgtgggctacaagaacggccacctctacgaagatggttggacctgcgactggcaggcccgcgaccactattacaaggcctacggcaaggctcaggccatccgcaagttcctgtttccgaagtgcaaacggaactttggcgaagactcccccgaattccgctacctgctcgatctggccgcgtactgcgatcagcagggcgtcgtgcgcatggagcaggaactcaagagtgaatatctggcccgtgagcggctggagtggtgggggctttttgatgaaggccgctttgcggcgatccatggggagtttctgaggggattcgacaagctcgaggtgatggcgatggattacgagacgattgcggaaaggctgctttctgaaggggttgtaggcagcactcaagcggctaatgcgaccgccaatattgcgatgaaatggatgcactgcccgggcatcagtttcgacttcaagaaacgcatgaatcagacctaccgggcgcgcttgaaccggatcggcatcaacatcgcccagccctacgacgtgacccgtcattcggtcgtgatgattcgtcgtgctgaggaaatcgtcaccagcgacgtgctggagctgccggagttctatcggcatgcaccgcgcccgcgtcacctgcggttggtggcctga

SEQ ID NO: 8311 - DNA, 252 bp, Pseudomonas aeruginosa
aagagcttaaggagtaagtctatgaaaaacctgaaaaaactgttcgttcgtggtggttctgctgttgctgtaggcgctgccctggtcgtctcgcaatccgcctcggctgccggctgggactacagctcgctgacctctgatgttgatttctcgaccatcgcgaccggcgtgctggccgtcgctgcgctgctggccgccgtgtatgccggcatcaagggcgctcgcgtggtcctgggcttcctgcggagctga

SEQ ID NO: 8312 - DNA, 1395 bp, Pseudomonas aeruginosa
tcgaggagggtggttggatggggcggcttcggtcgcccctttttgtttctggcaggggagtttgatcgatggcggatttatatgagttcgcgttctttgttattggcgctgcgtgttcctgggcgatcttttcgaggtggtaaaatgtttaggatgctagttctatttatggtttttttttgctgttctagcgccagtgctgatgctttttggtggcaggttaatggtattgatagtttgcgggacaagtcgttcgcttctcctggtgaggggtgttcggcggtgctggcctattttcagtctcagggcagcgggtacagtttttcgtttaattatttgaggcgtaattctgatgtggagtttagctgttctttgaagcgtttggatcaaggcgagtttgttggcgaggttggtgcttctataggtaggtatggtgatgcttgtccgattgatactcggtatgatgatcaaactggcgaatgcaagcctgagtccaagcagtgtgaggctgggcaaacagatttatttgcaagtgcgccgtctccagttgttcagatcagcgggcgaaatcaggttttaagcactccgccgactggttgcaagggtggctgtgcgtatacgccttcaagttcgaagacgcgcagttgttactttgttccagggtcgcaaacagacggtttctgtaactatctgcttacctctgatggtaattcgtgcgccgctgattcgggtaatcctggggcagttggcccgccgttgaatccgaccccgccgaccgatcctgatgagccgccatcggaccctaacgaccccggctgtccgaccggctacagctggtccgggaccacgtgcgtgaagtctgacggttcaggtggtccgggcggtgatggcggtacgggtggcggtggtgatggtggcggcgacggtggcactggcgggggtggtgatggtggtggcgatggtggaaccggtggcggtggcgatggtggtggcacgcccggtactggcggcgatggtggcggtacgggtggtggtggcgacggctcaggggagggcggtggtaccggtggcgggacgggtttgcaaggcggctgtaaggacgatagctgcgcgttcgtgaagaacaacccgttcggcaaggacaaggttccgggctttgacgaatcgctgcaaaaggcttggacggatatcaagaatgcgccgattgggcaggccctggccaagattacgttcccgaccgggggaagttgtccgactcagagtgttgagctgttcggtaagagtgtgatgttcagttcgcattgtgacttgtgggctcagattgaaccgatcttgaaagcggtattcctggcgttttgggcgctgctgtctgtgcgcgtattcttgtcggcatga

SEQ ID NO: 8313 - DNA, 321 bp, Pseudomonas aeruginosa
cgtgctcgccccgactctcgaagctctcgcgttgctcgccggtgctgcaattctgattcacgccctgggcgtgtgggctcgctcatgagcgcctacagcctccagggcgtgtccctatcttccagcgagcgtcggtcgctccagcttcgccagcaggcccgcgccgctgtcgatcgcagcgtgttgcaacagaccgtcgcccaagcgctccaggcgctcgaaaagcacaaggaggagggcggcaaggcttccaatccttggatcactgtcatcaacgaaaagggcacgccgtgggtcggtgatgcattcgggtggtcgtga

SEQ ID NO: 8314 - DNA, 240 bp, Pseudomonas aeruginosa
gcaggcttcctgatgatttccgccctgtcctgcgatggctccatctcgattgcgccggatggggcacccctgtgttcgggcatgtgggtcttgacccatgtgccggagcagttcgacccgtcgatgctggacaccgaagcactcgcccaggcgttctcggtcgggttcggtcttgtcgcgacggtcttggtcggcgccctgggcgtcaaggccgtactcgacttcattaaaagagcttaa

SEQ ID NO: 8315 - DNA, 1269 bp, Pseudomonas aeruginosa
tgtatggcaattgatgcgtatgtgggcaagcctgggcacggtaaaagttacggcgtcgtcgaacacgtaattatcccgtcgctgaaacaagaccggcatgtcgtcacgaatattccgctcgaagtcgatatgttgctgatggatttcggcgggactattgagcaactgcctgaagactggtttgagcgtgaagacttggctgactttgcgccgcctggttcggtcctggtcctcgacgaactctggcggcgctggcccaagggtcagaaaaccaatgatgcgccgatggccgacaagaaactgttggccgagcatcggcaccgcgtagacaagaaaaaccgctcgatgcgggttgtcatggtgacccaggatctcgaccagctggcgagctgggcaacgttgctcgtcgaaacgacgtaccggatggtcaagaagtcgaagacaatgttccgggtcgatatttacaacggtgtggcgaagggcgacagcccgccgaagtcgaagctgctgcgcagcacggccgggcgtttcaagcctgacgtttaccggtactacaagtccgctacgcagtctgaaacgggcgctgtgggcgatgagtcgaaggccgacacccgtggctcgttttggcgatcctggggcttctgggggcttgttgggctgatcgtggtctgtctgtccgtagggattcccggcgtcgtccggttcttcacgccaccgcagcccaagcaagcgtcagcgccgactcccgcggctaaggttgttgagcaggtgcagccagtggcggctcccgcggggcgtgcgatgcaagcggtctacggcacgtcgtcgaatggacctgtgccgtctgcgatctggcggattgccggctatgtgcatgccggcctgggccgggctgaggcgtggccgtcgaaggatggttacaacgtggagccggatcgaccgatcagcaagacgtcacgcgtggtgctggtgtccgaaggtggccgtacaaggttctggccgattgagaaatgccggttcttcgaacagactcccgacctgtattgcgacatcgacggcgagcgtgtgacgttctggacgggccgaggggccgtatcgactgtgatggatgcgacaagcaccgcgagcggcggcagccagcgtagcgcagcgtccgccgcgaccggtgcgcaggtgcagaccccgcattcgtttcagccgcagcagccgtcccagggaacccgcgtgaccgtagtgtctgataacagccgctcaccccgcacgttgtga

SEQ ID NO: 8316 - DNA, 489 bp, Pseudomonas aeruginosa
ctccggactggtgatttacacgtaacgtccgttatgcgatgccgctccgggtttttcgttaccgtaacggaaaatccttgctttcggtccggcagggcctatgattcgaatattcgttacggtaacggaaattcgaagatggccaaggatacccgcgatacccagaccctcgacgccttcccggccaagccatccaggggccggcctcgcaaggctgacgcgctctccaatgctgagcggcagcgcctctaccgtcagcggcaggcgggcaaggcaccccaggtggacgcggatgccctggtccgtctgcagaacgaattcgaccggcacgttgataatgcgcgcgctctggtcgcccatcttcgaaagaccattgcgcagatggagcttgaggtggatctgtgccgccaagagcgatccgatgccatgcgcgtcaacagcatttaccgcgagcgtctggagcttgctggtctccctacagactactag

SEQ ID NO: 8317 - DNA, 531 bp, Pseudomonas aeruginosa
acggcgccgtatggcgagcgtccaccgcacactcgtcccgtccggaggttcgccatgcccagtcgcctgtcactgatcgccgccctgctgttgcccctggccgtccaggccgaacccgctgatacccgggccctgctcgccgacagcctggccgacagccaggcccaggtggaggcagccgagcaagccatgcgccgttccgaaaacaaggcggtgcagctctatgccaagcgcgtactcaccgaacagcaggagttcgaccatcagttgcgcgccctggccggggaaaaggccttggcgctgccctcgccgcgccagaccgaacggcaggccgccgctcccggcggcttcgacgagcgcggtttcctcgacgcgcagattcgccagcaggaccgtctggtcgcacgcttcgagggaatcgcccgggactccgccgatcctgacctgcgccgcttcgccgacgaatggctggcgcgcttctaccaccaccgcgaactggccgaccagttgcgtagcggccgcgccgactga

SEQ ID NO: 8318 - DNA, 1443 bp, Pseudomonas aeruginosa
gaactcgctgtaggggaaagtgctgccgacgatcagcagggtgtcgcaatgctccatcagcatgctgctggcgcgggtgccgagcaggccgatggagccggtcacgtacggcaggtcgtcggaaaccgccgccttgcccaggagcgccttggccactccggcggccaggcgctcggcgaccgcttccagttgccggtgcgcgcccagggcgccggcaccggcgaggatcgccacgcgccggccgcgattgaggatcgccgcggcggcctccaggtcggcgtcgcgcgcgtagggtcgcggctggacgaagcccaccgccgacatcacgtggccgtgctcgtggggctggcgcttcggggccgccatctgttgcacgtcgttgggcacgatcaccgtcgccacctgccgctcgccgaccgccacgcgcagggctcggtccagcacatggagcagttgtgccgggctgaccacggtctcgacataggcggaaacgtccttgaacaagctctgcagatcgacttcctgctggtagtcgctgcccaacgcggtagccgcctgctggccgacgatggccagcaccggctgatgatccatgcgcgcgtcgtagagcccgttcagcaggtggatcgcgcccggccccgaggtggcgaggcacaccccgacctctccggtgaacttggcgtgggcgccggccatgaaggccgccatctcctcgtggcgcacgcggatatagtcgaatgcctcggcgcgccggcccatggcgcccatgatcccgttgatgccatcgcctgggtagccgaagacgcgcttcaccccccactggctcaagcgttcgagcaattgatcggcaaccgtgctggacattctcgcctcctggtcgtgtctggggtcgtaccagtgaggactggcgccgcggggcaagggtttcaaggcaatcgaccggcggtgccgacggcgaaatcgactgaactgtcggattctcgaccgggcccaggaacagggccccgcatgggcccttccccaggaggttgccgccatgacccccgccatcaagattccgggaaacgaagaccccgggtccctgctgggaaaccgaacgccgaccccccggctcggcggtgccgccgtccgaagcgcccggataaagccctgccgggcccgcgtcccaggaatgcatccggcgcgtgcgagcgctacctggcgttttgcaccgagtccagcagggaacaacgccagcacgccggcgagtgcgccgacatctgccgcctcgccgctctgctgctggagcgccgcagcccatgggcgccggccgcctgcgagctggcggcgcgctatgccctggcatgcgcggagcgttgcgatggcgacgagccgctggagcgcgaatgtgcgggtgcctgccggcgcttcgtcgaggcctgtcggccgttgttgccggcctga

SEQ ID NO: 8319 - DNA, 558 bp, Pseudomonas aeruginosa
accgacagggatgtcgtccttgatgacacaatgcggaccgacaaacacatcgtcgccgatagcgatgtcacccagtacacgcgtgaaggccccgatttggacgcggctccctatggtggggtgacgcttaccggcgggattagccgatatgccagttgcccccaataccacacctccgaggatgtaacagtcatcaccgattaccgctgtctcgccaatgaccgtgccatgcccatggtccaggatgaatcgactgccaatcttgcatcttgggtggatttccgcgcccgacaggagctttccacgagaggagaccaggagcgcggtagcctccaacgctctctcaggatcgccttcagatgtgcttcgcagacacagcatgtgggaaagccggtagtgcagcactgccttgaacgagctgtagccaaacgcaatgtcggatgtccgtccctgtgcggctggatccttgctggcgaatgcctgcaggtcttcctcgcaccaacgtctggcttcttcgaacatcgaatgagcgactatccgctccaccagttggggtga

SEQ ID NO: 8320 - DNA, 309 bp, Pseudomonas aeruginosa
ggacttgcccaggccgacgagggccttcaccgcctcggttgcctgcagcaggccaatcactccaggcagcacaccaataactccccctgcgttacagcttggagccatctcaggcgggggattgttcgggaagagacattggtagcaggggcctccctccagattgaagacgctgacctgaccttcgaaccgatagatcgcgccaaagacgagtggttttccgagcttggcgcaaaccgcgttgaccaagtaacgtgtggcgaagttgtcggtgccatccaataccaggtcatagctctgaatcagtga

SEQ ID NO: 8321 - DNA, 411 bp, Pseudomonas aeruginosa
cgctgcaatcgcaccgcgacgccctgctcaccggcccgttgcgccaggcgcaggctgtcgtcgcgcagcagttcgtcctcgccgacctgtaccagcagcggcggcagccccgccaggtcggcatgcagcggcgacaaggcggccgagcctggctccgcgtcggccggcagcagcaggcgcaccgcgctttccagccaggcccgcgacagcagcgggtcgccggccgccggcgtgtgcaggcgctggcagccgaggtcggtccagggcgagaacagcagcaacccggccggcaacggcaagccgcgcgccttcagctccagggccagggacagcgccaggtggccgcccgcggagtcgccggcgagcagcagccggcgcggcgaatggccggcctccagcaatgccaggtag

SEQ ID NO: 8322 - DNA, 1830 bp, Pseudomonas aeruginosa
agcacccggcgccgcgcctccaccccgcgcggccgcaaccactcgcagggcacgccggcgaggctgcggcgctcgcggacgacgccgccggcgcccagcgtcgccaggctcagcccgcgcaacacgccgcgttgcagcgccactggcatgggcggacggaccagcccgcggaacaacaggcgcaggcagccgcgcaggagaccggcgcgcaggcgttgcggcggcgacatcaggggcgcttcagcgggccaggtcatagtcggcaagctccggccggcgcgtacgccagcgatagacgaaggtgtagcccggccagttgttggtgttcttgccggcggcagtcttgtaccagctgtcgcagccacgctcccagacggtatggcgcaacccctgttgcacctccaggttgaagcgccgctggacctcgggcttcacgtcgaggtagcgcaagccctgctcctggagctggcgcaggcagccgagcacgtaggggaactggctttccagcatgtagacgatggagttgtggccgaggttggtgttcggcccgtaaaggatgaacaggttggggaagccgctgacgctgatgcccttgtaggcttccgcgccatccgcccaggcctgccgcaggtcgcgtccgtcgaggccgaggatgcgcatcggggcgaggaactcggtggcggcgaagccggtaccgaagatgatcgcgtcgacctcgtgccggcggccgtcacggccgaccacggcgtcttcggtgacttcgcgaatgcccgtgtcgaccagttcgacattgctcctggccagcgccgggtaatagtcgttgctgatcaggatgcgcttgcaacccagcgggtagtcgggaaccagccgcgcgcgcagttgcggatcggcgatctgccggtgcaggtgacgatggaagctcagccgcatcaccttcatcagcgccgggaaggtcgcgaaggcgagcatccgcgattcgtggtgcaggtacttgagcccccgatccaggcgttgcagccacggccagcgcgccttcaggcggcgttcccagtcggcgtaggtgcggtccggcttggcgatcacgtaaggcgcgctgcgctggaacagcgacaggcgttgcacctgcggggcgatccgcgggacgaactggatggcgctgggctccggtgccgatcaccgcgacccgcttgccggccagctcgacctcggcgtcccagttcgccgagtggaacgccggaccctggaagcgctccaggccgggcaggcgcggcagcagcggccggctcaactggccggtggcgcagaccagggcccgtgcgcgcagcgtctggccatcggcgcagcgcacctgccattcgccgctgccggcgtcgaaacgggcctcctccacctcgcagtggaaacggatcttctcgcgcagacggtacttgtccgcgcaatgccgcaggtagtcgaggatttccgcctgcggggcgaacttgcgcgaccagtcggccttcggctcgaaggaaaacgaatagagatgcgaggggacgtcgcaggcggcgcccgggtagcggttttcccgccagcaaccgccgacatcggcggccttttccaggaccagataatcgtcgatgcctgcctgtcgcaggcggatcgccaagccgagaccggcgaagccggcgccgaccaccagcacccgcaagggggcttcagggcgggactcgttgtgcattgttgtgctcccgtttgttgcttgccacgccgtccggcgcgattccgcccagcggcggatggcagcatcctagttcgccggggcgactggcgttatggccgggccggacataa

SEQ ID NO: 8323 - DNA, 1068 bp, Pseudomonas aeruginosa
agttgtgattttcggtcaacctcggacgccaccatgcccactccgccttggtctccccgccgcagcgccatcagcgcgcacctgctgatccagttcggcatcgaccgcggcctcggcctggagcagtgcctggcaggtagcggcctggatatccgcctgctcggcgatccctccggggaaatcgacgcggcccaggaactgagcgtagtgcgcaacctggtccggcacctgggcgacgcctgcgcgccgggcctggcggcaggcctgcgctatcacctcaacgcctacggcatctggggcttcgccctgctcagcagcccgaccttcctcagcgccgcgcaactgggcctgcgctacctcgacctgaccttcgccttccatggcatccgcctggaggtacacgacgatgaagcgcacctggtgctcgacgacgccggcattcccgaggacctgcggattttcctcctcgaacgcgacgccggtggcgtgctgcgcatccagcgcgacctcaccgggcagcgcctgccgatcctccgcgccggcttccgccgcccaccgcccgccgatcccgcgccctacgtgcgcgagctgggcctgtgcccggcgttcggccaggcggacaaccgggtggtcttcgaacggcgcttcctcgacctcccgctgcccggcgccaatccagaggtggcgcgcgcctgcgaggagcagtgccgcgccctgctcgcccgccgccaggtgcgcggcggtctggccggacgcatccgcgaccgcttgctgaggacgcccggccacttgccggacatgcagaccctggccatggaactgcacctcaccgtgcgtaccctgcgtcgccgcctggacgacgagggcagcagctaccgcctgttgctcgacgaggtgcgccaggccctcgccgaagagctgctggccaccggcgcgattcgcctggaggagatcgccgagcgcctcggctacggcgaggtgtccaacttcagccatgccttcaggcgctggaaaggcatgacgccgcgccagtatcgccagcggcgacgactcgacgcgatgtcctga

SEQ ID NO: 8324 - DNA, 1278 bp, Pseudomonas aeruginosa
ggccggaaggcctccgcgacccaggccagggagcggtcgtggacctccagccagccgctggcccaggcatcctctccggcctgcatcgggccctgttcgagcaggccgccggcatcgaacagcaggctacgtcgtgccgccaccgccagctggcgtccctcgccggtggtcagccgcgcgctgccgcgcagggtcaccaggcggatcgccccgcgctcctcggccagcagcaggctgccgctggcgcagtccacccgtccggcggcgcagtcgagggcgaaggcgccgcgcgggtcctccttcacttccaggcgcatcgcgccgcgccgcagctccaggcgtcgctgggcgccgtcgagcagcggtcgcgccttgctccgcgcgttcaggcgcaggcggctgccgtcggccagcaaccagtcgcggcgctcgccggtgccggtcgccagttcgccgggcagacccatgccggcctggacccagcgctccaggccggcgccgccggcgagcaggacgaacagcccgagggcgccgccgacgaagcgccggcggctcgacggctgctccagggcgcgcagcacggtagcgctcggctggccgcgccagggcgagtcctgtagcggcgcgaggctgccaagcagttgccggaacacctcggcatgctcgctcgacagcgccttccagcgttccagggcatcgccctcggcggcgctgaagtcgccggattgcaggcgcaccatccattcgatggcctcctcgacgatgcgttgccgttccggcttctcgctcattcctggaatccccggtagcagcagtgcaaggcatccttcatcaactggtggatgcgccccagggacaatccgaggcgttcgccgatctgcacgtaggtcaggccttccagctggctcatcaggaacactgccctggcctgcccggacaggccgtcgagcaggcggtcgatggcttgcaggctctcgatcagcatccactgctcgtgaggcgacggctgcaccgcctccggcgcctcggcgaggatctgcaggtaggcgcgctccaggtccttgcgccgccagctctcgtacatcaggcgttgcgcgatggtcgcgaggaacgcccgcggcgagcggatcgacgccgggtcggggagcatccagacctgcaggaaggcctcggcggcgaggtcttcggcgctgtggctacagccggtctggtaggacagcttcttgcacagccagtcgtagttctgctggaacaactgggcgatcagggtgttcttga

SEQ ID NO: 8325 - DNA, 477 bp, Pseudomonas aeruginosa
acggtgaactggccggtcatctgcaacagcgatgccaggtgggcgaacggcacccggccccgggccagcgcccgcagttgctccgccggggcgatgccgggcgcgccgcggatggccggcagcaggcgcaggagcagcggcaggccgagcaacgcgaccccggcgagcagcaggaacaggctacgccagccccagaactcgccgatcagggtgcccagcggtacgcccagcaccagcgaggcgacgatgccggcgaacaccagaccgatcgctcggccgcgccgttccggcgcgacaatggccaccgccagggtgatcgccaccaccacgatgaccgaggcgctggccgccaccagcagccggctcgccagcaacagggcgaagctcggcgcggcggcgctggccaggttggcgccgatgaacgccagcagcgcgccggccagcaggcggcggcgctcgataccggcgctgaggtag

SEQ ID NO: 8326 - DNA, 1083 bp, Pseudomonas aeruginosa
accagcgcgtacaggctcatcagcaacccggcccggccctggctgacggcgaaactggcggccagttcgtcgagcaccccggccaccaccagttccaccgtgccgaccacgaaggccagtccggccagcagccagacgccgacctccgccctgctccgttcagtctcgcccatggctgcgtgcctccccgtcgatggcgtagcgatagcgcccgagcatgaccagcagccctgccgccacgccgaacgcgccgagcaggaccagcgtcgagcccgcgtaggagcccgcgcggtcgtagaagtaacccagcagccaggaccccaggctgatggcgatggcgaaggtgaagggctggatcgagccatagatcacgctgaaatggcgcaggccgaagtagcggctgacgaagtactgggtggtgccggtctcgccgccggcgcccaggccgatcaggaacaccgcgccccagagcagcgccggcggtccgccaaggagcaggagcagcagcccgagcgccgccagcagggcgaacggcaaggcgatgcgcggggtgtcgtagcggtccagcaggtagcccagcgccggttgcgaaacgatcatgccgacccacagcgccgccagcacgtcggtggcgacttcccgcgacaggccgcgctcctgcaacagcggcacgccatgcaccatcacgccagtgacggcgaacacgccgaggatcaggttgccgacgatcagccagaagtccgccgagcgccaggcctggcctggcgtcgctccgggcagcgcgtcggctggcgggcgccgcgcctgcggcaggtcgccgggtcgctcgcggaacaacgcatagagcagcggcagcgccaggaggccttcgagcaggccatagacgaggaaggtggcgcgccagccgaaggcgtcgatgcaggcgctgcccaggtacagcgccagcggcccgccgacgccgaagccgagtccgaggatgccgtaggccgcgccgcgacgacgctcgaaccagccgccgagaatccgcgcatagggaatgttgcccggcgtcagcaggccgagcagcgcgaacagcaggtatag

SEQ ID NO: 8327 - DNA, 846 bp, Pseudomonas aeruginosa
actgttcgatcagcgcctgggcgcggaagaacaccgcctgccaggcttcggcgcgcaggtcgtcggtcgccggcagatcggcgaatatccgcgcgctggtcgccacccagtcccccaggtcttcacgccgatggcgctcggcgacgtaggcggacatcgccgcgtgcacctcgaacacccgctgtcgccagagcgtcgcctgcgccgccggatcgcgttcgacggcgctcatcggagcgcctcccggtggctggcgagaaaccccagcaggtgctccagcacggcgtccggcacgtcctcgggaagcatgtggctggcgccgatggcggcgccctcgacctgcccggcccaggtcttccagatttccagcggatgctgcccggcggcgtaggggcgctcctgccagagcacctggaccgggcattgcaggcgccggccggcgtcgcgatcggcctggtcggcgtcggcatcgacgcccaccgcggcccggtagtcctcgcacatcgcatggcgcacggcggggtcgcggaacgcccggcggtaactttccagcgcctgcgggtggtagatgtcgcggccctgggccatgcgtcgcagggtgtagtcgaggaagtgctccggatcggcgccgatcaggcgctccggcaggtcgtacggctgggcgaggaggaaccagtgataggcgttgagggcgaaggccttgttcaccgcggcccagttgtcgaggatcggcaccacggtcagcgagacgaaggccgcgaccgcttgcggatggtccagcgccaggcgatagccgacccgcgcgccgcggtcgtggccgatcaccgcgaagcgttcgaagcctag

SEQ ID NO: 8328 - DNA, 1008 bp, Pseudomonas aeruginosa
tgtcgaccccatggcgggtcagccagcggtccaggttcagcaggtaggccaggccggcggtcgggctcgccgaggcacgcgggctgggcagcggcgtgccctgttcgagagcctggcggacccgcccggcgtccaccagttcgaacagcggcgagcggccgtcgtcgagcaggcggccgacccgctcgcgcagcagcgccaggtaacgtgggtcggggttggccgggaaaccgctcttgcgccgctccaggatcgcctgcggcaggtgcccgcgcagggcccggcgcagcaggctcttgctttccccggcgacgctcttcagcgcccagggcaggttccatacgtactccaccaggcggtggtcgcagaacggcacgcgcacttccaggccgaccgccatgctcatccggtccttgcgttcgagcatcgccggcagccagcggctcagcgccaggtaggcgacctcgcgctggcgtcgctgggcggcatcctcgccatccagccgcggcacttcggcgagggcctcgcggtagcgcgcccggatgtattccggcgccgccacccgttcggcgacctcccgccgcagcagttgccagggcccgctcttgccggccagccaggggaagccgtcgtgtgcgagggcgctcgggtcgtggaagaacgggtagccgccgaacacctcgtcggccgactcgcccgacagtgccaccgtggtgtgctcgcggacctggcggaacagcaggtagagcgaggcgtccagctcgccccagccgggcaggtcgcgggcctggagcaccgcctcgtcctgttccagcacctcttccggggcgaccagcacggtacggtgcggcgtaccgaggaagttcgccgccagctgcgcatagggttcgtcccagctgctttgccagggcgtcgggacgaagccgcggccttcgccggggaagtccacggagaaggtcggcaggcgccgcgcgtcgccatccagcgcggccaccgcgaaggcactga

SEQ ID NO: 8329 - DNA, 540 bp, Pseudomonas aeruginosa
tcccctcgctttccagcaggcgcagccggcgcaggcaggcggatggcgagagggagaccttctccgccaggtcctggttgctcatccgcccgtcctgctgcaggtgacggagaatgcgcagatcgatggcgtccagggacatgtgcaattcctatcagaatgaatagctatcttcgaattttgtgcgaacagattgccatgcgaccttgcatttcgcacgaaaattctccgaaatctcgttcattatcattcgctggacttccggagaaaaacaatgacttcgctccggtactgggacatcagtcccgccctcgacccgaacacgccgacctggcccggcgacacgccgttccagcaggaatgggcggcgcggctggacgagcagtgcccggtcaacgtcggccggatcaccctttcgccgcataccggcgcccacgtcgacggccccctgcactaccgcgccgacggcctgcccatcggccaggtgccgctggacatctacatgggaccgtgccgggtgatccactgtatcggcgctaa

SEQ ID NO: 8330 - DNA, 2496 bp, Pseudomonas aeruginosa
cccggagcaactgccggcggcgatcgacgcggataccgcggtggtgatgctcagccatgtcaactacaagaccggctacctgcacgacatgcgcgaggtcacccgcctggtccacgaaaacggcgccctggcgatctgggacctggcccactcggccggcgcgctgccgctggacctgcacgcggccgacgccgactacgccatcggctgcacctacaagtacctcaacggcggccccggctcgccggcctacgtgtgggtcgcgccgcgcctgcgcgagcgtgtctggcaaccgctgtccggctggttcggtcattcccgccagttcgccatggagccgcgctaccagcccggcgaaggcatcacccggttcctctgcggcacccagccgatcacctcgctggccctggtcgaatgcggcctggatatcttcgcccggaccgacatgcagcgcctgcgcgacaagtcgctggccctcgccgatctgttcatcgaattggtggaaagccgttgcgaacgcttcggcctggccctggtgaccccgcgcgagcatgcccggcgcggcagccatgtcagcttcgagcatgcccagggctacgccatcgtccaggccctgatcgaccggggggtaatcggcgactaccgcgagccgggcatcctgcgcttcggcttcaccccgctgtacacccgcttcgtcgaggtctgggatgcggtgcaggcgttgctggaaatcctccagagcgaagcctggaaagagccgcgctaccaggtccggcacaaggtgacctgagtcccgcccgcgcggaccgcgccggtattcccggggcggcccgcgagcacccaccgctctcgcgcacaggagcccgcgaccggcacccgcacatcgccaccgacgttccctcggcaattcataagaaccccaataagattccagaggacatccagatgaacgacccccagggcttcgaggccatctcgcgccgcgaacagggcctgcaacggcggctctcggccgcgcagatgagcatgatcgccatcggcggcgccatcggcaccggcctgttcatgggcagcgccttcgccatcggtttcgccggccccagcgtcctgctcagctatgccatcggcgcgctgatcaccctgctgctgatgggctgcctggcggaaatgaccgtggcccatgccacccccggctcgttcggcgccttcgccgagcactacgtcggcccgctggccgggttcctggtgcgctacgcctactgggcggccatcgtcctggcggtgggcaccgaggtcacggcggtggccatgtacatgaagtactggttcgccggtatcccggaatgggtctggatcatctccttctcgaccctgctgatcggcctgaacgccagcagcgtgaaagctttcggcaacttcgaatactgcttctcgacactgaagatcgccgccatcgtcgccttcatcctgctcggcgcctacctggtgttcggctccgccaacccggcctacggcgtgcacaactacagcgcccacggcggcttcttcccgcacggcctgaaaggcatgtggatcgccgtggtggtgtcgatcttcagttatctcagcgtggagatgatcgcggtcgccgcccgcccggaaggccgagcatccggaacaggcggtgaagtcggcgttccgctcgaccatcgtgcgcctggtggtgttctacctgctgaccctggcgctgatgctcgccatcgtcccctgggaccaggccgggcagagccagagcccgttcgtcacggtgatgcaggcgatcggcctgcccggcgccaccggggtgatgaacttcgtggtgctggtggccgcgctgtcggcgatgaacagccagctctacatcaccacccggatgatgttcagcctgtcgcgcgcggggcacgcgccgaagggcctcggcgaactgagccgccagggcgtgccgctgaacgcgctgctgctgtcgagcgtcggtatcgccctggcgaccctgctcaacctggtctaccccgagcagtccttcaccctgatgatggcggtgtcgatgttcggcgccctcttcacctggctgatgatcttcttcacccacctctgcttccgccgccaccgcgcccgccacggcggcgcgccgctggccttccgcatgcgcctggcgccctggtcgacattgctcggcctggcgctgatggcggcgatcctggtcaccaccttcttcaccgaggcgttccgcatgaccctggtcttcggcgtgccgttcctcgcgctgctcagcgcactctacctggtcttcgtccgcaagcccggcagggattgtccgatagaacgggcaacgccctaggcgctctccgccctgcgaacctggcgcgcacggcgaagcccgaccggcgcgccctttccggaccgggcggttccgtttcccataccttttccgtcgcacaaaaagcattacccgccggccgccgcgactccgtagcgtag

SEQ ID NO: 8331 - DNA, 1911 bp, Pseudomonas aeruginosa
ggggaacacgatgcatccgaccttttcgcgggtcctgctggccgccgcactggccgccgccggcagccctgccgtcgccaccgaaatccagctcgagcaaggctggaacgccgagcaacgcgcctcctggtacgacgcctcgctcggttcgcggctgctgccgctggcctgggcccaggcgctggagcgtccggacagcgaggagcgcctgttctccgaagacaacgcccggcgcctcggctttcccctgcgcaactggcaaggcggcgaactgcgcctgccgcgcggcttcgccctcgaccagcaggacgacagccagttctccgacacccgcctgcgctggaaagcccgccagtcgtccagcgaaccctgggtcgggctgaattgcgccggctgccactccaccgacatcagttaccgcggcagcgaactgaccgtcgacgccggcgccaccctggccaacgtccaggcgatcttcgacgaagtgctcgccgcgctgcgccgcaccagcgacgacggcgacaagttcgcgcgcttcgccggcaacgtcctcggcagcgaggacagcccggccaaccgcgagctgctgaaggccgccctggtcaaacgcgcggcgctgatcgacaccctgctgagcatgtccgcgaccgacctgcaacccggcccggggcgcctcgacgccaccggccagtcactcaaccgcgcggcaatcaactccggcgcccgccatctgcaagcgaacccgaccgacgcgccgaccagcttcccggcactgtggcacacgttgcagatggacaagctgcaatccagcggattcgtgcccaacgtcaaggtcctcgacctcaacggccaggtcttcgacctcggctacctggccggcgacatcggcgtggtccagggcgactacggcgacgtggtcagccatccgctgtccggcctggagggctatatatcgagcatccgcgtggacaacctgacccgtgtcgagggcctgatccacaagctcaaggcgccggcctggccgagccagctgttcggcgccccggacagcgccaggctggcccagggcaagcgcctctacgaggagaactgcgcggcctgccatgcgagcatcggccgcgacgacctgcaaaccccgatcaaggtccgccaggtgcgcctgaaggcccatggcgacgacgcgccgatcggcaccgacccgtggatggcctgcaacaccttcaccttcagcagccccagcggcaactacttcggcctgttccgaccgtccctcggcacccccagcggcgtcggcatcgtcgggcggacttcgaagatcgccgacatgcaggtccccgaggtgttccagatcatgctcggcaagaaaggccagctggccgacggcatcgccgagatcatccacgccatcgtcaccgggcagcagaccctgcccggctccgacagcctgcaagcggtgcccgccggacaattgctgctggccggcgccgcccctgccgacagccaggcgcagagcctcgccgccggcgaagtccccaccgacaagagtgcgcgcaaggactactgcctgaataccgagcatccattcctcggctacatcgctcgcccgctgaacggcatctgggccaccgcaccctacctgcacaacggttcggtgccgtcgctgtacgacctgctgctgccccaggagcaacggccggccaccttctacaccggcagccacgagttcgatccgagccgggtcggctacctcaccgcgcccggcccggacaacgccttccttttcgacacccacctggaaggcaactccaacgccggccacgacttcgcccgcgagtacgacgaaagccagcgcctggcgctgctcgaatacctcaagaccctgtgagccggccccgcccacatgcccaatag

SEQ ID NO: 8332 - DNA, 2073 bp, Pseudomonas aeruginosa
  unsure (418),(482): Identity of nucleotide at the above locations are unknown.
agagaaccgcccgatgaccctatcgcgactcagccttgccatcctttccgtcctcgccggtgccccggcattcgccgacgacagcggcgtcgacctcgaccagggctggaaccagacccagaagaccgcctggctggaagccggccagggctcgcggatgctgccgctggcctggctggtggcgctggagcagcgcgccagcgaagaaccgctgatgtccgatgcgctgatccgccagtacggctatgtcccgcacaccctcggcggttccagcgtgaaggtggtgcagggctacgcggtcgaccgcagcgacgacagcgacctgaccttcaccaagctgcgctggaaagccctgcagggctccagggaaccctgggtcggaccgacctgcagcatgtgccacacttcgcacatcagntaccagggcacccagctgaccgtctacggcgggcagaccatgggcgacctcgccggcttccagntggagatcctcggcgccctgcagagcacccgcgccgacaccgccaagttcgagcgcttcgcccgcaaggtgctcggcgccgacggcctggtcagcggctacaacgatgccaacaaggcacgcctgcaggcagccctggacgccaccatcgtgcgcctgcgcgacggctcgcacttcaacctgccgcacgatcccgagttcggcccgggccgcctggacgccatcggttcgatcttcaactcggtgggctacgaactgcatgccaacgagcagatctacggcgccgaggacgcccccgtgagctatccgttcctgtggaacgtaccgcagctggaccgcgtacagtggaccggcttcaacccgaaccacatcaacgtggtcgagatcgacaaccgcaagttcgacgtcggcgccctggcgcgcaacgccggcgaggcggtcggggtattcgccgacgtcaaggtgctcagcccgatccagtcggcgctgcacatcggctacccgtcgagcatcaacgtcgacaacctgatccgcatcgaagaccagctcggccaactgaagccgccggcctggccgaaccagctgttcggcgccccggagccgaccagggtcgccgagggccgcgagctgtaccggcaacattgctccagctgccacacgccgctggaccgcaacgacctgcggaccccggtgaagaccgtgctcacccacctgcaggcgcgcggcgaggtcgcgccgatcggcaccgacccgtggaccgcctgcaacagcatcgcccagctgaagaccggctacgtgcgcggcaagccctacctgtccttcgtcggcaccggccagcgcggtttctacggcaagcaggcctatgcggtggacgtgctccaggaagtggtggtccaggccctggccgcgcgcggcctgagcgtcgccctgggtgccttccagaccgccgccctgggcatcttcgacgggcagttgccgccgctgatcagtccggtgccggacagccccgacgccgacagcgtcgaagcgaccgccgcggacgcgccaggcgccctgctcctggccgaaaacgtcgcggccggcagcgacaaggcccggcgcctggagcagtgcctggcgatgaccagcgacctgatggcctacaaggcgcgcccgctgaacggtatctgggccagcccgccctacctgcacaacggctcggtggcgaccctctacgacctgctgctgccgccggacctgaggccgcggaccttctataccggcagcgtcgagttcgacccggtcaacgtcggctacatcaccgatgccggcggcgccaaccgcttcctcttcgacagcggcaagccgggcaacgccaatggcggccacgactacggcaacgcgcagttcaacgagcagcagcgccgcgccctggtcgagtacatgaagaccctctgaagcccctcgcgcggccggcgctcccggccgcgtccctcaaccggcggcgacccgccgcgcggtctcgacgaagcattcgaactgggtgtcgctggcacgaagccgcgaagtcggcgacaccgccagccccaccggcaggcggaagccttcgttga

SEQ ID NO: 8333 - DNA, 1776 bp, Pseudomonas aeruginosa
aatcttcaagatttttcttacaaggcaataggactcgtccaagttacctcgcccatagctcccggtaccctcgcccgttacacctttcaagcaccaacgggatctccagggcttatgcttcttcgaaccatcagtgtggaaactgccgagcagacggaactgaatgcggccttgttgtgtggtttcgccattcccgccagcgaccgcaacttcatcgcctacagcctcaacgaacaggtcgacgaaaacgactcgcgcgtctacatcgcctccctgttcaagaccgacgacggcttccgcctgggccgtctcgacaccgacgaggcctgcgaggcggccatccaggtgttccgccaactggtccgcgaagccaccaccggcaaccgccggaccagcgatctggcctaccacctcatcgacctgcaggacgcggccatcgcccattcgcggcgggaagaacaccgctccctggtgctcgaacgcgaatgggtgatgaagctcgtcaccttcgagtccccccatggctacggccccgccctggatggcgaggaaccctgcgcggaagtcccgccgctcgtccaggaggcccttttcgaagacgccgctcccgatgtcctcgccgaagacgatgcggacgagaccacggacgggccggcggagcccatcgacgagcccgaggcggcggaagacgaaaccgtcaccgaggccggatgcgtcgagcccgagccgcggccggaggcggaaacggcagcgcccgagggtggggcgccagccgagttcgcggcgaaagcggagcagtccgccaaggtagcggatgccgaggccatcggcgccttcgtcgacaacgccagtcatcttcgcgaggagcttgccgacctggcgcagatgctccaccccgcgctgcacgccgccgacgccacgggcagcgccaaccttccgtctccagacgccgccgaggaatcctccatgcccccgagcccctcccccctcgccgcacccgcgccggaaccggtatcggccagggtccccagcctgtcgctgcgcctccgggtgccgcccgcacgcctggccggcgccgagggcggggccaacgccagagaggcgcccacccaggccgccgccatcattcgccaacccgaggatgaagcccacgtggatacggataccgcgctcgatatcggcaacgataccgagcatctgctacaggacgtgcagggcaccctggccgacctcgccggcatggcccagcaactgagccagcagaagcaggaagcgctcaagcagcaggagtcgctggagtcgctccagacgcaactgcacgagaaggagcggcaattgcaggaaaaggaaaagcagctccggcagtggcacaagcgcctgcaggacgaccgccaggcgctggagcgggaaaccgagcagagcaaccgtctcctcgccgagcgcagcgcggccctgcaacaactcgcggaaagcgtcgaagcccgcgagcgcagcagcgcgcggcgagccgaagtactgcagatcgagcaggaacgcctcgaagagttgcgcagccagcagaacctgcgccaggccgaactggaaaagcgcgaagccagcgtccaacagcgcagcctggaactcggcgagcgcttcaagaagctggaaagcgcccgcgagaagttggcgcagatcgtcaagggtttcaacgagaccgtacagttcaataccgctctgcacgccatcagtcataccgggttgaagcgccaggaagagagcgcagccgaactggaataa

SEQ ID NO: 8334 - DNA, 2019 bp, Pseudomonas aeruginosa
ccgaacatttcgcccagcgggacctcggcacggatcacctttgcccgccggggtatcctccatgccctggatcaggccacgccggcggttgaggtcgcccatcacgtcgcccatgtagtcctccggggtcaccacctcgaccttcatcaccggctccaggagcaccgctccgcccttctgcgagagttgcttggtggccatcgaggcggcgatcttgaacgccatctcgctggagtcgacgtcatggtaggagccgtcgtacaccgtcgccttcaggccgatcagcgggtagccggcgagcacgccgttctgcatctggtcctcgatgcccttctggatcgccgggatgaactctcggggaatcaccccgccgaccacctcgttgtggaactccaggccttcctgcccctcgtcggccggagcgaagcggatccagcaatggccgaactggccgcggccgccggactggcggacgaacttgccctcgatctcgcaggtgttgcggatggtctcgcgataggccacctgcggcttgccgatattggcttcgacgccgaactcgcggcgcatgcggtcgacgatgatgtccaggtgcaactcgcccatcccggaaatgatggtttgcgcggtctcctcgtcggtcttcacgcggaacgacgggtcttcctgggccagcttgctcagggcgatgcccatcttctcctggtcggccttggtcttcggttccaccgccaccgagatcaccggatcggggaagtccatgcgttcgaggatgatcggcttgtcgatggcgcacagggtgtcgccggtggtcacgtccttcatgccgatcagcgcggcgatgtcgccggcgcgcacttccttgatctcgtcgcgctggttggcgtgcatctgcaccatccgcccgacccgctccttcttgcctttcaccgagttgagcaccgcatcgccggaagtcagcaccccggaatacacacgggcgaaggtcagggtgccgacgaaggggtcggtggcgatcttgaacgccagcgccgagaacggctcgtcgtcgtccgcatggcgctcgtcgtgcttctcttcgtcgtccgggtcggtacccctgatcgccgggatttccgatggagccgggagatagtcgatcaccgcgtcgagcaccagaggcacgcccttgttcttgaacgaggagccgagcaccgccggtacgatctggttggccagggtccgctggcgcaccccggccttgatctcctcgatgctcagttcctcgccttccagatacttgttcatcagttcgtcgttggcctcggcggcggcctcgaccatgtgcgcccgccactcctcggccagcgcccgcaactccgccgggatctcctcctcgcggtagctggtgccctggtcgtcatcgttccagtagatggccttcatcttcaccaggtcgatctgcccgctgaagttttcctccgcgccgatcgccagctggatcggcaccgggacatggcccaggcgttgcttgatctgcgcgaccacgcggaggaaatcggcgccctggcggtccatcttgttcacgtaggccaggcgcggcacatggtacttgttggcctggcgccagaccgtctcggactgcggctcgaccccgtcggcgccgctgaacaccaccaccgcgccatcgagcacgcgcagcgagcgctccacctcgatggtgaagtcgacgtggccgggggtgtcgatgatgttgaagcgatagcggtgcgggaactgcttggtcgagccctgccagaaggccgtggtcgccgccgaggtgatggtgatgccgcgctcctgctcctggaccatccagtccatggtcgccgcgccgtcatggacctcgcccatcttgtggttgacgccggtgtagaagaggatccgctcggtcgtcgtggtcttgccggcgtcgacgtgggcgacgatgccgatgttgcgataaagctcgatgggagtggtgcgagccatgatctgccccttgggtgctgccctggatga

SEQ ID NO: 8335 - DNA, 486 bp, Pseudomonas aeruginosa
ttccgcgcaacggcatctgccggcagagcctgtggcgctacctcgacctggtgccggaaaccgagaagacctcggtgttcagccgcgccaccggcaagctggccgacgagcacaacgtcagcctggagtacttctggtcgcgcaacgacaacgctacccaggtcggcccagggaccctcaccggcctgcagatcgatcccggcaccgccttctatcccggcaacggcatcactcccggacccggcggcttcgtcctcgacccgagccggccggtggaggtcaactggcgacagagcgtgctcgggccgcgcctgcaatcctcgcagaacaccggccagcgcctgctgctcggcttcgacggccagttcgccggctgggactacgatatcggcgcctcgtacaaccagaacaaggtggtcgaccatatccacagcggctacgtcgatgatcgcgccgccgccctcggcatcgccaacgggacgctga

SEQ ID NO: 8336 - DNA, 564 bp, Pseudomonas aeruginosa
aggcgcagtacgccgaactcaacgtgccggtgctggacagcctggaactcagcgcggcgatccgccacgacaagtacagcgacttcggcagcaccagcaacccgaaatattcgttccgcttccagccgttccgccagttggtcctgcgcggcgcctacagcgaaggtttccgtgcgccgtcgctgtacgaactgtacaacccgaccttcaccacctataccagcgccaactacgacgacccgcgcctgtgcgccggcggccagccgagccagggcggcatcgccaaccgcgactgcgcccagcagttctacaacgccaccggcggcaataccgacctgcgaccggaaaccgcgcgcaacgttaccctgggcctggtctaccagccgctgcgcgacctttccgtcggcctggacttctggtggatcaggatcgccaaccagatcgccgagtttcccgaagcggcgatcttcgccgacccgcaggcctacgccggacgcatcgtgcgcaaggccgacggctctatcgatcacgtcgtcaccggactggccaacctcggcaaggtaa

SEQ ID NO: 8337 - DNA, 1683 bp, Pseudomonas aeruginosa
agaacctgttcgaccgcgaaccgccgttcagcaaccagacctacaccttccagagcggctacgacccgcgctacaccgatccctacgggcgcatcctgttcggccgcctcagctacagcttctgatgccggcgcgggcgcccggccggtatggccggcaagcccgtcgacggctgtccagctaccagatccggtagccctgccagatttcgcaggcgaccagatctggcaggttgttgggctcccggtgccatgcaacctattacgcctctcgccccccacccgttcgcgcaagaggacaccgcatgatcattctcgggatcaccaacaacgacctgtccggcgcctgcctggtgcgcgacggcgggatcgtcgccgccgccagcgaggagcgcttcacccgccagaaggaccacaaggcctggccgagccgctccatcgactatgtgctcggcgaggccggcatcgacctggccgacatcgaccgcatcgcctacggctggaacgccgggttcgacgccgggcggcacctcgacctctacctggaccgggtcctcgaggaagcccgcgagcgtcccgagggcctgccgcacctgcgcaagcggatcgccgacgagatggccaacgacaaggccaagcgcggcgaattcgatgccttcgtccgcgccaacgggctgcgcggcaaggtccagtacttcgaccatcacgaatgccacgccctcggcgcgttcgtctgctcgccgttcgacgaggcgctgaccctcacctgcgacggccgcggcgacttccagtcgctcaccgtcacccactaccgcgccgacggcggcgaggcggtcctgcaacgcgagaccagcgtcgacagcctgggctacttctacgggcgcatcacccgcctgctcggcttcaagccgaaccgccacgaaggcaagatcaccggcctggcggcgttcggcgacgcggaaaagctgctgccgctgatgaacgacatgatccgcctggagaacggccgcctgcgcgcccgctgcggcgaactgtacctgccctcctacgacggctacagcgatccgctgctgcaacgctgcgcggcggaacgcccggcggatgtcgccgccgccgcgcaacggcactccgaagacctgctggtggccatcgcccgggagcacgtggcgcgcaccggctgcgccaacctgtgcctggccggcggggtgttcggcaacgtcaagctgaaccagcgcctgcgcgagatccccggggtccgcgatgtctacgtgctgccctgcatgggcgacggcggcctggccctggccgcggcggtggcggtggcctatcgcgagaacggtacgcgcttcccggcgccgagcatggccctcgggccggacgcgcgcagcgccgcgcagaatgccgagatgatcgccagccagtacccgcaactggcctacagccggccggccaacctgatcgagacgctggtcgaagcgctgcgggaaaaccaggtgctgggcatgttcaagggccgcatggagttcggccctcgcgccttgtgcaaccgcagcatcgtctaccatcccggcgatgccagcgccaacgactggctcaatcagcgcatggaacgcaccgagttcatgccattcgccccggtcaccgcggtagaacacgccgaggcttgctacgttggctggcgtga

SEQ ID NO: 8338 - DNA, 768 bp, Pseudomonas aeruginosa
  unsure (392): Identity of nucleotide at the above locations are unknown.
tcatggcgctgttcgccctcggcggcgcggtcctggtctggcttgccctacagagtgcccgagatgcatcgactagcgttttcagccgttctgtttgacatggacggcgtcctgatcagctcccgcgaagccatcgccgcggcctggagccgggtcgccggcgaacagggcgtggcgctcggcccggactgcctgcgcgaccacgtgcacggtcgcccgggcggctacaccctggactatctgttcggccacctgccgatggagcgccggcggatcctcaagcaacgggtcgatgcgctggaggaaggcgccgactgtcccctgctgcccggcgtcgccgcggtgatccgccagttgcgttggctggacgtgcccttggcgctggtcaccancagttggccggcacgcatctaccacgtgctgcgccagcacgacctgcacgcggcgttccgcaccctggtcagccgcgacgacgtggtccacggcaagccggctccggatggctatcgcctggccgcggccaggctcggcgtggcaccgtcgcgctgcctggtgttcgaagactccctcagcggcgtgcaggccgcctgtgccgccggcgcgacctgcgtggcgatcggcgaggagagcggcctgctcgccgccggcgcgcgctggtcggtccgggatttccgcgagctacggatcgtccgcgaagacgaccggctgtactgccagcatcggcaccccgccacgaccggcagcgagaggagcgttggcgtcccatga

SEQ ID NO: 8339 - DNA, 1977 bp, Pseudomonas aeruginosa
tcttccccacagcttgccgacaggcgcgcgccgctagggtgtccgcatcgccgcaccgccctggcggggccgcgacctcccggctgcgcaggctcgcgcagtccgtcctgccacctgcgtggaaaccagcggatgcacagaacttcgcgacgcaccttcgtcaaaggcctcgccgccaccggtctgctcggcggactgggtctctggcgcgccccggcctgggccctggccggggcgggccagcagaacctgctcgccggcgacagtttcgacctgttcatcggcgagaccccggtgaacctcagcggctcgccggccaccgccatgaccatcaacggttcgctgcccggcccgaccctgcgctggcgcgaaggcgacaacgtgaccctgcgggtgcgcaaccgcctcgccgaggacacctcgatccactggcacggcatcatcctgccggccaacatggatggcgtgccgggcctcagcttcgagggcatcgctcctggcggtctctacgaataccgcttcaaggtccggcagaacggcacctactggtaccacagccactcggggctacaggagcaggccggggtctacggcgccctggtgatcgacgcccgcgagccggaaccgttcagctacgaccgcgactacgtggtgctgctcagcgactggtcggacgagaagccgcagcgcatcctcgccaagctgaagaagcagtccgactactacaacttccacaagcgcaccgtcggcgacttcatcgacgacgtcagcgccaacggctgggccgcgaccctggccgaccgcaagatgtgggccgagatgaagatgagtcccaccgatctcgccgacgtcagcggctacacctatacctacctgctcaacggacagccgccggacggcaactggaccggcctgttccgccccggcgaaaagctccgcctgcgcttcgtcaacgcctcggcgatgagctatttcgacgtccgcattcccggcctgaagatgaccgtggtggccgccgacggacagcacgtcgagccggtcagcgtcgacgagttgcgcatcgccgtggccgagacctacgacgtgatcgtcgaaccgggcggcgagcgcgcctataccctcttcgcccagtccatggaccgcagcggttacgcccgcggcaccctggcgctggccgaagggcttagcgcgccggtgccgacgcccgatccgcgcccgctgatcggcatggacgacatgggcatgggcggcatggaccacggcgccatggggcatggcgcggcgacgaggcccgccagcgagatggaccattcgaagatgtcgggcatggacatgaagggcatggaccattcgaagatggccggcatggacatgaacggcatggaccactccaagatggccggcatggaccactccaggatgggcatgggcgccatgccgatgcagtcccatccggcttcggaggacggcaacccgctggtcgacatgcagaccatgacgccgacaccgaagctcgccgaccccggcctcggcctgcgcgacaacgggcggcgggtgctgacctacgccgacctgcgcagccgcttcgccgacccggacggccgcgagccggggcgcaccatcgagctgcacctgaccggacacatggagaagttcgcctggtccttcgacggcatcaagttctccgacgccgagccgctgcgcctgacctacggcgagcgcctgcggatcgtcctggtcaacgacaccatgatgacccacccgatccacctgcacggcatgtggagcgacctggaggacgagcaaggcaatttcctggtgcgcaagcacaccatcgacatgccgccgggcacccgccgcagctaccgggtcaccgccgacgccctgggacgctgggcctatcactgccacctgctgttccacatggagatgggcatgttccgcgaagtgcgggtagacgaaggagacaacgcatga

SEQ ID NO: 8340 - DNA, 1368 bp, Pseudomonas aeruginosa
cctggaaccgctcctacggcaacagcgccgacctggcccgcgccgagggcgaggacgacgacgaggcgcgcttcgtcgccggtatccgcatgtggttctgaacgcgatcgcggccagccgctagcggtagccgtcgagcaacggcgaatcgtcgatgaggtcgcagcgttccagcgctggcaggttgcacggccggtagtcggggcattcgtccagccgccgctgcaccgaacggtgcagcttgacccgggtttcctgcccgaccggttccagcggccgcgagcgcggccggccacgcgaccagcgccaggcgcggttgccgctgcggcggtcccagaccagcagcggcagccactcggccaggcgccagggccgggtcatcaccggcaggatcggcgcggtcgggtccgggccctgcttcgaacgtgcgcgcaactggtcgcggctgcgcgccgggtcgacatgcaggccggcctccagcgcctcgccgagcatccaggtaaaggccaccagagccagccgcgagtccttcggcgcatagccaccgccgacatcggagtgcatgccggggaaccacacctgcaacacgtcggacttgcggtccttctcgccgaaccagaggttctgccggaagaagcagcggcattcgtcgatggccagggcctggcggaccacgtcgaccatttcgttgttcgaggaatacggcacggtcagcgggtcgtagacccagcccaccgaggtcacggtgtcgaacaggccgaggaagtgcaccttcacctgccggccgaagaccttgcggaagcgtcccagcaggccgaagtccggtccgcggcgacgcgtgccggcccgcttgtcttcgtcgcggggcggcatgcgggtggtgagcagggtccaggcgtagtcgaagaggtgcggctggtgcgcatcgatcaggcccaccgcgcgcagcatcgcggccagcacgcgcaccgcgtaggccccgcgggaaaagccgaagaggaatatctggtcgccgggccggtagtgctcggcgaggaagcgataggcgccctcgacgttgcgcttgagcccccagccgaaggccaggccggcgatccgcgagggaaacttctgccactcgaacagggtttccttcaggccgaaggtgccgacgccctggtcgtagtaggccagcactctgcgcggatcgcgcgacagcgagcggtacaggcgcaccacgttggtcggctggtcgccgaagcggttcgaggttccgtcgatgcagaccaccaactggcgcggcgcgtcgttgtcctgggcgctgccggcaggcggcaaggcggaatcgggggagagatcgtccattgggctcacgcaggcaaagcctga

SEQ ID NO: 8341 - DNA, 657 bp, Pseudomonas aeruginosa
gggcggccaccgccgcgtcgacgtcggcctcgcgggtgtagcgaccgaggctcaggcgcacgctgcggccagcgctggcggcatcgtgaccgagggcgagaagcacgtgggacggcgccggccgcgccgagttgcaggccgaggtgctggacaccgccaggctggactccagtgcctgggggacaaaggccgggttgtcgaaggtcaggttcagggtatgcgcgatgcgtgcgtcggcgctgccgttcaggcgccagccgtcgatctgcgccagcccctccagcagacgccgctggagtccggcgatgcgcctgccctcctcctcgaaaagctcgccggcgagggcgaaggcctcgcccataccgacgatctggtgggtcgccagggtcccggaacgcaggccctgctcgtgtccgccgccgtggatctgcgccttcagccgccgctcggcgcgcggcccgacgtacaacgcgccgatgcccttgggcccgtaggtcttgtgtgcggagaacgacatcaagtccaccgccaggcggcccaggtcgatcgccaccttgccgctggcctgcgccgcgtcgacgtggaacagcgcgccgcgctcgcgcacccgttcgccgatggcggcgatgtcggtcagggtgccgagttcgttgttga

SEQ ID NO: 8342 - DNA, 1152 bp, Pseudomonas aeruginosa
gcgacgctcaggttttccactcgcaacagttcccggttcatctcatgtcctcggatcgaaggcgtcgcgcaccgcttcgccgatgaacaccagcaggctgagcaaggtcgccaggaccacgaacacggtcagcccgagccagggcgcctggaggttgtcacggccctgcccgaccagttcgccaaggctcggcgagccgggcggcaggccgaaaccgaggaagtccagggcggtcagggtggtcaccgcgccacagagcaggaacggcaggaaggtcagggtcgcgaccatggcgttgggcaggatgtgccggaacatcaccccggcgtcgccgaggccgagggtccgcgccgccttgacgtactccaggtgacgaccgcgcaggaactcggcgcgaaccacgtcgaccaggctggtccaggagaacagcagcatgatcgccagcagccagccgaccccgggctgcaccaggctggcgaggatgatcagcaggtaaagcatcggcagacccgaccagacctcgatgaagcgctggccgaacaggtcgatccagccgccgtagtagccctgcaccgcgcctgcgcagattcccagcaacgacgaggccagggtcaggccgagggcgaagagaatcgacaggcgcaggccgtagatcacccgcgcgagcacatcgcggccctggtcgtcggtacccagccagttctccgccgagggcggcgccggcgccgggcgcgcgtagttgatgctgcgggcgtcgaagcggatcggcggccacagcgcccagccgtcgcgggcgatgcgttcgctcatgaagcgaccgcggtagtccggcgggaacggcagctcgccgccgaaggcggtttccggatagtcccgcagcaccggcaggaaccactggccacggtattccagcagcagcgggcggtcgttggcgatcagctcggcgaacaggcaggtgacgaacagcgcgaggaacagccgcagcgccaggcgcccgcggcggttggcgcggaacgcggcgaggcggcggcggtgcagcggggaaaggacgatggccatctcactgtctcctcgcggcgaagtcgatgcgcgggtcgaccaggctgtaggccaggtcgccggccagcttcaccagcaacccgagcagggtga

SEQ ID NO: 8343 - DNA, 1308 bp, Pseudomonas aeruginosa
cgccaccatcgtgttcgtcgccctgccggaaatcagccgggcgctggatttttcggcgcaacgcctgcaatgggtggtgagcgcctatacggtggccttcggcggcttcctcctgctcggcgggcgcgccaccgacctgctcggccggcgccgcatgtacgtcctcgggcaaagcctgtacgccctcgcgtccctcgcgggcggcctggcccagagcgagttgccgttgatcctcgcccgcgccgtgcagggcctgggtggcgcgctgctgttcccggcgaccctggcgctgatcggcaatcacttcgccgagggcccggcgcgcaatcgtgccctggcgatctggagcatcgcctcggcgttcggcctggccctcggctcggcgctcggcggcgcgctcaccgagctgttcggctgggcctcgatcttcctggtcaacgtgccgctggccggcgccgcggcgctgctcgccctgcgcctgatcccggccgacgcccggcgccagcgcggtcggcgcttcgacctggccggcgcgctgacggtcaccgccggcgccaccctgctggtcttcaccctggtccagggccccgagtcgggctgggatgcgccctcggtacgtttcggactttacctttccgtcccgctgctactggcgttcctcgccatcgaacactacagccgcgacccgctgatgccgctgcgcctgctgggcaaccgcaacctgcaggtggcgatgctgctgaccgcgatcttcatgagcagctacggcgtgcagtactacttcctggccatctacttccagtcggtgtacggctacagcgtgttgcagaccggcctggcgttcctcccggcgactctgctctgcaccctcggtatccgcgtcgccgagcgcctgctggcccgccacggggcacgcgcgacgctggtcgccggcctgctgctgggcgcactcgggctcggcctgctggcagcgtgcctgccgctggggcgcggcttcctggcgctgctgccggccatcgtgatcctcagcgtcggccagggcatgacctggaccgccatgtgggtgagcgccgccagcggcgtcgatcccgccgaacagggcgtcgcctcggggatggcctcgatgacccagcagatcggcggcgcgctcggcctggccctgctggtggcgctggccaacgcccaggtgcgcggcgccgatgccgccagcctgctggccagccaggcgcgcggcatcgaatgggtgaccgcgctcagcgccctgctcgccctgttcggcgccgccctggccttgcggctgcgccgtga

SEQ ID NO: 8344 - DNA, 1485 bp, Pseudomonas aeruginosa
aagatcgccatcccgcgacgactgtcgtcattccttacgaaatggcaacgccgcgatccgcggaaagcggcatactcgtcagcttgtttcgccgcgtcgacaacgcccgtaccaatgtccgcctcgctccccaacgacaccccgcctgacgaagccctgcccctggtcctggccggtcccctgctgcgccgcgcagagcccggacgcctggtgttctggctggccacgtcatgcccgacgaccatcgaactgatcctcgccagcgaaggcgaggcggagcgtcggatccgcctcgcggaaggaacccactcggccatccgcatcggcacccatgcctggctgcacctgctggatgtcgcgctcgacccgccgttgccctgcgcccgcctggtcgactacgacctgcgcctggccgccgacggccgggagcccgcgggaatcgccgaatgggcgccgcatctgctctaccccggtcgccagcgcgccagcctggtgctcaagccacgtctcgaccagttgctccacggctcctgccgcaagccgcatcacccggcggccgatggcctgctgcaggtcgaccggctgctggaggaaaacctgctgcaggccgaaagccgcccggcgttgctgatgatgagcggcgaccaggtctacgccgacgacgtcgcccgggccgatgctggtggccatccatgggctgatccgccgcctcggcctgtacggcgaacacctggaaggcgcgctggtggacgacagcgaggcgctctacgcacacccggccacctactaccggcgcgaggacctgctgcccgccttcaagtccaacgaagccctgcgcgagcgcttcttcggcggggtgaagaagccgatcttcacctcggccaacgcccacaaccatctggtcggcctggccgaggtgctggcgatgtacctgctggtctggtcgccggcgccctggcgcctggtcaggctggaaccgccgccggggctggatgcgcggcacgcgcagcgcttcgccgacgagcgccggcacatcgaagccttccgcgatggcctgcccggcgtggcgcgggcactggcgcatatctcgtcgctgatgatcttcgacgaccacgacatcaccgacgactggaacctttccgcgcgctgggagctgaccgcctacggccatccgttctcccggcggatcatcggcaacgccctgctcgcctacctgctctgccagggctggggcaacgacccgcagcattgcggcgaatggctggcgccggtcgcggccctgatggagggtgccgcggcagacggccggctgccctgcgccgagcaggaccgcctgctcgatgccctgctcgacttccagcactggcactaccggttgcctggcagcccgaccctgatcgtcctcgacacgcgcacccgccgctggcgcagcgagcgcaacctgggccggccctccgggctgatggactgggaggcgctgagtga

SEQ ID NO: 8345 - DNA, 744 bp, Pseudomonas aeruginosa
ctacctgatcctttccggcgacgtgcattactccttcgtctacgacatccggattcgccaccgcgagcacgggccccggctctggcagatcaccagcagcgggatcaagaacgaattcccgcgacgcctgctggactggttcgaccgcctcaaccgctggctctatgcgccctggtcgccgctgaactggctgacccagcggcgcagcctggaaatccgcccgcgcgttccgcagcacagccaggccggcgagcgcctgtggaacagcgccgggatcggccaggtattcattggcgaggacggccgtccgcgcgcggtgttgcaggtcaatgccgatggctcgccggcgaccgccttcgagcgacatcgcgacgtcgaagacgaacgagcggaccagtcgccggtcgcgccgggtcgctgagacgccagaacaagggggacgggcggacgccgcgccgcgtcatccgcccgcccggtttcagaacggccgctcctgcacgtccagggtcgccgccagcgcttgccagagcacctcggcgaagacccgctgggcgtcgccggacaggtacgcctgcatggcagcttcatcgctccactcgctgtgcaacagccacaggtcggcgtccccgtccgcctggcgcagttcgtagcgcaggcaaccgggcgcggcctggcccgcctgcgccagctcttgcaggcgcaggccgaggcggtgcgactggccgctgcgggcgcgaatgctga

SEQ ID NO: 8346 - DNA, 867 bp, Pseudomonas aeruginosa
cccgcgcgacatcccgatgctggcgccgctgatcctccgcgagattttctaccgcctgctgcgcagcggccagggccagcgcctgcacgagatcgccatcgccgacagccaggcccaccgcatcacccgcgccatcgactggatcaaccagaactacggcaagccgctgcgcatcgagcaactggcccaggtggtcaacctcagcccctcgaccctgcaccaccgcttcaaggccgtgaccgcgatgagcccgttgcagtaccagaagcagctgcgcttgcaggaagcacgccggctgatcttcagcgagggcctggaagtggccgccgccggctaccgggtcggctacgaaagcccgtcgcagttcagccgcgagtacagccggctgttcggcgccccgccgctgcgcgacctggcgcgggcgcgcaacaccgcctaggggaacgcggcagcggccgcgacggtcaatcgggaagcggcggcataccttcgtcgccccgaccgaccttgcgcaaccgtacccgccatgacccgagccctgcccctgctcctgcttgccctgtcccttcccgccgcggcgacggacagcgagtcgttcgcccgccgctacctggcctatgcccatgccgtcggccagcacagcgaacgactctggcccggctggcggatggccgacaaggccttcctctacagcgatggccgcagtacctgggtcgccgatgccgaaggccgcgcgcagcgcaccacggtggcgggcgacagcgacccggatctcgacctgagctatgcctttccgcgttaccggggccgtccggcggtgctgctgcagatcagcgccgcgcacctgcggagcaataccggcaatag

SEQ ID NO: 8347 - DNA, 1335 bp, Pseudomonas aeruginosa
cgagacgctggccgccatcggcccgcacgaagccttccatcactacgcccaggaagactggccgggcctgcgcaagcccggtggctatcgcggcgacctggccacgctcgacccgcgcccgcgggaataccgctatgccctgttccagtcgctgctccaggccctgcgcacgcccgggcagcgcgacagctacctgagcgacgcccagggctggctgcgccgctggcgcgaagcggctcccgaggaaagccggctggcggcgcaggtcgatctcagcgaaggcaccgcgcgctacatcgagatggccgccgccgcgcgctaccgcaccgatttcgccgaggatccgcaacgctatcggcaggcgctgcgggagtacgccctggccttctacgatgccaacgagatcggcgtcggcgtcgacagcgaagcctacgagatcggcgcgctggccggagtgctgctggacctgcgcgacgacgacgcggactggaaggaagccgcgacggccggcacctggccgctggactacctgctgcgcgaccagcctccggcctggagcgaacttcccgacgacgcgcgggcgcgcggcgagcgctaccggcgcgagatgggcgccacccgccagcgcctggtcgagttgcaggaggccttcgccgacccacggcgaccgctgctggtgatcccgcaaccgcgacgcaccatcggcttcgccacggcggccagcgaggtgcgcgggggcttctacgtccttgccgacgggccgttccgccaggcctacctcggcgcgcgctggaatgtcggcgagctgaccctggacggcgtcgactatctggagggcgacgccgaggcgtactgcccgggctacggccgttcggcgctgattccgttgcgcggaggcgattggcgcgaaggcacgctggcgccggaagaacccggcctgcgcggccgcctggcgactgctcgcagcctcgtcgacgggcggaccctttattgcgcggcggagaatgctccttgaggaccgacaacggcgctacaatgcccggctcgccgccgcaaccccgccgagggctcgccatgaagttcctgctgatcgggctgatccgcttctaccagtacgcaatcagcccgctgatcggtccccgctgccgcttctaccccagttgctcgcattacaccctggaagccatccgcgtgcatggcgcgctgcgaggcggctacctcggcgcgcgccggctgctgcgctgccacccctggcacccgggcggctacgacccggttccggagcgccaggaacaggcgtgcgcctgccacagaacggcaaagcccggcaaatga

SEQ ID NO: 8348 - DNA, 2049 bp, Pseudomonas aeruginosa
  unsure (103),(131): Identity of nucleotide at the above locations are unknown.
agccggcgaaaagatcgcaacggcgacatcccgcacataaccggacccgccggtcgacatgcggaattgataaaacctatcattcagggtccatctccccggntatcgcccggcgcccccttgcgcccgantacgccggggagttccgctcaaacgtttcatcctgaggctccgatgccccgtcatcccttctccccttccttcctcgccgccagcgttttttgcgccgccaccccggccctcgccgcgctgcaaccgatcgccgaggcgccgctggccggcgaaaccgagttccgctgccagttcaacgccgacaacagcaccgattgcgtgagcacctacagcttcaccatcctcaagccgagcggccgcgagatgctctcgcgcatcgatcgcagctacgcggagaccgatagcctgatcgtggagaaggccgagctgacccagcccggcggcaagccggtgccgctggaccagtcgcagatcgatacgcgcaccgcgccgaacccggaccagggcttcctgcgcgaacgccagacctccctggcgttccccaacctgcgcgtcggcacccgcatcagctacaccctgcgcgagcacttcaccgccaagccgctaagcacccagttccactacatcctcagccgcccgccgatgccggtgcgcgacgaccgcttcgtcgccgagttcaaggccgagcggccgatcttcgtgcgcagcgagctgatggacgcctatcgcatcgaacagagcgccgacaagaagaccctcaaggtcagcctgaaaaagccgcaatacaccaactacatcaacgaagccggcaacgcctacctgcgccataccccgcgcctggagctgggcagttcgctggacctgcaggacaacttcggcccgttcgccgcgcgctacaacgagatcctcgccgcggagctgcccaagggcgccgcggcggccgtcgccgcggtgaagggcaagccggcccgcgagcaggtcgccggcctgatgcagtacatcaacgacacctaccgctacctgggcgactggcgcgccagcgagcgcggctacgtgcccttctccctggcggagatcgagcgcaatggctacggcgactgcaaggacctggcgatcctcctcgccgccatgctcaaggccgccgggatcaaggccgaaccgaccctggtcagccgcggcgacgtggtctgggacctgctggtgcccggcatgtacgcgccgaaccatgccatcgtccgcgccgaggtggacggcaagacctggtggctggacccgaccaacccggtgttcgctcccggccgcaccatgcccgacatccagcagcgctgggcgctggtgctgggcgccgacggcaaggtgcggcgcgacgagattcccctggaagcgcccggcgacaccctgcgcgtgacccgcagcgagcattacacccatgacggcgaagcccgggtcgagtcgcgcgtggagctttccaacgcgccgctgatgcagctcagcgtcgccgatcgccagcgcggccgcaccagcaccgaccaggacctgtgccgcaacttcgccaaggaaggcagcgactgcgtgctggagcgcgacgacagccagttcgtgctgccgcccagctatacgatcagtgccaggcttaccgaccgccgcgccctcgaccggctcggcggagagtatttctacaaccgccaggacctggccagccagtgggatgccttcgccaagtaccgtagcgaaggccagttggccgagctgtacctgggcgaaccgcagatcacgtcctacgacatcagcctgtccggcggcaagactgacgagccggcgcacagttgcgagatccgcagtccctggttcgacatcgacctgcaggccgaaccggccaaggatggcggctaccactatcgttatcgggaagtgcagaagaccagttggctcaaccacgacgagatcaacagcgccgagttcggcaagctgatcgagcagagccgcggttgcgtcgagcaactgcgcctggtggtcaagctggacaagcgtccctga

SEQ ID NO: 8349 - DNA, 708 bp, Pseudomonas aeruginosa
tgcacacgcaggccttcgcgatatgccgcctgcgggcccagcgcacgcccctcggcgtccagcacccggccccgctgcatgcgcgccagccaggtgtcccggtcgatggccgggaaacgcgcgcagagacagtcgagcacggtgctccagggaccggccggcagatgcagggtgctggcgcggagactggcgtcgggcaaggaaggagacgacatgcggcaactcgggaaggacgggcgaccattaggccgcagcgcggcgcacaggtcaaagcacgccggggcgaaacgaagaaaccgcccgaaggcggtttcttccgtgacccagggatcgaatcaggcggcgctcgccttgcgctcttccgcctcgcaggcggctgcggtgaacagcacgtcggtcgaggagttcagcgcggtctccgcggagtcctggaggatcgcgatgatgaagcctaccgccaccacctgcatcgccacctcgctgggaatcccgaacaggctgcaggccagcgggatcagcagcagcgaaccgccagccacgccggacgcgccgcaggcgcagatcgacgccaccacgctgagcaggatcgcggtcggtacgtccacggcgatgcccagggtatgcaccgctgccagggtcagcacggtgatggtgatcgccgcgccagccatgttgatggtcgcgcccagcgggatcgataccgaatag

SEQ ID NO: 8350 - DNA, 612 bp, Pseudomonas aeruginosa
cctttcagggcctcgacgccggactcggcgaaggtcgaggcgaccaggccgaagatgcccagcggggcgaagcgaatcaccaccttgacgatcagcgagacgccgttggacagctcggagagcaggttgcgggtggtatcgctggcgtggcggaaagcgatgccgaggccgatggcccaggccaggatgccgatgaagttggccgagatcagggcgttgaccgggttgtccaccacgctcagcagcagggactggagcacctcggcgatgccgcccggaggcgacatctcgcccggatggctggccagcaccaggctcgaggggaaggcgaagctggcgatcaccgccaccaccgcggcgctgaaggtgccgaccaggtacagcagcacgatcggccggatatgggtctgctggccttgcctgtggttggcgatggatgccatcaccaggacgaacaccagtaccggcgcgacggccttcagcgcggaaacgaagaccttgccgatgaagccgaccttgagcgcggcggccgggaagaagctggcgagcagcaggccggcgatcaggccgacgatgatctggcccaccaggctggtacgcgtcagcagatga

SEQ ID NO: 8351 - DNA, 1422 bp, Pseudomonas aeruginosa
atccattcaccgctcgcctcactgggtcgggctcagctcgctctcctggaagcgcggcggcggacggctgaagctgcgagtcaggtagaacaggtagccgaagcccagtccggcccagatcagccccatcaccagcgaggtgctttccaggttgagccagagcaccgcgacgatggccgcgccgagcaatggcaggaccaggtagtggaaatgctccttgaggctgcggttgcgcccgccgcgcacatagaaatgcacgatcaccgagagattgacgaaggtgaaggccaccagggcgccgaaattgatcagcgcggtcgcggtcaccaggtcgaaggagatcgccgagagcgccaccatgcccacgatgagcacgttgatcgacggcgtacgccatttcggatggacgaagccgaagatccgctccggcagcacgttgtcccgccccatcacgtacagcaggcgcgacacgctggcctgggaggccaggcccgacgccagggtattgatgaaggtggcgcagaggaagatcgactggaacagcttgccgccgacgtacagggcgatttccggcagcgccgcgtcgggttccttgaagcgtacgttggtcgggaaataggactgcaggaaatacgacacggtgatgaagatcaccccgccgtacagcgcggtgaggaagatcgcccgcgggatcaccctgccggcgtcgcgggtttcctcggacagcgtagtcaccgcgtcgaaaccgaggaaggaaaagcagaggatcgtcgcccccgccaccatcgccgagagatgcgcgtgctcggagaagaacggctgggtactgagcaccgtggcggtcccctccccgttgttcaggccgtgaatcaccaggccgatgaagaccacgatgatcgccagctggaccagcacgaagacggtgttgaaattggcgaccaggttcacgctcttgatgttgatgagggtcatgatcagcacgaacatcaccacccagatccacggggcgacctcggggaacaatgcggtcaggtagatcttcgccagcagtgcgttgatcatcggcaggaacaggtagtccagcagcgacgaccagccgaccatgaagccgacatggggattgatcgctcgttgcgcgtaggtataggccgagcctgcggtggggaactggcggaccagcttgccgtagctgatcgcggtgaacagcacgccggcgagggccaccaggtaggcggtgggcacgtgtccctgggaaatcccggatacgatgccgaaggtgtcgaagacggtcatcggggtcaggtaggccaacccgatcatgacgatctgccacagcttgagggacttgcgaagctgggttcgttctgcggtggggggaggattcgacatgggtatgcttgcctcgatttcttctttttctaa

SEQ ID NO: 8352 - DNA, 633 bp, Pseudomonas aeruginosa
acctgtgttgaagactggccgcgcaaggctgggcggcccccgcgccgacggcaaggccctggccgcaggcgacagcctcggctggctggccgatggcgcgcgaccgcgcgcgctgcccctgcccagcgaacggatcatggactgcaccggcgaagcgcgcctggagctgatcctcggcgcgcagatcggcgacttcccggccatgagcctgttcgatgcgttcaacggcgactggcaggtggatacccgcgccgaccgcatgggcgtacgtctgctcggcccgcgcctggaatgccggcagcagtcgatgatctccgaaggcatcgccctcggcgcggtgcaagtgccgccggacggtcagccgatcgtcctgctcaacgaccgccagaccatcggcggctacccccgtctcggcgccctcgccccgctggcgctggcgcgcctggcgcaatgcctgccaggccagccggtacggctgctgccgacggtgcaggaggcggcgcaccgcgagcatcgacgcctgctggcggcctgggacgcataggcggtttttttgaacggcgccgtatggcgagcgtccaccgcacactcgtcccgtccggaggttcgccatgcccagtcgcctgtcactga

SEQ ID NO: 8353 - DNA, 210 bp, Pseudomonas aeruginosa
cagtcatcaccgattaccgctgtctcgccaatgaccgtgccatgcccatggtccaggatgaatcgactgccaatcttgcatcttgggtggatttccgcgcccgacaggagctttccacgagaggagaccaggagcgcggtagcctccaacgctctctcaggatcgccttcagatgtgcttcgcagacacagcatgtgggaaagccggtag

SEQ ID NO: 8354 - DNA, 966 bp, Pseudomonas aeruginosa
cagcagttgaggacgccatgcaggttgatcgccagcaaccgcgcgtggtcctccagggcgacctcttcgaagcggccgaaacgcaggacgccggcgcagttgaacagcaggcgcaggcggccatcggcacagaactgcgcaagcgcctcgccgaccgcgtcgggctcgctgacgtccacggcgcggtgccaggcgcctggcagttgcgcggccaagccgcgcaacgcctcggcatcgatgtccagcaaaccgacccgccagccccggcggtggaacagccgcgcgctggcggcgccgattccggaagcggcaccactgatcaggatgttctgcacctatcgccctccacgctgcattcgacgacgaacgcggccgcctcgtccaacgcccggtcggcgctggccaacacgccggcatgggcctggaacacgtgccagcaaccggcgtagcgctgcaatcgcaccgcgacgccctgctcaccggcccgttgcgccaggcgcaggctgtcgtcgcgcagcagttcgtcctcgccgacctgtaccagcagcggcggcagccccgccaggtcggcatgcagcggcgacaaggcggccgagcctggctccgcgtcggccggcagcagcaggcgcaccgcgctttccagccaggcccgcgacagcagcgggtcgccggccgccggcgtgtgcaggcgctggcagccgaggtcggtccagggcgagaacagcagcaacccggccggcaacggcaagccgcgcgccttcagctccagggccagggacagcgccaggtggccgcccgcggagtcgccggcgagcagcagccggcgcggcgaatggccggcctccagcaatgccaggtagaccgccagggcgtcgtcgcgggcggcggggaacggatgttccggggcgcgccggtagtccaccgcgcagacctcggcggcgcaacgccgggccaggtgcgtggtga

SEQ ID NO: 8355 - DNA, 918 bp, Pseudomonas aeruginosa
attggccgttcacgcgcggcatccggcggcgcggcagcggaggcatctccgctggcaacgggagaacgacacatgggttgccagcaacacgcatggccggcgcacgcgccggagcaggtcgaggccgaagtcaactatatccgcgacaacggccaacggccggtcgcctacacctatccggcccccgccgggacgccgcagcacagcgcgctgttgcagccgacccgggtggcgatccgcaatgcgcgtctgctggcgcaaccggccagcctggagcgcgagggtttccaactggtgcgcgaggcgagcgcggtgggcgatttcgaggatgaagcccaggttcgtgaacgctactacccggaaagcatcgccctgctccgccgcctgaccggcgccgccgaggcggtgatcttcgaccacacgctgcgcgtcgaccaggccgggcgcgaagaacgcggcctgcgcgaaccggtgcgctacgtgcacaacgaccagaccctgcgctcggcgccgcgccgggtccgcgaccacctgccggcggaacgcgccgaacggcgcctggccggacgcttccagatcgtcaacctgtggcgtccgttcggccacccggcgcagcgcgcgccgctggcgttgctggacgcccgcagcctggcgttcgacgacctggtggccagtgacctggtgtaccgcgacaaggtgggcgaaacctactcggtcaagcccaacccggagcaccgctggtactactacccgcacctgctgccggaggaagcgctgctgctgaagatctacgattcgcgggaggacgcgcaggcccgcctcggcgcgcacaccgccttcgacgatccctgcaccccggccgatgcgccgccgcggcagagtatcgaactgcgttgcctgctgttcttcgacgaatga

SEQ ID NO: 8356 - DNA, 636 bp, Pseudomonas aeruginosa
cgcggttgccggcgatctccgcgtcgagctggaggatgcctggcagatagggccggaaggcctccgcgacccaggccagggagcggtcgtggacctccagccagccgctggcccaggcatcctctccggcctgcatcgggccctgttcgagcaggccgccggcatcgaacagcaggctacgtcgtgccgccaccgccagctggcgtccctcgccggtggtcagccgcgcgctgccgcgcagggtcaccaggcggatcgccccgcgctcctcggccagcagcaggctgccgctggcgcagtccacccgtccggcggcgcagtcgagggcgaaggcgccgcgcgggtcctccttcacttccaggcgcatcgcgccgcgccgcagctccaggcgtcgctgggcgccgtcgagcagcggtcgcgccttgctccgcgcgttcaggcgcaggcggctgccgtcggccagcaaccagtcgcggcgctcgccggtgccggtcgccagttcgccgggcagacccatgccggcctggacccagcgctccaggccggcgccgccggcgagcaggacgaacagcccgagggcgccgccgacgaagcgccggcggctcgacggctgctccagggcgcgcagcacggtag

SEQ ID NO: 8357 - DNA, 837 bp, Pseudomonas aeruginosa
ggaatgttgcccggcgtcagcaggccgagcagcgcgaacagcaggtatagctgccagccgctgcgcgccagcgccaggctggccaggcacagggccagcgcggcggtcagcggcaggaccagggcgcgcgcgccccagcgatccaccagccagcccttcagcgggctactcagggctaccgccaggcccagcagggtcaccggcagcgccgactggccgcggtcccagtccaggtcggcggcgatcggctcgatgaacagcgagaagctgctgatcaccagcccggtggggccgaagatcacccccactaccgaggccagcagcaccccacaactggccacgccgaactcgccgacgccaggcgccgccggcgcgacgtcctccatggcctcgcgggcgacgccgctcatgcgtcgcgcctcaggcgctcgatcagttggcggcgcaagcggatgtcctcggcgttctcggtggtggcctcaagctggacgatctcgatgccggcgcgatgaaaggccaggatctgttccgccacctcgccgacgctgcccaccagcaccccggcgaagctgcgctgcacggtattcgccacccattcgcgcaaggcctccggctccagccgggcgagccggtcgcgctcgccgtcgcgggcgacctgcggcgatgccgccagttcgtcgaggggccgtgccagaagcagttcgaaagcggcctggcggtagtgctcggcgatgtccagggccgccgccggactgtcgccgaggatcacctggaagtgcttccagaacttcagccgccgtccctgctccgccgcctcctcgttcagcctgcgcttga

SEQ ID NO: 8358 - DNA, 489 bp, Pseudomonas aeruginosa
agcgccgccacccgttccggcgcagccaggcccatctcgaccagggcctgggcgaccaggtcgtcctcgccgccgaggccatcctcggcgaacggatggtgcgaggtgaacaggaataccccctgcgcctcgaggtgccgcgcgacccaccggaacagccgctcttcatcgggatacagccagtgcagcacggcggtcatgctgatcagctcgaagcgttccgccagcggcggcaggtcgagcaggtcgccctccagcagacgcgcctcgacgccagccccgcgcaactgcgcgcgcgcctgctccaggcgtagcggcgaacgctcgatgccccacaaccgttgcaggccgggccagcgccgggcgccgccgagcagcagcgagccgatgccgcagccgagatcgagcaggctgcgcggctcgatgccggcgcggtcgagcacccagtcctggtcgcgacgttgcagcagttcgctggaatcctggtag

SEQ ID NO: 8359 - DNA, 2013 bp, Pseudomonas aeruginosa
gggcagcacccggtagcgtgcggcgcgctcgaacagcgcgaaccaggtatccagcaggcggtcgtcgagcagctcggcttcggcgacgaggaaatcgctgacccgcgccagcaggtcgctgtcgggacgggacaaggcaaggctcatgagtatcctccgctaagaaagtgccgctcagaggctgatgtcgaccccatggcgggtcagccagcggtccaggttcagcaggtaggccaggccggcggtcgggctcgccgaggcacgcgggctgggcagcggcgtgccctgttcgagagcctggcggacccgcccggcgtccaccagttcgaacagcggcgagcggccgtcgtcgagcaggcggccgacccgctcgcgcagcagcgccaggtaacgtgggtcggggttggccgggaaaccgctcttgcgccgctccaggatcgcctgcggcaggtgcccgcgcagggcccggcgcagcaggctcttgctttccccggcgacgctcttcagcgcccagggcaggttccatacgtactccaccaggcggtggtcgcagaacggcacgcgcacttccaggccgaccgccatgctcatccggtccttgcgttcgagcatcgccggcagccagcggctcagcgccaggtaggcgacctcgcgctggcgtcgctgggcggcatcctcgccatccagccgcggcacttcggcgagggcctcgcggtagcgcgcccggatgtattccggcgccgccacccgttcggcgacctcccgccgcagcagttgccagggcccgctcttgccggccagccaggggaagccgtcgtgtgcgagggcgctcgggtcgtggaagaacgggtagccgccgaacacctcgtcggccgactcgcccgacagtgccaccgtggtgtgctcgcggacctggcggaacagcaggtagagcgaggcgtccagctcgccccagccgggcaggtcgcgggcctggagcaccgcctcgtcctgttccagcacctcttccggggcgaccagcacggtacggtgcggcgtaccgaggaagttcgccgccagctgcgcatagggttcgtcccagctgctttgccagggcgtcgggacgaagccgcggccttcgccggggaagtccacggagaaggtcggcaggcgccgcgcgtcgccatccagcgcggccaccgcgaaggcactgatggcgctggagtcgagcccgccggaaagcaggctgcccagcgggacgtcggccaccagttgctcggccaccgcctcgcggagcaactggccggcgcgttcggcgctgtcctcggcgccctcttcgtgacgttccgcgcgcagcgcccagtagaccaactcgcgcacaccattgcggtcgaagcgcagcgcctggcccggccggacctggcgcaggcccttgtacaggccgtggccgggagtcggcgcggtggtcagggcgaacagctcggcgatgccgctggcgtcgagcaccgggttggcctcggggttggcgaagatcgccttgggttccgaggcgaacagcacgcctccggcggtcgggtagtagtacagcggcttgaccccgaagcgatcgcgcaccagccacaggctctgctcgcgctcgtcccacagggcgaagccgtagatgccgcggagccgggcgaaggaagcctcgccccattgcagataggcgcgcagcaccacttcggtgtccgagcgggtgcggaagacctggcccagcgtctccagctcggcgcgcagctcgcggaagttgtagacctcgccgctgtaggtcagcgccacccgcccgccagcctcggcaagcatcggttgagcgccgttctccaggtcgatgatcgccaggcgccgatggccgagcagcgcgtgccgcgacagccacaggccttcggcgtccggcccgcgcggggccagggtacgggtcatgcgttcgaggatgctgcgctgctcgccgaggtcgcggctccagtcggtccagccggtgattccacacatggatga

SEQ ID NO: 8360 - DNA, 753 bp, Pseudomonas aeruginosa
atagctatcttcgaattttgtgcgaacagattgccatgcgaccttgcatttcgcacgaaaattctccgaaatctcgttcattatcattcgctggacttccggagaaaaacaatgacttcgctccggtactgggacatcagtcccgccctcgacccgaacacgccgacctggcccggcgacacgccgttccagcaggaatgggcggcgcggctggacgagcagtgcccggtcaacgtcggccggatcaccctttcgccgcataccggcgcccacgtcgacggccccctgcactaccgcgccgacggcctgcccatcggccaggtgccgctggacatctacatgggaccgtgccgggtgatccactgtatcggcgctaacccgctggtgacccccgaacacctcgccggccagctcgacgacctgccctcgcgggtgctgctacggaccttcgaacgggtcccggcgaactggccggaaggcttctgcgctatcgctccggccaccatcgagtgcctcgccgagcgcggcgtcaggttggtcggcatcgacaccccgtcgctcgacccccagcactccaagaccctcgacgcccaccacgcggtgggccgccacggcatggcgatcctcgaaggcgtggtcctcgacgacgtgcccgccggcgactacgaactgctcgccctgccgctgaaattcacccacctcgatgccagcccggtgcgtgccgtgctgcgcgccctgcctaccgcggagtaa

SEQ ID NO: 8361 - DNA, 1254 bp, Pseudomonas aeruginosa
ccgatgaccactcgtgacgactgcctggcgctcgacgccggcgatcccctggccgacctgcgccaactgttcgccctgcccgacggcgtgatctacctcgacggcaactccctcggcgcccgcccccgggccgccgtggagcgcgccgccgaagtggtcgccgcggaatggggcgaggggctcatccgcagctggaacagcgccgactggcgcggcctgccggagcgcctcggcgacaagctagcgcccctgatcggcgcgcgcgccggcgaagtggtgatcaccgacaccacatcgatcaacctgttcaaggtgctcagcgccgccctgcggatccaggaggaagacgcgccagggcgcaaggtgatcgtttccgaatcgagcaacttccccactgacctgtacatcgccgagggccttaccgacatgctccagcgcggctaccggctacgcctggtagatgacccggagcaactgccggcggcgatcgacgcggataccgcggtggtgatgctcagccatgtcaactacaagaccggctacctgcacgacatgcgcgaggtcacccgcctggtccacgaaaacggcgccctggcgatctgggacctggcccactcggccggcgcgctgccgctggacctgcacgcggccgacgccgactacgccatcggctgcacctacaagtacctcaacggcggccccggctcgccggcctacgtgtgggtcgcgccgcgcctgcgcgagcgtgtctggcaaccgctgtccggctggttcggtcattcccgccagttcgccatggagccgcgctaccagcccggcgaaggcatcacccggttcctctgcggcacccagccgatcacctcgctggccctggtcgaatgcggcctggatatcttcgcccggaccgacatgcagcgcctgcgcgacaagtcgctggccctcgccgatctgttcatcgaattggtggaaagccgttgcgaacgcttcggcctggccctggtgaccccgcgcgagcatgcccggcgcggcagccatgtcagcttcgagcatgcccagggctacgccatcgtccaggccctgatcgaccggggggtaatcggcgactaccgcgagccgggcatcctgcgcttcggcttcaccccgctgtacacccgcttcgtcgaggtctgggatgcggtgcaggcgttgctggaaatcctccagagcgaagcctggaaagagccgcgctaccaggtccggcacaaggtgacctga

SEQ ID NO: 8362 - DNA, 738 bp, Pseudomonas aeruginosa
tcgcggtcgccgcccgcccggaaggccgagcatccggaacaggcggtgaagtcggcgttccgctcgaccatcgtgcgcctggtggtgttctacctgctgaccctggcgctgatgctcgccatcgtcccctgggaccaggccgggcagagccagagcccgttcgtcacggtgatgcaggcgatcggcctgcccggcgccaccggggtgatgaacttcgtggtgctggtggccgcgctgtcggcgatgaacagccagctctacatcaccacccggatgatgttcagcctgtcgcgcgcggggcacgcgccgaagggcctcggcgaactgagccgccagggcgtgccgctgaacgcgctgctgctgtcgagcgtcggtatcgccctggcgaccctgctcaacctggtctaccccgagcagtccttcaccctgatgatggcggtgtcgatgttcggcgccctcttcacctggctgatgatcttcttcacccacctctgcttccgccgccaccgcgcccgccacggcggcgcgccgctggccttccgcatgcgcctggcgccctggtcgacattgctcggcctggcgctgatggcggcgatcctggtcaccaccttcttcaccgaggcgttccgcatgaccctggtcttcggcgtgccgttcctcgcgctgctcagcgcactctacctggtcttcgtccgcaagcccggcagggattgtccgatagaacgggcaacgccctag

SEQ ID NO: 8363 - DNA, 2025 bp, Pseudomonas aeruginosa
cgtagtgcccaaccggacgttccggcccgcggcgcgccgcggccggcgcgctcccgtcagggacgaagtggcggcacgcccagccatcgagcgcactgcatcgctctgccctgtggggacgcagacgtcgtcagccatgaggggaacacgatgcatccgaccttttcgcgggtcctgctggccgccgcactggccgccgccggcagccctgccgtcgccaccgaaatccagctcgagcaaggctggaacgccgagcaacgcgcctcctggtacgacgcctcgctcggttcgcggctgctgccgctggcctgggcccaggcgctggagcgtccggacagcgaggagcgcctgttctccgaagacaacgcccggcgcctcggctttcccctgcgcaactggcaaggcggcgaactgcgcctgccgcgcggcttcgccctcgaccagcaggacgacagccagttctccgacacccgcctgcgctggaaagcccgccagtcgtccagcgaaccctgggtcgggctgaattgcgccggctgccactccaccgacatcagttaccgcggcagcgaactgaccgtcgacgccggcgccaccctggccaacgtccaggcgatcttcgacgaagtgctcgccgcgctgcgccgcaccagcgacgacggcgacaagttcgcgcgcttcgccggcaacgtcctcggcagcgaggacagcccggccaaccgcgagctgctgaaggccgccctggtcaaacgcgcggcgctgatcgacaccctgctgagcatgtccgcgaccgacctgcaacccggcccggggcgcctcgacgccaccggccagtcactcaaccgcgcggcaatcaactccggcgcccgccatctgcaagcgaacccgaccgacgcgccgaccagcttcccggcactgtggcacacgttgcagatggacaagctgcaatccagcggattcgtgcccaacgtcaaggtcctcgacctcaacggccaggtcttcgacctcggctacctggccggcgacatcggcgtggtccagggcgactacggcgacgtggtcagccatccgctgtccggcctggagggctatatatcgagcatccgcgtggacaacctgacccgtgtcgagggcctgatccacaagctcaaggcgccggcctggccgagccagctgttcggcgccccggacagcgccaggctggcccagggcaagcgcctctacgaggagaactgcgcggcctgccatgcgagcatcggccgcgacgacctgcaaaccccgatcaaggtccgccaggtgcgcctgaaggcccatggcgacgacgcgccgatcggcaccgacccgtggatggcctgcaacaccttcaccttcagcagccccagcggcaactacttcggcctgttccgaccgtccctcggcacccccagcggcgtcggcatcgtcgggcggacttcgaagatcgccgacatgcaggtccccgaggtgttccagatcatgctcggcaagaaaggccagctggccgacggcatcgccgagatcatccacgccatcgtcaccgggcagcagaccctgcccggctccgacagcctgcaagcggtgcccgccggacaattgctgctggccggcgccgcccctgccgacagccaggcgcagagcctcgccgccggcgaagtccccaccgacaagagtgcgcgcaaggactactgcctgaataccgagcatccattcctcggctacatcgctcgcccgctgaacggcatctgggccaccgcaccctacctgcacaacggttcggtgccgtcgctgtacgacctgctgctgccccaggagcaacggccggccaccttctacaccggcagccacgagttcgatccgagccgggtcggctacctcaccgcgcccggcccggacaacgccttccttttcgacacccacctggaaggcaactccaacgccggccacgacttcgcccgcgagtacgacgaaagccagcgcctggcgctgctcgaatacctcaagaccctgtga

SEQ ID NO: 8364 - DNA, 1944 bp, Pseudomonas aeruginosa
  unsure (444),(508): Identity of nucleotide at the above locations are unknown.
gccggccccgcccacatgcccaatagagagaaccgcccgatgaccctatcgcgactcagccttgccatcctttccgtcctcgccggtgccccggcattcgccgacgacagcggcgtcgacctcgaccagggctggaaccagacccagaagaccgcctggctggaagccggccagggctcgcggatgctgccgctggcctggctggtggcgctggagcagcgcgccagcgaagaaccgctgatgtccgatgcgctgatccgccagtacggctatgtcccgcacaccctcggcggttccagcgtgaaggtggtgcagggctacgcggtcgaccgcagcgacgacagcgacctgaccttcaccaagctgcgctggaaagccctgcagggctccagggaaccctgggtcggaccgacctgcagcatgtgccacacttcgcacatcagntaccagggcacccagctgaccgtctacggcgggcagaccatgggcgacctcgccggcttccagntggagatcctcggcgccctgcagagcacccgcgccgacaccgccaagttcgagcgcttcgcccgcaaggtgctcggcgccgacggcctggtcagcggctacaacgatgccaacaaggcacgcctgcaggcagccctggacgccaccatcgtgcgcctgcgcgacggctcgcacttcaacctgccgcacgatcccgagttcggcccgggccgcctggacgccatcggttcgatcttcaactcggtgggctacgaactgcatgccaacgagcagatctacggcgccgaggacgcccccgtgagctatccgttcctgtggaacgtaccgcagctggaccgcgtacagtggaccggcttcaacccgaaccacatcaacgtggtcgagatcgacaaccgcaagttcgacgtcggcgccctggcgcgcaacgccggcgaggcggtcggggtattcgccgacgtcaaggtgctcagcccgatccagtcggcgctgcacatcggctacccgtcgagcatcaacgtcgacaacctgatccgcatcgaagaccagctcggccaactgaagccgccggcctggccgaaccagctgttcggcgccccggagccgaccagggtcgccgagggccgcgagctgtaccggcaacattgctccagctgccacacgccgctggaccgcaacgacctgcggaccccggtgaagaccgtgctcacccacctgcaggcgcgcggcgaggtcgcgccgatcggcaccgacccgtggaccgcctgcaacagcatcgcccagctgaagaccggctacgtgcgcggcaagccctacctgtccttcgtcggcaccggccagcgcggtttctacggcaagcaggcctatgcggtggacgtgctccaggaagtggtggtccaggccctggccgcgcgcggcctgagcgtcgccctgggtgccttccagaccgccgccctgggcatcttcgacgggcagttgccgccgctgatcagtccggtgccggacagccccgacgccgacagcgtcgaagcgaccgccgcggacgcgccaggcgccctgctcctggccgaaaacgtcgcggccggcagcgacaaggcccggcgcctggagcagtgcctggcgatgaccagcgacctgatggcctacaaggcgcgcccgctgaacggtatctgggccagcccgccctacctgcacaacggctcggtggcgaccctctacgacctgctgctgccgccggacctgaggccgcggaccttctataccggcagcgtcgagttcgacccggtcaacgtcggctacatcaccgatgccggcggcgccaaccgcttcctcttcgacagcggcaagccgggcaacgccaatggcggccacgactacggcaacgcgcagttcaacgagcagcagcgccgcgccctggtcgagtacatgaagaccctctga

SEQ ID NO: 8365 - DNA, 276 bp, Pseudomonas aeruginosa
accgcttccgtgtcggcggagcgccaggggggctacgctgagtttttcaggatcaggagtaccgccatgctggatcacgacctgactgtcgccctgctctgccgtctcaaccagaaccagagtgccctcggcatggccctggaggagctggcgatctgggcgaagcgccatgaaggcggcgaaacctacgatgtcgtcatgaaccacctgcagaccctggagcgcaatgccgacttcgtcgccgaggccatcgtcgtcctgatggcggatcgctga

SEQ ID NO: 8366 - DNA, 444 bp, Pseudomonas aeruginosa
cggatgccgaggccatcggcgccttcgtcgacaacgccagtcatcttcgcgaggagcttgccgacctggcgcagatgctccaccccgcgctgcacgccgccgacgccacgggcagcgccaaccttccgtctccagacgccgccgaggaatcctccatgcccccgagcccctcccccctcgccgcacccgcgccggaaccggtatcggccagggtccccagcctgtcgctgcgcctccgggtgccgcccgcacgcctggccggcgccgagggcggggccaacgccagagaggcgcccacccaggccgccgccatcattcgccaacccgaggatgaagcccacgtggatacggataccgcgctcgatatcggcaacgataccgagcatctgctacaggacgtgcagggcaccctggccgacctcgccggcatggcccagcaactga

SEQ ID NO: 8367 - DNA, 486 bp, Pseudomonas aeruginosa
gccagcagaagcaggaagcgctcaagcagcaggagtcgctggagtcgctccagacgcaactgcacgagaaggagcggcaattgcaggaaaaggaaaagcagctccggcagtggcacaagcgcctgcaggacgaccgccaggcgctggagcgggaaaccgagcagagcaaccgtctcctcgccgagcgcagcgcggccctgcaacaactcgcggaaagcgtcgaagcccgcgagcgcagcagcgcgcggcgagccgaagtactgcagatcgagcaggaacgcctcgaagagttgcgcagccagcagaacctgcgccaggccgaactggaaaagcgcgaagccagcgtccaacagcgcagcctggaactcggcgagcgcttcaagaagctggaaagcgcccgcgagaagttggcgcagatcgtcaagggtttcaacgagaccgtacagttcaataccgctctgcacgccatcagtcataccgggttga

SEQ ID NO: 8368 - DNA, 615 bp, Pseudomonas aeruginosa
gccacctgcggcttgccgatattggcttcgacgccgaactcgcggcgcatgcggtcgacgatgatgtccaggtgcaactcgcccatcccggaaatgatggtttgcgcggtctcctcgtcggtcttcacgcggaacgacgggtcttcctgggccagcttgctcagggcgatgcccatcttctcctggtcggccttggtcttcggttccaccgccaccgagatcaccggatcggggaagtccatgcgttcgaggatgatcggcttgtcgatggcgcacagggtgtcgccggtggtcacgtccttcatgccgatcagcgcggcgatgtcgccggcgcgcacttccttgatctcgtcgcgctggttggcgtgcatctgcaccatccgcccgacccgctccttcttgcctttcaccgagttgagcaccgcatcgccggaagtcagcaccccggaatacacacgggcgaaggtcagggtgccgacgaaggggtcggtggcgatcttgaacgccagcgccgagaacggctcgtcgtcgtccgcatggcgctcgtcgtgcttctcttcgtcgtccgggtcggtacccctgatcgccgggatttccgatggagccgggagatag

SEQ ID NO: 8369 - DNA, 672 bp, Pseudomonas aeruginosa
ctggggcttcggcgagctggaggaggatcgcttcaatgtcttcgcggtggccaactacgacaagcaggagcgcctcggcgccaaggaccgcggctacacctacaactaccagccgggacgcggcctcgactacagctccggcaccgccttccccggcaactggagccagggcgccaacgccagcaatccgctggccgccggcggttgcaagggcgccgacctgattccgcgcaacggcatctgccggcagagcctgtggcgctacctcgacctggtgccggaaaccgagaagacctcggtgttcagccgcgccaccggcaagctggccgacgagcacaacgtcagcctggagtacttctggtcgcgcaacgacaacgctacccaggtcggcccagggaccctcaccggcctgcagatcgatcccggcaccgccttctatcccggcaacggcatcactcccggacccggcggcttcgtcctcgacccgagccggccggtggaggtcaactggcgacagagcgtgctcgggccgcgcctgcaatcctcgcagaacaccggccagcgcctgctgctcggcttcgacggccagttcgccggctgggactacgatatcggcgcctcgtacaaccagaacaaggtggtcgaccatatccacagcggctacgtcgatga

SEQ ID NO: 8370 - DNA, 1428 bp, Pseudomonas aeruginosa
tcgcgccgccgccctcggcatcgccaacgggacgctgaacccgttcgggccgcagaccgacgccggcctcgcctacctcggcagccatgccctgagcggcgacttccgtacctcggtcggccgcgtcaagggcctggatgcccgcgccagccgggagatcggcgactggttcggcgccgggccggcggccctggcgctgggcggcgagttccgcaaggaagcgttccaccaggacatccaggacttcgccggcaacgtgcagagcctcggcgtcgatcccgccgccacggtcagcggcgagcgcaacctgaaggcgcagtacgccgaactcaacgtgccggtgctggacagcctggaactcagcgcggcgatccgccacgacaagtacagcgacttcggcagcaccagcaacccgaaatattcgttccgcttccagccgttccgccagttggtcctgcgcggcgcctacagcgaaggtttccgtgcgccgtcgctgtacgaactgtacaacccgaccttcaccacctataccagcgccaactacgacgacccgcgcctgtgcgccggcggccagccgagccagggcggcatcgccaaccgcgactgcgcccagcagttctacaacgccaccggcggcaataccgacctgcgaccggaaaccgcgcgcaacgttaccctgggcctggtctaccagccgctgcgcgacctttccgtcggcctggacttctggtggatcaggatcgccaaccagatcgccgagtttcccgaagcggcgatcttcgccgacccgcaggcctacgccggacgcatcgtgcgcaaggccgacggctctatcgatcacgtcgtcaccggactggccaacctcggcaaggtaaagaccagcggcgtcgacctgagcctcgattatcgtttcccggccagccgctacgggcagttcgggctcgacctgcaaggcacctacgtgtcccgctacgacttccagcagcagatcggcggccagtacctggacaacgtcggcgacttccagggcgtcggcgtgatcgcccgctggaagcacgtcgccaacgccacctggagccgcgacgcctggcaggccaccctgagcaaccgctacaccagcggctacaacgactacgaccgcgccagccacggcaaggtcggttcgtggaacctctgggacctggccggcagctaccgcctcagccacgcgctggggctgaccctcggggtgaagaacctgttcgaccgcgaaccgccgttcagcaaccagacctacaccttccagagcggctacgacccgcgctacaccgatccctacgggcgcatcctgttcggccgcctcagctacagcttctgatgccggcgcgggcgcccggccggtatggccggcaagcccgtcgacggctgtccagctaccagatccggtag

SEQ ID NO: 8371 - DNA, 1833 bp, Pseudomonas aeruginosa
ccctgccagatttcgcaggcgaccagatctggcaggttgttgggctcccggtgccatgcaacctattacgcctctcgccccccacccgttcgcgcaagaggacaccgcatgatcattctcgggatcaccaacaacgacctgtccggcgcctgcctggtgcgcgacggcgggatcgtcgccgccgccagcgaggagcgcttcacccgccagaaggaccacaaggcctggccgagccgctccatcgactatgtgctcggcgaggccggcatcgacctggccgacatcgaccgcatcgcctacggctggaacgccgggttcgacgccgggcggcacctcgacctctacctggaccgggtcctcgaggaagcccgcgagcgtcccgagggcctgccgcacctgcgcaagcggatcgccgacgagatggccaacgacaaggccaagcgcggcgaattcgatgccttcgtccgcgccaacgggctgcgcggcaaggtccagtacttcgaccatcacgaatgccacgccctcggcgcgttcgtctgctcgccgttcgacgaggcgctgaccctcacctgcgacggccgcggcgacttccagtcgctcaccgtcacccactaccgcgccgacggcggcgaggcggtcctgcaacgcgagaccagcgtcgacagcctgggctacttctacgggcgcatcacccgcctgctcggcttcaagccgaaccgccacgaaggcaagatcaccggcctggcggcgttcggcgacgcggaaaagctgctgccgctgatgaacgacatgatccgcctggagaacggccgcctgcgcgcccgctgcggcgaactgtacctgccctcctacgacggctacagcgatccgctgctgcaacgctgcgcggcggaacgcccggcggatgtcgccgccgccgcgcaacggcactccgaagacctgctggtggccatcgcccgggagcacgtggcgcgcaccggctgcgccaacctgtgcctggccggcggggtgttcggcaacgtcaagctgaaccagcgcctgcgcgagatccccggggtccgcgatgtctacgtgctgccctgcatgggcgacggcggcctggccctggccgcggcggtggcggtggcctatcgcgagaacggtacgcgcttcccggcgccgagcatggccctcgggccggacgcgcgcagcgccgcgcagaatgccgagatgatcgccagccagtacccgcaactggcctacagccggccggccaacctgatcgagacgctggtcgaagcgctgcgggaaaaccaggtgctgggcatgttcaagggccgcatggagttcggccctcgcgccttgtgcaaccgcagcatcgtctaccatcccggcgatgccagcgccaacgactggctcaatcagcgcatggaacgcaccgagttcatgccattcgccccggtcaccgcggtagaacacgccgaggcttgctacgttggctggcgtgaagaccaggtggcggccgactacatgaccatgacctacgactgccatgcggatttccgcgagcgctgcccggcagtggtgcatgtcgacggcaccgcccggccgcagatcatccggccgcaggccgatccgttcatgcacgccctgctgcatgcctggcatgcccgcagcggccagccggcgctgatcaacacctccttcaaccgccacgaggaaccgatcgtctgcgccccgcaggacgccctcggcgcgctggaggacgggatggtcgacctggtggtgctgggcgagtccctgctggtctggcgcaagggcgagaacgccttcgccagggcgcgcttcgagtga

SEQ ID NO: 8372 - DNA, 1062 bp, Pseudomonas aeruginosa
  unsure (46): Identity of nucleotide at the above locations are unknown.
tccgccagttgcgttggctggacgtgcccttggcgctggtcaccancagttggccggcacgcatctaccacgtgctgcgccagcacgacctgcacgcggcgttccgcaccctggtcagccgcgacgacgtggtccacggcaagccggctccggatggctatcgcctggccgcggccaggctcggcgtggcaccgtcgcgctgcctggtgttcgaagactccctcagcggcgtgcaggccgcctgtgccgccggcgcgacctgcgtggcgatcggcgaggagagcggcctgctcgccgccggcgcgcgctggtcggtccgggatttccgcgagctacggatcgtccgcgaagacgaccggctgtactgccagcatcggcaccccgccacgaccggcagcgagaggagcgttggcgtcccatgagcccgaccctgcaagatgcccggctgctctgggacttcctcggccagggccgctgccatgtgccctgcgaactgctggtggtatgcggctcctacgacctgcgggtctgcgaccacgcctgcgaactgctcgaacgcggcctcgccgaacgcctgctgttcaccggcaacaccgggcactggacgcgccatctctgggtcgagccggaagccgagctgttcgcccgccacgccagggcgcgcggggtaagcgacagcctcatcgtgatcgagccgcgggcgaccaacttcgccgagaacatcgccttcgcccgcgagctgttccccgacctgcgccgcacgaccttcgtcaccaagcccaactcgatccgccgcgtggcgctgaccctgccggtccgctggccgggtctggagggacacgtggatgcgcccgactacgcatttcccgacggcatctcgaacctggtcggcgtactcggggtgatcgacgagatggtcggcgacctcgaccgcatcatgcgttacccggcgctgggcttccaggtcgcctgcccgatcccggcgcaggtcatggacgcctgggaacgcctggtggcgcgcggtttcgaccgccacttggtgaacccgccgcgctgagctga

SEQ ID NO: 8373 - DNA, 1230 bp, Pseudomonas aeruginosa
ccgcttcgcggttatccgcagcccctggcttcggcgagggcgggtcgagccggccgctcagcctgccctggataccccgaggaacggctgccacgccggcgcgccactatccgccgcggccttgagggcggccaccgccgcgtcgacgtcggcctcgcgggtgtagcgaccgaggctcaggcgcacgctgcggccagcgctggcggcatcgtgaccgagggcgagaagcacgtgggacggcgccggccgcgccgagttgcaggccgaggtgctggacaccgccaggctggactccagtgcctgggggacaaaggccgggttgtcgaaggtcaggttcagggtatgcgcgatgcgtgcgtcggcgctgccgttcaggcgccagccgtcgatctgcgccagcccctccagcagacgccgctggagtccggcgatgcgcctgccctcctcctcgaaaagctcgccggcgagggcgaaggcctcgcccataccgacgatctggtgggtcgccagggtcccggaacgcaggccctgctcgtgtccgccgccgtggatctgcgccttcagccgccgctcggcgcgcggcccgacgtacaacgcgccgatgcccttgggcccgtaggtcttgtgtgcggagaacgacatcaagtccaccgccaggcggcccaggtcgatcgccaccttgccgctggcctgcgccgcgtcgacgtggaacagcgcgccgcgctcgcgcacccgttcgccgatggcggcgatgtcggtcagggtgccgagttcgttgttgacccgcatcagcgacaccaggcgggtatcggcgcgccaggccgcctccacctgttccggccggatcaggccatcggtgccgggcgccagccaggtcacgctccagccgtcatcggcgagttgctgcacggtgtccagcaccgccttgtgctccaggcgactggtgatcaggtggccgggtgcgtccagcgcctgggccacgcccttgagggccaggttgttggattcggtggcgccggaagtccagacaatctgcccggcgctggcgccgaccagcgcggccacctgctccctggcccgctccactgcccgccgcgcctggcggccgtaggcatgggaattcgacgcgggattgccaaaacacgcctggtagccgagacactccaccatggcccggatcacgcgctcgtccacgggcgtggtggcggcgtaatcgaagtacaacggtaa

SEQ ID NO: 8374 - DNA, 408 bp, Pseudomonas aeruginosa
agtcgatccccttcacgacctgcgtgtcgccataggcgacgctcaggttttccactcgcaacagttcccggttcatctcatgtcctcggatcgaaggcgtcgcgcaccgcttcgccgatgaacaccagcaggctgagcaaggtcgccaggaccacgaacacggtcagcccgagccagggcgcctggaggttgtcacggccctgcccgaccagttcgccaaggctcggcgagccgggcggcaggccgaaaccgaggaagtccagggcggtcagggtggtcaccgcgccacagagcaggaacggcaggaaggtcagggtcgcgaccatggcgttgggcaggatgtgccggaacatcaccccggcgtcgccgaggccgagggtccgcgccgccttgacgtactccaggtga

SEQ ID NO: 8375 - DNA, 2133 bp, Pseudomonas aeruginosa
tcccgcagcaccggcaggaaccactggccacggtattccagcagcagcgggcggtcgttggcgatcagctcggcgaacaggcaggtgacgaacagcgcgaggaacagccgcagcgccaggcgcccgcggcggttggcgcggaacgcggcgaggcggcggcggtgcagcggggaaaggacgatggccatctcactgtctcctcgcggcgaagtcgatgcgcgggtcgaccaggctgtaggccaggtcgccggccagcttcaccagcaacccgagcagggtgaagatgaacaggctgccgaacaccaccgggtagtcgcggccaagcgccgcttcgtagcccatcaggccgaggccgtcgagggagaacagcacctcgatcagcagcgacccggtgaagaacaccgagaccagcgccgccggcagcccggccaccaccagcaacatggcgttgcggaacacatggccgtagagcacccggcgctcgctgagccctttggcgcgagcggtggcgacgtactgcctggatatctcgtcgaggaagctgttcttggtcagcagggtcaggctggcgaaaccgccgaccaccagcgaacccaccggcagcgccaggtgccagaggtaatcggcgaagcgcgccagcgggccgaggcgctcggcgccctcggaagccaggccgcgcagggggaaccagtccaggtagctgccgccggcgaacagcacgatcaggacgatggcgaagaggaagccgggcaccgcatagccgaccaccaccagcgcgctgctccacaggtcgaaggcgctgccgtggcgcaccgccttggccacccccaggggaatcgacaccaggtaggtgatcagtgtcgcccacaagcccagggacagcgagaccggcagcttctcggcgatcaggtcgatgacccgcgcgtcgcggtagaagctctcgccgaaatccagccgggcgtagctcgacagcatcagccagagccgttgcagcggcggcttgtcgaagccgtactggcgctccagggcggccaccagctgcggatcgatgccggtctcgccgtggcgctgcggttccagagcgccatgcccaccctccccgccacgccccagcggaccgccgccgtcgacgccctgcaggcgcgcgatggcctgatccaccggcccgccgggtgcggcctggacgatggcgaagttgatcagcaggatgcccagcagggtcggcaggatcagcgccaggcggcgcaacaggtagccgcccatgtcactgcgcctcccggctcggcgcggcccgctcgcggacttcccaccaggtgttcagccccaggctgtagcgcggcgcctgcggcggtcggccgaagcgattccagctggcgatccagacctcgtcggcataccaggtcgggatcaggtagtagccccattgcagcacccggtcgagggcgcgcacggcggtttccagggcggcccgcgagtcggcctcgaccaccgcctggaccagccggtcgatggccgggtccttcaggccgatgcggttgtagccgccgggatcggcgtagctggaggaatgccagaagctgtactgctcgttgcccggcgaattggactgggagaagctcgaaacgatcatgtcgtagtcccgcgcacgtatgcgctcgatgtattgcgaagcgtccacctggcgcaggcgcatatcgatgccgatccgcgccaggttgcgctggaacggcagcagcgcgcgctccaggcccttgccctggagcaggaggtcgaagcgcagcggccgtccggcggtatccagcaggcgcccgtcgacggcatgccagccggcctcgccgagcaggcggtaggcctgcaccaggcgctcgtggatatcgccgctgccgtcgttcaccggcggagcgtaggcctggccgaagacctcctcggggatttgcccgcgcagcggctccagcaaggccagttcgtcggcgccgggcaggccgcgagcggccatctccgagttgtcgaaatagctgcgcaggcgcttgtagcgaccgccgaagagctgccggttggtccattcgaagtcgaacaacaggctcagcgcctggcgtacccggcggtcctcgaacagcggccggcgcaggttga

SEQ ID NO: 8376 - DNA, 507 bp, Pseudomonas aeruginosa
cgtagaccttgttcaggcgattcggatcgacgctggcgtcgccggcgttgcgctcgacccgcgccagggtgtcgcggcactgcgccgagtccggatcgagcccgccgctacggcaggccgcctcgtcgcgcagcagtttgtccggatcgagggtggtcagcaggtcatcgatctggatgtggtagtagtcggcggaaaagtcgaacctgctcgacggcgaccagacgaagccgtagctccagtagcgcccgcgctcggacttcaggtcgggcgtgccgctctgcacgtagtcgacccggccgttcttgcaggcgccgtcgacgcctttctcgcaaccgtagtagtccttctgcgccgggtagtagccgttggcgtcggcctggtagatgtagttcaggtccggcgcgcggaagctggtgccgtagctgccgcgtagcagcaggctggtcagcgggcgccactccagccccaggttgtaggtggtctgctcctcggtgcgaccgctga

SEQ ID NO: 8377 - DNA, 1509 bp, Pseudomonas aeruginosa
ttattttcatcagtgaaaggacggagaggctatttatcacgattccagcatgagaaacactggccgcgcccaacccagaccaggagtcccgccgtgacggaccgtgccgccccttccaactggatgctcgccctgctcgcctgcgcgcaactgatcatcgcccttgacgccaccatcgtgttcgtcgccctgccggaaatcagccgggcgctggatttttcggcgcaacgcctgcaatgggtggtgagcgcctatacggtggccttcggcggcttcctcctgctcggcgggcgcgccaccgacctgctcggccggcgccgcatgtacgtcctcgggcaaagcctgtacgccctcgcgtccctcgcgggcggcctggcccagagcgagttgccgttgatcctcgcccgcgccgtgcagggcctgggtggcgcgctgctgttcccggcgaccctggcgctgatcggcaatcacttcgccgagggcccggcgcgcaatcgtgccctggcgatctggagcatcgcctcggcgttcggcctggccctcggctcggcgctcggcggcgcgctcaccgagctgttcggctgggcctcgatcttcctggtcaacgtgccgctggccggcgccgcggcgctgctcgccctgcgcctgatcccggccgacgcccggcgccagcgcggtcggcgcttcgacctggccggcgcgctgacggtcaccgccggcgccaccctgctggtcttcaccctggtccagggccccgagtcgggctgggatgcgccctcggtacgtttcggactttacctttccgtcccgctgctactggcgttcctcgccatcgaacactacagccgcgacccgctgatgccgctgcgcctgctgggcaaccgcaacctgcaggtggcgatgctgctgaccgcgatcttcatgagcagctacggcgtgcagtactacttcctggccatctacttccagtcggtgtacggctacagcgtgttgcagaccggcctggcgttcctcccggcgactctgctctgcaccctcggtatccgcgtcgccgagcgcctgctggcccgccacggggcacgcgcgacgctggtcgccggcctgctgctgggcgcactcgggctcggcctgctggcagcgtgcctgccgctggggcgcggcttcctggcgctgctgccggccatcgtgatcctcagcgtcggccagggcatgacctggaccgccatgtgggtgagcgccgccagcggcgtcgatcccgccgaacagggcgtcgcctcggggatggcctcgatgacccagcagatcggcggcgcgctcggcctggccctgctggtggcgctggccaacgcccaggtgcgcggcgccgatgccgccagcctgctggccagccaggcgcgcggcatcgaatgggtgaccgcgctcagcgccctgctcgccctgttcggcgccgccctggccttgcggctgcgccgtgaggaacccgcggcgttgcagccgagtcgcggctga

SEQ ID NO: 8378 - DNA, 1473 bp, Pseudomonas aeruginosa
gcggcgaccaggtctacgccgacgacgtcgcccgggccgatgctggtggccatccatgggctgatccgccgcctcggcctgtacggcgaacacctggaaggcgcgctggtggacgacagcgaggcgctctacgcacacccggccacctactaccggcgcgaggacctgctgcccgccttcaagtccaacgaagccctgcgcgagcgcttcttcggcggggtgaagaagccgatcttcacctcggccaacgcccacaaccatctggtcggcctggccgaggtgctggcgatgtacctgctggtctggtcgccggcgccctggcgcctggtcaggctggaaccgccgccggggctggatgcgcggcacgcgcagcgcttcgccgacgagcgccggcacatcgaagccttccgcgatggcctgcccggcgtggcgcgggcactggcgcatatctcgtcgctgatgatcttcgacgaccacgacatcaccgacgactggaacctttccgcgcgctgggagctgaccgcctacggccatccgttctcccggcggatcatcggcaacgccctgctcgcctacctgctctgccagggctggggcaacgacccgcagcattgcggcgaatggctggcgccggtcgcggccctgatggagggtgccgcggcagacggccggctgccctgcgccgagcaggaccgcctgctcgatgccctgctcgacttccagcactggcactaccggttgcctggcagcccgaccctgatcgtcctcgacacgcgcacccgccgctggcgcagcgagcgcaacctgggccggccctccgggctgatggactgggaggcgctgagtgaactccagcaggatctgctcggcgaaaaggcggcgatcatcgtgtcgccggcgccgatgttcggggtcaagctgatcgagggcgtgcagaagctctttagctggatcggccagccgctgctggtcgatgcggaaaactggatggcccatcgcggcgcggcctcggtgatgatgaacatcttccgccactcgcgcacgccgggtaactacctgatcctttccggcgacgtgcattactccttcgtctacgacatccggattcgccaccgcgagcacgggccccggctctggcagatcaccagcagcgggatcaagaacgaattcccgcgacgcctgctggactggttcgaccgcctcaaccgctggctctatgcgccctggtcgccgctgaactggctgacccagcggcgcagcctggaaatccgcccgcgcgttccgcagcacagccaggccggcgagcgcctgtggaacagcgccgggatcggccaggtattcattggcgaggacggccgtccgcgcgcggtgttgcaggtcaatgccgatggctcgccggcgaccgccttcgagcgacatcgcgacgtcgaagacgaacgagcggaccagtcgccggtcgcgccgggtcgctga

SEQ ID NO: 8379 - DNA, 1014 bp, Pseudomonas aeruginosa
tcctgccatcgcgcagcgcgatggatgcctgtcgccgcgacgcgcgctagtcttgggaaggtttcccccgcgagtccccgcatgagcgaaaacaccccgcttctttccgtcgatctccccgccgaattgcgccagcgccagagcgaactggcgcagtcgctgctcaggcattgcccccgcgacggtatctacggcaccgccgtcgaacccctcgccctgatccgcgccgacggccccaccctgccggcgcgcggcatgcacaaacctgccctgtgcatcatcgcccagggccgcaaggaggtgcagttggccgaggaacgctatatctacgatccgttgcactacctggtggtctcggtcaccctgccgctggccggccaggtgatcgacgcctcgccggacgcaccctacctctgcgtccggctggatatcgaccctgcggaaatcacccaactgatctccgacgccgggcccatggaagtggccagccggcgcggcgaccgcggcctctacgtcgaccgtatcgacgccagcctgctggatgcggtgctgcgcctgatccatctgctggatagcccgcgcgacatcccgatgctggcgccgctgatcctccgcgagattttctaccgcctgctgcgcagcggccagggccagcgcctgcacgagatcgccatcgccgacagccaggcccaccgcatcacccgcgccatcgactggatcaaccagaactacggcaagccgctgcgcatcgagcaactggcccaggtggtcaacctcagcccctcgaccctgcaccaccgcttcaaggccgtgaccgcgatgagcccgttgcagtaccagaagcagctgcgcttgcaggaagcacgccggctgatcttcagcgagggcctggaagtggccgccgccggctaccgggtcggctacgaaagcccgtcgcagttcagccgcgagtacagccggctgttcggcgccccgccgctgcgcgacctggcgcgggcgcgcaacaccgcctag

SEQ ID NO: 8380 - DNA, 1443 bp, Pseudomonas aeruginosa
gggaacgcggcagcggccgcgacggtcaatcgggaagcggcggcataccttcgtcgccccgaccgaccttgcgcaaccgtacccgccatgacccgagccctgcccctgctcctgcttgccctgtcccttcccgccgcggcgacggacagcgagtcgttcgcccgccgctacctggcctatgcccatgccgtcggccagcacagcgaacgactctggcccggctggcggatggccgacaaggccttcctctacagcgatggccgcagtacctgggtcgccgatgccgaaggccgcgcgcagcgcaccacggtggcgggcgacagcgacccggatctcgacctgagctatgcctttccgcgttaccggggccgtccggcggtgctgctgcagatcagcgccgcgcacctgcggagcaataccggcaatagcgagacgctggccgccatcggcccgcacgaagccttccatcactacgcccaggaagactggccgggcctgcgcaagcccggtggctatcgcggcgacctggccacgctcgacccgcgcccgcgggaataccgctatgccctgttccagtcgctgctccaggccctgcgcacgcccgggcagcgcgacagctacctgagcgacgcccagggctggctgcgccgctggcgcgaagcggctcccgaggaaagccggctggcggcgcaggtcgatctcagcgaaggcaccgcgcgctacatcgagatggccgccgccgcgcgctaccgcaccgatttcgccgaggatccgcaacgctatcggcaggcgctgcgggagtacgccctggccttctacgatgccaacgagatcggcgtcggcgtcgacagcgaagcctacgagatcggcgcgctggccggagtgctgctggacctgcgcgacgacgacgcggactggaaggaagccgcgacggccggcacctggccgctggactacctgctgcgcgaccagcctccggcctggagcgaacttcccgacgacgcgcgggcgcgcggcgagcgctaccggcgcgagatgggcgccacccgccagcgcctggtcgagttgcaggaggccttcgccgacccacggcgaccgctgctggtgatcccgcaaccgcgacgcaccatcggcttcgccacggcggccagcgaggtgcgcgggggcttctacgtccttgccgacgggccgttccgccaggcctacctcggcgcgcgctggaatgtcggcgagctgaccctggacggcgtcgactatctggagggcgacgccgaggcgtactgcccgggctacggccgttcggcgctgattccgttgcgcggaggcgattggcgcgaaggcacgctggcgccggaagaacccggcctgcgcggccgcctggcgactgctcgcagcctcgtcgacgggcggaccctttattgcgcggcggagaatgctccttga

SEQ ID NO: 8381 - DNA, 417 bp, Pseudomonas aeruginosa
tgcagtacatcaacgacacctaccgctacctgggcgactggcgcgccagcgagcgcggctacgtgcccttctccctggcggagatcgagcgcaatggctacggcgactgcaaggacctggcgatcctcctcgccgccatgctcaaggccgccgggatcaaggccgaaccgaccctggtcagccgcggcgacgtggtctgggacctgctggtgcccggcatgtacgcgccgaaccatgccatcgtccgcgccgaggtggacggcaagacctggtggctggacccgaccaacccggtgttcgctcccggccgcaccatgcccgacatccagcagcgctgggcgctggtgctgggcgccgacggcaaggtgcggcgcgacgagattcccctggaagcgcccggcgacaccctgcgcgtga

SEQ ID NO: 8382 - DNA, 489 bp, Pseudomonas aeruginosa
tgcagctcagcgtcgccgatcgccagcgcggccgcaccagcaccgaccaggacctgtgccgcaacttcgccaaggaaggcagcgactgcgtgctggagcgcgacgacagccagttcgtgctgccgcccagctatacgatcagtgccaggcttaccgaccgccgcgccctcgaccggctcggcggagagtatttctacaaccgccaggacctggccagccagtgggatgccttcgccaagtaccgtagcgaaggccagttggccgagctgtacctgggcgaaccgcagatcacgtcctacgacatcagcctgtccggcggcaagactgacgagccggcgcacagttgcgagatccgcagtccctggttcgacatcgacctgcaggccgaaccggccaaggatggcggctaccactatcgttatcgggaagtgcagaagaccagttggctcaaccacgacgagatcaacagcgccgagttcggcaagctga

SEQ ID NO: 8383 - DNA, 840 bp, Pseudomonas aeruginosa
gcggccgcaggtagtcgtcggggctgccctcggcgtccagcagctcgggatagaacccatcgttctggatacccgcgccgagtgccgcgaggtgcacgcgcagctggtgcttcttgccggtcaccggatacagccggtagcgccaccagcggccgttgcgctcgacgacctcgatgcgcgtctcgctgttcggctcgccctcgccttcgcgcatgcggaagaacggctcgccgggcaccaggcgggtcctgcgcaacaacgggaagtccagttgcggcaaggccggagcgatcgcttcgtagcacttgtcgatgcgccgctcgcggaacagcgcctggtagcgcccgcggctgccgggattggtcgagaacagcaccagcccggcggtatgccggtcgatccggtgcagcggcaccaggtcgcgattgccggtgctgcgggccagccgcgccaggagcgtctgctcgacgtagccgccggccggcatcaccggcaggaagtgcggcttgtccgccaccagcagatgctcgtcgcggtacaggatgcgcgcctcgaaaggaatcggtgcctccaccggcaactcgcggaaatagtgcacacgcaggccttcgcgatatgccgcctgcgggcccagcgcacgcccctcggcgtccagcacccggccccgctgcatgcgcgccagccaggtgtcccggtcgatggccgggaaacgcgcgcagagacagtcgagcacggtgctccagggaccggccggcagatgcagggtgctggcgcggagactggcgtcgggcaaggaaggagacgacatgcggcaactcgggaaggacgggcgaccattag

SEQ ID NO: 8384 - DNA, 249 bp, Pseudomonas aeruginosa
gactgcaggaaatacgacacggtgatgaagatcaccccgccgtacagcgcggtgaggaagatcgcccgcgggatcaccctgccggcgtcgcgggtttcctcggacagcgtagtcaccgcgtcgaaaccgaggaaggaaaagcagaggatcgtcgcccccgccaccatcgccgagagatgcgcgtgctcggagaagaacggctgggtactgagcaccgtggcggtcccctccccgttgttcaggccgtga

SEQ ID NO: 8385 - DNA, 474 bp, Pseudomonas aeruginosa
gccaacccgatcatgacgatctgccacagcttgagggacttgcgaagctgggttcgttctgcggtggggggaggattcgacatgggtatgcttgcctcgatttcttctttttctaatgcacagcaaaggaaggcggacgggcggaaaccgcaggcttgccgccgtctaccttcagcaagggtgggaacctcgacggaagaacggggggctttctcctcccctcctccccctatctccccctctttctttttccctccccttccctccccccccccccctccccctttcctctccctcccctttcccctccccccccttcctctccctctccttcctcttcttttcctccctcccccttctttctcctcttctcccccctcctcctctcttcctctccctctccccctctcccctcctccccttccccttcctcccctctccctctcttcctcctccccctctccctcctgcctc

SEQ ID NO: 8386 - DNA, 543 bp, Pseudomonas aeruginosa
cctgtgttgaagactggccgcgcaaggctgggcggcccccgcgccgacggcaaggccctggccgcaggcgacagcctcggctggctggccgatggcgcgcgaccgcgcgcgctgcccctgcccagcgaacggatcatggactgcaccggcgaagcgcgcctggagctgatcctcggcgcgcagatcggcgacttcccggccatgagcctgttcgatgcgttcaacggcgactggcaggtggatacccgcgccgaccgcatgggcgtacgtctgctcggcccgcgcctggaatgccggcagcagtcgatgatctccgaaggcatcgccctcggcgcggtgcaagtgccgccggacggtcagccgatcgtcctgctcaacgaccgccagaccatcggcggctacccccgtctcggcgccctcgccccgctggcgctggcgcgcctggcgcaatgcctgccaggccagccggtacggctgctgccgacggtgcaggaggcggcgcaccgcgagcatcgacgcctgctggcggcctgggacgcatag

SEQ ID NO: 8387 - DNA, 1446 bp, Pseudomonas aeruginosa
ttcggagaaaatatgccggtcaaagcaaatattgacaccgattcaattttcagattcttcctaccagaagggcccggcctgaagtacaaacggctggcccagggcatcgaagaatctattcgcaatggggttctccggcagggagtcaagctgccgccacatcgcatcctcgcggacaagctcggtgtgaccgcgggcacggtgagccgggcctatggtgagctggagcgcatggggctggttgaggctcgggtcggcgacggtacgttcgtccgcaaccgcggtcgagaacgtgctcgggaggcgggctttcgcaatttcgtagacagcaccgagatgtgcaacgacatgagccggaatatgcatattccgggcaatgagaccgaactgctttcccgcagccttcagcaattgagtgcggcccctgagctcctgcaggagttaatgctctacacacccgacacaggactgctccgacaccggcaagcgggagcaacatggctgtctcacggtgagtttcaagcggagcaccagcagattctgtgcgtcaatggcagccaacacggtctgctcgtcgtgcttatggccatgctgcgcgccggcgacaccctggtaacggagcagctctcctatcctgggctgatcagtgccgcgcaactgttgggcatcaaggtgctcggcttggaaatggatgaagaggggctactgcccgacgccctcgaagaggcctgccgcacgaacaggatcaccgccctgtactgcacacccaccatccagaacccgaccactgcagtgatgtcaggcgccaggcggaaggaaatcgcgaagatctgccgcgagcacggcttgatcgtcatcgaggacgaaacccatgctgtattgatggccgaacgccccacccctctctgccatctgctgcctgagcggggcatcctcatcggtggcatgagcaaggcggtcgctgcaggattgcgggttggatacgttcatgctcctgcatccatggtaagtcgcatggcagcagcgcttcgcaattcgtgctggatggcgacaccactggttctcgagattgcgagccgatgggtcgaggacggtactgcaagcgcactgctcgaataccagagaggggaaatcgcgcgtcgccaagcgctggttgtggacctgctgcagggcctgacctatcgcagccatctatgctgtccgcatttctgggtagaagtgccagccccctggcgcgccatcgaaatagagcaaggcatgcgcggacagcagcatcttgtcaccaccgcagaggcctttagtacgggccgcggtacgcttccccaggccattcgaatcagcgtcagcaattccccaggaggggggaatacgttatctgacggcttcgcagtcctggcagcgctcctacgcgaaggcccccaagagatgctgacgatgcgtgcttga

SEQ ID NO: 8388 - DNA, 1110 bp, Pseudomonas aeruginosa
tcaggatgttctgcacctatcgccctccacgctgcattcgacgacgaacgcggccgcctcgtccaacgcccggtcggcgctggccaacacgccggcatgggcctggaacacgtgccagcaaccggcgtagcgctgcaatcgcaccgcgacgccctgctcaccggcccgttgcgccaggcgcaggctgtcgtcgcgcagcagttcgtcctcgccgacctgtaccagcagcggcggcagccccgccaggtcggcatgcagcggcgacaaggcggccgagcctggctccgcgtcggccggcagcagcaggcgcaccgcgctttccagccaggcccgcgacagcagcgggtcgccggccgccggcgtgtgcaggcgctggcagccgaggtcggtccagggcgagaacagcagcaacccggccggcaacggcaagccgcgcgccttcagctccagggccagggacagcgccaggtggccgcccgcggagtcgccggcgagcagcagccggcgcggcgaatggccggcctccagcaatgccaggtagaccgccagggcgtcgtcgcgggcggcggggaacggatgttccggggcgcgccggtagtccaccgcgcagacctcggcggcgcaacgccgggccaggtgcgtggtgatcgcccggtgggtcgccggcgagccgatcaggtaggcgccgccgtgcaggtagagcacccggcgccgcgcctccaccccgcgcggccgcaaccactcgcagggcacgccggcgaggctgcggcgctcgcggacgacgccgccggcgcccagcgtcgccaggctcagcccgcgcaacacgccgcgttgcagcgccactggcatgggcggacggaccagcccgcggaacaacaggcgcaggcagccgcgcaggagaccggcgcgcaggcgttgcggcggcgacatcaggggcgcttcagcgggccaggtcatagtcggcaagctccggccggcgcgtacgccagcgatagacgaaggtgtagcccggccagttgttggtgttcttgccggcggcagtcttgtaccagctgtcgcagccacgctcccagacggtatggcgcaacccctgttgcacctccaggttga

SEQ ID NO: 8389 - DNA, 456 bp, Pseudomonas aeruginosa
gcccccgatccaggcgttgcagccacggccagcgcgccttcaggcggcgttcccagtcggcgtaggtgcggtccggcttggcgatcacgtaaggcgcgctgcgctggaacagcgacaggcgttgcacctgcggggcgatccgcgggacgaactggatggcgctgggctccggtgccgatcaccgcgacccgcttgccggccagctcgacctcggcgtcccagttcgccgagtggaacgccggaccctggaagcgctccaggccgggcaggcgcggcagcagcggccggctcaactggccggtggcgcagaccagggcccgtgcgcgcagcgtctggccatcggcgcagcgcacctgccattcgccgctgccggcgtcgaaacgggcctcctccacctcgcagtggaaacggatcttctcgcgcagacggtacttgtccgcgcaatgccgcaggtag

SEQ ID NO: 8390 - DNA, 1122 bp, Pseudomonas aeruginosa
agcgcacctggtgctcgacgacgccggcattcccgaggacctgcggattttcctcctcgaacgcgacgccggtggcgtgctgcgcatccagcgcgacctcaccgggcagcgcctgccgatcctccgcgccggcttccgccgcccaccgcccgccgatcccgcgccctacgtgcgcgagctgggcctgtgcccggcgttcggccaggcggacaaccgggtggtcttcgaacggcgcttcctcgacctcccgctgcccggcgccaatccagaggtggcgcgcgcctgcgaggagcagtgccgcgccctgctcgcccgccgccaggtgcgcggcggtctggccggacgcatccgcgaccgcttgctgaggacgcccggccacttgccggacatgcagaccctggccatggaactgcacctcaccgtgcgtaccctgcgtcgccgcctggacgacgagggcagcagctaccgcctgttgctcgacgaggtgcgccaggccctcgccgaagagctgctggccaccggcgcgattcgcctggaggagatcgccgagcgcctcggctacggcgaggtgtccaacttcagccatgccttcaggcgctggaaaggcatgacgccgcgccagtatcgccagcggcgacgactcgacgcgatgtcctgagccgctccgggcttattccacgaaggcaggacgccagcgctcgatgttcgtttcgccgccgcctgccagcggctagattggccgttcacgcgcggcatccggcggcgcggcagcggaggcatctccgctggcaacgggagaacgacacatgggttgccagcaacacgcatggccggcgcacgcgccggagcaggtcgaggccgaagtcaactatatccgcgacaacggccaacggccggtcgcctacacctatccggcccccgccgggacgccgcagcacagcgcgctgttgcagccgacccgggtggcgatccgcaatgcgcgtctgctggcgcaaccggccagcctggagcgcgagggtttccaactggtgcgcgaggcgagcgcggtgggcgatttcgaggatgaagcccaggttcgtgaacgctactacccggaaagcatcgccctgctccgccgcctga

SEQ ID NO: 8391 - DNA, 1248 bp, Pseudomonas aeruginosa
ggaatcaatcgaggcgctccccgcagtccgccctgcccgccggccgctgcgcggacagccagccgcaggcggggggcgcagaggatcagcgcggcgcccccccagggggagcgcgcgcaccgccacctgatccaccaggatcgcgccgatgaaggcgcccagggccacgccgagctggatcgcgctggtgttgaggctgatctggatcgccgcggtgtccgggctgagttccaccaggtatttctggatcgccggccccggcgccatgttgaacacgcaccagaacaccaccgcgcccagcagcagcggcaggccgccggtggcgaacggcagcaggaccagggccagtgcgtgcaggagcaggaaggcgacgaaggtggccggccccggccagcggtcggcggcgcgtccgccgagcagcgcgccgaggatgccgccgcccccgtagaccagcaggaccaggctgatggtcggtttgtcgagggccatgctgccgaccaggaacggcacgatgtaggtgtagacggtgaactggccggtcatctgcaacagcgatgccaggtgggcgaacggcacccggccccgggccagcgcccgcagttgctccgccggggcgatgccgggcgcgccgcggatggccggcagcaggcgcaggagcagcggcaggccgagcaacgcgaccccggcgagcagcaggaacaggctacgccagccccagaactcgccgatcagggtgcccagcggtacgcccagcaccagcgaggcgacgatgccggcgaacaccagaccgatcgctcggccgcgccgttccggcgcgacaatggccaccgccagggtgatcgccaccaccacgatgaccgaggcgctggccgccaccagcagccggctcgccagcaacagggcgaagctcggcgcggcggcgctggccaggttggcgccgatgaacgccagcagcgcgccggccagcaggcggcggcgctcgataccggcgctgaggtagaccagcagcgggccgagcagcgcatagaccagcgcgtacaggctcatcagcaacccggcccggccctggctgacggcgaaactggcggccagttcgtcgagcaccccggccaccaccagttccaccgtgccgaccacgaaggccagtccggccagcagccagacgccgacctccgccctgctccgttcagtctcgcccatggctgcgtgcctccccgtcgatggcgtagcgatagcgcccgagcatga

SEQ ID NO: 8392 - DNA, 594 bp, Pseudomonas aeruginosa
cggcgaacacgccgaggatcaggttgccgacgatcagccagaagtccgccgagcgccaggcctggcctggcgtcgctccgggcagcgcgtcggctggcgggcgccgcgcctgcggcaggtcgccgggtcgctcgcggaacaacgcatagagcagcggcagcgccaggaggccttcgagcaggccatagacgaggaaggtggcgcgccagccgaaggcgtcgatgcaggcgctgcccaggtacagcgccagcggcccgccgacgccgaagccgagtccgaggatgccgtaggccgcgccgcgacgacgctcgaaccagccgccgagaatccgcgcatagggaatgttgcccggcgtcagcaggccgagcagcgcgaacagcaggtatagctgccagccgctgcgcgccagcgccaggctggccaggcacagggccagcgcggcggtcagcggcaggaccagggcgcgcgcgccccagcgatccaccagccagcccttcagcgggctactcagggctaccgccaggcccagcagggtcaccggcagcgccgactggccgcggtcccagtccaggtcggcggcgatcggctcgatga

SEQ ID NO: 8393 - DNA, 663 bp, Pseudomonas aeruginosa
tcaccagcccggtggggccgaagatcacccccactaccgaggccagcagcaccccacaactggccacgccgaactcgccgacgccaggcgccgccggcgcgacgtcctccatggcctcgcgggcgacgccgctcatgcgtcgcgcctcaggcgctcgatcagttggcggcgcaagcggatgtcctcggcgttctcggtggtggcctcaagctggacgatctcgatgccggcgcgatgaaaggccaggatctgttccgccacctcgccgacgctgcccaccagcaccccggcgaagctgcgctgcacggtattcgccacccattcgcgcaaggcctccggctccagccgggcgagccggtcgcgctcgccgtcgcgggcgacctgcggcgatgccgccagttcgtcgaggggccgtgccagaagcagttcgaaagcggcctggcggtagtgctcggcgatgtccagggccgccgccggactgtcgccgaggatcacctggaagtgcttccagaacttcagccgccgtccctgctccgccgcctcctcgttcagcctgcgcttgagctccgcggtctgcgtggggctggcgaagtggccggcgtagacgtcggcgaagcgcaccgccaggcgttgtgcctgcgccgaggagccgccaacggatag

SEQ ID NO: 8394 - DNA, 3345 bp, Pseudomonas aeruginosa
cggcgggcgcggccgctggatcggcaggaagccgctgccggcgtcctccagccggtagaactcgccgtggtagtcgaagggttcgcggctttccagggcgcgggtgaagacctccaggtactccacggcgcgccggtagcgttcgtccttgtcggcgaagtcgccgtcgcggcgcacgtcggcgtcgctggagccgatcaccaggtgtacgccggcgcgcccgttggacaggccgtcgagagtggccagggcgcgcgcggcaacggtcggctgggcgctccccggtcggtgcgcgacggtggcgcgcatgcgcggcgccgcggccaaagcccagccggcgaccagccaggggtcgggccaggcagcggaaacggtgaacagcgcgccgtcgaggccgtccgcctcttccaggcgggccttctgctggatgtcgaaggcgctcaccgcgcgactgcgggtgtccggcaggaaacgcgcggcctggcgggcgaaggcactgtcgccgatgaccgcggaggcgcgcacgccgccgcgcagttcgatgctcatggttcgtcctccttagaaggtgtaggccgcgccgaggtagtagaaggcgccgttgaagctgatctgcgaggcataggtgtcgtactggttgaagccgaggtaggcgctctcggccggcagcttgtcgggcttcacgtcgaacagattgttggccccggcgctcagggtcaggttgcggctcgccgcatagcgcagggcaacgtcggtgatgtacttgggcgagttctcgaagcggttgaagaccgtggtcgaataggcatgctcgccggtgtagtagtccagttcggaaaccgtcttgctgtagcgcgtttcgcgcagggtcaggccccagcgccggtagctccagtcggcctgcaggctgacctggctgcgcggcgtggagctggtgatccaggcctgctgctggtcgttgagcagcggctggccgttgcgcccgcgatgattcctgaccagcttcgtgcgattgacgttggcgcccaggcgccagtcgatccggccccactcgccgagccgggtcaggtagctggcggtgaggtcgaggccgtgggtacgggtgtcggcgccgttggtcatgtagtgggtgctgacctgggtcagtccggccgggatgctgatcccgccggcgcgcagcgcatcgatcgccggctgtccggaataggtggcaccgtcgacgatgcggtcgcggatctcgatgcgataggcgtcgatggccaggttcaggtccggcaagggatcgagcaccaggccgaggttgtagctgatcgatttttccggctccaggtcttcggcgccgagcagcctggccgccggcgagttgaccgccagcaggccgctggcgatggtcggcgagacgcccaggcttgtgtagttctcctgggccagcgacggcgcgcggaagccgctgctgagactggcccgcgccgatacctcggggctgaagcggtagcggctggcgagcttgccgttggtggtgctgccgaagtcgctgtagtgctcgtagcgcgccgccgtctccagttgccagcgctcgtcgagggcgatggacaggtcgagataggcgccgagcacgtcgcggctccactgtccggcggtggccggcgcctgcccggggagtgccttggaaccgccgttgtagtaggaccagggatcgccggcctcgacctcgtagagctcgcggcgctgctccaggccccaggagaaattcagcggcgccggcagccaggcgaggtcgaagtcgcggcgcaggtcgagattgttggtccactgggtggccttgtagcgcgccaggtcgaaggagcgcggcgaatcgccggtctcgccgtagagggcgaggttgatcgaatggtccatgccgatctccgggcggtcggcaccgtaggtcgaactgaggtcccagtcccaggcgccgaacagctcgccgccacgggcgccgagggtcagcgaatagtcgtcctcgtcgctggtgatgcgcggggtgaagccgttcggatagagtcgcggcgccagggacggcaactggtagatctgcgccgaggacaccgagcgatgggtataggtggcgaagctgtacagctcgacgttgtcgtccagcgccacgccggcgttgtaggccagcgcctggcggtgcagcgaagggtcgccgatggacgggttgccgtagtgcccggtacgctggtcgatgccggcgcggatggtccgcgcctgttcgcggaactgcgcgctgaggttgaggaaaccgctctcgccgaaacgcaggccgccattcaccccgccgttctgggtcaggccgtcgccatcgccgtagcgaccgttgtcgtaggcgagccggccgccgtggtcggccgacttgaggatgacgttgatcaccccggcgatggcgtccgagccgtactgcgccgaggcgccgtcgcgcagcacctcgatgcgctcgatggcggcgagcgggatggtatccaggtcgaccccggtggagccgctctgcagcccgccgctgacattgatgttggcggtctcgtgacggcgcttgccgttcaccagcaccagcacgtggttgggactcaggccgcgcagcgactgcgcgttggtcagcgccgaagcgttgtaggcctgggcctggcgcgacagcgagggcagcaggcgcaccagggcgtcgcgcaggtcgccgctgccactgtcgcgcaattgctcggcgctgaccacatcgatcggtgccaggctctcgccggccttgacatcggccttgcgggtgccggtgaccaccaccgtggccagggtcccggcgggcttcgccgccggcagcgcggcatccggcgccgtggcgcgttgcaggctgagcacgccggcggcgctgcggatgtattccaggccgctgccctgcaaggcccgctgcagcgcctgctcgacgctgtaggagccctggatcgccggtgccggcaggccctccaccaggtgctggtcgaaggcgatcggggtgcgactctggcggactatgctcagcagtacctgggccagttcgccggccgggatgtcgaagcgctggatctcggcgctgctggtggcgcggacctcctctgccgccgactcgccgggctggccaaggcaggccaggccgaccgcgcagagcacggggacaagtcgaagacgtggcgaacgcgggttggacatggtcggttcatccttgatcggttgcggatgccaccgagtgcaattgcccgtaccgattttcagccgcgcggcagaccgattgcgcataaggttatgcctcgccctcccgagcccggcagcgccagacactga

SEQ ID NO: 8395 - DNA, 540 bp, Pseudomonas aeruginosa
gcggacatcgccgcgtgcacctcgaacacccgctgtcgccagagcgtcgcctgcgccgccggatcgcgttcgacggcgctcatcggagcgcctcccggtggctggcgagaaaccccagcaggtgctccagcacggcgtccggcacgtcctcgggaagcatgtggctggcgccgatggcggcgccctcgacctgcccggcccaggtcttccagatttccagcggatgctgcccggcggcgtaggggcgctcctgccagagcacctggaccgggcattgcaggcgccggccggcgtcgcgatcggcctggtcggcgtcggcatcgacgcccaccgcggcccggtagtcctcgcacatcgcatggcgcacggcggggtcgcggaacgcccggcggtaactttccagcgcctgcgggtggtagatgtcgcggccctgggccatgcgtcgcagggtgtagtcgaggaagtgctccggatcggcgccgatcaggcgctccggcaggtcgtacggctgggcgaggaggaaccagtgataggcgttga

SEQ ID NO: 8396 - DNA, 300 bp, Pseudomonas aeruginosa
cccccgaacacctcgccggccagctcgacgacctgccctcgcgggtgctgctacggaccttcgaacgggtcccggcgaactggccggaaggcttctgcgctatcgctccggccaccatcgagtgcctcgccgagcgcggcgtcaggttggtcggcatcgacaccccgtcgctcgacccccagcactccaagaccctcgacgcccaccacgcggtgggccgccacggcatggcgatcctcgaaggcgtggtcctcgacgacgtgcccgccggcgactacgaactgctcgccctgccgctga

SEQ ID NO: 8397 - DNA, 492 bp, Pseudomonas aeruginosa
tgctcagccatgtcaactacaagaccggctacctgcacgacatgcgcgaggtcacccgcctggtccacgaaaacggcgccctggcgatctgggacctggcccactcggccggcgcgctgccgctggacctgcacgcggccgacgccgactacgccatcggctgcacctacaagtacctcaacggcggccccggctcgccggcctacgtgtgggtcgcgccgcgcctgcgcgagcgtgtctggcaaccgctgtccggctggttcggtcattcccgccagttcgccatggagccgcgctaccagcccggcgaaggcatcacccggttcctctgcggcacccagccgatcacctcgctggccctggtcgaatgcggcctggatatcttcgcccggaccgacatgcagcgcctgcgcgacaagtcgctggccctcgccgatctgttcatcgaattggtggaaagccgttgcgaacgcttcggcctggccctggtga

SEQ ID NO: 8398 - DNA, 675 bp, Pseudomonas aeruginosa
aacgggcaacgccctaggcgctctccgccctgcgaacctggcgcgcacggcgaagcccgaccggcgcgccctttccggaccgggcggttccgtttcccataccttttccgtcgcacaaaaagcattacccgccggccgccgcgactccgtagcgtagtgcccaaccggacgttccggcccgcggcgcgccgcggccggcgcgctcccgtcagggacgaagtggcggcacgcccagccatcgagcgcactgcatcgctctgccctgtggggacgcagacgtcgtcagccatgaggggaacacgatgcatccgaccttttcgcgggtcctgctggccgccgcactggccgccgccggcagccctgccgtcgccaccgaaatccagctcgagcaaggctggaacgccgagcaacgcgcctcctggtacgacgcctcgctcggttcgcggctgctgccgctggcctgggcccaggcgctggagcgtccggacagcgaggagcgcctgttctccgaagacaacgcccggcgcctcggctttcccctgcgcaactggcaaggcggcgaactgcgcctgccgcgcggcttcgccctcgaccagcaggacgacagccagttctccgacacccgcctgcgctggaaagcccgccagtcgtccagcgaaccctgggtcgggctga

SEQ ID NO: 8399 - DNA, 405 bp, Pseudomonas aeruginosa
aggcccatggcgacgacgcgccgatcggcaccgacccgtggatggcctgcaacaccttcaccttcagcagccccagcggcaactacttcggcctgttccgaccgtccctcggcacccccagcggcgtcggcatcgtcgggcggacttcgaagatcgccgacatgcaggtccccgaggtgttccagatcatgctcggcaagaaaggccagctggccgacggcatcgccgagatcatccacgccatcgtcaccgggcagcagaccctgcccggctccgacagcctgcaagcggtgcccgccggacaattgctgctggccggcgccgcccctgccgacagccaggcgcagagcctcgccgccggcgaagtccccaccgacaagagtgcgcgcaaggactactgcctga

SEQ ID NO: 8400 - DNA, 318 bp, Pseudomonas aeruginosa
acggcatctgggccaccgcaccctacctgcacaacggttcggtgccgtcgctgtacgacctgctgctgccccaggagcaacggccggccaccttctacaccggcagccacgagttcgatccgagccgggtcggctacctcaccgcgcccggcccggacaacgccttccttttcgacacccacctggaaggcaactccaacgccggccacgacttcgcccgcgagtacgacgaaagccagcgcctggcgctgctcgaatacctcaagaccctgtgagccggccccgcccacatgcccaatagagagaaccgcccgatga

SEQ ID NO: 8401 - DNA, 447 bp, Pseudomonas aeruginosa
cggtcgtcgccgtcgccgatgtcgcgggtcagcgccttggcctcggcgatgatcttcaccgcgcggcaatgcaccaccctgcccacttcggtcaggctcaccccggccggaccgcggacgaacagcgcctcgccgatgtgcacttcgagcgcctggatctgccgcgacagcgacggctgcgaaacgtgcagcacctcggcggcctggccgatgctgccgtactcggcgacacaggcgaaatacatcagctggcgcaacgaaggcatcgccttcgaccagttgatgatcgggaaactggcatcggtcacggacattgcgtacatacccctcgctggcaacacgggtcggatcggcacggacagggaaaccccgggacggcgcgacgagcgaccgccggccgccttcatccgaaagccgtttcgcggcagaagaacgaaagataggtag

SEQ ID NO: 8402 - DNA, 1221 bp, Pseudomonas aeruginosa
tggcggatcgctgaagcgcgccgcccccgtacgagcggacgagcctgcgcggtgtgctgggcacggtgcgcagtaaaatcttcaagatttttcttacaaggcaataggactcgtccaagttacctcgcccatagctcccggtaccctcgcccgttacacctttcaagcaccaacgggatctccagggcttatgcttcttcgaaccatcagtgtggaaactgccgagcagacggaactgaatgcggccttgttgtgtggtttcgccattcccgccagcgaccgcaacttcatcgcctacagcctcaacgaacaggtcgacgaaaacgactcgcgcgtctacatcgcctccctgttcaagaccgacgacggcttccgcctgggccgtctcgacaccgacgaggcctgcgaggcggccatccaggtgttccgccaactggtccgcgaagccaccaccggcaaccgccggaccagcgatctggcctaccacctcatcgacctgcaggacgcggccatcgcccattcgcggcgggaagaacaccgctccctggtgctcgaacgcgaatgggtgatgaagctcgtcaccttcgagtccccccatggctacggccccgccctggatggcgaggaaccctgcgcggaagtcccgccgctcgtccaggaggcccttttcgaagacgccgctcccgatgtcctcgccgaagacgatgcggacgagaccacggacgggccggcggagcccatcgacgagcccgaggcggcggaagacgaaaccgtcaccgaggccggatgcgtcgagcccgagccgcggccggaggcggaaacggcagcgcccgagggtggggcgccagccgagttcgcggcgaaagcggagcagtccgccaaggtagcggatgccgaggccatcggcgccttcgtcgacaacgccagtcatcttcgcgaggagcttgccgacctggcgcagatgctccaccccgcgctgcacgccgccgacgccacgggcagcgccaaccttccgtctccagacgccgccgaggaatcctccatgcccccgagcccctcccccctcgccgcacccgcgccggaaccggtatcggccagggtccccagcctgtcgctgcgcctccgggtgccgcccgcacgcctggccggcgccgagggcggggccaacgccagagaggcgcccacccaggccgccgccatcattcgccaacccgaggatga

SEQ ID NO: 8403 - DNA, 813 bp, Pseudomonas aeruginosa
agcccacgtggatacggataccgcgctcgatatcggcaacgataccgagcatctgctacaggacgtgcagggcaccctggccgacctcgccggcatggcccagcaactgagccagcagaagcaggaagcgctcaagcagcaggagtcgctggagtcgctccagacgcaactgcacgagaaggagcggcaattgcaggaaaaggaaaagcagctccggcagtggcacaagcgcctgcaggacgaccgccaggcgctggagcgggaaaccgagcagagcaaccgtctcctcgccgagcgcagcgcggccctgcaacaactcgcggaaagcgtcgaagcccgcgagcgcagcagcgcgcggcgagccgaagtactgcagatcgagcaggaacgcctcgaagagttgcgcagccagcagaacctgcgccaggccgaactggaaaagcgcgaagccagcgtccaacagcgcagcctggaactcggcgagcgcttcaagaagctggaaagcgcccgcgagaagttggcgcagatcgtcaagggtttcaacgagaccgtacagttcaataccgctctgcacgccatcagtcataccgggttgaagcgccaggaagagagcgcagccgaactggaataaggttctcctccggcaaaagggcgcggcgccgatactggcccgcgccctttttcattcgcccagctgcgcctggccgctcgccctcgggacgcggtgccgccggccagttcaccggcgcgcagagcagttgtgcgccggacagcgccggcaggcgcacccattcgggaaactccaaatcgtag

SEQ ID NO: 8404 - DNA, 2748 bp, Pseudomonas aeruginosa
cagaccatcaccgcgattcgcccgaagcgggtagcgaccaccggcgctgtccctggcacaaggccatgggaaggacggagtgtcggcaagcgaagacgggaagggaatcagtcaggtcaaataatcagttcagcattttctgaaccatacgcagggcgatcgctgaaccgagggccgccgaggcaccgcgtgcgcccttctgacgcccgctcaaggccggcgcgcagcatggccttcggcggaaacctgtggcgcctgggtctgccccgcctcgcgctccagcagatcgcgcaggcgctgcgcatccagcggtcggctgagcaggaacccttgcagttcgtggcattgctcgtcgcgcaggatgtgcatctgcccttcggtctccacgccctcggcggtgacccgcaggttcagggcgttgccgagattgatgatggcctgcacgatcgaacggtcgcgcccggtcttctccatgctggcgacgaagcgcttgtcgatcttgatgctgtcgaagggataggtgcgcaggtagccgagcgaggaatagccggtaccgaagtcgtccatgttgaggcggacgcccagctccttgagggccgtcatggtccgcagcgcgccatcgacatcgttgagcatgacgttctcggtgacttccagctccagccggcgagcatccaggcgggccaggcgcagggcctcgcgcacctgccagacgatatcgccggtcatgaactgcgccggcgacacgttcaccgagaccatcacctcgcctggccagctggcggcggtggcgcaggcctcgcgcagcacccagttgccgatctgcacgatcaggtcgctttcttccgccaggccgatgaactcgtccgggccgatcagcccgcggcgcggatggttccagcggatcaacgcctccgccgaggcgatcgtctgttcctgcgccaggaaacgcggctggtagtacaactcgaactcgccgttctgcaaggcggcgcgcaactcggtctcgcgcagcttcttctcggcgagatgggagtccatcgcttccaagtagaaacgccaggtattgcgccccgcggccttggcctcgtacatcgccacgtcggcgcaacgcagcaggccccgcggatcgccgccgtgctccggcgccagggccacgccgatgctcgcgccgacatggaagctgtgcccttcgtaggcgacctcgcggttgatcacgtcgatcagccggctacagaacttctcgatttccagcttcgacgacacgtgggtactgaccaccacgaactcgtcgccgccgagccgggcaaccatgtcctggtcgcgggtcgaggcgcgcagccgttcggcgatggcgtagagcaccgcatcgccggcgggatggccgtgctggtcgttgatcggcttgaagcggtcgaggtcgagcatcagtaccgctaccggcgacttgccagccttttccgccagcaggcgttcgaggaactggaacagcttgttgcggttcggcaggccggtcagggcatcgtgcagggacagatgctggatcttcgcatgggcttcgacctcgtcggtgatgtcggccgccgtgccgcgatagccgctggcgacgccgttgcggatcgcgctggcgctcagcttgccgacccgcgcctggccctggctgtcgcggaaagcgcagaccaggctggacggcgcaccggcatcgggcagcccttccagccacttgacgatgttcaccgtatcgctatccagcaactcgtccagccgccgcccgatccaggcctccggctggtagccggtgacgtcgcggaagcgcacggagagataggtgaagacgaaatgcccgtcgacttcccagatccagtccgaggccgcctcggctatcgacttgaaacgttcctcgctggccagcagggcctggttgctgcgtttcaggaccttctgctggcgatccaccgcgcgggcgttgagcacggcgctgcggctcagccagaacagcagcccggcggcgagcacgaagattcccagcagcggcaacgcggtctcccgcagcatggcgctacccggacgcgacgacacccaggccaggcgatggggagtgccctccagggcaaggctttccttgtcgcccgccgcgccgccggccagcaggtgcaggttggcgatgccgtagtcgccgccgagcttggccagcttcgccggggtcagccggtcgacgaagaccatcaccgaggccttggccaggtcgatgggcgcatgatcgctggtgggcttgatcgccgaggcgaccaggatcgccggtgcgccgtcgaagtcgacgtagcggctgatcgccgcttcgtccaccgcggcacggcgtgcggagcggaggatgtccccggtgtcggcgttcagcgagtcggccagcgagcgttcggaaagctcgccctcgagcatggcgtagcgagtgccacggtcgtcgatgacgaagacgccgtcgtagccgttggtggtgtagagcaccgagccgaggttgttcttggtgaaggcccagtccacgtcgacccggtttcccagatagacgtaagcatcggtccagaaggaataggtggtggagaactgctcggaattttcccggcgattctgcagcgccttttccacgtagaaatggctctgctcgatggcgatgtcgtcctggtgcctggcgatgtgcaggatcgcccagccgcatgcaccgagggcgaggaaaagggcggccaggaacattag

SEQ ID NO: 8405 - DNA, 330 bp, Pseudomonas aeruginosa
  unsure (121): Identity of nucleotide at the above locations are unknown.
ttaagcatccagggggcgtcaaaaaccccgcttggcaagcgcatcggcgccgaagatgcggctgccgctcccgcaaaggcgcgcgccgccgctggcctcggcggcgcgcggcggctctcancggccctgcctggcgacgatcgcctcggccacgctggccggtacctcggcatagcggacgaactccatcgagtagctcgcgcgcccctgggacatcgagcgcacgtcggtggcatagccgaacatttcgcccagcgggacctcggcacggatcacctttgcccgccggggtatcctccatgccctggatcaggccacgccggcggttga

SEQ ID NO: 8406 - DNA, 2712 bp, Pseudomonas aeruginosa
gccgtccctggaaaatcccccggctcgacggacatccctggacacaccggaacaagggatgccccgaccatgcaccgatcgctccacaccgacgcgccgctgggcgccgccctgctgctggccctgcagctcgctcccggcagcgccgccgcggcggaggaacaggcgcctgtcgacccgcccacggtccagttgcaacgaatcgaggtgaccggcagcgcgatccgccgggtcgatgcggaaaccgcggtgccgatcagcgtcctgcgcgccgaggagctgcgccaacagggcgtgaccagcaccgaggaactgatcggccggctttccggcaaccagggcgtatacaactccagtcgctcggtcggcagcgccaccggcggcgcctcgttcgccgacctgcgcggaatcggcgcgaacaagaccctggtgctgctcaatggccggcgcctggcgaacaatgccatcgacggctccgcggtggatctcaacaccattcccttcgccgccatcgaccgggtcgaggtgctgcgcgacggcgcctccgcgctgtacggcaccgatgccatcggcggggtgatcaacttcatcacccgcaagagcctgaacgaaggccgcttcgacagcggctacgcctcccccacccacgacggcggcggcaaccagcgcaacgtcagcgctagctggggcttcggcgagctggaggaggatcgcttcaatgtcttcgcggtggccaactacgacaagcaggagcgcctcggcgccaaggaccgcggctacacctacaactaccagccgggacgcggcctcgactacagctccggcaccgccttccccggcaactggagccagggcgccaacgccagcaatccgctggccgccggcggttgcaagggcgccgacctgattccgcgcaacggcatctgccggcagagcctgtggcgctacctcgacctggtgccggaaaccgagaagacctcggtgttcagccgcgccaccggcaagctggccgacgagcacaacgtcagcctggagtacttctggtcgcgcaacgacaacgctacccaggtcggcccagggaccctcaccggcctgcagatcgatcccggcaccgccttctatcccggcaacggcatcactcccggacccggcggcttcgtcctcgacccgagccggccggtggaggtcaactggcgacagagcgtgctcgggccgcgcctgcaatcctcgcagaacaccggccagcgcctgctgctcggcttcgacggccagttcgccggctgggactacgatatcggcgcctcgtacaaccagaacaaggtggtcgaccatatccacagcggctacgtcgatgatcgcgccgccgccctcggcatcgccaacgggacgctgaacccgttcgggccgcagaccgacgccggcctcgcctacctcggcagccatgccctgagcggcgacttccgtacctcggtcggccgcgtcaagggcctggatgcccgcgccagccgggagatcggcgactggttcggcgccgggccggcggccctggcgctgggcggcgagttccgcaaggaagcgttccaccaggacatccaggacttcgccggcaacgtgcagagcctcggcgtcgatcccgccgccacggtcagcggcgagcgcaacctgaaggcgcagtacgccgaactcaacgtgccggtgctggacagcctggaactcagcgcggcgatccgccacgacaagtacagcgacttcggcagcaccagcaacccgaaatattcgttccgcttccagccgttccgccagttggtcctgcgcggcgcctacagcgaaggtttccgtgcgccgtcgctgtacgaactgtacaacccgaccttcaccacctataccagcgccaactacgacgacccgcgcctgtgcgccggcggccagccgagccagggcggcatcgccaaccgcgactgcgcccagcagttctacaacgccaccggcggcaataccgacctgcgaccggaaaccgcgcgcaacgttaccctgggcctggtctaccagccgctgcgcgacctttccgtcggcctggacttctggtggatcaggatcgccaaccagatcgccgagtttcccgaagcggcgatcttcgccgacccgcaggcctacgccggacgcatcgtgcgcaaggccgacggctctatcgatcacgtcgtcaccggactggccaacctcggcaaggtaaagaccagcggcgtcgacctgagcctcgattatcgtttcccggccagccgctacgggcagttcgggctcgacctgcaaggcacctacgtgtcccgctacgacttccagcagcagatcggcggccagtacctggacaacgtcggcgacttccagggcgtcggcgtgatcgcccgctggaagcacgtcgccaacgccacctggagccgcgacgcctggcaggccaccctgagcaaccgctacaccagcggctacaacgactacgaccgcgccagccacggcaaggtcggttcgtggaacctctgggacctggccggcagctaccgcctcagccacgcgctggggctgaccctcggggtgaagaacctgttcgaccgcgaaccgccgttcagcaaccagacctacaccttccagagcggctacgacccgcgctacaccgatccctacgggcgcatcctgttcggccgcctcagctacagcttctga

SEQ ID NO: 8407 - DNA, 450 bp, Pseudomonas aeruginosa
tcattctcgggatcaccaacaacgacctgtccggcgcctgcctggtgcgcgacggcgggatcgtcgccgccgccagcgaggagcgcttcacccgccagaaggaccacaaggcctggccgagccgctccatcgactatgtgctcggcgaggccggcatcgacctggccgacatcgaccgcatcgcctacggctggaacgccgggttcgacgccgggcggcacctcgacctctacctggaccgggtcctcgaggaagcccgcgagcgtcccgagggcctgccgcacctgcgcaagcggatcgccgacgagatggccaacgacaaggccaagcgcggcgaattcgatgccttcgtccgcgccaacgggctgcgcggcaaggtccagtacttcgaccatcacgaatgccacgccctcggcgcgttcgtctgctcgccgttcgacgaggcgctga

SEQ ID NO: 8408 - DNA, 1368 bp, Pseudomonas aeruginosa
tcaacacctccttcaaccgccacgaggaaccgatcgtctgcgccccgcaggacgccctcggcgcgctggaggacgggatggtcgacctggtggtgctgggcgagtccctgctggtctggcgcaagggcgagaacgccttcgccagggcgcgcttcgagtgaggcgcaaaccgcagcgaaccggcacggcgacgcgggaaccggcatgtacctgatcttttccggctacttcgccgccgaggggctgatctatccgttctggccgacctggctggccagcctgggcttcggcgccagccagatcggcctgttgatcgccgcggcctactggccgcaggtgatcgccggggtggcgctgacctacgtggccgactggcgcatcgaccagttgcgcctggcgaccctgctggcggccctggccggcgcctgcgccctgctgttccagctggccgagggcctgcccctgttcatcgccctgagcgtgctctacggcgcgttctggaccagcgtgctgccgctcaccgaatcctacctgctcaagcgcgacaaggccgccctgcagaactacgggcgggtacgcgcagtcggttcgctggccttcatcctcaccgcgaccctgggcggcctgctgctcggtcggttcggccagcaactggtgcccgccctggtcggcctgacgatgctgctcaccgcgctggcctgcctgttcctccgtcgccgcagcctgcgccgtccggactcgccgctgccgggcgccaggcgccgtcccgacctgcgcgggatcctccgtcaacgccccctgctgctggccatcgccgcggcgggaatgatccaactgagccactcgctgtacttcaccaccgcctcgctgggctggcagacgctgggctactcgtcgttctcggtcggcgccttctggggcctggcggtgatcgccgagatcagcttcttcgccgtctccaaccgcatcctggaccgccacccggcgctccaggtgatgctcttctccagcctttgcgcggcgctgcgctggggcctgctggccggcagcgaacacctcgccgcgatcctcctcggccagtgcctgcacgccctcagcttcgccgcctaccacgccgcggtgatgcgttacatccgcgaccacgcgccggaaagcgcgcgggtactgacccaggggatctactactctctggcggtagcgctgcccatgggcctcgccagtccggccgccggctggctgtacgaaggcctgccgcagtggtcctatctgatcatggcgctgttcgccctcggcggcgcggtcctggtctggcttgccctacagagtgcccgagatgcatcgactagcgttttcagccgttctgtttga

SEQ ID NO: 8409 - DNA, 1305 bp, Pseudomonas aeruginosa
  unsure (294): Identity of nucleotide at the above locations are unknown.
catggacggcgtcctgatcagctcccgcgaagccatcgccgcggcctggagccgggtcgccggcgaacagggcgtggcgctcggcccggactgcctgcgcgaccacgtgcacggtcgcccgggcggctacaccctggactatctgttcggccacctgccgatggagcgccggcggatcctcaagcaacgggtcgatgcgctggaggaaggcgccgactgtcccctgctgcccggcgtcgccgcggtgatccgccagttgcgttggctggacgtgcccttggcgctggtcaccancagttggccggcacgcatctaccacgtgctgcgccagcacgacctgcacgcggcgttccgcaccctggtcagccgcgacgacgtggtccacggcaagccggctccggatggctatcgcctggccgcggccaggctcggcgtggcaccgtcgcgctgcctggtgttcgaagactccctcagcggcgtgcaggccgcctgtgccgccggcgcgacctgcgtggcgatcggcgaggagagcggcctgctcgccgccggcgcgcgctggtcggtccgggatttccgcgagctacggatcgtccgcgaagacgaccggctgtactgccagcatcggcaccccgccacgaccggcagcgagaggagcgttggcgtcccatgagcccgaccctgcaagatgcccggctgctctgggacttcctcggccagggccgctgccatgtgccctgcgaactgctggtggtatgcggctcctacgacctgcgggtctgcgaccacgcctgcgaactgctcgaacgcggcctcgccgaacgcctgctgttcaccggcaacaccgggcactggacgcgccatctctgggtcgagccggaagccgagctgttcgcccgccacgccagggcgcgcggggtaagcgacagcctcatcgtgatcgagccgcgggcgaccaacttcgccgagaacatcgccttcgcccgcgagctgttccccgacctgcgccgcacgaccttcgtcaccaagcccaactcgatccgccgcgtggcgctgaccctgccggtccgctggccgggtctggagggacacgtggatgcgcccgactacgcatttcccgacggcatctcgaacctggtcggcgtactcggggtgatcgacgagatggtcggcgacctcgaccgcatcatgcgttacccggcgctgggcttccaggtcgcctgcccgatcccggcgcaggtcatggacgcctgggaacgcctggtggcgcgcggtttcgaccgccacttggtgaacccgccgcgctga

SEQ ID NO: 8410 - DNA, 1203 bp, Pseudomonas aeruginosa
gctgacagcactgtaatcttccccacagcttgccgacaggcgcgcgccgctagggtgtccgcatcgccgcaccgccctggcggggccgcgacctcccggctgcgcaggctcgcgcagtccgtcctgccacctgcgtggaaaccagcggatgcacagaacttcgcgacgcaccttcgtcaaaggcctcgccgccaccggtctgctcggcggactgggtctctggcgcgccccggcctgggccctggccggggcgggccagcagaacctgctcgccggcgacagtttcgacctgttcatcggcgagaccccggtgaacctcagcggctcgccggccaccgccatgaccatcaacggttcgctgcccggcccgaccctgcgctggcgcgaaggcgacaacgtgaccctgcgggtgcgcaaccgcctcgccgaggacacctcgatccactggcacggcatcatcctgccggccaacatggatggcgtgccgggcctcagcttcgagggcatcgctcctggcggtctctacgaataccgcttcaaggtccggcagaacggcacctactggtaccacagccactcggggctacaggagcaggccggggtctacggcgccctggtgatcgacgcccgcgagccggaaccgttcagctacgaccgcgactacgtggtgctgctcagcgactggtcggacgagaagccgcagcgcatcctcgccaagctgaagaagcagtccgactactacaacttccacaagcgcaccgtcggcgacttcatcgacgacgtcagcgccaacggctgggccgcgaccctggccgaccgcaagatgtgggccgagatgaagatgagtcccaccgatctcgccgacgtcagcggctacacctatacctacctgctcaacggacagccgccggacggcaactggaccggcctgttccgccccggcgaaaagctccgcctgcgcttcgtcaacgcctcggcgatgagctatttcgacgtccgcattcccggcctgaagatgaccgtggtggccgccgacggacagcacgtcgagccggtcagcgtcgacgagttgcgcatcgccgtggccgagacctacgacgtgatcgtcgaaccgggcggcgagcgcgcctataccctcttcgcccagtccatggaccgcagcggttacgcccgcggcaccctggcgctggccgaagggcttag

SEQ ID NO: 8411 - DNA, 1842 bp, Pseudomonas aeruginosa
cgcgccggtgccgacgcccgatccgcgcccgctgatcggcatggacgacatgggcatgggcggcatggaccacggcgccatggggcatggcgcggcgacgaggcccgccagcgagatggaccattcgaagatgtcgggcatggacatgaagggcatggaccattcgaagatggccggcatggacatgaacggcatggaccactccaagatggccggcatggaccactccaggatgggcatgggcgccatgccgatgcagtcccatccggcttcggaggacggcaacccgctggtcgacatgcagaccatgacgccgacaccgaagctcgccgaccccggcctcggcctgcgcgacaacgggcggcgggtgctgacctacgccgacctgcgcagccgcttcgccgacccggacggccgcgagccggggcgcaccatcgagctgcacctgaccggacacatggagaagttcgcctggtccttcgacggcatcaagttctccgacgccgagccgctgcgcctgacctacggcgagcgcctgcggatcgtcctggtcaacgacaccatgatgacccacccgatccacctgcacggcatgtggagcgacctggaggacgagcaaggcaatttcctggtgcgcaagcacaccatcgacatgccgccgggcacccgccgcagctaccgggtcaccgccgacgccctgggacgctgggcctatcactgccacctgctgttccacatggagatgggcatgttccgcgaagtgcgggtagacgaaggagacaacgcatgagccgccagccgaaacccgcccgcctggccgccggtgccctcgccctgggtctgctgctgggcctgccgaatcccgtcgaggccgcgcgggacaatggcatggaccactcggccatggaccacggcgcgatgcctggcatggaccacggccagaggacctccgccccggcgaaacccatggaccaccaggggatggggcatggccggatgccggggatggaccacggcgccgcatcgcccgccccggcacagcccatggagcaccagggaatggaccatggccggatgccggggatgagccgcgctgcgcggcaacctccggcgcaggccgcgcccagccagagccgtacgccgatcccggtgccgaccgaggccgaccgccgtgccgcctttccgccgctggaggggcacaaggtgcacgacagcgcgctgaacagcttcttcctgctcgaccagttggaataccaggacgccgacgacggtagcgcgctggcctgggacgccagcggctggatcggcggcgacatcaaccgcctgtggctgcgcagcgaaggcgaacggctcgacggcaagaccgaggacgccgaggtccaggcgctgttcgggcacgccatcggtccctggtgggacctggtcgccggcgtgcgccaggatttcaagcccggctcgccgcagacctgggcggcgttcggcgtgcagggcctggcgctctacgacttcgaggcggaagtcaccgccttcctcggcgagaacggccagagcgcgctgcgcctggagggcgagtacgacatcctgttgaccaaccggctgatcctccagcccagcgccgaggtcaacctgtacggcaggaacgatcccgcccgcggcatcggttcgggccttgccgatagcgagctgggcctgcgcctgcgctacgagatccgtcgcgagttcgcgccctacatcggggtgacctggaaccgctcctacggcaacagcgccgacctggcccgcgccgagggcgaggacgacgacgaggcgcgcttcgtcgccggtatccgcatgtggttctga

SEQ ID NO: 8412 - DNA, 1722 bp, Pseudomonas aeruginosa
gaaaagcgccggggcgtctggaaagaacctttcggaacatccttagagtcagcatggtttcccgcctcagattcccagcccggccacccgcagatgctcttccaggcgcagcgcgggtatcgctccgagcaactcgcgggtataggggtggcgcggctggctgaacagcgcagcggcgctgccctgctccaccacccggccgtccttgagcaccaggatgtcgtgggccagggcgcgtaccacggccaggtcgtggctgatgaacaggtagctcagcccgtggcgacgctgcaaccgacgcagcagctcgaccacctggcactgcacgctacggtcgagcgccgaggtcggttcgtcgagcaggatcagcgccggcttcagcaccagcgcgcgggcgatggcgatgcgctggcgctggccgccggaaaactcgtggggatagcgttccaggcaaggctcgtcgagaccgacctcgcgcagtgcctccagcacccgcgcgcggcgttcgccggcatcgccgatgccatggatacgcaggccttcgccgacgatctgttccacgctaaggcgcgggttgaggctgccgtaggggtcctggaacaccgcctggaactgccggcgcaatggcaacaggcgcttgccgtgcagccggtcgaggcgctcgccctggaacaggatctgcccttcggccggcaacaggcgcagcagcgcctggccgagggaggacttgcccgaaccgctttcgccgacgatccccagggtgctgccacggcgcagccgcaggctgacctcgtgcaccgcgcgcagtcccgcgcgccggcgcagccagccgccgggcgcggggtagtcgaggctcagcgcgcgcacctccaggcaggtctcgcggcacgccaccggctccgccagcccacccggctcggcctcgatcagcaggcgcgtgtagggatgccggggcgagcggaacagcgtctcgcaggcgttctcctcgacgatctggccatcgcgcatcacgcagacccgatcggcgacccggcgcaccaggttgaggtcgtggctgatcagcaggatcgccatgcccagccgtcgctgcaagctttgcagcagctccaggaggcgtttctgcacggtgacgtcgagagccgtggtcggttcgtcggcgatcagcagttgcggctcgcaagccagcgccatggccagcatcactcgctgtcgctggccgccggagagctggtgcggataggcctcgagcaggcgtcgcggctgctcgaggccggccagttcgagcagttccagtacccgcccgcgcagcgcggcgccacgcaggcggcgatgcaggcgcaggccctcgccgacctggcggccgatgcgctgcaatggattgagcgaggtcatcggctcctggaacaccatgccgatgcgctgcccacgaatcgccagcaatgcctgcggcgacagggcgagcagttcctcgccgtccaggcgcacgctgccgcccaggcgcgccgcgcccggcagcaggcgcagcagggcgtgggcggtctgcgacttgccggagccggactcgccaaccagggccagggtctcgccggcgcgcaggctgaagtcgatccccttcacgacctgcgtgtcgccataggcgacgctcaggttttccactcgcaacagttcccggttcatctcatgtcctcggatcgaaggcgtcgcgcaccgcttcgccgatga

SEQ ID NO: 8413 - DNA, 1548 bp, Pseudomonas aeruginosa
ccgcccatgtcactgcgcctcccggctcggcgcggcccgctcgcggacttcccaccaggtgttcagccccaggctgtagcgcggcgcctgcggcggtcggccgaagcgattccagctggcgatccagacctcgtcggcataccaggtcgggatcaggtagtagccccattgcagcacccggtcgagggcgcgcacggcggtttccagggcggcccgcgagtcggcctcgaccaccgcctggaccagccggtcgatggccgggtccttcaggccgatgcggttgtagccgccgggatcggcgtagctggaggaatgccagaagctgtactgctcgttgcccggcgaattggactgggagaagctcgaaacgatcatgtcgtagtcccgcgcacgtatgcgctcgatgtattgcgaagcgtccacctggcgcaggcgcatatcgatgccgatccgcgccaggttgcgctggaacggcagcagcgcgcgctccaggcccttgccctggagcaggaggtcgaagcgcagcggccgtccggcggtatccagcaggcgcccgtcgacggcatgccagccggcctcgccgagcaggcggtaggcctgcaccaggcgctcgtggatatcgccgctgccgtcgttcaccggcggagcgtaggcctggccgaagacctcctcggggatttgcccgcgcagcggctccagcaaggccagttcgtcggcgccgggcaggccgcgagcggccatctccgagttgtcgaaatagctgcgcaggcgcttgtagcgaccgccgaagagctgccggttggtccattcgaagtcgaacaacaggctcagcgcctggcgtacccggcggtcctcgaacagcggccggcgcaggttgaacaccaggccctggaggctggccgggtacgggtagggaaagctctcctggcgcaaccggccatcgcgcagggccggcgagtcgtagccgctgctccaggccttgacgctggtctcgacattgatgtcggcctgcccggccttgaacgcctgcaaggccacgccgctgtcgcggtagtagtcgaaacggatccgctcgaagttgtacaggccacgcccgaccggcaggtcgcgagcccaccagtcggggttgcgccggtagctcaccgaacgccccgcctcggccttctccagccggtaaggtccgctgcccagcggcggctgcatgctgctgcggttgaagtcgcgtccctgccaccaatgcctgggcagcacgtagagctgggccagcaccagcggcagctcgcggttgccggcatgacggaaatcgaagcggatgcgcaggcgatcctccaccaccggctcgcggacctccttgtagtaggcgcgccagaacgggctgccctgctcgaccaggctatcgaaggaaaacttcacgtcctcggcggtgaccgccacgccgtcgctgaagcgcgcccgcggatcgatatggaaacgcacccagctgttgtccggggctttctcgatgtagcgcgccaggtagccgtattcggtgaacggctcgtccagtga

SEQ ID NO: 8414 - DNA, 1203 bp, Pseudomonas aeruginosa
ctggaagccgagggtttcgtagatcagcgcggcctgggtcatgctgatcggcgtgccgcggttggcgaaggggttcagcgtgtcgaagctgccgctttccatccgccgcaggctgccgcccttgggcgcctgcgggtcgacgaagtcgaagtgctggaaacccggcggatatttcgccggctcgtcgtagagcgtgatggcatggcgcggctcgctgcgggccaggctggcgagcaggcagcaagcgaagaccaggatgcgtccgggcatggctcaaccaccgaagtgatagctgaagtccagccaccattggcggcccatggcgtcgtagttgccggtgggatagtacggccagccatcggagtcgtcctccttgatctggtcgagcaggttgttcaccgtcaggccgacgctggcgcgttcgttgagccggtagcgggcgctggcgttgaacaccgtccacgggctcaggcgcccgctgccagcggcgttggtaacgctgccgtagcgcaccgcgaagagcgtcgaggtgaactgtgcgtagtcccaggtcaggctggcgttgagtttgctgcgccagtcgtgggagtcgaggctgtcgcgctggttctcgctggggtagtcgtcggactgcttgtagtcgtgggacaacaccagggtgtagccgagggtcgaggagaaggcgccgtagtcaccggcgccccagcggatgttgctgcgcaggtcgatgccgctggtgcgctccttggccgcgttgatggcattgacgtagaccttgttcaggcgattcggatcgacgctggcgtcgccggcgttgcgctcgacccgcgccagggtgtcgcggcactgcgccgagtccggatcgagcccgccgctacggcaggccgcctcgtcgcgcagcagtttgtccggatcgagggtggtcagcaggtcatcgatctggatgtggtagtagtcggcggaaaagtcgaacctgctcgacggcgaccagacgaagccgtagctccagtagcgcccgcgctcggacttcaggtcgggcgtgccgctctgcacgtagtcgacccggccgttcttgcaggcgccgtcgacgcctttctcgcaaccgtagtagtccttctgcgccgggtagtagccgttggcgtcggcctggtagatgtagttcaggtccggcgcgcggaagctggtgccgtagctgccgcgtag

SEQ ID NO: 8415 - DNA, 1002 bp, Pseudomonas aeruginosa
ggcgaatggccgcttgcggctatccgccggtccgaacacggcgttatccgccctgccgccctcgggtcagtacgtcagcgccccgcaccagtgcgcgctcttcagttcctcgtaaagcgcgccgatcttcagcgagcactgccgcgacggcgggtagatcagcgacaccgggcacagcggcggttcgaagggctggaggatgcgtaccagtcgacgccggcggatcgcctcctcggccatgaagcccatcacctggacgatgccctggccgaccagcgccgcgtcgaccagcgcgtcggccacgtccagcaccaggtcgccgcgcaccgccaggctcagcggctggccgtcgcgctggaactgccattccagcagcttgccggtgtgcaggtcgcgcaccgtcgggcagttgtgcccggcgagttgctccaggcgctccggcgtgccgtgactgcgcaggtattccggcgacgccaccgtgacccagcgcaacgccgccaatggccgggcgatcaggcgcacgtcgccgacccgaccgagacgcacggcggcgtcgaagccttcctcggtgaggtcgaccaggcgatcggtcatcgccgcctcgatctgcaattgcgggtagcgccgcgtcagttcgcgcagcaccggcatgatcacgatccgcccgagcgcctgcggggtggtgatcttcagcggaccgctcggcgcgcactggcggtccaccagcaacttctcgacttcctccagttccgccagcaagggtgcgcagcgctcgtagaacagctggccgtccggggtcaggctgacgctgcgggtggtgcggtgcagcagacgcacgccgagttcggcttccagccggccgatggcgcgcgacaggccggactgggtcagaccgagagaaacggcggcctgggtgaagctacgggtctcggccacgcgggcgagcaacttgacggcattcaggtccatggcgatctcatcgatgattattttcatcagtga

SEQ ID NO: 8416 - DNA, 498 bp, Pseudomonas aeruginosa
agcggctggctgtcgatctccaccgcacccggctcgctgaaagcccacgccaaggtccaggcgatcgtcgatcagcgccgcctccagggcgtcctggggcaactcctcgaggctcaactcgatgcccggatagcgctgattgaacggatccaccagggcgcccaccagatagcaggtgaaggtcggcgtcatgcccaggcgcaggcggccgcgactgaggtcgcgcacctcgtggatcgcccgttgcgccgcttccagctcgcgcaaggcacgccgcgcatgaagcaggtacagctcgccggcatcggtgggacgcacgctcctgccggagcggtcgagcaattgcacgcgcagttgctcttccagttgccgcacctgctgcgacagggtcggctgcgaaacgtgcagcgcctcggcggcgcgggtgaagttgcgatgctcggcgacagcgagcaggtagcgcaggtggcgaagcagcatggaaacatccaactatag

SEQ ID NO: 8417 - DNA, 759 bp, Pseudomonas aeruginosa
accagaccaatgactggaataataaaccggtcttggaccctatggctcaatccgcgcatcctggccccaccattcgacggccaggagcccagcgccatgcgtgacatcatcgacggctttctccgcttccagcgcgacgcctacccggcgcgctcgcaactgttcaagtccctggccacccggcaagcccccaaggcactgttcatcgcctgctcggacagccgggtggtccccgaactgctgacccagcgcgagcccggcgaactcttcgtgatccgtaatgccggcaacatcgtccccggatacgggccgcagcccggcggggtcagcgcctcggtggaatacgcggtggcggtgctcggggtcggcgacatcgtggtctgcggccactcggactgcggcgcgatgggcgccatcgcttcctgcgcctgtctcgaccagctgccggcggtggccggctggttgcaccacgccgaggccgcacgggcgatgaacagcgcccacgaacacgcctccgaggcggcgcggctggacgccctggtgcggcacaacgtgatcgcccaagtggccaacctgcgcacccacccctgcgtcgcccgcgccctggagcagggtcggctgaacctgcacggctgggtctacgacatcgaaagcggccgcatcgacgccctcgacggcgccagccggcgcttcgtctccctcgccgagcatcccgaagtgcgcgcggtaggcggcgaacccgggcaggcggtcgcctga

SEQ ID NO: 8418 - DNA, 510 bp, Pseudomonas aeruginosa
atcccttccctcacaaccacccgcaaggagagtcatctcatgcaacacagccaagtgtcccccaacgcgcgccagcaactggccgagaccgtggtcctgaacaaggcccgcctgggcctgtcctggcaggacctggccgacggcaccggtctcgccctgaccttagtcaccgccgccctgctcggccagcatgccctgccagaggcggcggcgcgcaaggtcgccgcccaactcggcctggacgacgacgcggtgctcctgctgcaaagcatcccgctgcgcggcagcattcccggcggcattcccagcgacccgaccatctatcgcttctacgagatgctgcaagtctacggcagcgccctgaaggcgctggtccacgaacagttcggcgacggcatcatcagcgcgatcaacttcaagctggacatcaagaaggtcgaggacccggaaggcggctcgcgggcggtgatcaccctcgacggcaagtacctgccgaccaagccgttctga

SEQ ID NO: 8419 - DNA, 552 bp, Pseudomonas aeruginosa
cgaagccctgcccctggtcctggccggtcccctgctgcgccgcgcagagcccggacgcctggtgttctggctggccacgtcatgcccgacgaccatcgaactgatcctcgccagcgaaggcgaggcggagcgtcggatccgcctcgcggaaggaacccactcggccatccgcatcggcacccatgcctggctgcacctgctggatgtcgcgctcgacccgccgttgccctgcgcccgcctggtcgactacgacctgcgcctggccgccgacggccgggagcccgcgggaatcgccgaatgggcgccgcatctgctctaccccggtcgccagcgcgccagcctggtgctcaagccacgtctcgaccagttgctccacggctcctgccgcaagccgcatcacccggcggccgatggcctgctgcaggtcgaccggctgctggaggaaaacctgctgcaggccgaaagccgcccggcgttgctgatgatgagcggcgaccaggtctacgccgacgacgtcgcccgggccgatgctggtggccatccatgggctga

SEQ ID NO: 8420 - DNA, 282 bp, Pseudomonas aeruginosa
gctatgcctttccgcgttaccggggccgtccggcggtgctgctgcagatcagcgccgcgcacctgcggagcaataccggcaatagcgagacgctggccgccatcggcccgcacgaagccttccatcactacgcccaggaagactggccgggcctgcgcaagcccggtggctatcgcggcgacctggccacgctcgacccgcgcccgcgggaataccgctatgccctgttccagtcgctgctccaggccctgcgcacgcccgggcagcgcgacagctacctga

SEQ ID NO: 8421 - DNA, 2748 bp, Pseudomonas aeruginosa
cgagccggcgcacagttgcgagatccgcagtccctggttcgacatcgacctgcaggccgaaccggccaaggatggcggctaccactatcgttatcgggaagtgcagaagaccagttggctcaaccacgacgagatcaacagcgccgagttcggcaagctgatcgagcagagccgcggttgcgtcgagcaactgcgcctggtggtcaagctggacaagcgtccctgagcgacccgcgcccgctccggcgggcgcgtccagccgcaccagcgggcgatccttctactcgcccgcgcagccctccaggccgagcgcctgttcatagaaacgcgccatgcgctccgggtcggcgacgtacgccagcattccgctggcgagcctgtcgcctacacctgccaatcgagccgcagcccggattcgaacgtacgcctctccccgctcagcgggtcgtcgaagcgcagccccctggccagcagcttgagcggccgcaggtagtcgtcggggctgccctcggcgtccagcagctcgggatagaacccatcgttctggatacccgcgccgagtgccgcgaggtgcacgcgcagctggtgcttcttgccggtcaccggatacagccggtagcgccaccagcggccgttgcgctcgacgacctcgatgcgcgtctcgctgttcggctcgccctcgccttcgcgcatgcggaagaacggctcgccgggcaccaggcgggtcctgcgcaacaacgggaagtccagttgcggcaaggccggagcgatcgcttcgtagcacttgtcgatgcgccgctcgcggaacagcgcctggtagcgcccgcggctgccgggattggtcgagaacagcaccagcccggcggtatgccggtcgatccggtgcagcggcaccaggtcgcgattgccggtgctgcgggccagccgcgccaggagcgtctgctcgacgtagccgccggccggcatcaccggcaggaagtgcggcttgtccgccaccagcagatgctcgtcgcggtacaggatgcgcgcctcgaaaggaatcggtgcctccaccggcaactcgcggaaatagtgcacacgcaggccttcgcgatatgccgcctgcgggcccagcgcacgcccctcggcgtccagcacccggccccgctgcatgcgcgccagccaggtgtcccggtcgatggccgggaaacgcgcgcagagacagtcgagcacggtgctccagggaccggccggcagatgcagggtgctggcgcggagactggcgtcgggcaaggaaggagacgacatgcggcaactcgggaaggacgggcgaccattaggccgcagcgcggcgcacaggtcaaagcacgccggggcgaaacgaagaaaccgcccgaaggcggtttcttccgtgacccagggatcgaatcaggcggcgctcgccttgcgctcttccgcctcgcaggcggctgcggtgaacagcacgtcggtcgaggagttcagcgcggtctccgcggagtcctggaggatcgcgatgatgaagcctaccgccaccacctgcatcgccacctcgctgggaatcccgaacaggctgcaggccagcgggatcagcagcagcgaaccgccagccacgccggacgcgccgcaggcgcagatcgacgccaccacgctgagcaggatcgcggtcggtacgtccacggcgatgcccagggtatgcaccgctgccagggtcagcacggtgatggtgatcgccgcgccagccatgttgatggtcgcgcccagcgggatcgataccgaataggtgtcttcgtgcaggccaaggcgctcgcagagctgcaggttgaccgggatattggctgccgagctgcgggtgaagaacgcggtcatgccgctttcgcgcaggcaggtcagcaccagcggatagggattgcggcggatcttcaggaacacgatcagcgggttgaccacgaaggccacgaacagcatgcagccgagcaacaccaccagcaggtgggcatagcctttcagggcctcgacgccggactcggcgaaggtcgaggcgaccaggccgaagatgcccagcggggcgaagcgaatcaccaccttgacgatcagcgagacgccgttggacagctcggagagcaggttgcgggtggtatcgctggcgtggcggaaagcgatgccgaggccgatggcccaggccaggatgccgatgaagttggccgagatcagggcgttgaccgggttgtccaccacgctcagcagcagggactggagcacctcggcgatgccgcccggaggcgacatctcgcccggatggctggccagcaccaggctcgaggggaaggcgaagctggcgatcaccgccaccaccgcggcgctgaaggtgccgaccaggtacagcagcacgatcggccggatatgggtctgctggccttgcctgtggttggcgatggatgccatcaccaggacgaacaccagtaccggcgcgacggccttcagcgcggaaacgaagaccttgccgatgaagccgaccttgagcgcggcggccgggaagaagctggcgagcagcaggccggcgatcaggccgacgatgatctggcccaccaggctggtacgcgtcagcagatgaagcaggggacgttcagggtatgtcatgcagatttctactcttataggtgtgtcgaaggccggcccaggcagcttccatgccgaacgaccctgtgccgttccgcccccgcgaagggatggttcgagcgagccgggtag

SEQ ID NO: 8422 - DNA, 438 bp, Pseudomonas aeruginosa
gggacttgcgaagctgggttcgttctgcggtggggggaggattcgacatgggtatgcttgcctcgatttcttctttttctaatgcacagcaaaggaaggcggacgggcggaaaccgcaggcttgccgccgtctaccttcagcaagggtgggaacctcgacggaagaacggggggctttctcctcccctcctccccctatctccccctctttctttttccctccccttccctccccccccccccctccccctttcctctccctcccctttcccctccccccccttcctctccctctccttcctcttcttttcctccctcccccttctttctcctcttctcccccctcctcctctcttcctctccctctccccctctcccctcctccccttccccttcctcccctctccctctcttcctcctccccctctccctcctgcc

SEQ ID NO: 8423 - DNA, 1761 bp, Pseudomonas aeruginosa
aggcaggagggagagggggaggaggaagagagggagaggggaggaaggggaaggggaggaggggagagggggagagggagaggaagagaggaggaggggggagaagaggagaaagaagggggagggaggaaaagaagaggaaggagagggagaggaaggggggggaggggaaaggggagggagaggaaagggggagggggggggggggagggaaggggagggaaaaagaaagagggggagatagggggaggaggggaggagaaagccccccgttcttccgtcgaggttcccacccttgctgaaggtagacggcggcaagcctgcggtttccgcccgtccgccttcctttgctgtgcattagaaaaagaagaaatcgaggcaagcatacccatgtcgaatcctccccccaccgcagaacgaacccagcttcgcaagtccctcaagctgtggcagatcgtcatgatcgggttggcctacctgaccccgatgaccgtcttcgacaccttcggcatcgtatccgggatttcccagggacacgtgcccaccgcctacctggtggccctcgccggcgtgctgttcaccgcgatcagctacggcaagctggtccgccagttccccaccgcaggctcggcctatacctacgcgcaacgagcgatcaatccccatgtcggcttcatggtcggctggtcgtcgctgctggactacctgttcctgccgatgatcaacgcactgctggcgaagatctacctgaccgcattgttccccgaggtcgccccgtggatctgggtggtgatgttcgtgctgatcatgaccctcatcaacatcaagagcgtgaacctggtcgccaatttcaacaccgtcttcgtgctggtccagctggcgatcatcgtggtcttcatcggcctggtgattcacggcctgaacaacggggaggggaccgccacggtgctcagtacccagccgttcttctccgagcacgcgcatctctcggcgatggtggcgggggcgacgatcctctgcttttccttcctcggtttcgacgcggtgactacgctgtccgaggaaacccgcgacgccggcagggtgatcccgcgggcgatcttcctcaccgcgctgtacggcggggtgatcttcatcaccgtgtcgtatttcctgcagtcctatttcccgaccaacgtacgcttcaaggaacccgacgcggcgctgccggaaatcgccctgtacgtcggcggcaagctgttccagtcgatcttcctctgcgccaccttcatcaataccctggcgtcgggcctggcctcccaggccagcgtgtcgcgcctgctgtacgtgatggggcgggacaacgtgctgccggagcggatcttcggcttcgtccatccgaaatggcgtacgccgtcgatcaacgtgctcatcgtgggcatggtggcgctctcggcgatctccttcgacctggtgaccgcgaccgcgctgatcaatttcggcgccctggtggccttcaccttcgtcaatctctcggtgatcgtgcatttctatgtgcgcggcgggcgcaaccgcagcctcaaggagcatttccactacctggtcctgccattgctcggcgcggccatcgtcgcggtgctctggctcaacctggaaagcacctcgctggtgatggggctgatctgggccggactgggcttcggctacctgttctacctgactcgcagcttcagccgtccgccgccgcgcttccaggagagcgagctgagcccgacccagtga

SEQ ID NO: 8424 - DNA, 1284 bp, Pseudomonas aeruginosa
acgtcccctgcttcatctgctgacgcgtaccagcctggtgggccagatcatcgtcggcctgatcgccggcctgctgctcgccagcttcttcccggccgccgcgctcaaggtcggcttcatcggcaaggtcttcgtttccgcgctgaaggccgtcgcgccggtactggtgttcgtcctggtgatggcatccatcgccaaccacaggcaaggccagcagacccatatccggccgatcgtgctgctgtacctggtcggcaccttcagcgccgcggtggtggcggtgatcgccagcttcgccttcccctcgagcctggtgctggccagccatccgggcgagatgtcgcctccgggcggcatcgccgaggtgctccagtccctgctgctgagcgtggtggacaacccggtcaacgccctgatctcggccaacttcatcggcatcctggcctgggccatcggcctcggcatcgctttccgccacgccagcgataccacccgcaacctgctctccgagctgtccaacggcgtctcgctgatcgtcaaggtggtgattcgcttcgccccgctgggcatcttcggcctggtcgcctcgaccttcgccgagtccggcgtcgaggccctgaaaggctatgcccacctgctggtggtgttgctcggctgcatgctgttcgtggccttcgtggtcaacccgctgatcgtgttcctgaagatccgccgcaatccctatccgctggtgctgacctgcctgcgcgaaagcggcatgaccgcgttcttcacccgcagctcggcagccaatatcccggtcaacctgcagctctgcgagcgccttggcctgcacgaagacacctattcggtatcgatcccgctgggcgcgaccatcaacatggctggcgcggcgatcaccatcaccgtgctgaccctggcagcggtgcataccctgggcatcgccgtggacgtaccgaccgcgatcctgctcagcgtggtggcgtcgatctgcgcctgcggcgcgtccggcgtggctggcggttcgctgctgctgatcccgctggcctgcagcctgttcgggattcccagcgaggtggcgatgcaggtggtggcggtaggcttcatcatcgcgatcctccaggactccgcggagaccgcgctgaactcctcgaccgacgtgctgttcaccgcagccgcctgcgaggcggaagagcgcaaggcgagcgccgcctgattcgatccctgggtcacggaagaaaccgccttcgggcggtttcttcgtttcgccccggcgtgctttga

SEQ ID NO: 8425 - DNA, 1035 bp, Pseudomonas aeruginosa
tggtcgcccgtccttcccgagttgccgcatgtcgtctccttccttgcccgacgccagtctccgcgccagcaccctgcatctgccggccggtccctggagcaccgtgctcgactgtctctgcgcgcgtttcccggccatcgaccgggacacctggctggcgcgcatgcagcggggccgggtgctggacgccgaggggcgtgcgctgggcccgcaggcggcatatcgcgaaggcctgcgtgtgcactatttccgcgagttgccggtggaggcaccgattcctttcgaggcgcgcatcctgtaccgcgacgagcatctgctggtggcggacaagccgcacttcctgccggtgatgccggccggcggctacgtcgagcagacgctcctggcgcggctggcccgcagcaccggcaatcgcgacctggtgccgctgcaccggatcgaccggcataccgccgggctggtgctgttctcgaccaatcccggcagccgcgggcgctaccaggcgctgttccgcgagcggcgcatcgacaagtgctacgaagcgatcgctccggccttgccgcaactggacttcccgttgttgcgcaggacccgcctggtgcccggcgagccgttcttccgcatgcgcgaaggcgagggcgagccgaacagcgagacgcgcatcgaggtcgtcgagcgcaacggccgctggtggcgctaccggctgtatccggtgaccggcaagaagcaccagctgcgcgtgcacctcgcggcactcggcgcgggtatccagaacgatgggttctatcccgagctgctggacgccgagggcagccccgacgactacctgcggccgctcaagctgctggccagggggctgcgcttcgacgacccgctgagcggggagaggcgtacgttcgaatccgggctgcggctcgattggcaggtgtaggcgacaggctcgccagcggaatgctggcgtacgtcgccgacccggagcgcatggcgcgtttctatgaacaggcgctcggcctggagggctgcgcgggcgagtag

SEQ ID NO: 8426 - DNA, 1488 bp, Pseudomonas aeruginosa
aaggatcgcccgctggtgcggctggacgcgcccgccggagcgggcgcgggtcgctcagggacgcttgtccagcttgaccaccaggcgcagttgctcgacgcaaccgcggctctgctcgatcagcttgccgaactcggcgctgttgatctcgtcgtggttgagccaactggtcttctgcacttcccgataacgatagtggtagccgccatccttggccggttcggcctgcaggtcgatgtcgaaccagggactgcggatctcgcaactgtgcgccggctcgtcagtcttgccgccggacaggctgatgtcgtaggacgtgatctgcggttcgcccaggtacagctcggccaactggccttcgctacggtacttggcgaaggcatcccactggctggccaggtcctggcggttgtagaaatactctccgccgagccggtcgagggcgcggcggtcggtaagcctggcactgatcgtatagctgggcggcagcacgaactggctgtcgtcgcgctccagcacgcagtcgctgccttccttggcgaagttgcggcacaggtcctggtcggtgctggtgcggccgcgctggcgatcggcgacgctgagctgcatcagcggcgcgttggaaagctccacgcgcgactcgacccgggcttcgccgtcatgggtgtaatgctcgctgcgggtcacgcgcagggtgtcgccgggcgcttccaggggaatctcgtcgcgccgcaccttgccgtcggcgcccagcaccagcgcccagcgctgctggatgtcgggcatggtgcggccgggagcgaacaccgggttggtcgggtccagccaccaggtcttgccgtccacctcggcgcggacgatggcatggttcggcgcgtacatgccgggcaccagcaggtcccagaccacgtcgccgcggctgaccagggtcggttcggccttgatcccggcggccttgagcatggcggcgaggaggatcgccaggtccttgcagtcgccgtagccattgcgctcgatctccgccagggagaagggcacgtagccgcgctcgctggcgcgccagtcgcccaggtagcggtaggtgtcgttgatgtactgcatcaggccggcgacctgctcgcgggccggcttgcccttcaccgcggcgacggccgccgcggcgcccttgggcagctccgcggcgaggatctcgttgtagcgcgcggcgaacgggccgaagttgtcctgcaggtccagcgaactgcccagctccaggcgcggggtatggcgcaggtaggcgttgccggcttcgttgatgtagttggtgtattgcggctttttcaggctgaccttgagggtcttcttgtcggcgctctgttcgatgcgataggcgtccatcagctcgctgcgcacgaagatcggccgctcggccttgaactcggcgacgaagcggtcgtcgcgcaccggcatcggcgggcggctgaggatgtagtggaactgggtgcttag

SEQ ID NO: 8427 - DNA, 687 bp, Pseudomonas aeruginosa
tattcttttttgcgttcgggcttctgcggcatattgccttccgcgcaggcccggcggcctgccatcgctgtttgcgggagggacacgtgcaatccgacgtcggcgccgcctcccgccgatcaaggtttcgcctgccaccccgacgcccggtggcgcaggcccgtagcacgagagtgcggaatgggcatggatcagacacgcaatcgcctcgtcggcctgatgttccagaacgactattcctggctgagcgggcgcctgcggcgctacctcggctgcccccacagcgccgaggacatcgcctcggaaaccttcctcaaggtccttgccctgccggatccggcaagcatccgcgagccgcgcgcgctgctcaccaccatcgcccgccggctgatgtacgacggctggcggcgccaggacctggaacgcgcctacctggaaagcctggccgggcttccggaggccctcgcgccgtccgccgaggagcaggcccaggtggtggaaaccctgctgcgcctggagcgcatgctcgccgggctgtcgtcgaaggcccgcgccgccttcatccatagccagatcggcggactgacctacgtggagatcgccggcttgctggaggtttccgtcagccgcatccaccagtacatggtcgagggcttcaagcagtgctaccaggtgcttgccgaatga

SEQ ID NO: 8428 - DNA, 744 bp, Pseudomonas aeruginosa
tcggagccctcgaggcgccgtccgcccgtcgccggtttctccagcgcagcctcgcccctggcggcgttcggcgtggcgacgctggcgctggggcggatcggcatcgtcggcttcccctggcccggcgacctgtacaccggcaccggacaacgccagagcttccgcctggaggatggcagccaactggtgctggacgcgcgcagccgggtacgccccgaattcgatggctaccggcgtcgcctgcgcttacgcgagggccgcctgctggttgacgtggcacgggatccggcgcggcctttcgtcgtcgacaccgggcgtggccaggtcgaggcgcagggaacccgcttccaggtcagcgatgacggcgccagctcgcgagtggtggtgctcgagtcgcgggtgcggatcaccactgccgacggacggcaatgcctgttggagcgcggccagagcgcccgtttcgacgcctcggcgattatcgcccgaggtcctgccgaaggcggcgagagcgcctggctggatggccggctggaggtccgcgaccgcccgctgggggaggtgctggaagcgttgcgcgcctatcgccgcggcatcatcagcgtcgccgacgacgcggcggcgctgcgcgtcagtggcatctacccgctggacgacagcggcgcggcgctggcattgctggagcagagcctgccgatccggctcgactaccacgggccctactgggtcagcatcgccagccgctga

SEQ ID NO: 8429 - DNA, 444 bp, Pseudomonas aeruginosa
gggaagggattcaggcgaccgcctgcccgggttcgccgcctaccgcgcgcacttcgggatgctcggcgagggagacgaagcgccggctggcgccgtcgagggcgtcgatgcggccgctttcgatgtcgtagacccagccgtgcaggttcagccgaccctgctccagggcgcgggcgacgcaggggtgggtgcgcaggttggccacttgggcgatcacgttgtgccgcaccagggcgtccagccgcgccgcctcggaggcgtgttcgtgggcgctgttcatcgcccgtgcggcctcggcgtggtgcaaccagccggccaccgccggcagctggtcgagacaggcgcaggaagcgatggcgcccatcgcgccgcagtccgagtggccgcagaccacgatgtcgccgaccccgagcaccgccaccgcgtattccaccgaggcgctga

SEQ ID NO: 8430 - DNA, 630 bp, Pseudomonas aeruginosa
cgctgttctggcgccagggcagccaccccggtgccgcgcgcctggccttccaggccctggcgctggaactcggcgccgagctgggcgacgcctgagcgggatcagccgcgactcggctgcaacgccgcgggttcctcacggcgcagccgcaaggccagggcggcgccgaacagggcgagcagggcgctgagcgcggtcacccattcgatgccgcgcgcctggctggccagcaggctggcggcatcggcgccgcgcacctgggcgttggccagcgccaccagcagggccaggccgagcgcgccgccgatctgctgggtcatcgaggccatccccgaggcgacgccctgttcggcgggatcgacgccgctggcggcgctcacccacatggcggtccaggtcatgccctggccgacgctgaggatcacgatggccggcagcagcgccaggaagccgcgccccagcggcaggcacgctgccagcaggccgagcccgagtgcgcccagcagcaggccggcgaccagcgtcgcgcgtgccccgtggcgggccagcaggcgctcggcgacgcggataccgagggtgcagagcagagtcgccgggaggaacgccaggccggtctgcaacacgctgtag

SEQ ID NO: 8431 - DNA, 876 bp, Pseudomonas aeruginosa
cttcacccaggccgccgtttctctcggtctgacccagtccggcctgtcgcgcgccatcggccggctggaagccgaactcggcgtgcgtctgctgcaccgcaccacccgcagcgtcagcctgaccccggacggccagctgttctacgagcgctgcgcacccttgctggcggaactggaggaagtcgagaagttgctggtggaccgccagtgcgcgccgagcggtccgctgaagatcaccaccccgcaggcgctcgggcggatcgtgatcatgccggtgctgcgcgaactgacgcggcgctacccgcaattgcagatcgaggcggcgatgaccgatcgcctggtcgacctcaccgaggaaggcttcgacgccgccgtgcgtctcggtcgggtcggcgacgtgcgcctgatcgcccggccattggcggcgttgcgctgggtcacggtggcgtcgccggaatacctgcgcagtcacggcacgccggagcgcctggagcaactcgccgggcacaactgcccgacggtgcgcgacctgcacaccggcaagctgctggaatggcagttccagcgcgacggccagccgctgagcctggcggtgcgcggcgacctggtgctggacgtggccgacgcgctggtcgacgcggcgctggtcggccagggcatcgtccaggtgatgggcttcatggccgaggaggcgatccgccggcgtcgactggtacgcatcctccagcccttcgaaccgccgctgtgcccggtgtcgctgatctacccgccgtcgcggcagtgctcgctgaagatcggcgcgctttacgaggaactgaagagcgcgcactggtgcggggcgctgacgtactgacccgagggcggcagggcggataa

SEQ ID NO: 8432 - DNA, 1971 bp, Pseudomonas aeruginosa
tttccgccgcgccgctgcgcgcggccgtaccggcggcgaaagtgcaaccgctggccggcgaaagcggagcagaccctggagcgggtggtggtgaccggctcgcggattccccgcgcccagcaaggaagggccgtcgccggtcacggtgatcagcagcgaggaaatccagaaccgtggctaccgcaacgtcttcgatgccttgcagacgcagacccagaacaccggcatgacccagggcgaggactacggcaacacctggcaaccggcggccaacgccctcaacctgcgcgatctcggccccaaccacacgctggtgctgatcaacggccggcgcgtcgccgactacccgaccgcctatggcggctcggtgaacttcaccaacctggcgaacatcccggcggtcatgatcgaccgcatcgagatcctcagcggcggcgcctcggccatctacggctcggatgccatcgccggggtggtcaatatcgtcctgaagaagaaattcgatggcgtcgacgtcaacctgcgcgccggcaccaccgagcgcggcggcggcgacaaccagcgcctgcaactggtcggcggcggcgcgacgggcgacttcgaaggcctgttcggcctgcaggtcgagcagcgccagccggtctgggccaaccagcgcggtttcatggacagctacccggacggcaacaacgtcggctaccggctgaacccgcagagcggacgctacctcggcgacgcctcctgcgccggcctcggcggcctgttcggcggcaacgtggcgccggtgccgggcgccaggggtggctatcgctgcatgaccgaccagtactacaacaactactggaccctacagaccaagaaggaaaactacgacggctacgccggcggcacctggcacctgagcgacagcggcaagctgttcgccgacctgctgttcggcttcgaccacctgcagaacaatacccgcgggccgtccttcacctcgccggacttcatcaatgcctccagcggcgacctggagcgctggtaccggctgttctcgcccgaggagatcggcggcaagagcagcaacaacagcaagtggcgcgaggtgtcctggaccggcaccctcggctacagcgaccacgtcgccaatacttcctgggaatacgaactggccgcgacccgctccgagtaccgcagcgaccgcactacccgctacaccccggcggccgggatcctcgacctgtacctgggccgcaagctcggcgaacgcgacggctacccggtctacgatcccgatccggcgcgcctcggacgtccgctgagcgaggaagagtggcgcagcctgcggcgcaacgtgacccagcacagcgagtcctactcgcagacctacagcttcaccggcaacggcgagctgttcgacctgccggccggcccggtggccttcgccggcgtgctggaggtgggcaagcagggctacaggatccgtcccgactcgcaatacaacgacggctctctctacaacgtctccaaggccagcagctccggcggctcgcgcgaccgttacgccgccggcggcgaattcagcatcccgctgcacgacacgctgctggcgtccgccgccggccgctgggaccagtacaggttcagcggtcgcaccgaggagcagaccacctacaacctggggctggagtggcgcccgctgaccagcctgctgctacgcggcagctacggcaccagcttccgcgcgccggacctgaactacatctaccaggccgacgccaacggctactacccggcgcagaaggactactacggttgcgagaaaggcgtcgacggcgcctgcaagaacggccgggtcgactacgtgcagagcggcacgcccgacctgaagtccgagcgcgggcgctactggagctacggcttcgtctggtcgccgtcgagcaggttcgacttttccgccgactactaccacatccagatcgatga

SEQ ID NO: 8433 - DNA, 1419 bp, Pseudomonas aeruginosa
cctggtcgagcagggcagcccgttctggcgcgcctactacaaggaggtccgcgagccggtggtggaggatcgcctgcgcatccgcttcgatttccgtcatgccggcaaccgcgagctgccgctggtgctggcccagctctacgtgctgcccaggcattggtggcagggacgcgacttcaaccgcagcagcatgcagccgccgctgggcagcggaccttaccggctggagaaggccgaggcggggcgttcggtgagctaccggcgcaaccccgactggtgggctcgcgacctgccggtcgggcgtggcctgtacaacttcgagcggatccgtttcgactactaccgcgacagcggcgtggccttgcaggcgttcaaggccgggcaggccgacatcaatgtcgagaccagcgtcaaggcctggagcagcggctacgactcgccggccctgcgcgatggccggttgcgccaggagagctttccctacccgtacccggccagcctccagggcctggtgttcaacctgcgccggccgctgttcgaggaccgccgggtacgccaggcgctgagcctgttgttcgacttcgaatggaccaaccggcagctcttcggcggtcgctacaagcgcctgcgcagctatttcgacaactcggagatggccgctcgcggcctgcccggcgccgacgaactggccttgctggagccgctgcgcgggcaaatccccgaggaggtcttcggccaggcctacgctccgccggtgaacgacggcagcggcgatatccacgagcgcctggtgcaggcctaccgcctgctcggcgaggccggctggcatgccgtcgacgggcgcctgctggataccgccggacggccgctgcgcttcgacctcctgctccagggcaagggcctggagcgcgcgctgctgccgttccagcgcaacctggcgcggatcggcatcgatatgcgcctgcgccaggtggacgcttcgcaatacatcgagcgcatacgtgcgcgggactacgacatgatcgtttcgagcttctcccagtccaattcgccgggcaacgagcagtacagcttctggcattcctccagctacgccgatcccggcggctacaaccgcatcggcctgaaggacccggccatcgaccggctggtccaggcggtggtcgaggccgactcgcgggccgccctggaaaccgccgtgcgcgccctcgaccgggtgctgcaatggggctactacctgatcccgacctggtatgccgacgaggtctggatcgccagctggaatcgcttcggccgaccgccgcaggcgccgcgctacagcctggggctgaacacctggtgggaagtccgcgagcgggccgcgccgagccgggaggcgcagtgacatgggcggctacctgttgcgccgcctggcgctga

SEQ ID NO: 8434 - DNA, 1086 bp, Pseudomonas aeruginosa
agctggccggcgacctggcctacagcctggtcgacccgcgcatcgacttcgccgcgaggagacagtgagatggccatcgtcctttccccgctgcaccgccgccgcctcgccgcgttccgcgccaaccgccgcgggcgcctggcgctgcggctgttcctcgcgctgttcgtcacctgcctgttcgccgagctgatcgccaacgaccgcccgctgctgctggaataccgtggccagtggttcctgccggtgctgcgggactatccggaaaccgccttcggcggcgagctgccgttcccgccggactaccgcggtcgcttcatgagcgaacgcatcgcccgcgacggctgggcgctgtggccgccgatccgcttcgacgcccgcagcatcaactacgcgcgcccggcgccggcgccgccctcggcggagaactggctgggtaccgacgaccagggccgcgatgtgctcgcgcgggtgatctacggcctgcgcctgtcgattctcttcgccctcggcctgaccctggcctcgtcgttgctgggaatctgcgcaggcgcggtgcagggctactacggcggctggatcgacctgttcggccagcgcttcatcgaggtctggtcgggtctgccgatgctttacctgctgatcatcctcgccagcctggtgcagcccggggtcggctggctgctggcgatcatgctgctgttctcctggaccagcctggtcgacgtggttcgcgccgagttcctgcgcggtcgtcacctggagtacgtcaaggcggcgcggaccctcggcctcggcgacgccggggtgatgttccggcacatcctgcccaacgccatggtcgcgaccctgaccttcctgccgttcctgctctgtggcgcggtgaccaccctgaccgccctggacttcctcggtttcggcctgccgcccggctcgccgagccttggcgaactggtcgggcagggccgtgacaacctccaggcgccctggctcgggctgaccgtgttcgtggtcctggcgaccttgctcagcctgctggtgttcatcggcgaagcggtgcgcgacgccttcgatccgaggacatga

SEQ ID NO: 8435 - DNA, 1116 bp, Pseudomonas aeruginosa
gatgaaccgggaactgttgcgagtggaaaacctgagcgtcgcctatggcgacacgcaggtcgtgaaggggatcgacttcagcctgcgcgccggcgagaccctggccctggttggcgagtccggctccggcaagtcgcagaccgcccacgccctgctgcgcctgctgccgggcgcggcgcgcctgggcggcagcgtgcgcctggacggcgaggaactgctcgccctgtcgccgcaggcattgctggcgattcgtgggcagcgcatcggcatggtgttccaggagccgatgacctcgctcaatccattgcagcgcatcggccgccaggtcggcgagggcctgcgcctgcatcgccgcctgcgtggcgccgcgctgcgcgggcgggtactggaactgctcgaactggccggcctcgagcagccgcgacgcctgctcgaggcctatccgcaccagctctccggcggccagcgacagcgagtgatgctggccatggcgctggcttgcgagccgcaactgctgatcgccgacgaaccgaccacggctctcgacgtcaccgtgcagaaacgcctcctggagctgctgcaaagcttgcagcgacggctgggcatggcgatcctgctgatcagccacgacctcaacctggtgcgccgggtcgccgatcgggtctgcgtgatgcgcgatggccagatcgtcgaggagaacgcctgcgagacgctgttccgctcgccccggcatccctacacgcgcctgctgatcgaggccgagccgggtgggctggcggagccggtggcgtgccgcgagacctgcctggaggtgcgcgcgctgagcctcgactaccccgcgcccggcggctggctgcgccggcgcgcgggactgcgcgcggtgcacgaggtcagcctgcggctgcgccgtggcagcaccctggggatcgtcggcgaaagcggttcgggcaagtcctccctcggccaggcgctgctgcgcctgttgccggccgaagggcagatcctgttccagggcgagcgcctcgaccggctgcacggcaagcgcctgttgccattgcgccggcagttccaggcggtgttccaggacccctacggcagcctcaacccgcgccttag

SEQ ID NO: 8436 - DNA, 411 bp, Pseudomonas aeruginosa
cgtgcagtgccaggtggtcgagctgctgcgtcggttgcagcgtcgccacgggctgagctacctgttcatcagccacgacctggccgtggtacgcgccctggcccacgacatcctggtgctcaaggacggccgggtggtggagcagggcagcgccgctgcgctgttcagccagccgcgccacccctatacccgcgagttgctcggagcgatacccgcgctgcgcctggaagagcatctgcgggtggccgggctgggaatctgaggcgggaaaccatgctgactctaaggatgttccgaaaggttctttccagacgccccggcgcttttcttaagatcggcctgcgggcccgtcagggacaaggagccatgtcggcttccgggtccgtccgatcgattgggggaatgcgatga

SEQ ID NO: 8437 - DNA, 1380 bp, Pseudomonas aeruginosa
ccgcgaagcggttattcgccctgcggctccaggggcttttcgtctttgccgccatttcccggcaatgtgcgcttggcggatcatccaggttgggtatcatgcgtcgccattcccatccaccgccgacggaagtcaggctttgcctgcgtgagcccaatggacgatctctcccccgattccgccttgccgcctgccggcagcgcccaggacaacgacgcgccgcgccagttggtggtctgcatcgacggaacctcgaaccgcttcggcgaccagccgaccaacgtggtgcgcctgtaccgctcgctgtcgcgcgatccgcgcagagtgctggcctactacgaccagggcgtcggcaccttcggcctgaaggaaaccctgttcgagtggcagaagtttccctcgcggatcgccggcctggccttcggctgggggctcaagcgcaacgtcgagggcgcctatcgcttcctcgccgagcactaccggcccggcgaccagatattcctcttcggcttttcccgcggggcctacgcggtgcgcgtgctggccgcgatgctgcgcgcggtgggcctgatcgatgcgcaccagccgcacctcttcgactacgcctggaccctgctcaccacccgcatgccgccccgcgacgaagacaagcgggccggcacgcgtcgccgcggaccggacttcggcctgctgggacgcttccgcaaggtcttcggccggcaggtgaaggtgcacttcctcggcctgttcgacaccgtgacctcggtgggctgggtctacgacccgctgaccgtgccgtattcctcgaacaacgaaatggtcgacgtggtccgccaggccctggccatcgacgaatgccgctgcttcttccggcagaacctctggttcggcgagaaggaccgcaagtccgacgtgttgcaggtgtggttccccggcatgcactccgatgtcggcggtggctatgcgccgaaggactcgcggctggctctggtggcctttacctggatgctcggcgaggcgctggaggccggcctgcatgtcgacccggcgcgcagccgcgaccagttgcgcgcacgttcgaagcagggcccggacccgaccgcgccgatcctgccggtgatgacccggccctggcgcctggccgagtggctgccgctgctggtctgggaccgccgcagcggcaaccgcgcctggcgctggtcgcgtggccggccgcgctcgcggccgctggaaccggtcgggcaggaaacccgggtcaagctgcaccgttcggtgcagcggcggctggacgaatgccccgactaccggccgtgcaacctgccagcgctggaacgctgcgacctcatcgacgattcgccgttgctcgacggctaccgctag

SEQ ID NO: 8438 - DNA, 1935 bp, Pseudomonas aeruginosa
tgtcgccgccgatccagccgctggcgtcccaggccagcgcgctaccgtcgtcggcgtcctggtattccaactggtcgagcaggaagaagctgttcagcgcgctgtcgtgcaccttgtgcccctccagcggcggaaaggcggcacggcggtcggcctcggtcggcaccgggatcggcgtacggctctggctgggcgcggcctgcgccggaggttgccgcgcagcgcggctcatccccggcatccggccatggtccattccctggtgctccatgggctgtgccggggcgggcgatgcggcgccgtggtccatccccggcatccggccatgccccatcccctggtggtccatgggtttcgccggggcggaggtcctctggccgtggtccatgccaggcatcgcgccgtggtccatggccgagtggtccatgccattgtcccgcgcggcctcgacgggattcggcaggcccagcagcagacccagggcgagggcaccggcggccaggcgggcgggtttcggctggcggctcatgcgttgtctccttcgtctacccgcacttcgcggaacatgcccatctccatgtggaacagcaggtggcagtgataggcccagcgtcccagggcgtcggcggtgacccggtagctgcggcgggtgcccggcggcatgtcgatggtgtgcttgcgcaccaggaaattgccttgctcgtcctccaggtcgctccacatgccgtgcaggtggatcgggtgggtcatcatggtgtcgttgaccaggacgatccgcaggcgctcgccgtaggtcaggcgcagcggctcggcgtcggagaacttgatgccgtcgaaggaccaggcgaacttctccatgtgtccggtcaggtgcagctcgatggtgcgccccggctcgcggccgtccgggtcggcgaagcggctgcgcaggtcggcgtaggtcagcacccgccgcccgttgtcgcgcaggccgaggccggggtcggcgagcttcggtgtcggcgtcatggtctgcatgtcgaccagcgggttgccgtcctccgaagccggatgggactgcatcggcatggcgcccatgcccatcctggagtggtccatgccggccatcttggagtggtccatgccgttcatgtccatgccggccatcttcgaatggtccatgcccttcatgtccatgcccgacatcttcgaatggtccatctcgctggcgggcctcgtcgccgcgccatgccccatggcgccgtggtccatgccgcccatgcccatgtcgtccatgccgatcagcgggcgcggatcgggcgtcggcaccggcgcgctaagcccttcggccagcgccagggtgccgcgggcgtaaccgctgcggtccatggactgggcgaagagggtataggcgcgctcgccgcccggttcgacgatcacgtcgtaggtctcggccacggcgatgcgcaactcgtcgacgctgaccggctcgacgtgctgtccgtcggcggccaccacggtcatcttcaggccgggaatgcggacgtcgaaatagctcatcgccgaggcgttgacgaagcgcaggcggagcttttcgccggggcggaacaggccggtccagttgccgtccggcggctgtccgttgagcaggtaggtataggtgtagccgctgacgtcggcgagatcggtgggactcatcttcatctcggcccacatcttgcggtcggccagggtcgcggcccagccgttggcgctgacgtcgtcgatgaagtcgccgacggtgcgcttgtggaagttgtagtagtcggactgcttcttcagcttggcgaggatgcgctgcggcttctcgtccgaccagtcgctgagcagcaccacgtagtcgcggtcgtagctgaacggttccggctcgcgggcgtcgatcaccagggcgccgtagaccccggcctgctcctgtag

SEQ ID NO: 8439 - DNA, 618 bp, Pseudomonas aeruginosa
acaggggcaggccctcggccagctggaacagcagggcgcaggcgccggccagggccgccagcagggtcgccaggcgcaactggtcgatgcgccagtcggccacgtaggtcagcgccaccccggcgatcacctgcggccagtaggccgcggcgatcaacaggccgatctggctggcgccgaagcccaggctggccagccaggtcggccagaacggatagatcagcccctcggcggcgaagtagccggaaaagatcaggtacatgccggttcccgcgtcgccgtgccggttcgctgcggtttgcgcctcactcgaagcgcgccctggcgaaggcgttctcgcccttgcgccagaccagcagggactcgcccagcaccaccaggtcgaccatcccgtcctccagcgcgccgagggcgtcctgcggggcgcagacgatcggttcctcgtggcggttgaaggaggtgttgatcagcgccggctggccgctgcgggcatgccaggcatgcagcagggcgtgcatgaacggatcggcctgcggccggatgatctgcggccgggcggtgccgtcgacatgcaccactgccgggcagcgctcgcggaaatccgcatggcagtcgtag

SEQ ID NO: 8440 - DNA, 2703 bp, Pseudomonas aeruginosa
  unsure (2569): Identity of nucleotide at the above locations are unknown.
tcggcaccgcggtttccgcatcgacccggcggatcgcgctgccggtcacctcgattcgttgcaactggaccgtgggcgggtcgacaggcgcctgttcctccgccgcggcggcgctgccgggagcgagctgcagggccagcagcagggcggcgcccagcggcgcgtcggtgtggagcgatcggtgcatggtcggggcatcccttgttccggtgtgtccagggatgtccgtcgagccgggggattttccagggacggcttagacctttgcgccatgagtttatgtccgctgggaacaagccctgccgtcgcgcctttcgtcggcgggccggagcggcagaaccagtcccctctgccgaggtcgaaaagcaggcgtcgcggcggtgctgtggcgtcctttcttcagctacatttttctttcagcagtcgttcccatcatccagggcagcacccaaggggcagatcatggctcgcaccactcccatcgagctttatcgcaacatcggcatcgtcgcccacgtcgacgccggcaagaccacgacgaccgagcggatcctcttctacaccggcgtcaaccacaagatgggcgaggtccatgacggcgcggcgaccatggactggatggtccaggagcaggagcgcggcatcaccatcacctcggcggcgaccacggccttctggcagggctcgaccaagcagttcccgcaccgctatcgcttcaacatcatcgacacccccggccacgtcgacttcaccatcgaggtggagcgctcgctgcgcgtgctcgatggcgcggtggtggtgttcagcggcgccgacggggtcgagccgcagtccgagacggtctggcgccaggccaacaagtaccatgtgccgcgcctggcctacgtgaacaagatggaccgccagggcgccgatttcctccgcgtggtcgcgcagatcaagcaacgcctgggccatgtcccggtgccgatccagctggcgatcggcgcggaggaaaacttcagcgggcagatcgacctggtgaagatgaaggccatctactggaacgatgacgaccagggcaccagctaccgcgaggaggagatcccggcggagttgcgggcgctggccgaggagtggcgggcgcacatggtcgaggccgccgccgaggccaacgacgaactgatgaacaagtatctggaaggcgaggaactgagcatcgaggagatcaaggccggggtgcgccagcggaccctggccaaccagatcgtaccggcggtgctcggctcctcgttcaagaacaagggcgtgcctctggtgctcgacgcggtgatcgactatctcccggctccatcggaaatcccggcgatcaggggtaccgacccggacgacgaagagaagcacgacgagcgccatgcggacgacgacgagccgttctcggcgctggcgttcaagatcgccaccgaccccttcgtcggcaccctgaccttcgcccgtgtgtattccggggtgctgacttccggcgatgcggtgctcaactcggtgaaaggcaagaaggagcgggtcgggcggatggtgcagatgcacgccaaccagcgcgacgagatcaaggaagtgcgcgccggcgacatcgccgcgctgatcggcatgaaggacgtgaccaccggcgacaccctgtgcgccatcgacaagccgatcatcctcgaacgcatggacttccccgatccggtgatctcggtggcggtggaaccgaagaccaaggccgaccaggagaagatgggcatcgccctgagcaagctggcccaggaagacccgtcgttccgcgtgaagaccgacgaggagaccgcgcaaaccatcatttccgggatgggcgagttgcacctggacatcatcgtcgaccgcatgcgccgcgagttcggcgtcgaagccaatatcggcaagccgcaggtggcctatcgcgagaccatccgcaacacctgcgagatcgagggcaagttcgtccgccagtccggcggccgcggccagttcggccattgctggatccgcttcgctccggccgacgaggggcaggaaggcctggagttccacaacgaggtggtcggcggggtgattccccgagagttcatcccggcgatccagaagggcatcgaggaccagatgcagaacggcgtgctcgccggctacccgctgatcggcctgaaggcgacggtgtacgacggctcctaccatgacgtcgactccagcgagatggcgttcaagatcgccgcctcgatggccaccaagcaactctcgcagaagggcggagcggtgctcctggagccggtgatgaaggtcgaggtggtgaccccggaggactacatgggcgacgtgatgggcgacctcaaccgccggcgtggcctgatccagggcatggaggataccccggcgggcaaaggtgatccgtgccgaggtcccgctgggcgaaatgttcggctatgccaccgacgtgcgctcgatgtcccaggggcgcgcgagctactcgatggagttcgtccgctatgccgaggtaccggccagcgtggccgaggcgatcgtcgccaggcagggccgntgagagccgccgcgcgccgccgaggccagcggcggcgcgcgcctttgcgggagcggcagccgcatcttcggcgccgatgcgcttgccaagcggggtttttgacgccccctggatgcttaactataagacagtga

SEQ ID NO: 8441 - DNA, 1107 bp, Pseudomonas aeruginosa
ccggctgatcgacgtgatcaaccgcgaggtcgcctacgaagggcacagcttccatgtcggcgcgagcatcggcgtggccctggcgccggagcacggcggcgatccgcggggcctgctgcgttgcgccgacgtggcgatgtacgaggccaaggccgcggggcgcaatacctggcgtttctacttggaagcgatggactcccatctcgccgagaagaagctgcgcgagaccgagttgcgcgccgccttgcagaacggcgagttcgagttgtactaccagccgcgtttcctggcgcaggaacagacgatcgcctcggcggaggcgttgatccgctggaaccatccgcgccgcgggctgatcggcccggacgagttcatcggcctggcggaagaaagcgacctgatcgtgcagatcggcaactgggtgctgcgcgaggcctgcgccaccgccgccagctggccaggcgaggtgatggtctcggtgaacgtgtcgccggcgcagttcatgaccggcgatatcgtctggcaggtgcgcgaggccctgcgcctggcccgcctggatgctcgccggctggagctggaagtcaccgagaacgtcatgctcaacgatgtcgatggcgcgctgcggaccatgacggccctcaaggagctgggcgtccgcctcaacatggacgacttcggtaccggctattcctcgctcggctacctgcgcacctatcccttcgacagcatcaagatcgacaagcgcttcgtcgccagcatggagaagaccgggcgcgaccgttcgatcgtgcaggccatcatcaatctcggcaacgccctgaacctgcgggtcaccgccgagggcgtggagaccgaagggcagatgcacatcctgcgcgacgagcaatgccacgaactgcaagggttcctgctcagccgaccgctggatgcgcagcgcctgcgcgatctgctggagcgcgaggcggggcagacccaggcgccacaggtttccgccgaaggccatgctgcgcgccggccttgagcgggcgtcagaagggcgcacgcggtgcctcggcggccctcggttcagcgatcgccctgcgtatggttcagaaaatgctgaactga

SEQ ID NO: 8442 - DNA, 1353 bp, Pseudomonas aeruginosa
cagatgctcggtatcgttgccgatatcgagcgcggtatccgtatccacgtgggcttcatcctcgggttggcgaatgatggcggcggcctgggtgggcgcctctctggcgttggccccgccctcggcgccggccaggcgtgcgggcggcacccggaggcgcagcgacaggctggggaccctggccgataccggttccggcgcgggtgcggcgaggggggaggggctcgggggcatggaggattcctcggcggcgtctggagacggaaggttggcgctgcccgtggcgtcggcggcgtgcagcgcggggtggagcatctgcgccaggtcggcaagctcctcgcgaagatgactggcgttgtcgacgaaggcgccgatggcctcggcatccgctaccttggcggactgctccgctttcgccgcgaactcggctggcgccccaccctcgggcgctgccgtttccgcctccggccgcggctcgggctcgacgcatccggcctcggtgacggtttcgtcttccgccgcctcgggctcgtcgatgggctccgccggcccgtccgtggtctcgtccgcatcgtcttcggcgaggacatcgggagcggcgtcttcgaaaagggcctcctggacgagcggcgggacttccgcgcagggttcctcgccatccagggcggggccgtagccatggggggactcgaaggtgacgagcttcatcacccattcgcgttcgagcaccagggagcggtgttcttcccgccgcgaatgggcgatggccgcgtcctgcaggtcgatgaggtggtaggccagatcgctggtccggcggttgccggtggtggcttcgcggaccagttggcggaacacctggatggccgcctcgcaggcctcgtcggtgtcgagacggcccaggcggaagccgtcgtcggtcttgaacagggaggcgatgtagacgcgcgagtcgttttcgtcgacctgttcgttgaggctgtaggcgatgaagttgcggtcgctggcgggaatggcgaaaccacacaacaaggccgcattcagttccgtctgctcggcagtttccacactgatggttcgaagaagcataagccctggagatcccgttggtgcttgaaaggtgtaacgggcgagggtaccgggagctatgggcgaggtaacttggacgagtcctattgccttgtaagaaaaatcttgaagattttactgcgcaccgtgcccagcacaccgcgcaggctcgtccgctcgtacgggggcggcgcgcttcagcgatccgccatcaggacgacgatggcctcggcgacgaagtcggcattgcgctccagggtctgcaggtggttcatgacgacatcgtag

SEQ ID NO: 8443 - DNA, 225 bp, Pseudomonas aeruginosa
cccccggcagcttcggaccgacctggcaaggggacctatccgaacggcgagggtggcccgcggtggtggcgcgccgcatggccagtttcccatgccgcctggctatactggcggcgcgggaacaagacgccgtccatgaagagcgtcccggacccgaacgtcgcgcttcctgtcatctccgctacctatctttcgttcttctgccgcgaaacggctttcggatga

SEQ ID NO: 8444 - DNA, 945 bp, Pseudomonas aeruginosa
aacaccaccaggcgcacgatggtcgagcggaacgccgacttcaccgcctgttccggatgctcggccttccgggcgggcggcgaccgcgatcatctccacgctgagataactgaagatcgacaccaccacggcgatccacatgcctttcaggccgtgcgggaagaagccgccgtgggcgctgtagttgtgcacgccgtaggccgggttggcggagccgaacaccaggtaggcgccgagcaggatgaaggcgacgatggcggcgatcttcagtgtcgagaagcagtattcgaagttgccgaaagctttcacgctgctggcgttcaggccgatcagcagggtcgagaaggagatgatccagacccattccgggataccggcgaaccagtacttcatgtacatggccaccgccgtgacctcggtgcccaccgccaggacgatggccgcccagtaggcgtagcgcaccaggaacccggccagcgggccgacgtagtgctcggcgaaggcgccgaacgagccgggggtggcatgggccacggtcatttccgccaggcagcccatcagcagcagggtgatcagcgcgccgatggcatagctgagcaggacgctggggccggcgaaaccgatggcgaaggcgctgcccatgaacaggccggtgccgatggcgccgccgatggcgatcatgctcatctgcgcggccgagagccgccgttgcaggccctgttcgcggcgcgagatggcctcgaagccctgggggtcgttcatctggatgtcctctggaatcttattggggttcttatgaattgccgagggaacgtcggtggcgatgtgcgggtgccggtcgcgggctcctgtgcgcgagagcggtgggtgctcgcgggccgccccgggaataccggcgcggtccgcgcgggcgggactcaggtcaccttgtgccggacctggtag

SEQ ID NO: 8445 - DNA, 1113 bp, Pseudomonas aeruginosa
agcgggtcgagggcgaactggtcagcagccgcagcaacttcgtcgtccatcagttccgcaaccgcgaggcctggaacttcgtcggcgaagccagtcatgtcctgcgcgacggtcccgagggcttgcgcatcgtctcgcgggagatccgcctggaccacgagaccatcagcgcccagcggcgcatcagcatcattctgtgaggcgccgcccatgagcaccgatccgttgctgcccggcttcgactacctgaccctgcacacctccgccgcgcgcctccgcgtcgccgtgaagggcagcggcccgccgctgctgctgttgcatggctatccgcagacccacctggcctggcatcgcatcgctccgcgcctggccgaggactacagcgtggtcctcgccgacctgcgcggctatggcgaatcgcgggcgctggacgaggagggcgccgactattccaaggccgcgctggcccgcgaccaactggaaacgatgggccagctaggcttcgaacgcttcgcggtgatcggccacgaccgcggcgcgcgggtcggctatcgcctggcgctggaccatccgcaagcggtcgcggccttcgtctcgctgaccgtggtgccgatcctcgacaactgggccgcggtgaacaaggccttcgccctcaacgcctatcactggttcctcctcgcccagccgtacgacctgccggagcgcctgatcggcgccgatccggagcacttcctcgactacaccctgcgacgcatggcccagggccgcgacatctaccacccgcaggcgctggaaagttaccgccgggcgttccgcgaccccgccgtgcgccatgcgatgtgcgaggactaccgggccgcggtgggcgtcgatgccgacgccgaccaggccgatcgcgacgccggccggcgcctgcaatgcccggtccaggtgctctggcaggagcgcccctacgccgccgggcagcatccgctggaaatctggaagacctgggccgggcaggtcgagggcgccgccatcggcgccagccacatgcttcccgaggacgtgccggacgccgtgctggagcacctgctggggtttctcgccagccaccgggaggcgctccgatga

SEQ ID NO: 8446 - DNA, 1266 bp, Pseudomonas aeruginosa
tcgaacagttcatcgtcgcgcgcccggcggattaccggctcgacgactgggcgcgcgccaccgcgcggatctatcgcgcgctggaaccggcggggcggggcgatccggccagcgccgccgaccgtctggcacgccaggccgcgctctacggttcgcgtttcgaggtgcaggccgaggctgacgggcgcgcggtattccacaaccgtcactgcgcgatctgggactaccgcgagcgcgcccgcgcccgaggcgtgccgatcaccctggagtcggcctgcacctattgcaccaagctgctgtcggcgttcgtcgccgccagcgattgccgcgccgactggcggctctacgaagagccgcaaggccacggctgcgtatggaccatcacggcggacagcctcaaccaaggagcaggcgtacatgaacgcgatcattgaacaggcgcgcagcctggacggctaccaggattccagcgaactgctgcaacgtcgcgaccaggactgggtgctcgaccgcgccggcatcgagccgcgcagcctgctcgatctcggctgcggcatcggctcgctgctgctcggcggcgcccggcgctggcccggcctgcaacggttgtggggcatcgagcgttcgccgctacgcctggagcaggcgcgcgcgcagttgcgcggggctggcgtcgaggcgcgtctgctggagggcgacctgctcgacctgccgccgctggcggaacgcttcgagctgatcagcatgaccgccgtgctgcactggctgtatcccgatgaagagcggctgttccggtgggtcgcgcggcacctcgaggcgcagggggtattcctgttcacctcgcaccatccgttcgccgaggatggcctcggcggcgaggacgacctggtcgcccaggccctggtcgagatgggcctggctgcgccggaacgggtggcggcgctctacgcggaagccgggctgctgccgatgggcacccgcacccgtggccgggaggcgttgcgcgaacgcgtcgaacgacacttccgggtcgactccatcgtctcccgcccggcggtcctgcgtgtcgccgactccgccgaataccagcgtttccacgccgccaccttcggcacctatttcgcaccgctggtgccggcgacgcgcctggaggaattcttcgtccgcctcgggcggatcgccgagcggcgcatgcaggccgacggacaggtcagcgaaatcccggtcagtgtctggcgctgccgggctcgggagggcgaggcataa

SEQ ID NO: 8447 - DNA, 3678 bp, Pseudomonas aeruginosa
accgaccatgtccaacccgcgttcgccacgtcttcgacttgtccccgtgctctgcgcggtcggcctggcctgccttggccagcccggcgagtcggcggcagaggaggtccgcgccaccagcagcgccgagatccagcgcttcgacatcccggccggcgaactggcccaggtactgctgagcatagtccgccagagtcgcaccccgatcgccttcgaccagcacctggtggagggcctgccggcaccggcgatccagggctcctacagcgtcgagcaggcgctgcagcgggccttgcagggcagcggcctggaatacatccgcagcgccgccggcgtgctcagcctgcaacgcgccacggcgccggatgccgcgctgccggcggcgaagcccgccgggaccctggccacggtggtggtcaccggcacccgcaaggccgatgtcaaggccggcgagagcctggcaccgatcgatgtggtcagcgccgagcaattgcgcgacagtggcagcggcgacctgcgcgacgccctggtgcgcctgctgccctcgctgtcgcgccaggcccaggcctacaacgcttcggcgctgaccaacgcgcagtcgctgcgcggcctgagtcccaaccacgtgctggtgctggtgaacggcaagcgccgtcacgagaccgccaacatcaatgtcagcggcgggctgcagagcggctccaccggggtcgacctggataccatcccgctcgccgccatcgagcgcatcgaggtgctgcgcgacggcgcctcggcgcagtacggctcggacgccatcgccggggtgatcaacgtcatcctcaagtcggccgaccacggcggccggctcgcctacgacaacggtcgctacggcgatggcgacggcctgacccagaacggcggggtgaatggcggcctgcgtttcggcgagagcggtttcctcaacctcagcgcgcagttccgcgaacaggcgcggaccatccgcgccggcatcgaccagcgtaccgggcactacggcaacccgtccatcggcgacccttcgctgcaccgccaggcgctggcctacaacgccggcgtggcgctggacgacaacgtcgagctgtacagcttcgccacctatacccatcgctcggtgtcctcggcgcagatctaccagttgccgtccctggcgccgcgactctatccgaacggcttcaccccgcgcatcaccagcgacgaggacgactattcgctgaccctcggcgcccgtggcggcgagctgttcggcgcctgggactgggacctcagttcgacctacggtgccgaccgcccggagatcggcatggaccattcgatcaacctcgccctctacggcgagaccggcgattcgccgcgctccttcgacctggcgcgctacaaggccacccagtggaccaacaatctcgacctgcgccgcgacttcgacctcgcctggctgccggcgccgctgaatttctcctggggcctggagcagcgccgcgagctctacgaggtcgaggccggcgatccctggtcctactacaacggcggttccaaggcactccccgggcaggcgccggccaccgccggacagtggagccgcgacgtgctcggcgcctatctcgacctgtccatcgccctcgacgagcgctggcaactggagacggcggcgcgctacgagcactacagcgacttcggcagcaccaccaacggcaagctcgccagccgctaccgcttcagccccgaggtatcggcgcgggccagtctcagcagcggcttccgcgcgccgtcgctggcccaggagaactacacaagcctgggcgtctcgccgaccatcgccagcggcctgctggcggtcaactcgccggcggccaggctgctcggcgccgaagacctggagccggaaaaatcgatcagctacaacctcggcctggtgctcgatcccttgccggacctgaacctggccatcgacgcctatcgcatcgagatccgcgaccgcatcgtcgacggtgccacctattccggacagccggcgatcgatgcgctgcgcgccggcgggatcagcatcccggccggactgacccaggtcagcacccactacatgaccaacggcgccgacacccgtacccacggcctcgacctcaccgccagctacctgacccggctcggcgagtggggccggatcgactggcgcctgggcgccaacgtcaatcgcacgaagctggtcaggaatcatcgcgggcgcaacggccagccgctgctcaacgaccagcagcaggcctggatcaccagctccacgccgcgcagccaggtcagcctgcaggccgactggagctaccggcgctggggcctgaccctgcgcgaaacgcgctacagcaagacggtttccgaactggactactacaccggcgagcatgcctattcgaccacggtcttcaaccgcttcgagaactcgcccaagtacatcaccgacgttgccctgcgctatgcggcgagccgcaacctgaccctgagcgccggggccaacaatctgttcgacgtgaagcccgacaagctgccggccgagagcgcctacctcggcttcaaccagtacgacacctatgcctcgcagatcagcttcaacggcgccttctactacctcggcgcggcctacaccttctaaggaggacgaaccatgagcatcgaactgcgcggcggcgtgcgcgcctccgcggtcatcggcgacagtgccttcgcccgccaggccgcgcgtttcctgccggacacccgcagtcgcgcggtgagcgccttcgacatccagcagaaggcccgcctggaagaggcggacggcctcgacggcgcgctgttcaccgtttccgctgcctggcccgacccctggctggtcgccggctgggctttggccgcggcgccgcgcatgcgcgccaccgtcgcgcaccgaccggggagcgcccagccgaccgttgccgcgcgcgccctggccactctcgacggcctgtccaacgggcgcgccggcgtacacctggtgatcggctccagcgacgccgacgtgcgccgcgacggcgacttcgccgacaaggacgaacgctaccggcgcgccgtggagtacctggaggtcttcacccgcgccctggaaagccgcgaacccttcgactaccacggcgagttctaccggctggaggacgccggcagcggcttcctgccgatccagcggccgcgcccgccgctatccgttggcggctcctcggcgcaggcacaacgcctggcggtgcgcttcgccgacgtctacgccggccacttcgccagccccacgcagaccgcggagctcaagcgcaggctgaacgaggaggcggcggagcagggacggcggctgaagttctggaagcacttccaggtgatcctcggcgacagtccggcggcggccctggacatcgccgagcactaccgccaggccgctttcgaactgcttctggcacggcccctcgacgaactggcggcatcgccgcaggtcgcccgcgacggcgagcgcgaccggctcgcccggctggagccggaggccttgcgcgaatgggtggcgaataccgtgcagcgcagcttcgccggggtgctggtgggcagcgtcggcgaggtggcggaacagatcctggcctttcatcgcgccggcatcgagatcgtccagcttga

SEQ ID NO: 8448 - DNA, 1353 bp, Pseudomonas aeruginosa
ggccaccaccgagaacgccgaggacatccgcttgcgccgccaactgatcgagcgcctgaggcgcgacgcatgagcggcgtcgcccgcgaggccatggaggacgtcgcgccggcggcgcctggcgtcggcgagttcggcgtggccagttgtggggtgctgctggcctcggtagtgggggtgatcttcggccccaccgggctggtgatcagcagcttctcgctgttcatcgagccgatcgccgccgacctggactgggaccgcggccagtcggcgctgccggtgaccctgctgggcctggcggtagccctgagtagcccgctgaagggctggctggtggatcgctggggcgcgcgcgccctggtcctgccgctgaccgccgcgctggccctgtgcctggccagcctggcgctggcgcgcagcggctggcagctatacctgctgttcgcgctgctcggcctgctgacgccgggcaacattccctatgcgcggattctcggcggctggttcgagcgtcgtcgcggcgcggcctacggcatcctcggactcggcttcggcgtcggcgggccgctggcgctgtacctgggcagcgcctgcatcgacgccttcggctggcgcgccaccttcctcgtctatggcctgctcgaaggcctcctggcgctgccgctgctctatgcgttgttccgcgagcgacccggcgacctgccgcaggcgcggcgcccgccagccgacgcgctgcccggagcgacgccaggccaggcctggcgctcggcggacttctggctgatcgtcggcaacctgatcctcggcgtgttcgccgtcactggcgtgatggtgcatggcgtgccgctgttgcaggagcgcggcctgtcgcgggaagtcgccaccgacgtgctggcggcgctgtgggtcggcatgatcgtttcgcaaccggcgctgggctacctgctggaccgctacgacaccccgcgcatcgccttgccgttcgccctgctggcggcgctcgggctgctgctcctgctccttggcggaccgccggcgctgctctggggcgcggtgttcctgatcggcctgggcgccggcggcgagaccggcaccacccagtacttcgtcagccgctacttcggcctgcgccatttcagcgtgatctatggctcgatccagcccttcaccttcgccatcgccatcagcctggggtcctggctgctgggttacttctacgaccgcgcgggctcctacgcgggctcgacgctggtcctgctcggcgcgttcggcgtggcggcagggctgctggtcatgctcgggcgctatcgctacgccatcgacggggaggcacgcagccatgggcgagactga

SEQ ID NO: 8449 - DNA, 618 bp, Pseudomonas aeruginosa
cctgttcctgctgctcgccggggtcgcgttgctcggcctgccgctgctcctgcgcctgctgccggccatccgcggcgcgcccggcatcgccccggcggagcaactgcgggcgctggcccggggccgggtgccgttcgcccacctggcatcgctgttgcagatgaccggccagttcaccgtctacacctacatcgtgccgttcctggtcggcagcatggccctcgacaaaccgaccatcagcctggtcctgctggtctacgggggcggcggcatcctcggcgcgctgctcggcggacgcgccgccgaccgctggccggggccggccaccttcgtcgccttcctgctcctgcacgcactggccctggtcctgctgccgttcgccaccggcggcctgccgctgctgctgggcgcggtggtgttctggtgcgtgttcaacatggcgccggggccggcgatccagaaatacctggtggaactcagcccggacaccgcggcgatccagatcagcctcaacaccagcgcgatccagctcggcgtggccctgggcgccttcatcggcgcgatcctggtggatcaggtggcggtgcgcgcgctccccctgggggggcgccgcgctga

SEQ ID NO: 8450 - DNA, 702 bp, Pseudomonas aeruginosa
aggatgccttgcactgctgctaccggggattccaggaatgagcgagaagccggaacggcaacgcatcgtcgaggaggccatcgaatggatggtgcgcctgcaatccggcgacttcagcgccgccgagggcgatgccctggaacgctggaaggcgctgtcgagcgagcatgccgaggtgttccggcaactgcttggcagcctcgcgccgctacaggactcgccctggcgcggccagccgagcgctaccgtgctgcgcgccctggagcagccgtcgagccgccggcgcttcgtcggcggcgccctcgggctgttcgtcctgctcgccggcggcgccggcctggagcgctgggtccaggccggcatgggtctgcccggcgaactggcgaccggcaccggcgagcgccgcgactggttgctggccgacggcagccgcctgcgcctgaacgcgcggagcaaggcgcgaccgctgctcgacggcgcccagcgacgcctggagctgcggcgcggcgcgatgcgcctggaagtgaaggaggacccgcgcggcgccttcgccctcgactgcgccgccggacgggtggactgcgccagcggcagcctgctgctggccgaggagcgcggggcgatccgcctggtgaccctgcgcggcagcgcgcggctgaccaccggcgagggacgccagctggcggtggcggcacgacgtag

SEQ ID NO: 8451 - DNA, 933 bp, Pseudomonas aeruginosa
tcggcaccggagcccagcgccatccagttcgtcccgcggatcgccccgcaggtgcaacgcctgtcgctgttccagcgcagcgcgccttacgtgatcgccaagccggaccgcacctacgccgactgggaacgccgcctgaaggcgcgctggccgtggctgcaacgcctggatcgggggctcaagtacctgcaccacgaatcgcggatgctcgccttcgcgaccttcccggcgctgatgaaggtgatgcggctgagcttccatcgtcacctgcaccggcagatcgccgatccgcaactgcgcgcgcggctggttcccgactacccgctgggttgcaagcgcatcctgatcagcaacgactattacccggcgctggccaggagcaatgtcgaactggtcgacacgggcattcgcgaagtcaccgaagacgccgtggtcggccgtgacggccgccggcacgaggtcgacgcgatcatcttcggtaccggcttcgccgccaccgagttcctcgccccgatgcgcatcctcggcctcgacggacgcgacctgcggcaggcctgggcggatggcgcggaagcctacaagggcatcagcgtcagcggcttccccaacctgttcatcctttacgggccgaacaccaacctcggccacaactccatcgtctacatgctggaaagccagttcccctacgtgctcggctgcctgcgccagctccaggagcagggcttgcgctacctcgacgtgaagcccgaggtccagcggcgcttcaacctggaggtgcaacaggggttgcgccataccgtctgggagcgtggctgcgacagctggtacaagactgccgccggcaagaacaccaacaactggccgggctacaccttcgtctatcgctggcgtacgcgccggccggagcttgccgactatgacctggcccgctga

SEQ ID NO: 8452 - DNA, 783 bp, Pseudomonas aeruginosa
agcgcccctgatgtcgccgccgcaacgcctgcgcgccggtctcctgcgcggctgcctgcgcctgttgttccgcgggctggtccgtccgcccatgccagtggcgctgcaacgcggcgtgttgcgcgggctgagcctggcgacgctgggcgccggcggcgtcgtccgcgagcgccgcagcctcgccggcgtgccctgcgagtggttgcggccgcgcggggtggaggcgcggcgccgggtgctctacctgcacggcggcgcctacctgatcggctcgccggcgacccaccgggcgatcaccacgcacctggcccggcgttgcgccgccgaggtctgcgcggtggactaccggcgcgccccggaacatccgttccccgccgcccgcgacgacgccctggcggtctacctggcattgctggaggccggccattcgccgcgccggctgctgctcgccggcgactccgcgggcggccacctggcgctgtccctggccctggagctgaaggcgcgcggcttgccgttgccggccgggttgctgctgttctcgccctggaccgacctcggctgccagcgcctgcacacgccggcggccggcgacccgctgctgtcgcgggcctggctggaaagcgcggtgcgcctgctgctgccggccgacgcggagccaggctcggccgccttgtcgccgctgcatgccgacctggcggggctgccgccgctgctggtacaggtcggcgaggacgaactgctgcgcgacgacagcctgcgcctggcgcaacgggccggtga

SEQ ID NO: 8453 - DNA, 756 bp, Pseudomonas aeruginosa
gtgcagaacatcctgatcagtggtgccgcttccggaatcggcgccgccagcgcgcggctgttccaccgccggggctggcgggtcggtttgctggacatcgatgccgaggcgttgcgcggcttggccgcgcaactgccaggcgcctggcaccgcgccgtggacgtcagcgagcccgacgcggtcggcgaggcgcttgcgcagttctgtgccgatggccgcctgcgcctgctgttcaactgcgccggcgtcctgcgtttcggccgcttcgaagaggtcgccctggaggaccacgcgcggttgctggcgatcaacctgcatggcgtcctcaactgctgtcacgcggcctttccgttcctgcgcgcgacgccgcaggcgcaggtgctcaacatgggctcggcatcggggctgtatggcgtaccggagatggccgtctactcggcctcgaagttcgccgtgcgcgggcttaccgaggcgctggagctggaatggcgccgccacggtattcgtgtggccgacctgattccgccgttcgttcgcacgccgatggtcgccgggcaggcctaccagccgccggtgttgcgtcgcctggggctgagactggacgccgaggatatcgccgaagcggcctggcggcaggcgcacagccggcgggtacaccggccggtgggcgggttgttcacggcgctgtaccgggctgggcagttgtctccgccgtgggtgaaccgagcggtgatggcgtggttgtcgcggggttag

SEQ ID NO: 8454 - DNA, 633 bp, Pseudomonas aeruginosa
agaggtttgataagcaataaagggcgtcaatcaaagaataacatgggggaaagacgtgcagcttatgtcaattcaagctctgactatcaacaggcggcaggtacgtgtggccagcctggtgaccgctgttctatttctagtggtgtgtatcagctgggggactacctggctcggcatcaagatcgccgtggagagcgtgccgccgctaactgccgccggattgcgctttctgatcgcatttccgcttttcctgctctttgcgcggctgcgccacgagacgatctttttcccgcggcgactcctggccttcttcgtcttcgtgacgctcggctacttcagcgtgccctactacctgctgaactatggcgagcaatacgtcgcttcaggtcttaccgcgctgctgttcagcagcatgcccgtgttcatcctgatcttctccgcgatcttcctgcgcgagcgcatctacctgtcgcagatccttggtattgcgattggcttcggcagcctgttcatgatcatcaggtctcaagggctgcatctggactacacggagttgttaggcgtacttgccatcctgctcgcggcgatcatgcacgcactcagctacgtcatcaccaaaaggcaaggtgctga

SEQ ID NO: 8455 - DNA, 1422 bp, Pseudomonas aeruginosa
aaagtgaagacggtaatttttccggaagtactggtacgggccgcccaactggaaggcgggcgcctggagggagcgggcttgacggttggcgagctgctggcaggccttgccaggaagcattcttcattactcgggcacctgtattacgaaaacggtcaattgaaagaacacttcctgctgacccacaaaggttcgctagtcaatctggatggcgagctttccgatggagatgaagtcgaagtcatgctcgcgacatctggcggttctggcgttgaagcgttgagcgacgaagaagttcaacgctacgttcgccacatcacgttgccaggcgttggcagggaaggccagcagcgcctgaagcaggccagggtgctgataatcggaacgggcggcctgggttcgcccgcttgcctttatctggccgcagcaggagtgggcaccatcgggctggttgactttgacgtggtggagtcgagcaatctccagcgccaggtcgtccatggctatagcacgctcggtatgccgaaggttgagtccgcccagcgccggatgcaggacctgaacccctacattgaagtcgtaacccaccgttacgccatcgacgcggacaatgcgcagtcactgattcagagctatgacctggtattggatggcaccgacaacttcgccacacgttacttggtcaacgcggtttgcgccaagctcggaaaaccactcgtctttggcgcgatctatcggttcgaaggtcaggtcagcgtcttcaatctggagggaggcccctgctaccaatgtctcttcccgaacaatcccccgcctgagatggctccaagctgtaacgcagggggagttattggtgtgctgcctggagtgattggcctgctgcaggcaaccgaggcggtgaaggccctcgtcggcctgggcaagtccctatcaggcagacttcttcgattcgacgcgctgctcatgcacttcaatgaagtgaagttcaatcggcgcgacgattgtccggcctgcggcaaaaccgctgcagagaatccccgccactggagggagggattgctctgccaggcaagcgcggcaccgtcgcaacgactcgacgacgatcgctatatcgatcccggctgcctgttgcagttgatgaaatccaacagcgaaaactatgcccttctggatgtacgcgacgcgggcgagctcgaagtgtgccagttgccggggatcgtccacgttcccttgaacgaactcgccagccatttcgccaatctcgacttcagtaagcgctacatcctcgtgtgctacgccggcactcgtgccgaacgcgcggccatacagctcatgggggcagggttctccaacgtccaagtgctcgatggcggcatgaagcgatgggcgaaagagatagagcagcacatgccgatgtactga

SEQ ID NO: 8456 - DNA, 936 bp, Pseudomonas aeruginosa
accataggcagggaaagcatgatctacgattcgctactcgatttaattggcgggacgccggtgatacggctgagcaaattgtctgctcgcctgggggtgagcgtattcaccaagctggaatccttcaatccaggaggaagtcataaggcgcgtatcgcgctctggatgattctggatgccgaacgcaaaggaatcctggtgcgcgggaaagggcagaccattctcgagccgagcgggggaaatacggggattggactggcaatggcggggaacatcctggggtaccgcgtgaccctggtggttcccgacaactacagccctgacaagagacaattgctcgagctgtatggcgctcacgtcgtgctgtcggatagcagaaaagggaacaactcgcatggcgagctggcaatccagatactgctggaacatccggagttcgtcatgctcaaccagcagcgcaatccagccaacccgcaagcccatcgcgaagctacagccctggaaatcctgagggactttgcaggccagccacctccggacttcttcttcgctggcattggaactggtggacatatcacgggtgttggagaggtgctgaggaaccactggccggatatggccatctatggcgtgcagccagagcagtgcgacttgctcgacgataggcacgcaccgcatgagattcagggactttccattggtatcgtgccggaagtctgcaacctcggcattgttactggcatggtcggggtgtcgaaatctgcctgcttgtcgatgatccgggaagtcctgcaaaacgactctgtgagcatggggttgtcctccgcagccaacctggtcgcggtgctgaacatggcatctgccatgccgtcaggcgctcgtgtactgacgatgatctacgatggcgtcgagtcatacatggacgcttttcgatga

SEQ ID NO: 8457 - DNA, 777 bp, Pseudomonas aeruginosa
agttgtagagcagagcacggcgataacgcttgcatggtcgaaatgaggtcgcatgcgatggacaaactggtaggtaatctgatgcgcgcggcattgatggagtgctgctcaccccaactggtggagcggatagtcgctcattcgatgttcgaagaagccagacgttggtgcgaggaagacctgcaggcattcgccagcaaggatccagccgcacagggacggacatccgacattgcgtttggctacagctcgttcaaggcagtgctgcactaccggctttcccacatgctgtgtctgcgaagcacatctgaaggcgatcctgagagagcgttggaggctaccgcgctcctggtctcctctcgtggaaagctcctgtcgggcgcggaaatccacccaagatgcaagattggcagtcgattcatcctggaccatgggcatggcacggtcattggcgagacagcggtaatcggtgatgactgttacatcctcggaggtgtggtattgggggcaactggcatatcggctaatcccgccggtaagcgtcaccccaccatagggagccgcgtccaaatcggggccttcacgcgtgtactgggtgacatcgctatcggcgacgatgtgtttgtcggtccgcattgtgtcatcaaggacgacatccctgtcggttcagtcgtaaccctgcgttctgaactacaggtcatccgaggcccccacatagttcagcaactacagccggcagccacgcagacccaaattcaaccaatggaggcatcatga

SEQ ID NO: 8458 - DNA, 2577 bp, Pseudomonas aeruginosa
gtattaaagacaccgacctgcagccttgcggtggaacccatgtggcgaataccgaaaaagttggggtggtgcgcgtttccaaaatggagaaaaaatcagcgcgcacccgtagggtggtactggtactgggttgagcgactaccgtcgacatggccgtcggtttcccattctacgccacaggtcaccctcgccacgcccggcagctccatgcaatgccagagggcctcaggccggcaacaacggccgacaggcctcgacgaagcgccggcaggcacccgcacattcgcgctccagcggctcgtcgccatcgcaacgctccgcgcatgccagggcatagcgcgccgccagctcgcaggcggccggcgcccatgggctgcggcgctccagcagcagagcggcgaggcggcagatgtcggcgcactcgccggcgtgctggcgttgttccctgctggactcggtgcaaaacgccaggtagcgctcgcacgcgccggatgcattcctgggacgcgggcccggcagggctttatccgggcgcttcggacggcggcaccgccgagccggggggtcggcgttcggtttcccagcagggacccggggtcttcgtttcccggaatcttgatggcgggggtcatggcggcaacctcctggggaagggcccatgcggggccctgttcctgggcccggtcgagaatccgacagttcagtcgatttcgccgtcggcaccgccggtcgattgccttgaaacccttgccccgcggcgccagtcctcactggtacgaccccagacacgaccaggaggcgagaatgtccagcacggttgccgatcaattgctcgaacgcttgagccagtggggggtgaagcgcgtcttcggctacccaggcgatggcatcaacgggatcatgggcgccatgggccggcgcgccgaggcattcgactatatccgcgtgcgccacgaggagatggcggccttcatggccggcgcccacgccaagttcaccggagaggtcggggtgtgcctcgccacctcggggccgggcgcgatccacctgctgaacgggctctacgacgcgcgcatggatcatcagccggtgctggccatcgtcggccagcaggcggctaccgcgttgggcagcgactaccagcaggaagtcgatctgcagagcttgttcaaggacgtttccgcctatgtcgagaccgtggtcagcccggcacaactgctccatgtgctggaccgagccctgcgcgtggcggtcggcgagcggcaggtggcgacggtgatcgtgcccaacgacgtgcaacagatggcggccccgaagcgccagccccacgagcacggccacgtgatgtcggcggtgggcttcgtccagccgcgaccctacgcgcgcgacgccgacctggaggccgccgcggcgatcctcaatcgcggccggcgcgtggcgatcctcgccggtgccggcgccctgggcgcgcaccggcaactggaagcggtcgccgagcgcctggccgccggagtggccaaggcgctcctgggcaaggcggcggtttccgacgacctgccgtacgtgaccggctccatcggcctgctcggcacccgcgccagcagcatgctgatggagcattgcgacaccctgctgatcgtcggcagcactttcccctacagcgagttcctacccaaggccggccaggcgcgggcggtgcagatcgacctgtatccgcgcaacatcggtatccgctatccgatcgaccaggccttgctcggcgatgcaggggaaaccctggagcgcctgctgccgctgctcgagcagaaaaagcacggcgcctggcgccgccgggtcgagcgggcggtgacggccagtcgcgaggaagcccggcgccaggccgaagagccagccgacccgatcaacccgcagcgggtattccgttccttgtcggagcaactgccggacgatgcgattctctgcggcgacagcggctcgcataccaactggtacgcccgcgacatccgcatgcgcccgggcatgctcggctcgctgtcgggcaagctggcgaccatgggcagcggcgtgccctacgccatcgccgccaagctcgcctatccgcagcggccggtggtggcgatggtcggcgacggcgccatgcagatgaacggcaacgccgaactggtcaccgtgcagcagtactggcagcgctgggactcgccgaccttcatcgtgctggtgctgaacaacggcgatctcaaccaggtgacctgggagcagcgtgccctggccggcgacccggagttcagcccggcgcaggaagtgatcgatttcccctacgcgcgttatgcggacatgctcggcttcaagggcatccgcgtggatcgcccggaggacatcgacgccgcctgggccgaggccttcgccgccgaccgcccggtgctgctggaggtggtcaccgacccgaacgtgccgccgctgccgccgcacatcagtttcgagcaggccaagcacctgcttggcgccatgctgcaggacgatcccaagcgctggggggtgattcgccagagcgcccggcaggtcctcgcgcggcactga

SEQ ID NO: 8459 - DNA, 231 bp, Pseudomonas aeruginosa
ccgtcttcgacaccttcggcatcgtatccgggatttcccagggacacgtgcccaccgcctacctggtggccctcgccggcgtgctgttcaccgcgatcagctacggcaagctggtccgccagttccccaccgcaggctcggcctatacctacgcgcaacgagcgatcaatccccatgtcggcttcatggtcggctggtcgtcgctgctggactacctgttcctgccgatga

SEQ ID NO: 8460 - DNA, 1437 bp, Pseudomonas aeruginosa
aatccacgccgtcccgatccggttcgatggccgtggcgggggagcccggtatccgctggtcggtgtttcctgtggtgctgtgcgtccttccctagactacccggctcgctcgaaccatcccttcgcgggggcggaacggcacagggtcgttcggcatggaagctgcctgggccggccttcgacacacctataagagtagaaatctgcatgacataccctgaacgtcccctgcttcatctgctgacgcgtaccagcctggtgggccagatcatcgtcggcctgatcgccggcctgctgctcgccagcttcttcccggccgccgcgctcaaggtcggcttcatcggcaaggtcttcgtttccgcgctgaaggccgtcgcgccggtactggtgttcgtcctggtgatggcatccatcgccaaccacaggcaaggccagcagacccatatccggccgatcgtgctgctgtacctggtcggcaccttcagcgccgcggtggtggcggtgatcgccagcttcgccttcccctcgagcctggtgctggccagccatccgggcgagatgtcgcctccgggcggcatcgccgaggtgctccagtccctgctgctgagcgtggtggacaacccggtcaacgccctgatctcggccaacttcatcggcatcctggcctgggccatcggcctcggcatcgctttccgccacgccagcgataccacccgcaacctgctctccgagctgtccaacggcgtctcgctgatcgtcaaggtggtgattcgcttcgccccgctgggcatcttcggcctggtcgcctcgaccttcgccgagtccggcgtcgaggccctgaaaggctatgcccacctgctggtggtgttgctcggctgcatgctgttcgtggccttcgtggtcaacccgctgatcgtgttcctgaagatccgccgcaatccctatccgctggtgctgacctgcctgcgcgaaagcggcatgaccgcgttcttcacccgcagctcggcagccaatatcccggtcaacctgcagctctgcgagcgccttggcctgcacgaagacacctattcggtatcgatcccgctgggcgcgaccatcaacatggctggcgcggcgatcaccatcaccgtgctgaccctggcagcggtgcataccctgggcatcgccgtggacgtaccgaccgcgatcctgctcagcgtggtggcgtcgatctgcgcctgcggcgcgtccggcgtggctggcggttcgctgctgctgatcccgctggcctgcagcctgttcgggattcccagcgaggtggcgatgcaggtggtggcggtaggcttcatcatcgcgatcctccaggactccgcggagaccgcgctgaactcctcgaccgacgtgctgttcaccgcagccgcctgcgaggcggaagagcgcaaggcgagcgccgcctga

SEQ ID NO: 8461 - DNA, 1023 bp, Pseudomonas aeruginosa
ttcgatccctgggtcacggaagaaaccgccttcgggcggtttcttcgtttcgccccggcgtgctttgacctgtgcgccgcgctgcggcctaatggtcgcccgtccttcccgagttgccgcatgtcgtctccttccttgcccgacgccagtctccgcgccagcaccctgcatctgccggccggtccctggagcaccgtgctcgactgtctctgcgcgcgtttcccggccatcgaccgggacacctggctggcgcgcatgcagcggggccgggtgctggacgccgaggggcgtgcgctgggcccgcaggcggcatatcgcgaaggcctgcgtgtgcactatttccgcgagttgccggtggaggcaccgattcctttcgaggcgcgcatcctgtaccgcgacgagcatctgctggtggcggacaagccgcacttcctgccggtgatgccggccggcggctacgtcgagcagacgctcctggcgcggctggcccgcagcaccggcaatcgcgacctggtgccgctgcaccggatcgaccggcataccgccgggctggtgctgttctcgaccaatcccggcagccgcgggcgctaccaggcgctgttccgcgagcggcgcatcgacaagtgctacgaagcgatcgctccggccttgccgcaactggacttcccgttgttgcgcaggacccgcctggtgcccggcgagccgttcttccgcatgcgcgaaggcgagggcgagccgaacagcgagacgcgcatcgaggtcgtcgagcgcaacggccgctggtggcgctaccggctgtatccggtgaccggcaagaagcaccagctgcgcgtgcacctcgcggcactcggcgcgggtatccagaacgatgggttctatcccgagctgctggacgccgagggcagccccgacgactacctgcggccgctcaagctgctggccagggggctgcgcttcgacgacccgctgagcggggagaggcgtacgttcgaatccgggctgcggctcgattggcaggtgtag

SEQ ID NO: 8462 - DNA, 834 bp, Pseudomonas aeruginosa
aagcggatcagcccgatcagcaggaacttcatggcgagccctcggcggggttgcggcggcgagccgggcattgtagcgccgttgtcggtcctcaaggagcattctccgccgcgcaataaagggtccgcccgtcgacgaggctgcgagcagtcgccaggcggccgcgcaggccgggttcttccggcgccagcgtgccttcgcgccaatcgcctccgcgcaacggaatcagcgccgaacggccgtagcccgggcagtacgcctcggcgtcgccctccagatagtcgacgccgtccagggtcagctcgccgacattccagcgcgcgccgaggtaggcctggcggaacggcccgtcggcaaggacgtagaagcccccgcgcacctcgctggccgccgtggcgaagccgatggtgcgtcgcggttgcgggatcaccagcagcggtcgccgtgggtcggcgaaggcctcctgcaactcgaccaggcgctggcgggtggcgcccatctcgcgccggtagcgctcgccgcgcgcccgcgcgtcgtcgggaagttcgctccaggccggaggctggtcgcgcagcaggtagtccagcggccaggtgccggccgtcgcggcttccttccagtccgcgtcgtcgtcgcgcaggtccagcagcactccggccagcgcgccgatctcgtaggcttcgctgtcgacgccgacgccgatctcgttggcatcgtagaaggccagggcgtactcccgcagcgcctgccgatagcgttgcggatcctcggcgaaatcggtgcggtagcgcgcggcggcggccatctcgatgtagcgcgcggtgccttcgctga

SEQ ID NO: 8463 - DNA, 1437 bp, Pseudomonas aeruginosa
cctacgtggagatcgccggcttgctggaggtttccgtcagccgcatccaccagtacatggtcgagggcttcaagcagtgctaccaggtgcttgccgaatgagccagggaaggcgagaacgcatcctcgacgaagcggcgcagtggatggcgctgctgcaatccggccatgccggcgccgaggagcgcctggcgttccagcagtggcgccaggccgatgccgagcacggtgcggtgttcgaccggctcagcatgggcttgcagtcgtttcgcgacgagcccatgcacggcttgcgcgccgagcaattgatcggagccctcgaggcgccgtccgcccgtcgccggtttctccagcgcagcctcgcccctggcggcgttcggcgtggcgacgctggcgctggggcggatcggcatcgtcggcttcccctggcccggcgacctgtacaccggcaccggacaacgccagagcttccgcctggaggatggcagccaactggtgctggacgcgcgcagccgggtacgccccgaattcgatggctaccggcgtcgcctgcgcttacgcgagggccgcctgctggttgacgtggcacgggatccggcgcggcctttcgtcgtcgacaccgggcgtggccaggtcgaggcgcagggaacccgcttccaggtcagcgatgacggcgccagctcgcgagtggtggtgctcgagtcgcgggtgcggatcaccactgccgacggacggcaatgcctgttggagcgcggccagagcgcccgtttcgacgcctcggcgattatcgcccgaggtcctgccgaaggcggcgagagcgcctggctggatggccggctggaggtccgcgaccgcccgctgggggaggtgctggaagcgttgcgcgcctatcgccgcggcatcatcagcgtcgccgacgacgcggcggcgctgcgcgtcagtggcatctacccgctggacgacagcggcgcggcgctggcattgctggagcagagcctgccgatccggctcgactaccacgggccctactgggtcagcatcgccagccgctgaggcgcgcgcccggcggcgagccgggcggcgcgacgcttcagaacggcttggtcggcaggtacttgccgtcgagggtgatcaccgcccgcgagccgccttccgggtcctcgaccttcttgatgtccagcttgaagttgatcgcgctgatgatgccgtcgccgaactgttcgtggaccagcgccttcagggcgctgccgtagacttgcagcatctcgtagaagcgatagatggtcgggtcgctgggaatgccgccgggaatgctgccgcgcagcgggatgctttgcagcaggagcaccgcgtcgtcgtccaggccgagttgggcggcgaccttgcgcgccgccgcctctggcagggcatgctggccgagcagggcggcggtgactaa

SEQ ID NO: 8464 - DNA, 996 bp, Pseudomonas aeruginosa
ttggatgtttccatgctgcttcgccacctgcgctacctgctcgctgtcgccgagcatcgcaacttcacccgcgccgccgaggcgctgcacgtttcgcagccgaccctgtcgcagcaggtgcggcaactggaagagcaactgcgcgtgcaattgctcgaccgctccggcaggagcgtgcgtcccaccgatgccggcgagctgtacctgcttcatgcgcggcgtgccttgcgcgagctggaagcggcgcaacgggcgatccacgaggtgcgcgacctcagtcgcggccgcctgcgcctgggcatgacgccgaccttcacctgctatctggtgggcgccctggtggatccgttcaatcagcgctatccgggcatcgagttgagcctcgaggagttgccccaggacgccctggaggcggcgctgatcgacgatcgcctggaccttggcgtgggctttcagcgagccgggtgcggtggagatcgacagccagccgctctaccgggaacgtctgggcctggtgctgggggcggaaccccggggggggacgcccccgttggccgccgcagcgctggcggagttgccgttggcgttgctgcgcgacgacttcgccacgcgccggcacatcgacgcttacatgcgccagcaaggggtgacggcgcgggtggcgctggaggcgaactcgatcagcgccatcgtcgacgtggttcgccgcggaagactggccagcatcctgccggaggcggtggcgcgccagcaggccgggttgcgctgcgtggcgctgcggccggcgttgccgacccgccaggtagcgctgttctggcgccagggcagccaccccggtgccgcgcgcctggccttccaggccctggcgctggaactcggcgccgagctgggcgacgcctgagcgggatcagccgcgactcggctgcaacgccgcgggttcctcacggcgcagccgcaaggccagggcggcgccgaacagggcgagcagggcgctga

SEQ ID NO: 8465 - DNA, 1074 bp, Pseudomonas aeruginosa
tcagttgcgcgcaggcgagcagggcgagcatccagttggaaggggcggcacggtccgtcacggcgggactcctggtctgggttgggcgcggccagtgtttctcatgctggaatcgtgataaatagcctctccgtcctttcactgatgaaaataatcatcgatgagatcgccatggacctgaatgccgtcaagttgctcgcccgcgtggccgagacccgtagcttcacccaggccgccgtttctctcggtctgacccagtccggcctgtcgcgcgccatcggccggctggaagccgaactcggcgtgcgtctgctgcaccgcaccacccgcagcgtcagcctgaccccggacggccagctgttctacgagcgctgcgcacccttgctggcggaactggaggaagtcgagaagttgctggtggaccgccagtgcgcgccgagcggtccgctgaagatcaccaccccgcaggcgctcgggcggatcgtgatcatgccggtgctgcgcgaactgacgcggcgctacccgcaattgcagatcgaggcggcgatgaccgatcgcctggtcgacctcaccgaggaaggcttcgacgccgccgtgcgtctcggtcgggtcggcgacgtgcgcctgatcgcccggccattggcggcgttgcgctgggtcacggtggcgtcgccggaatacctgcgcagtcacggcacgccggagcgcctggagcaactcgccgggcacaactgcccgacggtgcgcgacctgcacaccggcaagctgctggaatggcagttccagcgcgacggccagccgctgagcctggcggtgcgcggcgacctggtgctggacgtggccgacgcgctggtcgacgcggcgctggtcggccagggcatcgtccaggtgatgggcttcatggccgaggaggcgatccgccggcgtcgactggtacgcatcctccagcccttcgaaccgccgctgtgcccggtgtcgctgatctacccgccgtcgcggcagtgctcgctgaagatcggcgcgctttacgaggaactgaagagcgcgcactggtgcggggcgctgacgtactga

SEQ ID NO: 8466 - DNA, 2535 bp, Pseudomonas aeruginosa
ccggctcgcggattccccgcgcccagcaaggaagggccgtcgccggtcacggtgatcagcagcgaggaaatccagaaccgtggctaccgcaacgtcttcgatgccttgcagacgcagacccagaacaccggcatgacccagggcgaggactacggcaacacctggcaaccggcggccaacgccctcaacctgcgcgatctcggccccaaccacacgctggtgctgatcaacggccggcgcgtcgccgactacccgaccgcctatggcggctcggtgaacttcaccaacctggcgaacatcccggcggtcatgatcgaccgcatcgagatcctcagcggcggcgcctcggccatctacggctcggatgccatcgccggggtggtcaatatcgtcctgaagaagaaattcgatggcgtcgacgtcaacctgcgcgccggcaccaccgagcgcggcggcggcgacaaccagcgcctgcaactggtcggcggcggcgcgacgggcgacttcgaaggcctgttcggcctgcaggtcgagcagcgccagccggtctgggccaaccagcgcggtttcatggacagctacccggacggcaacaacgtcggctaccggctgaacccgcagagcggacgctacctcggcgacgcctcctgcgccggcctcggcggcctgttcggcggcaacgtggcgccggtgccgggcgccaggggtggctatcgctgcatgaccgaccagtactacaacaactactggaccctacagaccaagaaggaaaactacgacggctacgccggcggcacctggcacctgagcgacagcggcaagctgttcgccgacctgctgttcggcttcgaccacctgcagaacaatacccgcgggccgtccttcacctcgccggacttcatcaatgcctccagcggcgacctggagcgctggtaccggctgttctcgcccgaggagatcggcggcaagagcagcaacaacagcaagtggcgcgaggtgtcctggaccggcaccctcggctacagcgaccacgtcgccaatacttcctgggaatacgaactggccgcgacccgctccgagtaccgcagcgaccgcactacccgctacaccccggcggccgggatcctcgacctgtacctgggccgcaagctcggcgaacgcgacggctacccggtctacgatcccgatccggcgcgcctcggacgtccgctgagcgaggaagagtggcgcagcctgcggcgcaacgtgacccagcacagcgagtcctactcgcagacctacagcttcaccggcaacggcgagctgttcgacctgccggccggcccggtggccttcgccggcgtgctggaggtgggcaagcagggctacaggatccgtcccgactcgcaatacaacgacggctctctctacaacgtctccaaggccagcagctccggcggctcgcgcgaccgttacgccgccggcggcgaattcagcatcccgctgcacgacacgctgctggcgtccgccgccggccgctgggaccagtacaggttcagcggtcgcaccgaggagcagaccacctacaacctggggctggagtggcgcccgctgaccagcctgctgctacgcggcagctacggcaccagcttccgcgcgccggacctgaactacatctaccaggccgacgccaacggctactacccggcgcagaaggactactacggttgcgagaaaggcgtcgacggcgcctgcaagaacggccgggtcgactacgtgcagagcggcacgcccgacctgaagtccgagcgcgggcgctactggagctacggcttcgtctggtcgccgtcgagcaggttcgacttttccgccgactactaccacatccagatcgatgacctgctgaccaccctcgatccggacaaactgctgcgcgacgaggcggcctgccgtagcggcgggctcgatccggactcggcgcagtgccgcgacaccctggcgcgggtcgagcgcaacgccggcgacgccagcgtcgatccgaatcgcctgaacaaggtctacgtcaatgccatcaacgcggccaaggagcgcaccagcggcatcgacctgcgcagcaacatccgctggggcgccggtgactacggcgccttctcctcgaccctcggctacaccctggtgttgtcccacgactacaagcagtccgacgactaccccagcgagaaccagcgcgacagcctcgactcccacgactggcgcagcaaactcaacgccagcctgacctgggactacgcacagttcacctcgacgctcttcgcggtgcgctacggcagcgttaccaacgccgctggcagcgggcgcctgagcccgtggacggtgttcaacgccagcgcccgctaccggctcaacgaacgcgccagcgtcggcctgacggtgaacaacctgctcgaccagatcaaggaggacgactccgatggctggccgtactatcccaccggcaactacgacgccatgggccgccaatggtggctggacttcagctatcacttcggtggttga

SEQ ID NO: 8467 - DNA, 1812 bp, Pseudomonas aeruginosa
gccatgcccggacgcatcctggtcttcgcttgctgcctgctcgccagcctggcccgcagcgagccgcgccatgccatcacgctctacgacgagccggcgaaatatccgccgggtttccagcacttcgacttcgtcgacccgcaggcgcccaagggcggcagcctgcggcggatggaaagcggcagcttcgacacgctgaaccccttcgccaaccgcggcacgccgatcagcatgacccaggccgcgctgatctacgaaaccctcggcttccagtcactggacgagccgttcaccgaatacggctacctggcgcgctacatcgagaaagccccggacaacagctgggtgcgtttccatatcgatccgcgggcgcgcttcagcgacggcgtggcggtcaccgccgaggacgtgaagttttccttcgatagcctggtcgagcagggcagcccgttctggcgcgcctactacaaggaggtccgcgagccggtggtggaggatcgcctgcgcatccgcttcgatttccgtcatgccggcaaccgcgagctgccgctggtgctggcccagctctacgtgctgcccaggcattggtggcagggacgcgacttcaaccgcagcagcatgcagccgccgctgggcagcggaccttaccggctggagaaggccgaggcggggcgttcggtgagctaccggcgcaaccccgactggtgggctcgcgacctgccggtcgggcgtggcctgtacaacttcgagcggatccgtttcgactactaccgcgacagcggcgtggccttgcaggcgttcaaggccgggcaggccgacatcaatgtcgagaccagcgtcaaggcctggagcagcggctacgactcgccggccctgcgcgatggccggttgcgccaggagagctttccctacccgtacccggccagcctccagggcctggtgttcaacctgcgccggccgctgttcgaggaccgccgggtacgccaggcgctgagcctgttgttcgacttcgaatggaccaaccggcagctcttcggcggtcgctacaagcgcctgcgcagctatttcgacaactcggagatggccgctcgcggcctgcccggcgccgacgaactggccttgctggagccgctgcgcgggcaaatccccgaggaggtcttcggccaggcctacgctccgccggtgaacgacggcagcggcgatatccacgagcgcctggtgcaggcctaccgcctgctcggcgaggccggctggcatgccgtcgacgggcgcctgctggataccgccggacggccgctgcgcttcgacctcctgctccagggcaagggcctggagcgcgcgctgctgccgttccagcgcaacctggcgcggatcggcatcgatatgcgcctgcgccaggtggacgcttcgcaatacatcgagcgcatacgtgcgcgggactacgacatgatcgtttcgagcttctcccagtccaattcgccgggcaacgagcagtacagcttctggcattcctccagctacgccgatcccggcggctacaaccgcatcggcctgaaggacccggccatcgaccggctggtccaggcggtggtcgaggccgactcgcgggccgccctggaaaccgccgtgcgcgccctcgaccgggtgctgcaatggggctactacctgatcccgacctggtatgccgacgaggtctggatcgccagctggaatcgcttcggccgaccgccgcaggcgccgcgctacagcctggggctgaacacctggtgggaagtccgcgagcgggccgcgccgagccgggaggcgcagtga

SEQ ID NO: 8468 - DNA, 1200 bp, Pseudomonas aeruginosa
catgggcggctacctgttgcgccgcctggcgctgatcctgccgaccctgctgggcatcctgctgatcaacttcgccatcgtccaggccgcacccggcgggccggtggatcaggccatcgcgcgcctgcagggcgtcgacggcggcggtccgctggggcgtggcggggagggtgggcatggcgctctggaaccgcagcgccacggcgagaccggcatcgatccgcagctggtggccgccctggagcgccagtacggcttcgacaagccgccgctgcaacggctctggctgatgctgtcgagctacgcccggctggatttcggcgagagcttctaccgcgacgcgcgggtcatcgacctgatcgccgagaagctgccggtctcgctgtccctgggcttgtgggcgacactgatcacctacctggtgtcgattcccctgggggtggccaaggcggtgcgccacggcagcgccttcgacctgtggagcagcgcgctggtggtggtcggctatgcggtgcccggcttcctcttcgccatcgtcctgatcgtgctgttcgccggcggcagctacctggactggttccccctgcgcggcctggcttccgagggcgccgagcgcctcggcccgctggcgcgcttcgccgattacctctggcacctggcgctgccggtgggttcgctggtggtcggcggtttcgccagcctgaccctgctgaccaagaacagcttcctcgacgagatatccaggcagtacgtcgccaccgctcgcgccaaagggctcagcgagcgccgggtgctctacggccatgtgttccgcaacgccatgttgctggtggtggccgggctgccggcggcgctggtctcggtgttcttcaccgggtcgctgctgatcgaggtgctgttctccctcgacggcctcggcctgatgggctacgaagcggcgcttggccgcgactacccggtggtgttcggcagcctgttcatcttcaccctgctcgggttgctggtgaagctggccggcgacctggcctacagcctggtcgacccgcgcatcgacttcgccgcgaggagacagtgagatggccatcgtcctttccccgctgcaccgccgccgcctcgccgcgttccgcgccaaccgccgcgggcgcctggcgctgcggctgttcctcgcgctgttcgtcacctgcctgttcgccgagctga

SEQ ID NO: 8469 - DNA, 1698 bp, Pseudomonas aeruginosa
ccgtgttcgtggtcctggcgaccttgctcagcctgctggtgttcatcggcgaagcggtgcgcgacgccttcgatccgaggacatgagatgaaccgggaactgttgcgagtggaaaacctgagcgtcgcctatggcgacacgcaggtcgtgaaggggatcgacttcagcctgcgcgccggcgagaccctggccctggttggcgagtccggctccggcaagtcgcagaccgcccacgccctgctgcgcctgctgccgggcgcggcgcgcctgggcggcagcgtgcgcctggacggcgaggaactgctcgccctgtcgccgcaggcattgctggcgattcgtgggcagcgcatcggcatggtgttccaggagccgatgacctcgctcaatccattgcagcgcatcggccgccaggtcggcgagggcctgcgcctgcatcgccgcctgcgtggcgccgcgctgcgcgggcgggtactggaactgctcgaactggccggcctcgagcagccgcgacgcctgctcgaggcctatccgcaccagctctccggcggccagcgacagcgagtgatgctggccatggcgctggcttgcgagccgcaactgctgatcgccgacgaaccgaccacggctctcgacgtcaccgtgcagaaacgcctcctggagctgctgcaaagcttgcagcgacggctgggcatggcgatcctgctgatcagccacgacctcaacctggtgcgccgggtcgccgatcgggtctgcgtgatgcgcgatggccagatcgtcgaggagaacgcctgcgagacgctgttccgctcgccccggcatccctacacgcgcctgctgatcgaggccgagccgggtgggctggcggagccggtggcgtgccgcgagacctgcctggaggtgcgcgcgctgagcctcgactaccccgcgcccggcggctggctgcgccggcgcgcgggactgcgcgcggtgcacgaggtcagcctgcggctgcgccgtggcagcaccctggggatcgtcggcgaaagcggttcgggcaagtcctccctcggccaggcgctgctgcgcctgttgccggccgaagggcagatcctgttccagggcgagcgcctcgaccggctgcacggcaagcgcctgttgccattgcgccggcagttccaggcggtgttccaggacccctacggcagcctcaacccgcgccttagcgtggaacagatcgtcggcgaaggcctgcgtatccatggcatcggcgatgccggcgaacgccgcgcgcgggtgctggaggcactgcgcgaggtcggtctcgacgagccttgcctggaacgctatccccacgagttttccggcggccagcgccagcgcatcgccatcgcccgcgcgctggtgctgaagccggcgctgatcctgctcgacgaaccgacctcggcgctcgaccgtagcgtgcagtgccaggtggtcgagctgctgcgtcggttgcagcgtcgccacgggctgagctacctgttcatcagccacgacctggccgtggtacgcgccctggcccacgacatcctggtgctcaaggacggccgggtggtggagcagggcagcgccgctgcgctgttcagccagccgcgccacccctatacccgcgagttgctcggagcgatacccgcgctgcgcctggaagagcatctgcgggtggccgggctgggaatctga

SEQ ID NO: 8470 - DNA, 1404 bp, Pseudomonas aeruginosa
cccggccctggcgcctggccgagtggctgccgctgctggtctgggaccgccgcagcggcaaccgcgcctggcgctggtcgcgtggccggccgcgctcgcggccgctggaaccggtcgggcaggaaacccgggtcaagctgcaccgttcggtgcagcggcggctggacgaatgccccgactaccggccgtgcaacctgccagcgctggaacgctgcgacctcatcgacgattcgccgttgctcgacggctaccgctagcggctggccgcgatcgcgttcagaaccacatgcggataccggcgacgaagcgcgcctcgtcgtcgtcctcgccctcggcgcgggccaggtcggcgctgttgccgtaggagcggttccaggtcaccccgatgtagggcgcgaactcgcgacggatctcgtagcgcaggcgcaggcccagctcgctatcggcaaggcccgaaccgatgccgcgggcgggatcgttcctgccgtacaggttgacctcggcgctgggctggaggatcagccggttggtcaacaggatgtcgtactcgccctccaggcgcagcgcgctctggccgttctcgccgaggaaggcggtgacttccgcctcgaagtcgtagagcgccaggccctgcacgccgaacgccgcccaggtctgcggcgagccgggcttgaaatcctggcgcacgccggcgaccaggtcccaccagggaccgatggcgtgcccgaacagcgcctggacctcggcgtcctcggtcttgccgtcgagccgttcgccttcgctgcgcagccacaggcggttgatgtcgccgccgatccagccgctggcgtcccaggccagcgcgctaccgtcgtcggcgtcctggtattccaactggtcgagcaggaagaagctgttcagcgcgctgtcgtgcaccttgtgcccctccagcggcggaaaggcggcacggcggtcggcctcggtcggcaccgggatcggcgtacggctctggctgggcgcggcctgcgccggaggttgccgcgcagcgcggctcatccccggcatccggccatggtccattccctggtgctccatgggctgtgccggggcgggcgatgcggcgccgtggtccatccccggcatccggccatgccccatcccctggtggtccatgggtttcgccggggcggaggtcctctggccgtggtccatgccaggcatcgcgccgtggtccatggccgagtggtccatgccattgtcccgcgcggcctcgacgggattcggcaggcccagcagcagacccagggcgagggcaccggcggccaggcgggcgggtttcggctggcggctcatgcgttgtctccttcgtctacccgcacttcgcggaacatgcccatctccatgtggaacagcaggtggcagtga

SEQ ID NO: 8471 - DNA, 1422 bp, Pseudomonas aeruginosa
agaccgccaggagcgatgccctcgaagctgaggcccggcacgccatccatgttggccggcaggatgatgccgtgccagtggatcgaggtgtcctcggcgaggcggttgcgcacccgcagggtcacgttgtcgccttcgcgccagcgcagggtcgggccgggcagcgaaccgttgatggtcatggcggtggccggcgagccgctgaggttcaccggggtctcgccgatgaacaggtcgaaactgtcgccggcgagcaggttctgctggcccgccccggccagggcccaggccggggcgcgccagagacccagtccgccgagcagaccggtggcggcgaggcctttgacgaaggtgcgtcgcgaagttctgtgcatccgctggtttccacgcaggtggcaggacggactgcgcgagcctgcgcagccgggaggtcgcggccccgccagggcggtgcggcgatgcggacaccctagcggcgcgcgcctgtcggcaagctgtggggaagattacagtgctgtcagctcagcgcggcgggttcaccaagtggcggtcgaaaccgcgcgccaccaggcgttcccaggcgtccatgacctgcgccgggatcgggcaggcgacctggaagcccagcgccgggtaacgcatgatgcggtcgaggtcgccgaccatctcgtcgatcaccccgagtacgccgaccaggttcgagatgccgtcgggaaatgcgtagtcgggcgcatccacgtgtccctccagacccggccagcggaccggcagggtcagcgccacgcggcggatcgagttgggcttggtgacgaaggtcgtgcggcgcaggtcggggaacagctcgcgggcgaaggcgatgttctcggcgaagttggtcgcccgcggctcgatcacgatgaggctgtcgcttaccccgcgcgccctggcgtggcgggcgaacagctcggcttccggctcgacccagagatggcgcgtccagtgcccggtgttgccggtgaacagcaggcgttcggcgaggccgcgttcgagcagttcgcaggcgtggtcgcagacccgcaggtcgtaggagccgcataccaccagcagttcgcagggcacatggcagcggccctggccgaggaagtcccagagcagccgggcatcttgcagggtcgggctcatgggacgccaacgctcctctcgctgccggtcgtggcggggtgccgatgctggcagtacagccggtcgtcttcgcggacgatccgtagctcgcggaaatcccggaccgaccagcgcgcgccggcggcgagcaggccgctctcctcgccgatcgccacgcaggtcgcgccggcggcacaggcggcctgcacgccgctgagggagtcttcgaacaccaggcagcgcgacggtgccacgccgagcctggccgcggccaggcgatag

SEQ ID NO: 8472 - DNA, 1305 bp, Pseudomonas aeruginosa
ggcaagccagaccaggaccgcgccgccgagggcgaacagcgccatgatcagataggaccactgcggcaggccttcgtacagccagccggcggccggactggcgaggcccatgggcagcgctaccgccagagagtagtagatcccctgggtcagtacccgcgcgctttccggcgcgtggtcgcggatgtaacgcatcaccgcggcgtggtaggcggcgaagctgagggcgtgcaggcactggccgaggaggatcgcggcgaggtgttcgctgccggccagcaggccccagcgcagcgccgcgcaaaggctggagaagagcatcacctggagcgccgggtggcggtccaggatgcggttggagacggcgaagaagctgatctcggcgatcaccgccaggccccagaaggcgccgaccgagaacgacgagtagcccagcgtctgccagcccagcgaggcggtggtgaagtacagcgagtggctcagttggatcattcccgccgcggcgatggccagcagcagggggcgttgacggaggatcccgcgcaggtcgggacggcgcctggcgcccggcagcggcgagtccggacggcgcaggctgcggcgacggaggaacaggcaggccagcgcggtgagcagcatcgtcaggccgaccagggcgggcaccagttgctggccgaaccgaccgagcagcaggccgcccagggtcgcggtgaggatgaaggccagcgaaccgactgcgcgtacccgcccgtagttctgcagggcggccttgtcgcgcttgagcaggtaggattcggtgagcggcagcacgctggtccagaacgcgccgtagagcacgctcagggcgatgaacaggggcaggccctcggccagctggaacagcagggcgcaggcgccggccagggccgccagcagggtcgccaggcgcaactggtcgatgcgccagtcggccacgtaggtcagcgccaccccggcgatcacctgcggccagtaggccgcggcgatcaacaggccgatctggctggcgccgaagcccaggctggccagccaggtcggccagaacggatagatcagcccctcggcggcgaagtagccggaaaagatcaggtacatgccggttcccgcgtcgccgtgccggttcgctgcggtttgcgcctcactcgaagcgcgccctggcgaaggcgttctcgcccttgcgccagaccagcagggactcgcccagcaccaccaggtcgaccatcccgtcctccagcgcgccgagggcgtcctgcggggcgcagacgatcggttcctcgtggcggttga

SEQ ID NO: 8473 - DNA, 3528 bp, Pseudomonas aeruginosa
tcatgcggtgtcctcttgcgcgaacgggtggggggcgagaggcgtaataggttgcatggcaccgggagcccaacaacctgccagatctggtcgcctgcgaaatctggcagggctaccggatctggtagctggacagccgtcgacgggcttgccggccataccggccgggcgcccgcgccggcatcagaagctgtagctgaggcggccgaacaggatgcgcccgtagggatcggtgtagcgcgggtcgtagccgctctggaaggtgtaggtctggttgctgaacggcggttcgcggtcgaacaggttcttcaccccgagggtcagccccagcgcgtggctgaggcggtagctgccggccaggtcccagaggttccacgaaccgaccttgccgtggctggcgcggtcgtagtcgttgtagccgctggtgtagcggttgctcagggtggcctgccaggcgtcgcggctccaggtggcgttggcgacgtgcttccagcgggcgatcacgccgacgccctggaagtcgccgacgttgtccaggtactggccgccgatctgctgctggaagtcgtagcgggacacgtaggtgccttgcaggtcgagcccgaactgcccgtagcggctggccgggaaacgataatcgaggctcaggtcgacgccgctggtctttaccttgccgaggttggccagtccggtgacgacgtgatcgatagagccgtcggccttgcgcacgatgcgtccggcgtaggcctgcgggtcggcgaagatcgccgcttcgggaaactcggcgatctggttggcgatcctgatccaccagaagtccaggccgacggaaaggtcgcgcagcggctggtagaccaggcccagggtaacgttgcgcgcggtttccggtcgcaggtcggtattgccgccggtggcgttgtagaactgctgggcgcagtcgcggttggcgatgccgccctggctcggctggccgccggcgcacaggcgcgggtcgtcgtagttggcgctggtataggtggtgaaggtcgggttgtacagttcgtacagcgacggcgcacggaaaccttcgctgtaggcgccgcgcaggaccaactggcggaacggctggaagcggaacgaatatttcgggttgctggtgctgccgaagtcgctgtacttgtcgtggcggatcgccgcgctgagttccaggctgtccagcaccggcacgttgagttcggcgtactgcgccttcaggttgcgctcgccgctgaccgtggcggcgggatcgacgccgaggctctgcacgttgccggcgaagtcctggatgtcctggtggaacgcttccttgcggaactcgccgcccagcgccagggccgccggcccggcgccgaaccagtcgccgatctcccggctggcgcgggcatccaggcccttgacgcggccgaccgaggtacggaagtcgccgctcagggcatggctgccgaggtaggcgaggccggcgtcggtctgcggcccgaacgggttcagcgtcccgttggcgatgccgagggcggcggcgcgatcatcgacgtagccgctgtggatatggtcgaccaccttgttctggttgtacgaggcgccgatatcgtagtcccagccggcgaactggccgtcgaagccgagcagcaggcgctggccggtgttctgcgaggattgcaggcgcggcccgagcacgctctgtcgccagttgacctccaccggccggctcgggtcgaggacgaagccgccgggtccgggagtgatgccgttgccgggatagaaggcggtgccgggatcgatctgcaggccggtgagggtccctgggccgacctgggtagcgttgtcgttgcgcgaccagaagtactccaggctgacgttgtgctcgtcggccagcttgccggtggcgcggctgaacaccgaggtcttctcggtttccggcaccaggtcgaggtagcgccacaggctctgccggcagatgccgttgcgcggaatcaggtcggcgcccttgcaaccgccggcggccagcggattgctggcgttggcgccctggctccagttgccggggaaggcggtgccggagctgtagtcgaggccgcgtcccggctggtagttgtaggtgtagccgcggtccttggcgccgaggcgctcctgcttgtcgtagttggccaccgcgaagacattgaagcgatcctcctccagctcgccgaagccccagctagcgctgacgttgcgctggttgccgccgccgtcgtgggtgggggaggcgtagccgctgtcgaagcggccttcgttcaggctcttgcgggtgatgaagttgatcaccccgccgatggcatcggtgccgtacagcgcggaggcgccgtcgcgcagcacctcgacccggtcgatggcggcgaagggaatggtgttgagatccaccgcggagccgtcgatggcattgttcgccaggcgccggccattgagcagcaccagggtcttgttcgcgccgattccgcgcaggtcggcgaacgaggcgccgccggtggcgctgccgaccgagcgactggagttgtatacgccctggttgccggaaagccggccgatcagttcctcggtgctggtcacgccctgttggcgcagctcctcggcgcgcaggacgctgatcggcaccgcggtttccgcatcgacccggcggatcgcgctgccggtcacctcgattcgttgcaactggaccgtgggcgggtcgacaggcgcctgttcctccgccgcggcggcgctgccgggagcgagctgcagggccagcagcagggcggcgcccagcggcgcgtcggtgtggagcgatcggtgcatggtcggggcatcccttgttccggtgtgtccagggatgtccgtcgagccgggggattttccagggacggcttagacctttgcgccatgagtttatgtccgctgggaacaagccctgccgtcgcgcctttcgtcggcgggccggagcggcagaaccagtcccctctgccgaggtcgaaaagcaggcgtcgcggcggtgctgtggcgtcctttcttcagctacatttttctttcagcagtcgttcccatcatccagggcagcacccaaggggcagatcatggctcgcaccactcccatcgagctttatcgcaacatcggcatcgtcgcccacgtcgacgccggcaagaccacgacgaccgagcggatcctcttctacaccggcgtcaaccacaagatgggcgaggtccatgacggcgcggcgaccatggactggatggtccaggagcaggagcgcggcatcaccatcacctcggcggcgaccacggccttctggcagggctcgaccaagcagttcccgcaccgctatcgcttcaacatcatcgacacccccggccacgtcgacttcaccatcgaggtggagcgctcgctgcgcgtgctcgatggcgcggtggtggtgttcagcggcgccgacggggtcgagccgcagtccgagacggtctggcgccaggccaacaagtaccatgtgccgcgcctggcctacgtga

SEQ ID NO: 8474 - DNA, 192 bp, Pseudomonas aeruginosa
  unsure (189): Identity of nucleotide at the above locations are unknown.
tccagggcatggaggataccccggcgggcaaaggtgatccgtgccgaggtcccgctgggcgaaatgttcggctatgccaccgacgtgcgctcgatgtcccaggggcgcgcgagctactcgatggagttcgtccgctatgccgaggtaccggccagcgtggccgaggcgatcgtcgccaggcagggccgntga

SEQ ID NO: 8475 - DNA, 2643 bp, Pseudomonas aeruginosa
gacagtgaccaaggcccgcacctatacggtcacaaggatggcgaatcgatgcttgcttcagcgattgccagcggtaccgcagtctcccaggtctccaagcatctcctaatgttcctggccgcccttttcctcgccctcggtgcatgcggctgggcgatcctgcacatcgccaggcaccaggacgacatcgccatcgagcagagccatttctacgtggaaaaggcgctgcagaatcgccgggaaaattccgagcagttctccaccacctattccttctggaccgatgcttacgtctatctgggaaaccgggtcgacgtggactgggccttcaccaagaacaacctcggctcggtgctctacaccaccaacggctacgacggcgtcttcgtcatcgacgaccgtggcactcgctacgccatgctcgagggcgagctttccgaacgctcgctggccgactcgctgaacgccgacaccggggacatcctccgctccgcacgccgtgccgcggtggacgaagcggcgatcagccgctacgtcgacttcgacggcgcaccggcgatcctggtcgcctcggcgatcaagcccaccagcgatcatgcgcccatcgacctggccaaggcctcggtgatggtcttcgtcgaccggctgaccccggcgaagctggccaagctcggcggcgactacggcatcgccaacctgcacctgctggccggcggcgcggcgggcgacaaggaaagccttgccctggagggcactccccatcgcctggcctgggtgtcgtcgcgtccgggtagcgccatgctgcgggagaccgcgttgccgctgctgggaatcttcgtgctcgccgccgggctgctgttctggctgagccgcagcgccgtgctcaacgcccgcgcggtggatcgccagcagaaggtcctgaaacgcagcaaccaggccctgctggccagcgaggaacgtttcaagtcgatagccgaggcggcctcggactggatctgggaagtcgacgggcatttcgtcttcacctatctctccgtgcgcttccgcgacgtcaccggctaccagccggaggcctggatcgggcggcggctggacgagttgctggatagcgatacggtgaacatcgtcaagtggctggaagggctgcccgatgccggtgcgccgtccagcctggtctgcgctttccgcgacagccagggccaggcgcgggtcggcaagctgagcgccagcgcgatccgcaacggcgtcgccagcggctatcgcggcacggcggccgacatcaccgacgaggtcgaagcccatgcgaagatccagcatctgtccctgcacgatgccctgaccggcctgccgaaccgcaacaagctgttccagttcctcgaacgcctgctggcggaaaaggctggcaagtcgccggtagcggtactgatgctcgacctcgaccgcttcaagccgatcaacgaccagcacggccatcccgccggcgatgcggtgctctacgccatcgccgaacggctgcgcgcctcgacccgcgaccaggacatggttgcccggctcggcggcgacgagttcgtggtggtcagtacccacgtgtcgtcgaagctggaaatcgagaagttctgtagccggctgatcgacgtgatcaaccgcgaggtcgcctacgaagggcacagcttccatgtcggcgcgagcatcggcgtggccctggcgccggagcacggcggcgatccgcggggcctgctgcgttgcgccgacgtggcgatgtacgaggccaaggccgcggggcgcaatacctggcgtttctacttggaagcgatggactcccatctcgccgagaagaagctgcgcgagaccgagttgcgcgccgccttgcagaacggcgagttcgagttgtactaccagccgcgtttcctggcgcaggaacagacgatcgcctcggcggaggcgttgatccgctggaaccatccgcgccgcgggctgatcggcccggacgagttcatcggcctggcggaagaaagcgacctgatcgtgcagatcggcaactgggtgctgcgcgaggcctgcgccaccgccgccagctggccaggcgaggtgatggtctcggtgaacgtgtcgccggcgcagttcatgaccggcgatatcgtctggcaggtgcgcgaggccctgcgcctggcccgcctggatgctcgccggctggagctggaagtcaccgagaacgtcatgctcaacgatgtcgatggcgcgctgcggaccatgacggccctcaaggagctgggcgtccgcctcaacatggacgacttcggtaccggctattcctcgctcggctacctgcgcacctatcccttcgacagcatcaagatcgacaagcgcttcgtcgccagcatggagaagaccgggcgcgaccgttcgatcgtgcaggccatcatcaatctcggcaacgccctgaacctgcgggtcaccgccgagggcgtggagaccgaagggcagatgcacatcctgcgcgacgagcaatgccacgaactgcaagggttcctgctcagccgaccgctggatgcgcagcgcctgcgcgatctgctggagcgcgaggcggggcagacccaggcgccacaggtttccgccgaaggccatgctgcgcgccggccttga

SEQ ID NO: 8476 - DNA, 876 bp, Pseudomonas aeruginosa
ctgatggcgtgcagagcggtattgaactgtacggtctcgttgaaacccttgacgatctgcgccaacttctcgcgggcgctttccagcttcttgaagcgctcgccgagttccaggctgcgctgttggacgctggcttcgcgcttttccagttcggcctggcgcaggttctgctggctgcgcaactcttcgaggcgttcctgctcgatctgcagtacttcggctcgccgcgcgctgctgcgctcgcgggcttcgacgctttccgcgagttgttgcagggccgcgctgcgctcggcgaggagacggttgctctgctcggtttcccgctccagcgcctggcggtcgtcctgcaggcgcttgtgccactgccggagctgcttttccttttcctgcaattgccgctccttctcgtgcagttgcgtctggagcgactccagcgactcctgctgcttgagcgcttcctgcttctgctggctcagttgctgggccatgccggcgaggtcggccagggtgccctgcacgtcctgtagcagatgctcggtatcgttgccgatatcgagcgcggtatccgtatccacgtgggcttcatcctcgggttggcgaatgatggcggcggcctgggtgggcgcctctctggcgttggccccgccctcggcgccggccaggcgtgcgggcggcacccggaggcgcagcgacaggctggggaccctggccgataccggttccggcgcgggtgcggcgaggggggaggggctcgggggcatggaggattcctcggcggcgtctggagacggaaggttggcgctgcccgtggcgtcggcggcgtgcagcgcggggtggagcatctgcgccaggtcggcaagctcctcgcgaagatga

SEQ ID NO: 8477 - DNA, 1212 bp, Pseudomonas aeruginosa
agagcgtcccggacccgaacgtcgcgcttcctgtcatctccgctacctatctttcgttcttctgccgcgaaacggctttcggatgaaggcggccggcggtcgctcgtcgcgccgtcccggggtttccctgtccgtgccgatccgacccgtgttgccagcgaggggtatgtacgcaatgtccgtgaccgatgccagtttcccgatcatcaactggtcgaaggcgatgccttcgttgcgccagctgatgtatttcgcctgtgtcgccgagtacggcagcatcggccaggccgccgaggtgctgcacgtttcgcagccgtcgctgtcgcggcagatccaggcgctcgaagtgcacatcggcgaggcgctgttcgtccgcggtccggccggggtgagcctgaccgaagtgggcagggtggtgcattgccgcgcggtgaagatcatcgccgaggccaaggcgctgacccgcgacatcggcgacggcgacgaccgtcagttgcacatcggtttcagccgctatctcgatcccggctggtccggcgagctggcccggcaactgaaggaagcgcgggtgtgcagcgccgtttcgccatcctgggcgccatcgctggacctgctcagcctggtccgcgagtcgtccctggacgcggcgatcatcggcgcgccgccgaaggtggtgcgcgaatacgagctgatggagatcggcagctacgagcacgtcatcgccctgtcggaaaccctgtaccggcgactggcgcccgactggtcgctgaacgacctgattggcgagccgctgctggtaccgaaggactcgctgtttcccgcctacagccagttcatgaacgatgcgatggatgccgccgccttcgcgccccggcgcagcgtgcggccgaacgacctgagcattctcctggcccaggtcgccagcggcgacggcttcgccttcctgccgttgtcgctgaccaagttcgcctatccgggggtggccttcaccgctctgccggcggcggtcaacgaaggcttccgcctgccggtggggctggcggtgtcgccgacttcgcggcttcgtgccagcgacacccagttcgaatgcttcgtcgagaccgcgcggcgggtcgccgccggttgagggacgcggccgggagcgccggccgcgcgaggggcttcagagggtcttcatgtactcgaccagggcgcggcgctgctgctcgttga

SEQ ID NO: 8478 - DNA, 420 bp, Pseudomonas aeruginosa
tgtcggtggagtggcagccggcgcaattcagcccgacccagggttcgctggacgactggcgggctttccagcgcaggcgggtgtcggagaactggctgtcgtcctgctggtcgagggcgaagccgcgcggcaggcgcagttcgccgccttgccagttgcgcaggggaaagccgaggcgccgggcgttgtcttcggagaacaggcgctcctcgctgtccggacgctccagcgcctgggcccaggccagcggcagcagccgcgaaccgagcgaggcgtcgtaccaggaggcgcgttgctcggcgttccagccttgctcgagctggatttcggtggcgacggcagggctgccggcggcggccagtgcggcggccagcaggacccgcgaaaaggtcggatgcatcgtgttcccctcatggctga

SEQ ID NO: 8479 - DNA, 2409 bp, Pseudomonas aeruginosa
agggtcactgcaaggaacgtcatccatgtgtggaatcaccggctggaccgactggagccgcgacctcggcgagcagcgcagcatcctcgaacgcatgacccgtaccctggccccgcgcgggccggacgccgaaggcctgtggctgtcgcggcacgcgctgctcggccatcggcgcctggcgatcatcgacctggagaacggcgctcaaccgatgcttgccgaggctggcgggcgggtggcgctgacctacagcggcgaggtctacaacttccgcgagctgcgcgccgagctggagacgctgggccaggtcttccgcacccgctcggacaccgaagtggtgctgcgcgcctatctgcaatggggcgaggcttccttcgcccggctccgcggcatctacggcttcgccctgtgggacgagcgcgagcagagcctgtggctggtgcgcgatcgcttcggggtcaagccgctgtactactacccgaccgccggaggcgtgctgttcgcctcggaacccaaggcgatcttcgccaaccccgaggccaacccggtgctcgacgccagcggcatcgccgagctgttcgccctgaccaccgcgccgactcccggccacggcctgtacaagggcctgcgccaggtccggccgggccaggcgctgcgcttcgaccgcaatggtgtgcgcgagttggtctactgggcgctgcgcgcggaacgtcacgaagagggcgccgaggacagcgccgaacgcgccggccagttgctccgcgaggcggtggccgagcaactggtggccgacgtcccgctgggcagcctgctttccggcgggctcgactccagcgccatcagtgccttcgcggtggccgcgctggatggcgacgcgcggcgcctgccgaccttctccgtggacttccccggcgaaggccgcggcttcgtcccgacgccctggcaaagcagctgggacgaaccctatgcgcagctggcggcgaacttcctcggtacgccgcaccgtaccgtgctggtcgccccggaagaggtgctggaacaggacgaggcggtgctccaggcccgcgacctgcccggctggggcgagctggacgcctcgctctacctgctgttccgccaggtccgcgagcacaccacggtggcactgtcgggcgagtcggccgacgaggtgttcggcggctacccgttcttccacgacccgagcgccctcgcacacgacggcttcccctggctggccggcaagagcgggccctggcaactgctgcggcgggaggtcgccgaacgggtggcggcgccggaatacatccgggcgcgctaccgcgaggccctcgccgaagtgccgcggctggatggcgaggatgccgcccagcgacgccagcgcgaggtcgcctacctggcgctgagccgctggctgccggcgatgctcgaacgcaaggaccggatgagcatggcggtcggcctggaagtgcgcgtgccgttctgcgaccaccgcctggtggagtacgtatggaacctgccctgggcgctgaagagcgtcgccggggaaagcaagagcctgctgcgccgggccctgcgcgggcacctgccgcaggcgatcctggagcggcgcaagagcggtttcccggccaaccccgacccacgttacctggcgctgctgcgcgagcgggtcggccgcctgctcgacgacggccgctcgccgctgttcgaactggtggacgccgggcgggtccgccaggctctcgaacagggcacgccgctgcccagcccgcgtgcctcggcgagcccgaccgccggcctggcctacctgctgaacctggaccgctggctgacccgccatggggtcgacatcagcctctgagcggcactttcttagcggaggatactcatgagccttgccttgtcccgtcccgacagcgacctgctggcgcgggtcagcgatttcctcgtcgccgaagccgagctgctcgacgaccgcctgctggatacctggttcgcgctgttcgagcgcgccgcacgctaccgggtgctgcccttacaggagcaactggccggccaggcgccggaggacagcctgtacatcatcgacgacgaccacgtgcgcctgcgcgagcgggtcgacagcatcctcggcgggcatacctggatggagcagccgcgctcgcgcacccgccgcctggtgggcaacgtgcggctgaagcgggtcgagggcgaactggtcagcagccgcagcaacttcgtcgtccatcagttccgcaaccgcgaggcctggaacttcgtcggcgaagccagtcatgtcctgcgcgacggtcccgagggcttgcgcatcgtctcgcgggagatccgcctggaccacgagaccatcagcgcccagcggcgcatcagcatcattctgtgaggcgccgcccatga

SEQ ID NO: 8480 - DNA, 3261 bp, Pseudomonas aeruginosa
ccgccgtgctgcactggctgtatcccgatgaagagcggctgttccggtgggtcgcgcggcacctcgaggcgcagggggtattcctgttcacctcgcaccatccgttcgccgaggatggcctcggcggcgaggacgacctggtcgcccaggccctggtcgagatgggcctggctgcgccggaacgggtggcggcgctctacgcggaagccgggctgctgccgatgggcacccgcacccgtggccgggaggcgttgcgcgaacgcgtcgaacgacacttccgggtcgactccatcgtctcccgcccggcggtcctgcgtgtcgccgactccgccgaataccagcgtttccacgccgccaccttcggcacctatttcgcaccgctggtgccggcgacgcgcctggaggaattcttcgtccgcctcgggcggatcgccgagcggcgcatgcaggccgacggacaggtcagcgaaatcccggtcagtgtctggcgctgccgggctcgggagggcgaggcataaccttatgcgcaatcggtctgccgcgcggctgaaaatcggtacgggcaattgcactcggtggcatccgcaaccgatcaaggatgaaccgaccatgtccaacccgcgttcgccacgtcttcgacttgtccccgtgctctgcgcggtcggcctggcctgccttggccagcccggcgagtcggcggcagaggaggtccgcgccaccagcagcgccgagatccagcgcttcgacatcccggccggcgaactggcccaggtactgctgagcatagtccgccagagtcgcaccccgatcgccttcgaccagcacctggtggagggcctgccggcaccggcgatccagggctcctacagcgtcgagcaggcgctgcagcgggccttgcagggcagcggcctggaatacatccgcagcgccgccggcgtgctcagcctgcaacgcgccacggcgccggatgccgcgctgccggcggcgaagcccgccgggaccctggccacggtggtggtcaccggcacccgcaaggccgatgtcaaggccggcgagagcctggcaccgatcgatgtggtcagcgccgagcaattgcgcgacagtggcagcggcgacctgcgcgacgccctggtgcgcctgctgccctcgctgtcgcgccaggcccaggcctacaacgcttcggcgctgaccaacgcgcagtcgctgcgcggcctgagtcccaaccacgtgctggtgctggtgaacggcaagcgccgtcacgagaccgccaacatcaatgtcagcggcgggctgcagagcggctccaccggggtcgacctggataccatcccgctcgccgccatcgagcgcatcgaggtgctgcgcgacggcgcctcggcgcagtacggctcggacgccatcgccggggtgatcaacgtcatcctcaagtcggccgaccacggcggccggctcgcctacgacaacggtcgctacggcgatggcgacggcctgacccagaacggcggggtgaatggcggcctgcgtttcggcgagagcggtttcctcaacctcagcgcgcagttccgcgaacaggcgcggaccatccgcgccggcatcgaccagcgtaccgggcactacggcaacccgtccatcggcgacccttcgctgcaccgccaggcgctggcctacaacgccggcgtggcgctggacgacaacgtcgagctgtacagcttcgccacctatacccatcgctcggtgtcctcggcgcagatctaccagttgccgtccctggcgccgcgactctatccgaacggcttcaccccgcgcatcaccagcgacgaggacgactattcgctgaccctcggcgcccgtggcggcgagctgttcggcgcctgggactgggacctcagttcgacctacggtgccgaccgcccggagatcggcatggaccattcgatcaacctcgccctctacggcgagaccggcgattcgccgcgctccttcgacctggcgcgctacaaggccacccagtggaccaacaatctcgacctgcgccgcgacttcgacctcgcctggctgccggcgccgctgaatttctcctggggcctggagcagcgccgcgagctctacgaggtcgaggccggcgatccctggtcctactacaacggcggttccaaggcactccccgggcaggcgccggccaccgccggacagtggagccgcgacgtgctcggcgcctatctcgacctgtccatcgccctcgacgagcgctggcaactggagacggcggcgcgctacgagcactacagcgacttcggcagcaccaccaacggcaagctcgccagccgctaccgcttcagccccgaggtatcggcgcgggccagtctcagcagcggcttccgcgcgccgtcgctggcccaggagaactacacaagcctgggcgtctcgccgaccatcgccagcggcctgctggcggtcaactcgccggcggccaggctgctcggcgccgaagacctggagccggaaaaatcgatcagctacaacctcggcctggtgctcgatcccttgccggacctgaacctggccatcgacgcctatcgcatcgagatccgcgaccgcatcgtcgacggtgccacctattccggacagccggcgatcgatgcgctgcgcgccggcgggatcagcatcccggccggactgacccaggtcagcacccactacatgaccaacggcgccgacacccgtacccacggcctcgacctcaccgccagctacctgacccggctcggcgagtggggccggatcgactggcgcctgggcgccaacgtcaatcgcacgaagctggtcaggaatcatcgcgggcgcaacggccagccgctgctcaacgaccagcagcaggcctggatcaccagctccacgccgcgcagccaggtcagcctgcaggccgactggagctaccggcgctggggcctgaccctgcgcgaaacgcgctacagcaagacggtttccgaactggactactacaccggcgagcatgcctattcgaccacggtcttcaaccgcttcgagaactcgcccaagtacatcaccgacgttgccctgcgctatgcggcgagccgcaacctgaccctgagcgccggggccaacaatctgttcgacgtgaagcccgacaagctgccggccgagagcgcctacctcggcttcaaccagtacgacacctatgcctcgcagatcagcttcaacggcgccttctactacctcggcgcggcctacaccttctaa

SEQ ID NO: 8481 - DNA, 1092 bp, Pseudomonas aeruginosa
ggaggacgaaccatgagcatcgaactgcgcggcggcgtgcgcgcctccgcggtcatcggcgacagtgccttcgcccgccaggccgcgcgtttcctgccggacacccgcagtcgcgcggtgagcgccttcgacatccagcagaaggcccgcctggaagaggcggacggcctcgacggcgcgctgttcaccgtttccgctgcctggcccgacccctggctggtcgccggctgggctttggccgcggcgccgcgcatgcgcgccaccgtcgcgcaccgaccggggagcgcccagccgaccgttgccgcgcgcgccctggccactctcgacggcctgtccaacgggcgcgccggcgtacacctggtgatcggctccagcgacgccgacgtgcgccgcgacggcgacttcgccgacaaggacgaacgctaccggcgcgccgtggagtacctggaggtcttcacccgcgccctggaaagccgcgaacccttcgactaccacggcgagttctaccggctggaggacgccggcagcggcttcctgccgatccagcggccgcgcccgccgctatccgttggcggctcctcggcgcaggcacaacgcctggcggtgcgcttcgccgacgtctacgccggccacttcgccagccccacgcagaccgcggagctcaagcgcaggctgaacgaggaggcggcggagcagggacggcggctgaagttctggaagcacttccaggtgatcctcggcgacagtccggcggcggccctggacatcgccgagcactaccgccaggccgctttcgaactgcttctggcacggcccctcgacgaactggcggcatcgccgcaggtcgcccgcgacggcgagcgcgaccggctcgcccggctggagccggaggccttgcgcgaatgggtggcgaataccgtgcagcgcagcttcgccggggtgctggtgggcagcgtcggcgaggtggcggaacagatcctggcctttcatcgcgccggcatcgagatcgtccagcttgaggccaccaccgagaacgccgaggacatccgcttgcgccgccaactgatcgagcgcctgaggcgcgacgcatga

SEQ ID NO: 8482 - DNA, 1503 bp, Pseudomonas aeruginosa
tctatggctcgatccagcccttcaccttcgccatcgccatcagcctggggtcctggctgctgggttacttctacgaccgcgcgggctcctacgcgggctcgacgctggtcctgctcggcgcgttcggcgtggcggcagggctgctggtcatgctcgggcgctatcgctacgccatcgacggggaggcacgcagccatgggcgagactgaacggagcagggcggaggtcggcgtctggctgctggccggactggccttcgtggtcggcacggtggaactggtggtggccggggtgctcgacgaactggccgccagtttcgccgtcagccagggccgggccgggttgctgatgagcctgtacgcgctggtctatgcgctgctcggcccgctgctggtctacctcagcgccggtatcgagcgccgccgcctgctggccggcgcgctgctggcgttcatcggcgccaacctggccagcgccgccgcgccgagcttcgccctgttgctggcgagccggctgctggtggcggccagcgcctcggtcatcgtggtggtggcgatcaccctggcggtggccattgtcgcgccggaacggcgcggccgagcgatcggtctggtgttcgccggcatcgtcgcctcgctggtgctgggcgtaccgctgggcaccctgatcggcgagttctggggctggcgtagcctgttcctgctgctcgccggggtcgcgttgctcggcctgccgctgctcctgcgcctgctgccggccatccgcggcgcgcccggcatcgccccggcggagcaactgcgggcgctggcccggggccgggtgccgttcgcccacctggcatcgctgttgcagatgaccggccagttcaccgtctacacctacatcgtgccgttcctggtcggcagcatggccctcgacaaaccgaccatcagcctggtcctgctggtctacgggggcggcggcatcctcggcgcgctgctcggcggacgcgccgccgaccgctggccggggccggccaccttcgtcgccttcctgctcctgcacgcactggccctggtcctgctgccgttcgccaccggcggcctgccgctgctgctgggcgcggtggtgttctggtgcgtgttcaacatggcgccggggccggcgatccagaaatacctggtggaactcagcccggacaccgcggcgatccagatcagcctcaacaccagcgcgatccagctcggcgtggccctgggcgccttcatcggcgcgatcctggtggatcaggtggcggtgcgcgcgctccccctgggggggcgccgcgctgatcctctgcgccccccgcctgcggctggctgtccgcgcagcggccggcgggcagggcggactgcggggagcgcctcgattgattccctaccgcgcggccacgggaacagccccgggggccgttcctcaacctccaggctcactaccgctatccgtggcgtggcctgcccagcagcgaacgcttaccatggatag

SEQ ID NO: 8483 - DNA, 1362 bp, Pseudomonas aeruginosa
ccacagcgccgaagacctcgccgccgaggccttcctgcaggtctggatgctccccgacccggcgtcgatccgctcgccgcgggcgttcctcgcgaccatcgcgcaacgcctgatgtacgagagctggcggcgcaaggacctggagcgcgcctacctgcagatcctcgccgaggcgccggaggcggtgcagccgtcgcctcacgagcagtggatgctgatcgagagcctgcaagccatcgaccgcctgctcgacggcctgtccgggcaggccagggcagtgttcctgatgagccagctggaaggcctgacctacgtgcagatcggcgaacgcctcggattgtccctggggcgcatccaccagttgatgaaggatgccttgcactgctgctaccggggattccaggaatgagcgagaagccggaacggcaacgcatcgtcgaggaggccatcgaatggatggtgcgcctgcaatccggcgacttcagcgccgccgagggcgatgccctggaacgctggaaggcgctgtcgagcgagcatgccgaggtgttccggcaactgcttggcagcctcgcgccgctacaggactcgccctggcgcggccagccgagcgctaccgtgctgcgcgccctggagcagccgtcgagccgccggcgcttcgtcggcggcgccctcgggctgttcgtcctgctcgccggcggcgccggcctggagcgctgggtccaggccggcatgggtctgcccggcgaactggcgaccggcaccggcgagcgccgcgactggttgctggccgacggcagccgcctgcgcctgaacgcgcggagcaaggcgcgaccgctgctcgacggcgcccagcgacgcctggagctgcggcgcggcgcgatgcgcctggaagtgaaggaggacccgcgcggcgccttcgccctcgactgcgccgccggacgggtggactgcgccagcggcagcctgctgctggccgaggagcgcggggcgatccgcctggtgaccctgcgcggcagcgcgcggctgaccaccggcgagggacgccagctggcggtggcggcacgacgtagcctgctgttcgatgccggcggcctgctcgaacagggcccgatgcaggccggagaggatgcctgggccagcggctggctggaggtccacgaccgctccctggcctgggtcgcggaggccttccggccctatctgccaggcatcctccagctcgacgcggagatcgccggcaaccgcgtcagcggtctgttcccgctggacgacatgcacacgtccctggacatgctcggacgcagcctgccgatccgcgtgctgcgctacagcgactactggatcagcctgcgccccgcctga

SEQ ID NO: 8484 - DNA, 450 bp, Pseudomonas aeruginosa
cgatctggaagcgtccggccaggcgccgttcggcgcgttccgccggcaggtggtcgcggacccggcgcggcgccgagcgcagggtctggtcgttgtgcacgtagcgcaccggttcgcgcaggccgcgttcttcgcgcccggcctggtcgacgcgcagcgtgtggtcgaagatcaccgcctcggcggcgccggtcaggcggcggagcagggcgatgctttccgggtagtagcgttcacgaacctgggcttcatcctcgaaatcgcccaccgcgctcgcctcgcgcaccagttggaaaccctcgcgctccaggctggccggttgcgccagcagacgcgcattgcggatcgccacccgggtcggctgcaacagcgcgctgtgctgcggcgtcccggcgggggccggataggtgtaggcgaccggccgttggccgttgtcgcggatatagttga

SEQ ID NO: 8485 - DNA, 615 bp, Pseudomonas aeruginosa
agcccccttgcgggtgctggtggtcggcgccggcttcgccggtctcggcttggcgatccgcctgcgacaggcaggcatcgacgattatctggtcctggaaaaggccgccgatgtcggcggttgctggcgggaaaaccgctacccgggcgccgcctgcgacgtcccctcgcatctctattcgttttccttcgagccgaaggccgactggtcgcgcaagttcgccccgcaggcggaaatcctcgactacctgcggcattgcgcggacaagtaccgtctgcgcgagaagatccgtttccactgcgaggtggaggaggcccgtttcgacgccggcagcggcgaatggcaggtgcgctgcgccgatggccagacgctgcgcgcacgggccctggtctgcgccaccggccagttgagccggccgctgctgccgcgcctgcccggcctggagcgcttccagggtccggcgttccactcggcgaactgggacgccgaggtcgagctggccggcaagcgggtcgcggtgatcggcaccggagcccagcgccatccagttcgtcccgcggatcgccccgcaggtgcaacgcctgtcgctgttccagcgcagcgcgccttacgtga

SEQ ID NO: 8486 - DNA, 1131 bp, Pseudomonas aeruginosa
agcccgaggtccagcggcgcttcaacctggaggtgcaacaggggttgcgccataccgtctgggagcgtggctgcgacagctggtacaagactgccgccggcaagaacaccaacaactggccgggctacaccttcgtctatcgctggcgtacgcgccggccggagcttgccgactatgacctggcccgctgaagcgcccctgatgtcgccgccgcaacgcctgcgcgccggtctcctgcgcggctgcctgcgcctgttgttccgcgggctggtccgtccgcccatgccagtggcgctgcaacgcggcgtgttgcgcgggctgagcctggcgacgctgggcgccggcggcgtcgtccgcgagcgccgcagcctcgccggcgtgccctgcgagtggttgcggccgcgcggggtggaggcgcggcgccgggtgctctacctgcacggcggcgcctacctgatcggctcgccggcgacccaccgggcgatcaccacgcacctggcccggcgttgcgccgccgaggtctgcgcggtggactaccggcgcgccccggaacatccgttccccgccgcccgcgacgacgccctggcggtctacctggcattgctggaggccggccattcgccgcgccggctgctgctcgccggcgactccgcgggcggccacctggcgctgtccctggccctggagctgaaggcgcgcggcttgccgttgccggccgggttgctgctgttctcgccctggaccgacctcggctgccagcgcctgcacacgccggcggccggcgacccgctgctgtcgcgggcctggctggaaagcgcggtgcgcctgctgctgccggccgacgcggagccaggctcggccgccttgtcgccgctgcatgccgacctggcggggctgccgccgctgctggtacaggtcggcgaggacgaactgctgcgcgacgacagcctgcgcctggcgcaacgggccggtgagcagggcgtcgcggtgcgattgcagcgctacgccggttgctggcacgtgttccaggcccatgccggcgtgttggccagcgccgaccgggcgttggacgaggcggccgcgttcgtcgtcgaatgcagcgtggagggcgataggtgcagaacatcctga

SEQ ID NO: 8487 - DNA, 984 bp, Pseudomonas aeruginosa
gcaataaagggcgtcaatcaaagaataacatgggggaaagacgtgcagcttatgtcaattcaagctctgactatcaacaggcggcaggtacgtgtggccagcctggtgaccgctgttctatttctagtggtgtgtatcagctgggggactacctggctcggcatcaagatcgccgtggagagcgtgccgccgctaactgccgccggattgcgctttctgatcgcatttccgcttttcctgctctttgcgcggctgcgccacgagacgatctttttcccgcggcgactcctggccttcttcgtcttcgtgacgctcggctacttcagcgtgccctactacctgctgaactatggcgagcaatacgtcgcttcaggtcttaccgcgctgctgttcagcagcatgcccgtgttcatcctgatcttctccgcgatcttcctgcgcgagcgcatctacctgtcgcagatccttggtattgcgattggcttcggcagcctgttcatgatcatcaggtctcaagggctgcatctggactacacggagttgttaggcgtacttgccatcctgctcgcggcgatcatgcacgcactcagctacgtcatcaccaaaaggcaaggtgctgacatcggcgtgatcaccttcaatacgctgcccattggcatcgccggcttggggctgttcatggccggactcgtgatggaacacccgaacctgtctgccgtcacaagccgatcttgggctgccctgatctatctcggtctggtggcatcagtcgggggattcatcgtgtacttcttcctgctcaagcgtttgagtcccgttgtgctgtcgttcgtcttcatcattttcccggtgttcgccgtgatcatcggcgcctggtacgaaggggttgccatctctcgcgagttgattggcttcaccgtgctcctattggctggatttgccatcaccaagcttcccatcgagaagctgctcggcaggaggtga

SEQ ID NO: 8488 - DNA, 1503 bp, Pseudomonas aeruginosa
acggcggcaagcctgcggtttccgcccgtccgccttcctttgctgtgcattagaaaaagaagaaatcgaggcaagcatacccatgtcgaatcctccccccaccgcagaacgaacccagcttcgcaagtccctcaagctgtggcagatcgtcatgatcgggttggcctacctgaccccgatgaccgtcttcgacaccttcggcatcgtatccgggatttcccagggacacgtgcccaccgcctacctggtggccctcgccggcgtgctgttcaccgcgatcagctacggcaagctggtccgccagttccccaccgcaggctcggcctatacctacgcgcaacgagcgatcaatccccatgtcggcttcatggtcggctggtcgtcgctgctggactacctgttcctgccgatgatcaacgcactgctggcgaagatctacctgaccgcattgttccccgaggtcgccccgtggatctgggtggtgatgttcgtgctgatcatgaccctcatcaacatcaagagcgtgaacctggtcgccaatttcaacaccgtcttcgtgctggtccagctggcgatcatcgtggtcttcatcggcctggtgattcacggcctgaacaacggggaggggaccgccacggtgctcagtacccagccgttcttctccgagcacgcgcatctctcggcgatggtggcgggggcgacgatcctctgcttttccttcctcggtttcgacgcggtgactacgctgtccgaggaaacccgcgacgccggcagggtgatcccgcgggcgatcttcctcaccgcgctgtacggcggggtgatcttcatcaccgtgtcgtatttcctgcagtcctatttcccgaccaacgtacgcttcaaggaacccgacgcggcgctgccggaaatcgccctgtacgtcggcggcaagctgttccagtcgatcttcctctgcgccaccttcatcaataccctggcgtcgggcctggcctcccaggccagcgtgtcgcgcctgctgtacgtgatggggcgggacaacgtgctgccggagcggatcttcggcttcgtccatccgaaatggcgtacgccgtcgatcaacgtgctcatcgtgggcatggtggcgctctcggcgatctccttcgacctggtgaccgcgaccgcgctgatcaatttcggcgccctggtggccttcaccttcgtcaatctctcggtgatcgtgcatttctatgtgcgcggcgggcgcaaccgcagcctcaaggagcatttccactacctggtcctgccattgctcggcgcggccatcgtcgcggtgctctggctcaacctggaaagcacctcgctggtgatggggctgatctgggccggactgggcttcggctacctgttctacctgactcgcagcttcagccgtccgccgccgcgcttccaggagagcgagctgagcccgacccagtgaggcgagcggtgaatggattcagcggaaatgtgaaggaaaaagattggtaa

SEQ ID NO: 8489 - DNA, 2610 bp, Pseudomonas aeruginosa
cgccgttgtcggtcctcaaggagcattctccgccgcgcaataaagggtccgcccgtcgacgaggctgcgagcagtcgccaggcggccgcgcaggccgggttcttccggcgccagcgtgccttcgcgccaatcgcctccgcgcaacggaatcagcgccgaacggccgtagcccgggcagtacgcctcggcgtcgccctccagatagtcgacgccgtccagggtcagctcgccgacattccagcgcgcgccgaggtaggcctggcggaacggcccgtcggcaaggacgtagaagcccccgcgcacctcgctggccgccgtggcgaagccgatggtgcgtcgcggttgcgggatcaccagcagcggtcgccgtgggtcggcgaaggcctcctgcaactcgaccaggcgctggcgggtggcgcccatctcgcgccggtagcgctcgccgcgcgcccgcgcgtcgtcgggaagttcgctccaggccggaggctggtcgcgcagcaggtagtccagcggccaggtgccggccgtcgcggcttccttccagtccgcgtcgtcgtcgcgcaggtccagcagcactccggccagcgcgccgatctcgtaggcttcgctgtcgacgccgacgccgatctcgttggcatcgtagaaggccagggcgtactcccgcagcgcctgccgatagcgttgcggatcctcggcgaaatcggtgcggtagcgcgcggcggcggccatctcgatgtagcgcgcggtgccttcgctgagatcgacctgcgccgccagccggctttcctcgggagccgcttcgcgccagcggcgcagccagccctgggcgtcgctcaggtagctgtcgcgctgcccgggcgtgcgcagggcctggagcagcgactggaacagggcatagcggtattcccgcgggcgcgggtcgagcgtggccaggtcgccgcgatagccaccgggcttgcgcaggcccggccagtcttcctgggcgtagtgatggaaggcttcgtgcgggccgatggcggccagcgtctcgctattgccggtattgctccgcaggtgcgcggcgctgatctgcagcagcaccgccggacggccccggtaacgcggaaaggcatagctcaggtcgagatccgggtcgctgtcgcccgccaccgtggtgcgctgcgcgcggccttcggcatcggcgacccaggtactgcggccatcgctgtagaggaaggccttgtcggccatccgccagccgggccagagtcgttcgctgtgctggccgacggcatgggcataggccaggtagcggcgggcgaacgactcgctgtccgtcgccgcggcgggaagggacagggcaagcaggagcaggggcagggctcgggtcatggcgggtacggttgcgcaaggtcggtcggggcgacgaaggtatgccgccgcttcccgattgaccgtcgcggccgctgccgcgttcccctaggcggtgttgcgcgcccgcgccaggtcgcgcagcggcggggcgccgaacagccggctgtactcgcggctgaactgcgacgggctttcgtagccgacccggtagccggcggcggccacttccaggccctcgctgaagatcagccggcgtgcttcctgcaagcgcagctgcttctggtactgcaacgggctcatcgcggtcacggccttgaagcggtggtgcagggtcgaggggctgaggttgaccacctgggccagttgctcgatgcgcagcggcttgccgtagttctggttgatccagtcgatggcgcgggtgatgcggtgggcctggctgtcggcgatggcgatctcgtgcaggcgctggccctggccgctgcgcagcaggcggtagaaaatctcgcggaggatcagcggcgccagcatcgggatgtcgcgcgggctatccagcagatggatcaggcgcagcaccgcatccagcaggctggcgtcgatacggtcgacgtagaggccgcggtcgccgcgccggctggccacttccatgggcccggcgtcggagatcagttgggtgatttccgcagggtcgatatccagccggacgcagaggtagggtgcgtccggcgaggcgtcgatcacctggccggccagcggcagggtgaccgagaccaccaggtagtgcaacggatcgtagatatagcgttcctcggccaactgcacctccttgcggccctgggcgatgatgcacagggcaggtttgtgcatgccgcgcgccggcagggtggggccgtcggcgcggatcagggcgaggggttcgacggcggtgccgtagataccgtcgcgggggcaatgcctgagcagcgactgcgccagttcgctctggcgctggcgcaattcggcggggagatcgacggaaagaagcggggtgttttcgctcatgcggggactcgcgggggaaaccttcccaagactagcgcgcgtcgcggcgacaggcatccatcgcgctgcgcgatggcaggatcaggcaagcattcgccaggaacaggcaagccagctcgtttcaccgggcgcaagcggatgagaaaaaaccggaacgcggcagtttcaggcaagaacccgacagtatccgtctaccgattccccgcgccgtccccctaa

SEQ ID NO: 8490 - DNA, 423 bp, Pseudomonas aeruginosa
tcggaggcagggcacatgcgtcacccttacaccccacaacggccggccggcgtcttggcgccgccggcccttccactcctggtgccgcttgcgcagcggcgaatccatgtcgaggaggcagagagcatgccagcgttcaatcgggccagtcacctggtcagcattcgcgcccgcagcggccagtcgcaccgcctcggcctgcgcctgcaagagctggcgcaggcgggccaggccgcgcccggttgcctgcgctacgaactgcgccaggcggacggggacgccgacctgtggctgttgcacagcgagtggagcgatgaagctgccatgcaggcgtacctgtccggcgacgcccagcgggtcttcgccgaggtgctctggcaagcgctggcggcgaccctggacgtgcaggagcggccgttctga

SEQ ID NO: 8491 - DNA, 1653 bp, Pseudomonas aeruginosa
cgcggcgcggcgtccgcccgtcccccttgttctggcgtctcagcgacccggcgcgaccggcgactggtccgctcgttcgtcttcgacgtcgcgatgtcgctcgaaggcggtcgccggcgagccatcggcattgacctgcaacaccgcgcgcggacggccgtcctcgccaatgaatacctggccgatcccggcgctgttccacaggcgctcgccggcctggctgtgctgcggaacgcgcgggcggatttccaggctgcgccgctgggtcagccagttcagcggcgaccagggcgcatagagccagcggttgaggcggtcgaaccagtccagcaggcgtcgcgggaattcgttcttgatcccgctgctggtgatctgccagagccggggcccgtgctcgcggtggcgaatccggatgtcgtagacgaaggagtaatgcacgtcgccggaaaggatcaggtagttacccggcgtgcgcgagtggcggaagatgttcatcatcaccgaggccgcgccgcgatgggccatccagttttccgcatcgaccagcagcggctggccgatccagctaaagagcttctgcacgccctcgatcagcttgaccccgaacatcggcgccggcgacacgatgatcgccgccttttcgccgagcagatcctgctggagttcactcagcgcctcccagtccatcagcccggagggccggcccaggttgcgctcgctgcgccagcggcgggtgcgcgtgtcgaggacgatcagggtcgggctgccaggcaaccggtagtgccagtgctggaagtcgagcagggcatcgagcaggcggtcctgctcggcgcagggcagccggccgtctgccgcggcaccctccatcagggccgcgaccggcgccagccattcgccgcaatgctgcgggtcgttgccccagccctggcagagcaggtaggcgagcagggcgttgccgatgatccgccgggagaacggatggccgtaggcggtcagctcccagcgcgcggaaaggttccagtcgtcggtgatgtcgtggtcgtcgaagatcatcagcgacgagatatgcgccagtgcccgcgccacgccgggcaggccatcgcggaaggcttcgatgtgccggcgctcgtcggcgaagcgctgcgcgtgccgcgcatccagccccggcggcggttccagcctgaccaggcgccagggcgccggcgaccagaccagcaggtacatcgccagcacctcggccaggccgaccagatggttgtgggcgttggccgaggtgaagatcggcttcttcaccccgccgaagaagcgctcgcgcagggcttcgttggacttgaaggcgggcagcaggtcctcgcgccggtagtaggtggccgggtgtgcgtagagcgcctcgctgtcgtccaccagcgcgccttccaggtgttcgccgtacaggccgaggcggcggatcagcccatggatggccaccagcatcggcccgggcgacgtcgtcggcgtagacctggtcgccgctcatcatcagcaacgccgggcggctttcggcctgcagcaggttttcctccagcagccggtcgacctgcagcaggccatcggccgccgggtgatgcggcttgcggcaggagccgtggagcaactggtcgagacgtggcttga

SEQ ID NO: 8492 - DNA, 597 bp, Pseudomonas aeruginosa
ccagatcggcggactgacctacgtggagatcgccggcttgctggaggtttccgtcagccgcatccaccagtacatggtcgagggcttcaagcagtgctaccaggtgcttgccgaatgagccagggaaggcgagaacgcatcctcgacgaagcggcgcagtggatggcgctgctgcaatccggccatgccggcgccgaggagcgcctggcgttccagcagtggcgccaggccgatgccgagcacggtgcggtgttcgaccggctcagcatgggcttgcagtcgtttcgcgacgagcccatgcacggcttgcgcgccgagcaattgatcggagccctcgaggcgccgtccgcccgtcgccggtttctccagcgcagcctcgcccctggcggcgttcggcgtggcgacgctggcgctggggcggatcggcatcgtcggcttcccctggcccggcgacctgtacaccggcaccggacaacgccagagcttccgcctggaggatggcagccaactggtgctggacgcgcgcagccgggtacgccccgaattcgatggctaccggcgtcgcctgcgcttacgcgagggccgcctgctggttga

SEQ ID NO: 8493 - DNA, 498 bp, Pseudomonas aeruginosa
acccagccgtgcaggttcagccgaccctgctccagggcgcgggcgacgcaggggtgggtgcgcaggttggccacttgggcgatcacgttgtgccgcaccagggcgtccagccgcgccgcctcggaggcgtgttcgtgggcgctgttcatcgcccgtgcggcctcggcgtggtgcaaccagccggccaccgccggcagctggtcgagacaggcgcaggaagcgatggcgcccatcgcgccgcagtccgagtggccgcagaccacgatgtcgccgaccccgagcaccgccaccgcgtattccaccgaggcgctgaccccgccgggctgcggcccgtatccggggacgatgttgccggcattacggatcacgaagagttcgccgggctcgcgctgggtcagcagttcggggaccacccggctgtccgagcaggcgatgaacagtgccttgggggcttgccgggtggccagggacttgaacagttgcgagcgcgccgggtag

SEQ ID NO: 8494 - DNA, 480 bp, Pseudomonas aeruginosa
tcgacgatcgcctggaccttggcgtgggctttcagcgagccgggtgcggtggagatcgacagccagccgctctaccgggaacgtctgggcctggtgctgggggcggaaccccggggggggacgcccccgttggccgccgcagcgctggcggagttgccgttggcgttgctgcgcgacgacttcgccacgcgccggcacatcgacgcttacatgcgccagcaaggggtgacggcgcgggtggcgctggaggcgaactcgatcagcgccatcgtcgacgtggttcgccgcggaagactggccagcatcctgccggaggcggtggcgcgccagcaggccgggttgcgctgcgtggcgctgcggccggcgttgccgacccgccaggtagcgctgttctggcgccagggcagccaccccggtgccgcgcgcctggccttccaggccctggcgctggaactcggcgccgagctgggcgacgcctga

SEQ ID NO: 8495 - DNA, 702 bp, Pseudomonas aeruginosa
gcgggatcagccgcgactcggctgcaacgccgcgggttcctcacggcgcagccgcaaggccagggcggcgccgaacagggcgagcagggcgctgagcgcggtcacccattcgatgccgcgcgcctggctggccagcaggctggcggcatcggcgccgcgcacctgggcgttggccagcgccaccagcagggccaggccgagcgcgccgccgatctgctgggtcatcgaggccatccccgaggcgacgccctgttcggcgggatcgacgccgctggcggcgctcacccacatggcggtccaggtcatgccctggccgacgctgaggatcacgatggccggcagcagcgccaggaagccgcgccccagcggcaggcacgctgccagcaggccgagcccgagtgcgcccagcagcaggccggcgaccagcgtcgcgcgtgccccgtggcgggccagcaggcgctcggcgacgcggataccgagggtgcagagcagagtcgccgggaggaacgccaggccggtctgcaacacgctgtagccgtacaccgactggaagtagatggccaggaagtagtactgcacgccgtagctgctcatgaagatcgcggtcagcagcatcgccacctgcaggttgcggttgcccagcaggcgcagcggcatcagcgggtcgcggctgtagtgttcgatggcgaggaacgccagtag

SEQ ID NO: 8496 - DNA, 777 bp, Pseudomonas aeruginosa
cagcgggacggaaaggtaaagtccgaaacgtaccgagggcgcatcccagcccgactcggggccctggaccagggtgaagaccagcagggtggcgccggcggtgaccgtcagcgcgccggccaggtcgaagcgccgaccgcgctggcgccgggcgtcggccgggatcaggcgcagggcgagcagcgccgcggcgccggccagcggcacgttgaccaggaagatcgaggcccagccgaacagctcggtgagcgcgccgccgagcgccgagccgagggccaggccgaacgccgaggcgatgctccagatcgccagggcacgattgcgcgccgggccctcggcgaagtgattgccgatcagcgccagggtcgccgggaacagcagcgcgccacccaggccctgcacggcgcgggcgaggatcaacggcaactcgctctgggccaggccgcccgcgagggacgcgagggcgtacaggctttgcccgaggacgtacatgcggcgccggccgagcaggtcggtggcgcgcccgccgagcaggaggaagccgccgaaggccaccgtataggcgctcaccacccattgcaggcgttgcgccgaaaaatccagcgcccggctgatttccggcagggcgacgaacacgatggtggcgtcaagggcgatgatcagttgcgcgcaggcgagcagggcgagcatccagttggaaggggcggcacggtccgtcacggcgggactcctggtctgggttgggcgcggccagtgtttctcatgctggaatcgtga

SEQ ID NO: 8497 - DNA, 618 bp, Pseudomonas aeruginosa
  unsure (297): Identity of nucleotide at the above locations are unknown.
cgccggaggcgttatccgccgctatgcctattcgcccgcgcttataagctcagaacaaagcgttccaagcctgccctgcaaatctcccgcgctcatcgctcatcccctggaaaccatgttttcggggggaaccgaacgatgccgcaccatgctccatccacacgcctgccttccagcctggccctggccgcgctgctcgcggcggcctacgccgcgccgccggaggcacgtgcggagacgcccgcgcccgccgccaaggcgctcaccttcgacgtcgccgccggcccgctggaccangtgctgctaggcatctcgcggcagagcggcttgctgatctccttcgagcagtcgctggtgcgcggccggcaggcgccggcggtgcgcggtccgctgagtgtcgaccaggccctggaacaagccctgcgcggtagcggcctgcagttccgccgttccgagcgcggcgcggtgatttccgccgcgccgctgcgcgcggccgtaccggcggcgaaagtgcaaccgctggccggcgaaagcggagcagaccctggagcgggtggtggtgaccggctcgcggattccccgcgcccagcaaggaagggccgtcgccggtcacggtga

SEQ ID NO: 8498 - DNA, 405 bp, Pseudomonas aeruginosa
gcgacagcggcaagctgttcgccgacctgctgttcggcttcgaccacctgcagaacaatacccgcgggccgtccttcacctcgccggacttcatcaatgcctccagcggcgacctggagcgctggtaccggctgttctcgcccgaggagatcggcggcaagagcagcaacaacagcaagtggcgcgaggtgtcctggaccggcaccctcggctacagcgaccacgtcgccaatacttcctgggaatacgaactggccgcgacccgctccgagtaccgcagcgaccgcactacccgctacaccccggcggccgggatcctcgacctgtacctgggccgcaagctcggcgaacgcgacggctacccggtctacgatcccgatccggcgcgcctcggacgtccgctga

SEQ ID NO: 8499 - DNA, 312 bp, Pseudomonas aeruginosa
gctaccggcgcaaccccgactggtgggctcgcgacctgccggtcgggcgtggcctgtacaacttcgagcggatccgtttcgactactaccgcgacagcggcgtggccttgcaggcgttcaaggccgggcaggccgacatcaatgtcgagaccagcgtcaaggcctggagcagcggctacgactcgccggccctgcgcgatggccggttgcgccaggagagctttccctacccgtacccggccagcctccagggcctggtgttcaacctgcgccggccgctgttcgaggaccgccgggtacgccaggcgctga

SEQ ID NO: 8500 - DNA, 264 bp, Pseudomonas aeruginosa
acgacggcagcggcgatatccacgagcgcctggtgcaggcctaccgcctgctcggcgaggccggctggcatgccgtcgacgggcgcctgctggataccgccggacggccgctgcgcttcgacctcctgctccagggcaagggcctggagcgcgcgctgctgccgttccagcgcaacctggcgcggatcggcatcgatatgcgcctgcgccaggtggacgcttcgcaatacatcgagcgcatacgtgcgcgggactacgacatga

SEQ ID NO: 8501 - DNA, 1128 bp, Pseudomonas aeruginosa
acacctggtgggaagtccgcgagcgggccgcgccgagccgggaggcgcagtgacatgggcggctacctgttgcgccgcctggcgctgatcctgccgaccctgctgggcatcctgctgatcaacttcgccatcgtccaggccgcacccggcgggccggtggatcaggccatcgcgcgcctgcagggcgtcgacggcggcggtccgctggggcgtggcggggagggtgggcatggcgctctggaaccgcagcgccacggcgagaccggcatcgatccgcagctggtggccgccctggagcgccagtacggcttcgacaagccgccgctgcaacggctctggctgatgctgtcgagctacgcccggctggatttcggcgagagcttctaccgcgacgcgcgggtcatcgacctgatcgccgagaagctgccggtctcgctgtccctgggcttgtgggcgacactgatcacctacctggtgtcgattcccctgggggtggccaaggcggtgcgccacggcagcgccttcgacctgtggagcagcgcgctggtggtggtcggctatgcggtgcccggcttcctcttcgccatcgtcctgatcgtgctgttcgccggcggcagctacctggactggttccccctgcgcggcctggcttccgagggcgccgagcgcctcggcccgctggcgcgcttcgccgattacctctggcacctggcgctgccggtgggttcgctggtggtcggcggtttcgccagcctgaccctgctgaccaagaacagcttcctcgacgagatatccaggcagtacgtcgccaccgctcgcgccaaagggctcagcgagcgccgggtgctctacggccatgtgttccgcaacgccatgttgctggtggtggccgggctgccggcggcgctggtctcggtgttcttcaccgggtcgctgctgatcgaggtgctgttctccctcgacggcctcggcctgatgggctacgaagcggcgcttggccgcgactacccggtggtgttcggcagcctgttcatcttcaccctgctcgggttgctggtgaagctggccggcgacctggcctacagcctggtcgacccgcgcatcgacttcgccgcgaggagacagtga

SEQ ID NO: 8502 - DNA, 903 bp, Pseudomonas aeruginosa
gatggccatcgtcctttccccgctgcaccgccgccgcctcgccgcgttccgcgccaaccgccgcgggcgcctggcgctgcggctgttcctcgcgctgttcgtcacctgcctgttcgccgagctgatcgccaacgaccgcccgctgctgctggaataccgtggccagtggttcctgccggtgctgcgggactatccggaaaccgccttcggcggcgagctgccgttcccgccggactaccgcggtcgcttcatgagcgaacgcatcgcccgcgacggctgggcgctgtggccgccgatccgcttcgacgcccgcagcatcaactacgcgcgcccggcgccggcgccgccctcggcggagaactggctgggtaccgacgaccagggccgcgatgtgctcgcgcgggtgatctacggcctgcgcctgtcgattctcttcgccctcggcctgaccctggcctcgtcgttgctgggaatctgcgcaggcgcggtgcagggctactacggcggctggatcgacctgttcggccagcgcttcatcgaggtctggtcgggtctgccgatgctttacctgctgatcatcctcgccagcctggtgcagcccggggtcggctggctgctggcgatcatgctgctgttctcctggaccagcctggtcgacgtggttcgcgccgagttcctgcgcggtcgtcacctggagtacgtcaaggcggcgcggaccctcggcctcggcgacgccggggtgatgttccggcacatcctgcccaacgccatggtcgcgaccctgaccttcctgccgttcctgctctgtggcgcggtgaccaccctgaccgccctggacttcctcggtttcggcctgccgcccggctcgccgagccttggcgaactggtcgggcagggccgtga

SEQ ID NO: 8503 - DNA, 477 bp, Pseudomonas aeruginosa
gcctcgactaccccgcgcccggcggctggctgcgccggcgcgcgggactgcgcgcggtgcacgaggtcagcctgcggctgcgccgtggcagcaccctggggatcgtcggcgaaagcggttcgggcaagtcctccctcggccaggcgctgctgcgcctgttgccggccgaagggcagatcctgttccagggcgagcgcctcgaccggctgcacggcaagcgcctgttgccattgcgccggcagttccaggcggtgttccaggacccctacggcagcctcaacccgcgccttagcgtggaacagatcgtcggcgaaggcctgcgtatccatggcatcggcgatgccggcgaacgccgcgcgcgggtgctggaggcactgcgcgaggtcggtctcgacgagccttgcctggaacgctatccccacgagttttccggcggccagcgccagcgcatcgccatcgcccgcgcgctggtgctga

SEQ ID NO: 8504 - DNA, 1257 bp, Pseudomonas aeruginosa
gatcggcctgcgggcccgtcagggacaaggagccatgtcggcttccgggtccgtccgatcgattgggggaatgcgatgagttcgttaccgttgtacttcgattacgccgccaccacgcccgtggacgagcgcgtgatccgggccatggtggagtgtctcggctaccaggcgtgttttggcaatcccgcgtcgaattcccatgcctacggccgccaggcgcggcgggcagtggagcgggccagggagcaggtggccgcgctggtcggcgccagcgccgggcagattgtctggacttccggcgccaccgaatccaacaacctggccctcaagggcgtggcccaggcgctggacgcacccggccacctgatcaccagtcgcctggagcacaaggcggtgctggacaccgtgcagcaactcgccgatgacggctggagcgtgacctggctggcgcccggcaccgatggcctgatccggccggaacaggtggaggcggcctggcgcgccgatacccgcctggtgtcgctgatgcgggtcaacaacgaactcggcaccctgaccgacatcgccgccatcggcgaacgggtgcgcgagcgcggcgcgctgttccacgtcgacgcggcgcaggccagcggcaaggtggcgatcgacctgggccgcctggcggtggacttgatgtcgttctccgcacacaagacctacgggcccaagggcatcggcgcgttgtacgtcgggccgcgcgccgagcggcggctgaaggcgcagatccacggcggcggacacgagcagggcctgcgttccgggaccctggcgacccaccagatcgtcggtatgggcgaggccttcgccctcgccggcgagcttttcgaggaggagggcaggcgcatcgccggactccagcggcgtctgctggaggggctggcgcagatcgacggctggcgcctgaacggcagcgccgacgcacgcatcgcgcataccctgaacctgaccttcgacaacccggcctttgtcccccaggcactggagtccagcctggcggtgtccagcacctcggcctgcaactcggcgcggccggcgccgtcccacgtgcttctcgccctcggtcacgatgccgccagcgctggccgcagcgtgcgcctgagcctcggtcgctacacccgcgaggccgacgtcgacgcggcggtggccgccctcaaggccgcggcggatagtggcgcgccggcgtggcagccgttcctcggggtatccagggcaggctga

SEQ ID NO: 8505 - DNA, 1533 bp, Pseudomonas aeruginosa
gcggccggctcgacccgccctcgccgaagccaggggctgcggataaccgcgaagcggttattcgccctgcggctccaggggcttttcgtctttgccgccatttcccggcaatgtgcgcttggcggatcatccaggttgggtatcatgcgtcgccattcccatccaccgccgacggaagtcaggctttgcctgcgtgagcccaatggacgatctctcccccgattccgccttgccgcctgccggcagcgcccaggacaacgacgcgccgcgccagttggtggtctgcatcgacggaacctcgaaccgcttcggcgaccagccgaccaacgtggtgcgcctgtaccgctcgctgtcgcgcgatccgcgcagagtgctggcctactacgaccagggcgtcggcaccttcggcctgaaggaaaccctgttcgagtggcagaagtttccctcgcggatcgccggcctggccttcggctgggggctcaagcgcaacgtcgagggcgcctatcgcttcctcgccgagcactaccggcccggcgaccagatattcctcttcggcttttcccgcggggcctacgcggtgcgcgtgctggccgcgatgctgcgcgcggtgggcctgatcgatgcgcaccagccgcacctcttcgactacgcctggaccctgctcaccacccgcatgccgccccgcgacgaagacaagcgggccggcacgcgtcgccgcggaccggacttcggcctgctgggacgcttccgcaaggtcttcggccggcaggtgaaggtgcacttcctcggcctgttcgacaccgtgacctcggtgggctgggtctacgacccgctgaccgtgccgtattcctcgaacaacgaaatggtcgacgtggtccgccaggccctggccatcgacgaatgccgctgcttcttccggcagaacctctggttcggcgagaaggaccgcaagtccgacgtgttgcaggtgtggttccccggcatgcactccgatgtcggcggtggctatgcgccgaaggactcgcggctggctctggtggcctttacctggatgctcggcgaggcgctggaggccggcctgcatgtcgacccggcgcgcagccgcgaccagttgcgcgcacgttcgaagcagggcccggacccgaccgcgccgatcctgccggtgatgacccggccctggcgcctggccgagtggctgccgctgctggtctgggaccgccgcagcggcaaccgcgcctggcgctggtcgcgtggccggccgcgctcgcggccgctggaaccggtcgggcaggaaacccgggtcaagctgcaccgttcggtgcagcggcggctggacgaatgccccgactaccggccgtgcaacctgccagcgctggaacgctgcgacctcatcgacgattcgccgttgctcgacggctaccgctagcggctggccgcgatcgcgttcagaaccacatgcggataccggcgacgaagcgcgcctcgtcgtcgtcctcgccctcggcgcgggccaggtcggcgctgttgccgtag

SEQ ID NO: 8506 - DNA, 492 bp, Pseudomonas aeruginosa
tgccgtcgaaggaccaggcgaacttctccatgtgtccggtcaggtgcagctcgatggtgcgccccggctcgcggccgtccgggtcggcgaagcggctgcgcaggtcggcgtaggtcagcacccgccgcccgttgtcgcgcaggccgaggccggggtcggcgagcttcggtgtcggcgtcatggtctgcatgtcgaccagcgggttgccgtcctccgaagccggatgggactgcatcggcatggcgcccatgcccatcctggagtggtccatgccggccatcttggagtggtccatgccgttcatgtccatgccggccatcttcgaatggtccatgcccttcatgtccatgcccgacatcttcgaatggtccatctcgctggcgggcctcgtcgccgcgccatgccccatggcgccgtggtccatgccgcccatgcccatgtcgtccatgccgatcagcgggcgcggatcgggcgtcggcaccggcgcgctaa

SEQ ID NO: 8507 - DNA, 1980 bp, Pseudomonas aeruginosa
ccggaaaagatcaggtacatgccggttcccgcgtcgccgtgccggttcgctgcggtttgcgcctcactcgaagcgcgccctggcgaaggcgttctcgcccttgcgccagaccagcagggactcgcccagcaccaccaggtcgaccatcccgtcctccagcgcgccgagggcgtcctgcggggcgcagacgatcggttcctcgtggcggttgaaggaggtgttgatcagcgccggctggccgctgcgggcatgccaggcatgcagcagggcgtgcatgaacggatcggcctgcggccggatgatctgcggccgggcggtgccgtcgacatgcaccactgccgggcagcgctcgcggaaatccgcatggcagtcgtaggtcatggtcatgtagtcggccgccacctggtcttcacgccagccaacgtagcaagcctcggcgtgttctaccgcggtgaccggggcgaatggcatgaactcggtgcgttccatgcgctgattgagccagtcgttggcgctggcatcgccgggatggtagacgatgctgcggttgcacaaggcgcgagggccgaactccatgcggcccttgaacatgcccagcacctggttttcccgcagcgcttcgaccagcgtctcgatcaggttggccggccggctgtaggccagttgcgggtactggctggcgatcatctcggcattctgcgcggcgctgcgcgcgtccggcccgagggccatgctcggcgccgggaagcgcgtaccgttctcgcgataggccaccgccaccgccgcggccagggccaggccgccgtcgcccatgcagggcagcacgtagacatcgcggaccccggggatctcgcgcaggcgctggttcagcttgacgttgccgaacaccccgccggccaggcacaggttggcgcagccggtgcgcgccacgtgctcccgggcgatggccaccagcaggtcttcggagtgccgttgcgcggcggcggcgacatccgccgggcgttccgccgcgcagcgttgcagcagcggatcgctgtagccgtcgtaggagggcaggtacagttcgccgcagcgggcgcgcaggcggccgttctccaggcggatcatgtcgttcatcagcggcagcagcttttccgcgtcgccgaacgccgccaggccggtgatcttgccttcgtggcggttcggcttgaagccgagcaggcgggtgatgcgcccgtagaagtagcccaggctgtcgacgctggtctcgcgttgcaggaccgcctcgccgccgtcggcgcggtagtgggtgacggtgagcgactggaagtcgccgcggccgtcgcaggtgagggtcagcgcctcgtcgaacggcgagcagacgaacgcgccgagggcgtggcattcgtgatggtcgaagtactggaccttgccgcgcagcccgttggcgcggacgaaggcatcgaattcgccgcgcttggccttgtcgttggccatctcgtcggcgatccgcttgcgcaggtgcggcaggccctcgggacgctcgcgggcttcctcgaggacccggtccaggtagaggtcgaggtgccgcccggcgtcgaacccggcgttccagccgtaggcgatgcggtcgatgtcggccaggtcgatgccggcctcgccgagcacatagtcgatggagcggctcggccaggccttgtggtccttctggcgggtgaagcgctcctcgctggcggcggcgacgatcccgccgtcgcgcaccaggcaggcgccggacaggtcgttgttggtgatcccgagaatgatcatgcggtgtcctcttgcgcgaacgggtggggggcgagaggcgtaataggttgcatggcaccgggagcccaacaacctgccagatctggtcgcctgcgaaatctggcagggctaccggatctggtagctggacagccgtcgacgggcttgccggccataccggccgggcgcccgcgccggcatcagaagctgtag

SEQ ID NO: 8508 - DNA, 633 bp, Pseudomonas aeruginosa
ccgctgtcgaagcggccttcgttcaggctcttgcgggtgatgaagttgatcaccccgccgatggcatcggtgccgtacagcgcggaggcgccgtcgcgcagcacctcgacccggtcgatggcggcgaagggaatggtgttgagatccaccgcggagccgtcgatggcattgttcgccaggcgccggccattgagcagcaccagggtcttgttcgcgccgattccgcgcaggtcggcgaacgaggcgccgccggtggcgctgccgaccgagcgactggagttgtatacgccctggttgccggaaagccggccgatcagttcctcggtgctggtcacgccctgttggcgcagctcctcggcgcgcaggacgctgatcggcaccgcggtttccgcatcgacccggcggatcgcgctgccggtcacctcgattcgttgcaactggaccgtgggcgggtcgacaggcgcctgttcctccgccgcggcggcgctgccgggagcgagctgcagggccagcagcagggcggcgcccagcggcgcgtcggtgtggagcgatcggtgcatggtcggggcatcccttgttccggtgtgtccagggatgtccgtcgagccgggggattttccagggacggcttag

SEQ ID NO: 8509 - DNA, 1158 bp, Pseudomonas aeruginosa
cgaccagggcaccagctaccgcgaggaggagatcccggcggagttgcgggcgctggccgaggagtggcgggcgcacatggtcgaggccgccgccgaggccaacgacgaactgatgaacaagtatctggaaggcgaggaactgagcatcgaggagatcaaggccggggtgcgccagcggaccctggccaaccagatcgtaccggcggtgctcggctcctcgttcaagaacaagggcgtgcctctggtgctcgacgcggtgatcgactatctcccggctccatcggaaatcccggcgatcaggggtaccgacccggacgacgaagagaagcacgacgagcgccatgcggacgacgacgagccgttctcggcgctggcgttcaagatcgccaccgaccccttcgtcggcaccctgaccttcgcccgtgtgtattccggggtgctgacttccggcgatgcggtgctcaactcggtgaaaggcaagaaggagcgggtcgggcggatggtgcagatgcacgccaaccagcgcgacgagatcaaggaagtgcgcgccggcgacatcgccgcgctgatcggcatgaaggacgtgaccaccggcgacaccctgtgcgccatcgacaagccgatcatcctcgaacgcatggacttccccgatccggtgatctcggtggcggtggaaccgaagaccaaggccgaccaggagaagatgggcatcgccctgagcaagctggcccaggaagacccgtcgttccgcgtgaagaccgacgaggagaccgcgcaaaccatcatttccgggatgggcgagttgcacctggacatcatcgtcgaccgcatgcgccgcgagttcggcgtcgaagccaatatcggcaagccgcaggtggcctatcgcgagaccatccgcaacacctgcgagatcgagggcaagttcgtccgccagtccggcggccgcggccagttcggccattgctggatccgcttcgctccggccgacgaggggcaggaaggcctggagttccacaacgaggtggtcggcggggtgattccccgagagttcatcccggcgatccagaagggcatcgaggaccagatgcagaacggcgtgctcgccggctacccgctgatcggcctgaaggcgacggtgtacgacggctcctaccatga

SEQ ID NO: 8510 - DNA, 342 bp, Pseudomonas aeruginosa
ttcccttcccgtcttcgcttgccgacactccgtccttcccatggccttgtgccagggacagcgccggtggtcgctacccgcttcgggcgaatcgcggtgatggtctgctacgatttggagtttcccgaatgggtgcgcctgccggcgctgtccggcgcacaactgctctgcgcgccggtgaactggccggcggcaccgcgtcccgagggcgagcggccaggcgcagctgggcgaatgaaaaagggcgcgggccagtatcggcgccgcgcccttttgccggaggagaaccttattccagttcggctgcgctctcttcctggcgcttcaacccggtatgactga

SEQ ID NO: 8511 - DNA, 426 bp, Pseudomonas aeruginosa
tggcggcggcctgggtgggcgcctctctggcgttggccccgccctcggcgccggccaggcgtgcgggcggcacccggaggcgcagcgacaggctggggaccctggccgataccggttccggcgcgggtgcggcgaggggggaggggctcgggggcatggaggattcctcggcggcgtctggagacggaaggttggcgctgcccgtggcgtcggcggcgtgcagcgcggggtggagcatctgcgccaggtcggcaagctcctcgcgaagatgactggcgttgtcgacgaaggcgccgatggcctcggcatccgctaccttggcggactgctccgctttcgccgcgaactcggctggcgccccaccctcgggcgctgccgtttccgcctccggccgcggctcgggctcgacgcatccggcctcggtga

SEQ ID NO: 8512 - DNA, 1731 bp, Pseudomonas aeruginosa
cttggacgagtcctattgccttgtaagaaaaatcttgaagattttactgcgcaccgtgcccagcacaccgcgcaggctcgtccgctcgtacgggggcggcgcgcttcagcgatccgccatcaggacgacgatggcctcggcgacgaagtcggcattgcgctccagggtctgcaggtggttcatgacgacatcgtaggtttcgccgccttcatggcgcttcgcccagatcgccagctcctccagggccatgccgagggcactctggttctggttgagacggcagagcagggcgacagtcaggtcgtgatccagcatggcggtactcctgatcctgaaaaactcagcgtagcccccctggcgctccgccgacacggaagcggttcacgaaaagacgaagcggttcagccgctgccgacggggtggcctgcgttcgtggccggtgcccacggcgcagcgctttcgatagcccccggcagcttcggaccgacctggcaaggggacctatccgaacggcgagggtggcccgcggtggtggcgcgccgcatggccagtttcccatgccgcctggctatactggcggcgcgggaacaagacgccgtccatgaagagcgtcccggacccgaacgtcgcgcttcctgtcatctccgctacctatctttcgttcttctgccgcgaaacggctttcggatgaaggcggccggcggtcgctcgtcgcgccgtcccggggtttccctgtccgtgccgatccgacccgtgttgccagcgaggggtatgtacgcaatgtccgtgaccgatgccagtttcccgatcatcaactggtcgaaggcgatgccttcgttgcgccagctgatgtatttcgcctgtgtcgccgagtacggcagcatcggccaggccgccgaggtgctgcacgtttcgcagccgtcgctgtcgcggcagatccaggcgctcgaagtgcacatcggcgaggcgctgttcgtccgcggtccggccggggtgagcctgaccgaagtgggcagggtggtgcattgccgcgcggtgaagatcatcgccgaggccaaggcgctgacccgcgacatcggcgacggcgacgaccgtcagttgcacatcggtttcagccgctatctcgatcccggctggtccggcgagctggcccggcaactgaaggaagcgcgggtgtgcagcgccgtttcgccatcctgggcgccatcgctggacctgctcagcctggtccgcgagtcgtccctggacgcggcgatcatcggcgcgccgccgaaggtggtgcgcgaatacgagctgatggagatcggcagctacgagcacgtcatcgccctgtcggaaaccctgtaccggcgactggcgcccgactggtcgctgaacgacctgattggcgagccgctgctggtaccgaaggactcgctgtttcccgcctacagccagttcatgaacgatgcgatggatgccgccgccttcgcgccccggcgcagcgtgcggccgaacgacctgagcattctcctggcccaggtcgccagcggcgacggcttcgccttcctgccgttgtcgctgaccaagttcgcctatccgggggtggccttcaccgctctgccggcggcggtcaacgaaggcttccgcctgccggtggggctggcggtgtcgccgacttcgcggcttcgtgccagcgacacccagttcgaatgcttcgtcgagaccgcgcggcgggtcgccgccggttga

SEQ ID NO: 8513 - DNA, 1935 bp, Pseudomonas aeruginosa
  unsure (1473),(1537): Identity of nucleotide at the above locations are unknown.
gggacgcggccgggagcgccggccgcgcgaggggcttcagagggtcttcatgtactcgaccagggcgcggcgctgctgctcgttgaactgcgcgttgccgtagtcgtggccgccattggcgttgcccggcttgccgctgtcgaagaggaagcggttggcgccgccggcatcggtgatgtagccgacgttgaccgggtcgaactcgacgctgccggtatagaaggtccgcggcctcaggtccggcggcagcagcaggtcgtagagggtcgccaccgagccgttgtgcaggtagggcgggctggcccagataccgttcagcgggcgcgccttgtaggccatcaggtcgctggtcatcgccaggcactgctccaggcgccgggccttgtcgctgccggccgcgacgttttcggccaggagcagggcgcctggcgcgtccgcggcggtcgcttcgacgctgtcggcgtcggggctgtccggcaccggactgatcagcggcggcaactgcccgtcgaagatgcccagggcggcggtctggaaggcacccagggcgacgctcaggccgcgcgcggccagggcctggaccaccacttcctggagcacgtccaccgcataggcctgcttgccgtagaaaccgcgctggccggtgccgacgaaggacaggtagggcttgccgcgcacgtagccggtcttcagctgggcgatgctgttgcaggcggtccacgggtcggtgccgatcggcgcgacctcgccgcgcgcctgcaggtgggtgagcacggtcttcaccggggtccgcaggtcgttgcggtccagcggcgtgtggcagctggagcaatgttgccggtacagctcgcggccctcggcgaccctggtcggctccggggcgccgaacagctggttcggccaggccggcggcttcagttggccgagctggtcttcgatgcggatcaggttgtcgacgttgatgctcgacgggtagccgatgtgcagcgccgactggatcgggctgagcaccttgacgtcggcgaataccccgaccgcctcgccggcgttgcgcgccagggcgccgacgtcgaacttgcggttgtcgatctcgaccacgttgatgtggttcgggttgaagccggtccactgtacgcggtccagctgcggtacgttccacaggaacggatagctcacgggggcgtcctcggcgccgtagatctgctcgttggcatgcagttcgtagcccaccgagttgaagatcgaaccgatggcgtccaggcggcccgggccgaactcgggatcgtgcggcaggttgaagtgcgagccgtcgcgcaggcgcacgatggtggcgtccagggctgcctgcaggcgtgccttgttggcatcgttgtagccgctgaccaggccgtcggcgccgagcaccttgcgggcgaagcgctcgaacttggcggtgtcggcgcgggtgctctgcagggcgccgaggatctccanctggaagccggcgaggtcgcccatggtctgcccgccgtagacggtcagctgggtgccctggtanctgatgtgcgaagtgtggcacatgctgcaggtcggtccgacccagggttccctggagccctgcagggctttccagcgcagcttggtgaaggtcaggtcgctgtcgtcgctgcggtcgaccgcgtagccctgcaccaccttcacgctggaaccgccgagggtgtgcgggacatagccgtactggcggatcagcgcatcggacatcagcggttcttcgctggcgcgctgctccagcgccaccagccaggccagcggcagcatccgcgagccctggccggcttccagccaggcggtcttctgggtctggttccagccctggtcgaggtcgacgccgctgtcgtcggcgaatgccggggcaccggcgaggacggaaaggatggcaaggctgagtcgcgatag

SEQ ID NO: 8514 - DNA, 1239 bp, Pseudomonas aeruginosa
ggtcatcgggcggttctctctattgggcatgtgggcggggccggctcacagggtcttgaggtattcgagcagcgccaggcgctggctttcgtcgtactcgcgggcgaagtcgtggccggcgttggagttgccttccaggtgggtgtcgaaaaggaaggcgttgtccgggccgggcgcggtgaggtagccgacccggctcggatcgaactcgtggctgccggtgtagaaggtggccggccgttgctcctggggcagcagcaggtcgtacagcgacggcaccgaaccgttgtgcaggtagggtgcggtggcccagatgccgttcagcgggcgagcgatgtagccgaggaatggatgctcggtattcaggcagtagtccttgcgcgcactcttgtcggtggggacttcgccggcggcgaggctctgcgcctggctgtcggcaggggcggcgccggccagcagcaattgtccggcgggcaccgcttgcaggctgtcggagccgggcagggtctgctgcccggtgacgatggcgtggatgatctcggcgatgccgtcggccagctggcctttcttgccgagcatgatctggaacacctcggggacctgcatgtcggcgatcttcgaagtccgcccgacgatgccgacgccgctgggggtgccgagggacggtcggaacaggccgaagtagttgccgctggggctgctgaaggtgaaggtgttgcaggccatccacgggtcggtgccgatcggcgcgtcgtcgccatgggccttcaggcgcacctggcggaccttgatcggggtttgcaggtcgtcgcggccgatgctcgcatggcaggccgcgcagttctcctcgtagaggcgcttgccctgggccagcctggcgctgtccggggcgccgaacagctggctcggccaggccggcgccttgagcttgtggatcaggccctcgacacgggtcaggttgtccacgcggatgctcgatatatagccctccaggccggacagcggatggctgaccacgtcgccgtagtcgccctggaccacgccgatgtcgccggccaggtagccgaggtcgaagacctggccgttgaggtcgaggaccttgacgttgggcacgaatccgctggattgcagcttgtccatctgcaacgtgtgccacagtgccgggaagctggtcggcgcgtcggtcgggttcgcttgcagatggcgggcgccggagttgattgccgcgcggttgagtga

SEQ ID NO: 8515 - DNA, 1719 bp, Pseudomonas aeruginosa
ctggccggtggcgtcgaggcgccccgggccgggttgcaggtcggtcgcggacatgctcagcagggtgtcgatcagcgccgcgcgtttgaccagggcggccttcagcagctcgcggttggccgggctgtcctcgctgccgaggacgttgccggcgaagcgcgcgaacttgtcgccgtcgtcgctggtgcggcgcagcgcggcgagcacttcgtcgaagatcgcctggacgttggccagggtggcgccggcgtcgacggtcagttcgctgccgcggtaactgatgtcggtggagtggcagccggcgcaattcagcccgacccagggttcgctggacgactggcgggctttccagcgcaggcgggtgtcggagaactggctgtcgtcctgctggtcgagggcgaagccgcgcggcaggcgcagttcgccgccttgccagttgcgcaggggaaagccgaggcgccgggcgttgtcttcggagaacaggcgctcctcgctgtccggacgctccagcgcctgggcccaggccagcggcagcagccgcgaaccgagcgaggcgtcgtaccaggaggcgcgttgctcggcgttccagccttgctcgagctggatttcggtggcgacggcagggctgccggcggcggccagtgcggcggccagcaggacccgcgaaaaggtcggatgcatcgtgttcccctcatggctgacgacgtctgcgtccccacagggcagagcgatgcagtgcgctcgatggctgggcgtgccgccacttcgtccctgacgggagcgcgccggccgcggcgcgccgcgggccggaacgtccggttgggcactacgctacggagtcgcggcggccggcgggtaatgctttttgtgcgacggaaaaggtatgggaaacggaaccgcccggtccggaaagggcgcgccggtcgggcttcgccgtgcgcgccaggttcgcagggcggagagcgcctagggcgttgcccgttctatcggacaatccctgccgggcttgcggacgaagaccaggtagagtgcgctgagcagcgcgaggaacggcacgccgaagaccagggtcatgcggaacgcctcggtgaagaaggtggtgaccaggatcgccgccatcagcgccaggccgagcaatgtcgaccagggcgccaggcgcatgcggaaggccagcggcgcgccgccgtggcgggcgcggtggcggcggaagcagaggtgggtgaagaagatcatcagccaggtgaagagggcgccgaacatcgacaccgccatcatcagggtgaaggactgctcggggtagaccaggttgagcagggtcgccagggcgataccgacgctcgacagcagcagcgcgttcagcggcacgccctggcggctcagttcgccgaggcccttcggcgcgtgccccgcgcgcgacaggctgaacatcatccgggtggtgatgtagagctggctgttcatcgccgacagcgcggccaccagcaccacgaagttcatcaccccggtggcgccgggcaggccgatcgcctgcatcaccgtgacgaacgggctctggctctgcccggcctggtcccaggggacgatggcgagcatcagcgccagggtcagcaggtagaacaccaccaggcgcacgatggtcgagcggaacgccgacttcaccgcctgttccggatgctcggccttccgggcgggcggcgaccgcgatcatctccacgctga

SEQ ID NO: 8516 - DNA, 486 bp, Pseudomonas aeruginosa
gaattgcacatgtccctggacgccatcgatctgcgcattctccgtcacctgcagcaggacgggcggatgagcaaccaggacctggcggagaaggtctccctctcgccatccgcctgcctgcgccggctgcgcctgctggaaagcgaggggatcatccgcggctactcggtggaactggatgccgagcgactgggcgtggagctggaagccatcgtccatgtgtcgctgcgccaggacgtcgagggttggcacgaggcgttcatcgccagggtccgggactggccggaggtggtcaccgcctatgtggtgaccggcgccaccaactatgtgctacgggtccgggcgcgcaacctcaagcactattcggacttcatcgtgaacaaactgaaccgcgccgccggcgtcaccgatatccgctcggaaatcgtcctgcaggagatcaaggccggtgccgacctgctcgacctggtgaacctgaagagttga

SEQ ID NO: 8517 - DNA, 1278 bp, Pseudomonas aeruginosa
gcggtgagtgaatatatcgagaccgacgacgcaagttacttccgggtcaggcgccaggcctatgtttccgcggaactgcaccggcgcgaactgcacgagatattcgacgacagctggctgtatgccgcccacctcagcgaactgcgcgagcccggcgacttcatcacccgcgacgtcggcgggcgcaacctgatcatccagcgtcgcgccgatggcgagccggcggtctacctgaacgcctgcgcgcaccgtggggccaaggtctgcgccgagcgccagggcaacagccagcgtttcacctgtccctaccatggctggacctacgacagccacggcagcctgatcggtctgccggacaaggccgcctaccagcatgccgggcaatgccatccggagctgtccctgacacgggtgaaacacgcggtctaccgcaacttcctgttcatccactacgccgcccggcaaccgtccctggaaacctacctgggccaggcgaaggactatatcgacctgatctgcgaccagtccgaggcggaactggagatcatccccggcggcttcgagcattcgatcaaggccaactggaagctgctcgcggaaaacggcgtggacgcctaccacctgccgttcgcccacaagcgctacctggaatacctgaataccctcggcaccgatccggagtcgcacaagcgccacggtcgcggcgaggcgctgggcaacggccacgcgctgatcatcagcggcccgccgtccaccggacggccgatcgcctactggagcccgttgttcccggaagcgctcaagccgtccatcgccgccaagttcgaacgcctggtggaacgcttcgggcaggcgcgggcagaggacatcgcccacaccaacaaaagcctgttcatctttcccaacctagtgatcaacgacatcctcggcctgaacatccgctcgttcttcccgaccgccgccgatgaggtcagcgtcaccgtatggggcgccggcttcgccgatgagacccgcgaggagcgggcggcgcggatcaatgggttgatctcgttcatcggcccgggcggtttcggcacccccgacgacgtcgagatcctcgaatcctgtcagcgcgcctacgcccacgccgccctcggctacagcgatttttcccgcggcatgggaccggcaacccgccgccacgtcgacgaggagcagaaccgcggcttctggcgcgagtggagccgccggctcgggcagcagcccgccgccctgcggcttctcgccgtggccgtctga

SEQ ID NO: 8518 - DNA, 1920 bp, Pseudomonas aeruginosa
gccgtcttcaaccatcgctccctgcagatccctgcgcgccgccctggctacgcggggaataaagggtcactgcaaggaacgtcatccatgtgtggaatcaccggctggaccgactggagccgcgacctcggcgagcagcgcagcatcctcgaacgcatgacccgtaccctggccccgcgcgggccggacgccgaaggcctgtggctgtcgcggcacgcgctgctcggccatcggcgcctggcgatcatcgacctggagaacggcgctcaaccgatgcttgccgaggctggcgggcgggtggcgctgacctacagcggcgaggtctacaacttccgcgagctgcgcgccgagctggagacgctgggccaggtcttccgcacccgctcggacaccgaagtggtgctgcgcgcctatctgcaatggggcgaggcttccttcgcccggctccgcggcatctacggcttcgccctgtgggacgagcgcgagcagagcctgtggctggtgcgcgatcgcttcggggtcaagccgctgtactactacccgaccgccggaggcgtgctgttcgcctcggaacccaaggcgatcttcgccaaccccgaggccaacccggtgctcgacgccagcggcatcgccgagctgttcgccctgaccaccgcgccgactcccggccacggcctgtacaagggcctgcgccaggtccggccgggccaggcgctgcgcttcgaccgcaatggtgtgcgcgagttggtctactgggcgctgcgcgcggaacgtcacgaagagggcgccgaggacagcgccgaacgcgccggccagttgctccgcgaggcggtggccgagcaactggtggccgacgtcccgctgggcagcctgctttccggcgggctcgactccagcgccatcagtgccttcgcggtggccgcgctggatggcgacgcgcggcgcctgccgaccttctccgtggacttccccggcgaaggccgcggcttcgtcccgacgccctggcaaagcagctgggacgaaccctatgcgcagctggcggcgaacttcctcggtacgccgcaccgtaccgtgctggtcgccccggaagaggtgctggaacaggacgaggcggtgctccaggcccgcgacctgcccggctggggcgagctggacgcctcgctctacctgctgttccgccaggtccgcgagcacaccacggtggcactgtcgggcgagtcggccgacgaggtgttcggcggctacccgttcttccacgacccgagcgccctcgcacacgacggcttcccctggctggccggcaagagcgggccctggcaactgctgcggcgggaggtcgccgaacgggtggcggcgccggaatacatccgggcgcgctaccgcgaggccctcgccgaagtgccgcggctggatggcgaggatgccgcccagcgacgccagcgcgaggtcgcctacctggcgctgagccgctggctgccggcgatgctcgaacgcaaggaccggatgagcatggcggtcggcctggaagtgcgcgtgccgttctgcgaccaccgcctggtggagtacgtatggaacctgccctgggcgctgaagagcgtcgccggggaaagcaagagcctgctgcgccgggccctgcgcgggcacctgccgcaggcgatcctggagcggcgcaagagcggtttcccggccaaccccgacccacgttacctggcgctgctgcgcgagcgggtcggccgcctgctcgacgacggccgctcgccgctgttcgaactggtggacgccgggcgggtccgccaggctctcgaacagggcacgccgctgcccagcccgcgtgcctcggcgagcccgaccgccggcctggcctacctgctgaacctggaccgctggctgacccgccatggggtcgacatcagcctctga

SEQ ID NO: 8519 - DNA, 522 bp, Pseudomonas aeruginosa
cggaggatactcatgagccttgccttgtcccgtcccgacagcgacctgctggcgcgggtcagcgatttcctcgtcgccgaagccgagctgctcgacgaccgcctgctggatacctggttcgcgctgttcgagcgcgccgcacgctaccgggtgctgcccttacaggagcaactggccggccaggcgccggaggacagcctgtacatcatcgacgacgaccacgtgcgcctgcgcgagcgggtcgacagcatcctcggcgggcatacctggatggagcagccgcgctcgcgcacccgccgcctggtgggcaacgtgcggctgaagcgggtcgagggcgaactggtcagcagccgcagcaacttcgtcgtccatcagttccgcaaccgcgaggcctggaacttcgtcggcgaagccagtcatgtcctgcgcgacggtcccgagggcttgcgcatcgtctcgcgggagatccgcctggaccacgagaccatcagcgcccagcggcgcatcagcatcattctgtga

SEQ ID NO: 8520 - DNA, 1566 bp, Pseudomonas aeruginosa
ggcgccgcccatgagcaccgatccgttgctgcccggcttcgactacctgaccctgcacacctccgccgcgcgcctccgcgtcgccgtgaagggcagcggcccgccgctgctgctgttgcatggctatccgcagacccacctggcctggcatcgcatcgctccgcgcctggccgaggactacagcgtggtcctcgccgacctgcgcggctatggcgaatcgcgggcgctggacgaggagggcgccgactattccaaggccgcgctggcccgcgaccaactggaaacgatgggccagctaggcttcgaacgcttcgcggtgatcggccacgaccgcggcgcgcgggtcggctatcgcctggcgctggaccatccgcaagcggtcgcggccttcgtctcgctgaccgtggtgccgatcctcgacaactgggccgcggtgaacaaggccttcgccctcaacgcctatcactggttcctcctcgcccagccgtacgacctgccggagcgcctgatcggcgccgatccggagcacttcctcgactacaccctgcgacgcatggcccagggccgcgacatctaccacccgcaggcgctggaaagttaccgccgggcgttccgcgaccccgccgtgcgccatgcgatgtgcgaggactaccgggccgcggtgggcgtcgatgccgacgccgaccaggccgatcgcgacgccggccggcgcctgcaatgcccggtccaggtgctctggcaggagcgcccctacgccgccgggcagcatccgctggaaatctggaagacctgggccgggcaggtcgagggcgccgccatcggcgccagccacatgcttcccgaggacgtgccggacgccgtgctggagcacctgctggggtttctcgccagccaccgggaggcgctccgatgagcgccgtcgaacgcgatccggcggcgcaggcgacgctctggcgacagcgggtgttcgaggtgcacgcggcgatgtccgcctacgtcgccgagcgccatcggcgtgaagacctgggggactgggtggcgaccagcgcgcggatattcgccgatctgccggcgaccgacgacctgcgcgccgaagcctggcaggcggtgttcttccgcgcccaggcgctgatcgaacagttcatcgtcgcgcgcccggcggattaccggctcgacgactgggcgcgcgccaccgcgcggatctatcgcgcgctggaaccggcggggcggggcgatccggccagcgccgccgaccgtctggcacgccaggccgcgctctacggttcgcgtttcgaggtgcaggccgaggctgacgggcgcgcggtattccacaaccgtcactgcgcgatctgggactaccgcgagcgcgcccgcgcccgaggcgtgccgatcaccctggagtcggcctgcacctattgcaccaagctgctgtcggcgttcgtcgccgccagcgattgccgcgccgactggcggctctacgaagagccgcaaggccacggctgcgtatggaccatcacggcggacagcctcaaccaaggagcaggcgtacatgaacgcgatcattga

SEQ ID NO: 8521 - DNA, 519 bp, Pseudomonas aeruginosa
agagcggctgttccggtgggtcgcgcggcacctcgaggcgcagggggtattcctgttcacctcgcaccatccgttcgccgaggatggcctcggcggcgaggacgacctggtcgcccaggccctggtcgagatgggcctggctgcgccggaacgggtggcggcgctctacgcggaagccgggctgctgccgatgggcacccgcacccgtggccgggaggcgttgcgcgaacgcgtcgaacgacacttccgggtcgactccatcgtctcccgcccggcggtcctgcgtgtcgccgactccgccgaataccagcgtttccacgccgccaccttcggcacctatttcgcaccgctggtgccggcgacgcgcctggaggaattcttcgtccgcctcgggcggatcgccgagcggcgcatgcaggccgacggacaggtcagcgaaatcccggtcagtgtctggcgctgccgggctcgggagggcgaggcataaccttatgcgcaatcggtctgccgcgcggctga

SEQ ID NO: 8522 - DNA, 486 bp, Pseudomonas aeruginosa
atttctcctggggcctggagcagcgccgcgagctctacgaggtcgaggccggcgatccctggtcctactacaacggcggttccaaggcactccccgggcaggcgccggccaccgccggacagtggagccgcgacgtgctcggcgcctatctcgacctgtccatcgccctcgacgagcgctggcaactggagacggcggcgcgctacgagcactacagcgacttcggcagcaccaccaacggcaagctcgccagccgctaccgcttcagccccgaggtatcggcgcgggccagtctcagcagcggcttccgcgcgccgtcgctggcccaggagaactacacaagcctgggcgtctcgccgaccatcgccagcggcctgctggcggtcaactcgccggcggccaggctgctcggcgccgaagacctggagccggaaaaatcgatcagctacaacctcggcctggtgctcgatcccttgccggacctga

SEQ ID NO: 8523 - DNA, 1179 bp, Pseudomonas aeruginosa
cccgctgaagggctggctggtggatcgctggggcgcgcgcgccctggtcctgccgctgaccgccgcgctggccctgtgcctggccagcctggcgctggcgcgcagcggctggcagctatacctgctgttcgcgctgctcggcctgctgacgccgggcaacattccctatgcgcggattctcggcggctggttcgagcgtcgtcgcggcgcggcctacggcatcctcggactcggcttcggcgtcggcgggccgctggcgctgtacctgggcagcgcctgcatcgacgccttcggctggcgcgccaccttcctcgtctatggcctgctcgaaggcctcctggcgctgccgctgctctatgcgttgttccgcgagcgacccggcgacctgccgcaggcgcggcgcccgccagccgacgcgctgcccggagcgacgccaggccaggcctggcgctcggcggacttctggctgatcgtcggcaacctgatcctcggcgtgttcgccgtcactggcgtgatggtgcatggcgtgccgctgttgcaggagcgcggcctgtcgcgggaagtcgccaccgacgtgctggcggcgctgtgggtcggcatgatcgtttcgcaaccggcgctgggctacctgctggaccgctacgacaccccgcgcatcgccttgccgttcgccctgctggcggcgctcgggctgctgctcctgctccttggcggaccgccggcgctgctctggggcgcggtgttcctgatcggcctgggcgccggcggcgagaccggcaccacccagtacttcgtcagccgctacttcggcctgcgccatttcagcgtgatctatggctcgatccagcccttcaccttcgccatcgccatcagcctggggtcctggctgctgggttacttctacgaccgcgcgggctcctacgcgggctcgacgctggtcctgctcggcgcgttcggcgtggcggcagggctgctggtcatgctcgggcgctatcgctacgccatcgacggggaggcacgcagccatgggcgagactgaacggagcagggcggaggtcggcgtctggctgctggccggactggccttcgtggtcggcacggtggaactggtggtggccggggtgctcgacgaactggccgccagtttcgccgtcagccagggccgggccgggttgctga

SEQ ID NO: 8524 - DNA, 1149 bp, Pseudomonas aeruginosa
ccggccagttcaccgtctacacctacatcgtgccgttcctggtcggcagcatggccctcgacaaaccgaccatcagcctggtcctgctggtctacgggggcggcggcatcctcggcgcgctgctcggcggacgcgccgccgaccgctggccggggccggccaccttcgtcgccttcctgctcctgcacgcactggccctggtcctgctgccgttcgccaccggcggcctgccgctgctgctgggcgcggtggtgttctggtgcgtgttcaacatggcgccggggccggcgatccagaaatacctggtggaactcagcccggacaccgcggcgatccagatcagcctcaacaccagcgcgatccagctcggcgtggccctgggcgccttcatcggcgcgatcctggtggatcaggtggcggtgcgcgcgctccccctgggggggcgccgcgctgatcctctgcgccccccgcctgcggctggctgtccgcgcagcggccggcgggcagggcggactgcggggagcgcctcgattgattccctaccgcgcggccacgggaacagccccgggggccgttcctcaacctccaggctcactaccgctatccgtggcgtggcctgcccagcagcgaacgcttaccatggatagccaaggctccatcaagaacaccctgatcgcccagttgttccagcagaactacgactggctgtgcaagaagctgtcctaccagaccggctgtagccacagcgccgaagacctcgccgccgaggccttcctgcaggtctggatgctccccgacccggcgtcgatccgctcgccgcgggcgttcctcgcgaccatcgcgcaacgcctgatgtacgagagctggcggcgcaaggacctggagcgcgcctacctgcagatcctcgccgaggcgccggaggcggtgcagccgtcgcctcacgagcagtggatgctgatcgagagcctgcaagccatcgaccgcctgctcgacggcctgtccgggcaggccagggcagtgttcctgatgagccagctggaaggcctgacctacgtgcagatcggcgaacgcctcggattgtccctggggcgcatccaccagttgatgaaggatgccttgcactgctgctaccggggattccaggaatga

SEQ ID NO: 8525 - DNA, 1245 bp, Pseudomonas aeruginosa
ccaccggcgagggacgccagctggcggtggcggcacgacgtagcctgctgttcgatgccggcggcctgctcgaacagggcccgatgcaggccggagaggatgcctgggccagcggctggctggaggtccacgaccgctccctggcctgggtcgcggaggccttccggccctatctgccaggcatcctccagctcgacgcggagatcgccggcaaccgcgtcagcggtctgttcccgctggacgacatgcacacgtccctggacatgctcggacgcagcctgccgatccgcgtgctgcgctacagcgactactggatcagcctgcgccccgcctgactcattcgtcgaagaacagcaggcaacgcagttcgatactctgccgcggcggcgcatcggccggggtgcagggatcgtcgaaggcggtgtgcgcgccgaggcgggcctgcgcgtcctcccgcgaatcgtagatcttcagcagcagcgcttcctccggcagcaggtgcgggtagtagtaccagcggtgctccgggttgggcttgaccgagtaggtttcgcccaccttgtcgcggtacaccaggtcactggccaccaggtcgtcgaacgccaggctgcgggcgtccagcaacgccagcggcgcgcgctgcgccgggtggccgaacggacgccacaggttgacgatctggaagcgtccggccaggcgccgttcggcgcgttccgccggcaggtggtcgcggacccggcgcggcgccgagcgcagggtctggtcgttgtgcacgtagcgcaccggttcgcgcaggccgcgttcttcgcgcccggcctggtcgacgcgcagcgtgtggtcgaagatcaccgcctcggcggcgccggtcaggcggcggagcagggcgatgctttccgggtagtagcgttcacgaacctgggcttcatcctcgaaatcgcccaccgcgctcgcctcgcgcaccagttggaaaccctcgcgctccaggctggccggttgcgccagcagacgcgcattgcggatcgccacccgggtcggctgcaacagcgcgctgtgctgcggcgtcccggcgggggccggataggtgtaggcgaccggccgttggccgttgtcgcggatatagttgacttcggcctcgacctgctccggcgcgtgcgccggccatgcgtgttgctggcaacccatgtgtcgttctcccgttgccagcggagatgcctccgctgccgcgccgccggatgccgcgcgtga

SEQ ID NO: 8526 - DNA, 1056 bp, Pseudomonas aeruginosa
gatgctgccatccgccgctgggcggaatcgcgccggacggcgtggcaagcaacaaacgggagcacaacaatgcacaacgagtcccgccctgaagcccccttgcgggtgctggtggtcggcgccggcttcgccggtctcggcttggcgatccgcctgcgacaggcaggcatcgacgattatctggtcctggaaaaggccgccgatgtcggcggttgctggcgggaaaaccgctacccgggcgccgcctgcgacgtcccctcgcatctctattcgttttccttcgagccgaaggccgactggtcgcgcaagttcgccccgcaggcggaaatcctcgactacctgcggcattgcgcggacaagtaccgtctgcgcgagaagatccgtttccactgcgaggtggaggaggcccgtttcgacgccggcagcggcgaatggcaggtgcgctgcgccgatggccagacgctgcgcgcacgggccctggtctgcgccaccggccagttgagccggccgctgctgccgcgcctgcccggcctggagcgcttccagggtccggcgttccactcggcgaactgggacgccgaggtcgagctggccggcaagcgggtcgcggtgatcggcaccggagcccagcgccatccagttcgtcccgcggatcgccccgcaggtgcaacgcctgtcgctgttccagcgcagcgcgccttacgtgatcgccaagccggaccgcacctacgccgactgggaacgccgcctgaaggcgcgctggccgtggctgcaacgcctggatcgggggctcaagtacctgcaccacgaatcgcggatgctcgccttcgcgaccttcccggcgctgatgaaggtgatgcggctgagcttccatcgtcacctgcaccggcagatcgccgatccgcaactgcgcgcgcggctggttcccgactacccgctgggttgcaagcgcatcctgatcagcaacgactattacccggcgctggccaggagcaatgtcgaactggtcgacacgggcattcgcgaagtcaccgaagacgccgtggtcggccgtga

SEQ ID NO: 8527 - DNA, 1200 bp, Pseudomonas aeruginosa
aggcgcgcggcttgccgttgccggccgggttgctgctgttctcgccctggaccgacctcggctgccagcgcctgcacacgccggcggccggcgacccgctgctgtcgcgggcctggctggaaagcgcggtgcgcctgctgctgccggccgacgcggagccaggctcggccgccttgtcgccgctgcatgccgacctggcggggctgccgccgctgctggtacaggtcggcgaggacgaactgctgcgcgacgacagcctgcgcctggcgcaacgggccggtgagcagggcgtcgcggtgcgattgcagcgctacgccggttgctggcacgtgttccaggcccatgccggcgtgttggccagcgccgaccgggcgttggacgaggcggccgcgttcgtcgtcgaatgcagcgtggagggcgataggtgcagaacatcctgatcagtggtgccgcttccggaatcggcgccgccagcgcgcggctgttccaccgccggggctggcgggtcggtttgctggacatcgatgccgaggcgttgcgcggcttggccgcgcaactgccaggcgcctggcaccgcgccgtggacgtcagcgagcccgacgcggtcggcgaggcgcttgcgcagttctgtgccgatggccgcctgcgcctgctgttcaactgcgccggcgtcctgcgtttcggccgcttcgaagaggtcgccctggaggaccacgcgcggttgctggcgatcaacctgcatggcgtcctcaactgctgtcacgcggcctttccgttcctgcgcgcgacgccgcaggcgcaggtgctcaacatgggctcggcatcggggctgtatggcgtaccggagatggccgtctactcggcctcgaagttcgccgtgcgcgggcttaccgaggcgctggagctggaatggcgccgccacggtattcgtgtggccgacctgattccgccgttcgttcgcacgccgatggtcgccgggcaggcctaccagccgccggtgttgcgtcgcctggggctgagactggacgccgaggatatcgccgaagcggcctggcggcaggcgcacagccggcgggtacaccggccggtgggcgggttgttcacggcgctgtaccgggctgggcagttgtctccgccgtgggtgaaccgagcggtgatggcgtggttgtcgcggggttaggctctgcgcaggatggatag

SEQ ID NO: 8528 - DNA, 537 bp, Pseudomonas aeruginosa
ttggcttcaccgtgctcctattggctggatttgccatcaccaagcttcccatcgagaagctgctcggcaggaggtgacatgaatacgaacgtgttgaccgagcatgcattgagcgtgatctacagacacgcctgcaggacctatccaagggaatgctgcggattcgttctcgccgatgcaaaagtgaaagagggtacgaacatccaggatgaactgcacatggctgacccccggaggtacccacgcacggccgccaacgggtacacgttttccgtgacggataccgtattcctcaacagcagcttcaagacgtgcagcccggtatccgtcatctaccactcccacccggacgtcggtgcctacttcagccgggaggatatcgacaaggcattgtatgccggggagccaatgctgccggtcgactacctggttgttgatgtggccgccggcaacgttcgcggcgcaaaactgtttgcctggcgcaacggacgctttgaatgcacacgagagttcgggccatcgagccaggacgagtag

SEQ ID NO: 8529 - DNA, 819 bp, Pseudomonas aeruginosa
actacaggtcatccgaggcccccacatagttcagcaactacagccggcagccacgcagacccaaattcaaccaatggaggcatcatgacgcagaccgcctccctttttctccaggactcctaccgggaagagtgtttggcgagaatcaccgatctcgttgaagatggcctgctgctcgaccagaccgttttctatccccagggggggggccaggctggagacagtggttggctgacgctggctgatggcacgcggctccggatcgccgatacacgcaaggggacagaagcaggtgctggcagggatgccatcctgcatatcccagctgaaggccaggcaaccgttctccgagcaatgaagcctggcgaggtggttcttgcgcagatcgattgggtgcgtcgttaccggcacatgcgactgcataccgcagcgcacatgctctgtgctgtcctgccctatccggtcaatgggtgcagcatcactgatgagcatgcgcgcctggacttcgtgacgagtgaaccgctgtcccgcgaggccattgatagcgccttggcggcaatggtcgaggcagcacatccggtttcgatcgacaccatgagcgacgatgcactgcgggctaggccagatctggtgcgcaccatgagtgtccaacctccgatgggcgccgggcaggttcggttggtgagtattaaagacaccgacctgcagccttgcggtggaacccatgtggcgaataccgaaaaagttggggtggtgcgcgtttccaaaatggagaaaaaatcagcgcgcacccgtagggtggtactggtactgggttga

SEQ ID NO: 8530 - DNA, 2754 bp, Pseudomonas aeruginosa
gcgactaccgtcgacatggccgtcggtttcccattctacgccacaggtcaccctcgccacgcccggcagctccatgcaatgccagagggcctcaggccggcaacaacggccgacaggcctcgacgaagcgccggcaggcacccgcacattcgcgctccagcggctcgtcgccatcgcaacgctccgcgcatgccagggcatagcgcgccgccagctcgcaggcggccggcgcccatgggctgcggcgctccagcagcagagcggcgaggcggcagatgtcggcgcactcgccggcgtgctggcgttgttccctgctggactcggtgcaaaacgccaggtagcgctcgcacgcgccggatgcattcctgggacgcgggcccggcagggctttatccgggcgcttcggacggcggcaccgccgagccggggggtcggcgttcggtttcccagcagggacccggggtcttcgtttcccggaatcttgatggcgggggtcatggcggcaacctcctggggaagggcccatgcggggccctgttcctgggcccggtcgagaatccgacagttcagtcgatttcgccgtcggcaccgccggtcgattgccttgaaacccttgccccgcggcgccagtcctcactggtacgaccccagacacgaccaggaggcgagaatgtccagcacggttgccgatcaattgctcgaacgcttgagccagtggggggtgaagcgcgtcttcggctacccaggcgatggcatcaacgggatcatgggcgccatgggccggcgcgccgaggcattcgactatatccgcgtgcgccacgaggagatggcggccttcatggccggcgcccacgccaagttcaccggagaggtcggggtgtgcctcgccacctcggggccgggcgcgatccacctgctgaacgggctctacgacgcgcgcatggatcatcagccggtgctggccatcgtcggccagcaggcggctaccgcgttgggcagcgactaccagcaggaagtcgatctgcagagcttgttcaaggacgtttccgcctatgtcgagaccgtggtcagcccggcacaactgctccatgtgctggaccgagccctgcgcgtggcggtcggcgagcggcaggtggcgacggtgatcgtgcccaacgacgtgcaacagatggcggccccgaagcgccagccccacgagcacggccacgtgatgtcggcggtgggcttcgtccagccgcgaccctacgcgcgcgacgccgacctggaggccgccgcggcgatcctcaatcgcggccggcgcgtggcgatcctcgccggtgccggcgccctgggcgcgcaccggcaactggaagcggtcgccgagcgcctggccgccggagtggccaaggcgctcctgggcaaggcggcggtttccgacgacctgccgtacgtgaccggctccatcggcctgctcggcacccgcgccagcagcatgctgatggagcattgcgacaccctgctgatcgtcggcagcactttcccctacagcgagttcctacccaaggccggccaggcgcgggcggtgcagatcgacctgtatccgcgcaacatcggtatccgctatccgatcgaccaggccttgctcggcgatgcaggggaaaccctggagcgcctgctgccgctgctcgagcagaaaaagcacggcgcctggcgccgccgggtcgagcgggcggtgacggccagtcgcgaggaagcccggcgccaggccgaagagccagccgacccgatcaacccgcagcgggtattccgttccttgtcggagcaactgccggacgatgcgattctctgcggcgacagcggctcgcataccaactggtacgcccgcgacatccgcatgcgcccgggcatgctcggctcgctgtcgggcaagctggcgaccatgggcagcggcgtgccctacgccatcgccgccaagctcgcctatccgcagcggccggtggtggcgatggtcggcgacggcgccatgcagatgaacggcaacgccgaactggtcaccgtgcagcagtactggcagcgctgggactcgccgaccttcatcgtgctggtgctgaacaacggcgatctcaaccaggtgacctgggagcagcgtgccctggccggcgacccggagttcagcccggcgcaggaagtgatcgatttcccctacgcgcgttatgcggacatgctcggcttcaagggcatccgcgtggatcgcccggaggacatcgacgccgcctgggccgaggccttcgccgccgaccgcccggtgctgctggaggtggtcaccgacccgaacgtgccgccgctgccgccgcacatcagtttcgagcaggccaagcacctgcttggcgccatgctgcaggacgatcccaagcgctggggggtgattcgccagagcgcccggcaggtcctcgcgcggcactgagcaaggcggtcgcggcgctcagtcggcgcggccgctacgcaactggtcggccagttcgcggtggtggtagaagcgcgccagccattcgtcggcgaagcggcgcaggtcaggatcggcggagtcccgggcgattccctcgaagcgtgcgaccagacggtcctgctggcgaatctgcgcgtcgaggaaaccgcgctcgtcgaagccgccgggagcggcggcctgccgttcggtctggcgcggcgagggcagcgccaaggccttttccccggccagggcgcgcaactgatggtcgaactcctgctgttcggtga

SEQ ID NO: 8531 - DNA, 741 bp, Pseudomonas aeruginosa
cccggcttaccggcatcgaccgcaagacggtcaagggctaccgggagcggtggctggccgaaggagcaaattcccccggggtggccaccggctctgaagtggccgtggccacccccggccagcaaactcccccaccctggccaccggctggcatgccggtggccaccagtcggtgtgagccccaccgcgacttcatcgaggcccaggtccggctgggccgcaacggtgtggcgatctaccaggacctggtcgaccagcacggctttgccggcgcctacaactcggtcaagcgcttcgtggccaagttgcggcacgaggagcccgagcggttcgaccggctgtcgttcctgcccggcgaggagatgcaggtggactacggcgagggggcgccgacgcgggtgccggggacggaccgctaccgcaagccccggctgttcgtggccacgctgcgctactcgcggcgcagtttccggcgcgtggtctggaagtccagccagcaggtgtgggcagaactgcacgagcaggcctggcgctacttcggcggctcgtgccgctacgtggtgctggacaacctcaaggagggcgtgctcaagcccgacctgtacgagcccgagctcaacccggtgtttgccgccacgctggcgcactacgaggtggtggccgacccggccagggtcagggacccgaaccgcaagggcaccgtggagagcgccattggccacacccaggccacggcgctga

SEQ ID NO: 8532 - DNA, 453 bp, Pseudomonas aeruginosa
cgcccgcccgtcaagcgctccgcgagtgacgacgtcacgccgggaatgcccttggcgacctgctcgacctctgcagcgatgcgatcgatcacgcccaggtcgttgccggtcaccttcaccccgatcgggctcttgatgccggtagccagcatatcgatgcgattgcggatagggggaatccagatattggacaggcccgggatcttcacggcacgatccagctcttccacgagcttctcgggcgtcatgcctggacgccattgttccctgggcttgagcttaaccgtggtctcgaacatctccaggggcgccggatcggtcgcagtttcggcccgtcctgccttgccgaacaccttgtccacttcaggtacggtcttgatcatgcggttgctcagctgcagcaactccgtggcgcgctgcgccgagagtcccggcagggccgagggcatgtag

SEQ ID NO: 8533 - DNA, 546 bp, Pseudomonas aeruginosa
agttcgttcagcggaacttgcttgtgcgcaagaagcgagtgccgcgctggcacggcgatcacaatcgggtctcgccagatcggttcagccacgatgccttcgccaacatccgccgcgtgtgcaaatccgatcgtgaagtcgccagaccgtaggccccgtatctgctcggtcagcggtacctcggagagacgtatctcgacctcgggctcttccgcgcggcaacgagctaggaacgccgatagtcgtgggtccatcgcaccatcggaaattgcaatgcgcaggctgcccctcaggcccgcggcaatggctctggcattttcacgcgcttgctccaggacagtgaagagtcggcgggtgtcctgcaagaatgccgcccccgccacggtcagccgtgtgcccctgcggtcgcggtcaaacagcgtgaccccaagctcatcttccaattccttgatcgcgcgagacaaggggggttgctctatatgcagcctctcggccgcccgcgtgaaatgcaactcctctgccaagacgacaaagcatcgtagatga

SEQ ID NO: 8534 - DNA, 609 bp, Pseudomonas aeruginosa
aggaaggcgaacatgaggttctgcttcatgttgcgcacggtactcaccgagagcgtgcgagcgacagcgatgccacgcaggtcacccttgaccagcgtgacctgggcgctgttcatcgccacgtcggttcccgttcccatggcgatgcccacgtctgccttcgccaaggccggcgcgtcgttgatgccgtctccggccatggcgacgatgcgtccttctttctgcagtcgctcgatcaacatgagcttgtccgccggcttgacctcaccatgcacctcgtcgatgcctaggcgtgcaccgacggctttggcggtggtctgcccgtccccggtggccatgatgacccgcaggcccgcagccttcaacgcggccagggcctcgggggtgctgcccttgaccggatcggacacggcgagcaagcccgcgagctgcccgtccaccgccaggtacatgacgctggccccttcgccgcgcagagcttcggcctggggtacgagcggttccaccgatacgccagactgttccatcagcactgtgttgcccaacgccagttgccggtgctcaacctttccgcgcacgccgatgccggttcccgattcaaagctctga

SEQ ID NO: 8535 - DNA, 213 bp, Pseudomonas aeruginosa
tcgaaagcaggtcggccttcggtcagggttcctgtcttgtcgatgacgagggtatcgaccttgcgaagattctcgatcgccgcggcatcgcggaacagcacgccctgcgtggcgccacggcccgttgcgaccatgatcgacatcggcgtggccagacccagcgcgcacgggcaggcgatgatcaggacggccaccgcattgatcagtccatag

SEQ ID NO: 8536 - DNA, 537 bp, Pseudomonas aeruginosa
ccggcaacgacatcggccatgcgttgcatcggtgccttggaacgctgcgcctgggcgaccatctggacgatctgcgatagaacggtgtccgagccgatccgctccgaacgcatgaccagcgcgccgctggtgttgagtgtggccccgatgaccttgtcgcccacgcgcttgctgacgggcagcggttcgccggtcagcatggattcgtcaatcgagctgctgccctcgtgcacgatgccatccaccggcaccttctcgccgggtcggatgcgcagcaggtcgccgacgtgcacatggctgagtggcacgtcttcctcgctgccgtccgcattgatgcgccgcgccgtcttgggtgccagccccagcagcgacttgatggctgccgaagtctgggagcgggccttgagttccagcacctggccgagcagtgtcagcgagatgatgacggcggcggcctcgaaatacacgccgacccgtcccatggacatgaaggaagctggaaacacttccggcgcaacggttgccacaacgctgtag

SEQ ID NO: 8537 - DNA, 735 bp, Pseudomonas aeruginosa
gcggctatttttccgcgccgtagcgatttcatgggacatgcgatgaaactgctggtcgttgaagacgagaacaagacggcggattacgtccgccaaggtctcatggaggcgggattcgtcgtggatctggcgcgcaacggattggacggacaccacctggccatgggcgagacatacgatctggtggtcttggatgtcatgctgccggatgtcgatggctggcgcatcgtgcgtgcccttcgagatgccggtaaacaggtccctgtgctctttctgacggcgcgtggcggtgtagacgaccgtgtcaagggattggaactgggagcggacgactacctcgtcaagccattcgcgttctctgagttgctggcgcgggtgcggacgctgctgcgacgcggaagcgctccgagccagcctgatcgcatccaggttgccgatttggtgctggacttggcgcgccggcgcgcaacgcgcgctggccaacgcatcaatctcaccagcaaggagttcgcgttgcttgagctcctggcccgtcgccagggggaggtccttccacggtctctgatcgcgtcgcaggtatgggacatgaatttcgacagcgacagcaacgtcatcgatgtagccatccgccgtctacgcgcgaagatagacgatgcgttcaatccgaagctcatccacaccgtgcgtggaatgggatacacgctcgatgcgcccgatgatgcccctgcgccataa

SEQ ID NO: 8538 - DNA, 420 bp, Pseudomonas aeruginosa
tgttcggcgcagcgccagcgtagtcaccgtgaactggcccctggaagatgcagcgtcatgtgcagcgtggctgcgcgactggctccgatgatccgcattgatgcgctgtggctctccaccgagccgctggacatgcgagcaggcaccgagacggcgctcgcccgggtagtggctgtctttggcgcagcgcgcccacaccacgcctatctgttcgccaatcgacgagccaaccgcatgaaggtgctggtgcacgacggcatcggtgtctggctggcggcccggcgcctgaatagcggcaagttcgtctggccgcgcgatgccgccaccaccgccacactcagccgaacgcagttcgatgcgctcgtgctgggcctgccctggaagaacgtcggcgaggctggagtcatcactgtactttga

SEQ ID NO: 8539 - DNA, 477 bp, Pseudomonas aeruginosa; identical to SEQ ID NO: 6502

SEQ ID NO: 8540 - DNA, 312 bp, Pseudomonas aeruginosa
tcggagttcaccatgaaaacgcaagtttcggcgcaagccaaaaaactgtttgcctccctcgccctcgccgccattgttgcccccgtgtgggccgccactcagaccgtcacgctgtccgtaccgggcatgacctgctccgcctgcccgatcaccgtcaagaaggcgatttccaaggtcgaaggcgtcagcaaggttgacgtgaccttcgagacccgcgaagcggttgtcactttcgatgatgccaagaccagcgtccagaagctcaccaaagcaaccaccgatgcgggctatccctccagcgtcaagcagtga

SEQ ID NO: 8541 - DNA, 408 bp, Pseudomonas aeruginosa
accactgaacccgaacctggggcgctcggcagcgttgtttccgcgatgggttgcgccgcgtgctttccggccatcgccagcttgggcgcggccatcggcctgggctttctacaggaatacgaaggattgttcatctccaagctgctgccgctgttcgctgtcgtggctttgctggcgaacgcattgggctggctcagtcatcgccaatggcaccgcagtctgctcggcatgatcgggccagccatcgtgttcgccggaactgtctggctgcttggcaactggtgggcagcacacctcgtatacaccggcctggcgctgatggtcggcgtgtcgatctgggacttggtttcgccggcaaatcgccgttgcggcccggacggttgcgaacttcccacgaaacaaggctga

SEQ ID NO: 8542 - DNA, 1737 bp, Pseudomonas aeruginosa
cggcgggagccggcagccaatacagaaaaggaacgattaatgaccaccctcaaaattaccggcatgacctgcgactcctgcgcggttcacgtcaaggaggctctggagaaagtgcccggcgtgcaatcggcggaggtttcctatgccaagggcagcgccaggctcgccatcgaggccggcacattgccggatacgctgaccgctgccgtggccggactcggctatcgggctacgcttgccgatgcgcccgtggctccggcgggcggcggattgctcggcaaggtgcgcgaatggctgggcagtgatgacaaggctggcggggatagtggaaagctccatgtcgccgtgatcggcagcggcggggccgcaatggcggcagcactgaaggccgtcgagcagggcgcacgcgtcacgctgatcgagcgcggcacgattggcggcacctgcgtcaatgtcggctgcgtgccgtcgaagatcatgatccgcgccgcccatatcgcccacctgcgccgggaaagcccgttcgacaacggcatccaagcggtagcgccggtcatccagcgcacggcgctgctggcccagcagcaggcccgcgtcgatgaactgcgtcacgccaaatacgaaggcatcctggagggcaacccggccattaccgtgctgcatggcgctgcccgcttcaaagacaaccgcaacctggtcgtgcaactcaacggcggcagtgagcgcatggtgacgtttgaccgctgtctggtcgccaccggcgcgagtccggccgtgccgccgattcccggcctgaaagacaccccttactggacttccactgaggcactggtcagcgaaacgatccctaagcgcctggccgtaattggctcatcggtggtggcgctggagctggcgcaggcgttcgctcgactcggagcgaaggtgacgatcctggcgcgcagcacgctgttcttccgcgaagacccggccatcggcgaagccgtcacggccgcgttccgtgccgaaggcatcgaggtgagggaacacacccaggccagccaggtcgcgtacatcaatggtgaaagggacggcgaattcgtgctcaccacggcgcacggcgaactgcgcgccgacaagctgctggtcgccaccggccgtgcacccaacacgcgcagcctggcactggacgtggcaggcgtgatggtgaacaagcaaggtgcgatcgtcatcgaccaaggaatgcacacgagtagctccaacatctacgccgccggcgactgcaccgatcagccgcagttcgtctatgtggcagcggcggccggcacccgtgccgcgatcaacatgaccggtggcgacgctaccctgaacctgaccgccatgccggccgtggtgttcaccgacccgcaggtggccaccgtgggctacagcgaggcggaagcgcaccacgacggcatcgagaccgacagccgtacgctcacgctggacaacgtgccgcgcgcgctcgccaacttcgacacacgcggcttcatcaagctggtcgttgaagaaggcagcggacggctcatcggcgtgcaggcggttgcaccggaagccggcgagctgatccagacggcggccctggccattcgcaaccgcatgacggtgcaggaactggccgaccagttgttcccctacctgacgatggtcgagggcttgaagctcgcggcgcagaccttcaacaaggatgtgaagcagctttcctgctgcgccgggtga

SEQ ID NO: 8543 - DNA, 1539 bp, Pseudomonas aeruginosa
gcgtgcatatcgtgcgcgactacctgctgcgcggactgctgcggccggtggcgtgcacgccaggcggctacggcctgttcgacgaggcggccttgcagcgtctgtgcttcgtgcgatccgccttcgaagcgggcatcggcctcgatgcgctggcgaggctgtgccgggcgctggatgcagcggacggcggcgaagcggccacgcagcttgccgtgctgcgccagttcgtcgaacaccggcgcgaagcgttggccgatctggaagcgcagttggccaccctgccgaccgagccggcacagcacgcggagagtctgccatgaacggcccggaacgcctgccgaccaagacacgcaagccgttcaccggctacctgtggggcgcgctggccgtgctcacctgtccctgtcatttgccgattctcgccgttgtgctggccggaacgacagccggcgcattcatcggggagcattggggtattgcagccctcacgctgaccggcttgtttgctctgtccgtgacgcggctactgcgggccttccggggcggatcatgacgacctcgcagcccgccggatggacggcgaccgagttggcgcaggcggttgtgcgcgggcagcttgagttgcactaccagccgatagtcgatctgcgcagtgaccagattgtcggtgcggaagccctgttgcgctggcggcacccaaggctcggcttgttgctgccgggccagtttctccccttggtcgaatcgtccggcttgatgcctgaaatcggtgcttgggtgctgggcgcagcctgccgccagatgcgcgagtggcggatgctggcatggcaaccgttccggctggccgtcaatgtttcggcgagccaagtgagaccggatttcgacggatgggtaaagggcgtgctggctgacgccgagttgcccgccgagtctcttgaaatcgagctgaccgaatcggtcgcgttcggtgatccggcgatcttccccgccctggaagccttgcgacaaatcggtgtgcgcttcgccgccgatgatttcgggacggggtattcctgcctgcaacacctgaagtgctgcccgattactacgctcaagatcgaccagtccttcgtcgccggactcgccgacgaccaccgcgaccgaaccatcgtgcgctccgtcattcagcttgcgcacgggctgggcatggacgtggtggccgagggcgtggaaacgccgaccagtctcgcactgttgcggcaagcggcgtgcgatacgggacaaggcttcctgttcgccaagccaatgccggcggcggcattcgccgcctttgtcagtcaatggaggggtgccaccatgaatgcaaatgatccgactgccaccagttgctgcgtgtgctgcaaggaaatcccgctcgatgccgcctttaccccggaaggcgtggagtacgtcgagcacttctgcggactggagtgctatcagcgcttccaggcacgcgccaaggccgcgaccgaaaccagcgccgaacaaaacacttgcgattcgccgccgtcaggttga

SEQ ID NO: 8544 - DNA, 672 bp, Pseudomonas aeruginosa
cgcgacgtagaagcggattaccgacggttcggatggcatctgcacgaccagtaccggaatgtgctcctggtcggcgtcggagctggccgggtgggtgcggcggaatttctcgacgatcatcgacttgccgttgttggttggaccgaccaacagcaggttgggcatgcgttgtttgttcggccacgcatacagggcttccagccgattcagcgcctcgactgctcgcggatagccgatccagcggtcagcgcgaaggcgatggatgcgttcgtccgccggaagacgggccaagccctgggccaccggcatcaggtgggacaagtcgatgatgggatattcttccacggctaccactcctcaatctggtcgaacggtttggcaggtggctggttgtctgcctgcgggtcagccatgtccgcgtccggtggtggcgtggttttgaaaagaactgccgttgccttgagatgctggcgtcgatccgcgtcgcgccgcgccttgcgcgtagctttctgcgcggtggacacgatttcgcgcatctggccgatcatgcgaaacagcgccgactcatccacctgttcgcgcccttgctgccgcaatttcgccagcgcctgtcgttgttcccagagggtgacagccgggtgcgacaaggtgcggtatggaatttccagatag

SEQ ID NO: 8545 - DNA, 321 bp, Pseudomonas aeruginosa
ccttcccggcggcgagtagccttgagcggatcgaggccggcgatccgcagagccacggtgttgcgcgccggcgcccgcagcttttgcgctttgcaagcctgcgcgacctcgcggtggaacgctgccaggctacgcttctgcttggtcaggaagcgcttttgcagcaactcgcggatgatgcgctcaactgattccggcaagcgtcccttgccttttccgccgccggatcggctgcgagccaggtccgtcacaagcccagcaccttgccgggcacggcggattaggacatacacctgccgcctggacaggccaagcgcgtga

SEQ ID NO: 8546 - DNA, 1119 bp, Pseudomonas aeruginosa
gggtttctaatacgggacatgagtacatgtcaaagcagtagctgctcgagcagttgcaattcgcagacggtcgacgaggccccaagcgccattgcttccgtggagagcacattttcagttccgggaatggactgcccctccgaggagaacctcattcgcatggcgctgggtggtctgaccggggttgggccgatgaccttcgatctggcccatcggcagctccgggtggtgcactcgggcgagcccgccaggatcgcccagaagctgacgcccctgaacttgggtgcggttctgctgacaagcgagaggcgcaccgaaggcgggcagtggaagacgcgtttctccgtgccgaagatggattgcccgtcggaggagaatctcattcggatggcgctggccgatgcgtcggctgttgcggcactggacttcgatctgaaggaccgtgtactcaccgtgcagcatgggggaagtacgcaagagctgctgggccgtctcatccctctcaacctcggcgcgcaagtgttggacagcgtgcaaagcgacgagtctacggccccagacgcagaggggaatgcctctgaggctcggaccttaaagctgctgctcgctatcaacggtgcgatgtttgtctttgagttgatcgttggcctgatcgcccagtccacaggtctcatagcggactcgcttgacatgttcgccgatgcggcggtctacggactggcgctctatgcggtgggccgcgccgccgccttgaagatgaaggcagcgcacatcgctggttggttgcaagtcgtgcttgcgcttggcgcgcttttggaggtcgttcggcgggcagttgtgggaagtgagccggcgtccatgctcatgatgagtatcgggctggtcgcattgatcgccaacgtcacctgcctggtgctgatcgccaagaagcgggatcggggcgcccacatgacggcaagctacattttttctgcgaatgatgtgatcgcaaacgcgggggtgatagtcgctggtgttttggtcgcttggacgggctcctcgtaccctgacctcgtgattggcgcagtcattgcgctgatagtgctcagcggtgcccggcgcatcctgaacctccgatag

SEQ ID NO: 8547 - DNA, 486 bp, Pseudomonas aeruginosa
agggattcaagacaaccttgctggaggatggtgatgcaactcattgaatgcgccaaggcggcaggcgtcacaccggacacgttgcgtcactaccttcgggtggggcttgtggtgcccgatggccggggcacgaacggctaccgcgcattctcggatcgaagcgtcgcccgggttcgtttcatacgcaatgcattggccctcggcttcacgctcaaggacgctgcagagtttgtcgagatgagccagcgcggtgcatcgccttgtccgcgcgcgcgggcgctgctgagcgaacggcttgacgagcaggcccggcggctgaaggaggcgacagatttgcatcgccgcatgcagcaggcagagcgcgactggaagcggctgccggacggcgtcccggatggccattccgtctgcggtttgatcgaaggagcggatgcggacgttcagcgcaattcggtgcgcgcgaagtcccgtcgtgtacgcgcatga

SEQ ID NO: 8548 - DNA, 1836 bp, Pseudomonas aeruginosa
ctgggcgccgcgctggtggcgggcagaagacagcggcttcgtggcaccgttcatgatcctcaacggtcgccgcatcgaacagcgcagcaccatgcagcagcaggggggccgagaatggttccaccagcatctgcggctgaacggcttcgacccgatggagatcgacggcaccgaccccgccgcgttcgcctgggccgttcacgcgatggaggagcggttgtcggcctgcgcggctggagtttcgcagggcaccgttcagtacccggtacccctccactacaccatcgccgaagcgcccaagggattcggcttccccggtgctggaaccaatgccgcgcacaacctgccgctggaggggaacccccgggtcgaccagatagcgcttcagcagttcaacgagggtgctcgcgctctcttcgtgccgtcgcacgaactcgacgaagcggtcgcactactgcgccggcacgaagtgcagcatcgtcccctggagcgggaccatgccctggcgcaccgccaggtggcggcccccagacttccggttccgcagtggcatgttgcgggccagggcgaggtctcgccaatggcggcactcgacggagccttcgcggccctcgtccaagccaacccacagctgcgtccgcgggtaggcaatccggacgagctgcgcagcaaccgcatgggccagacattggacctgctcaaacaccgcgtcttcacgcccgaaccgggcctggcggaggccgtcgatggcgccgtgatcacggcgctcaacgaagaagcggtggtcagcgcggcgctgggcaacaagggcggcatcaacttggtcgtctcttacgaggcatttgccgtcaagatgctgggcgcgctgcgccaggaaatcctgttcgcgcgacatcaggcgcaggcaggcacaccacccggatggctgtcggtggtcacggttgcgacgtcccacacctgggagaacggcaagaacgagcagtcgcaccaggatccgacgctggccgaagcgctgttgggcgaaatgtccgacacctcgcgcgtgttgttcccggtcgatgccaacagtgccgttgcggcgctgcgcgcggcctacgcctcgcatggccagttctggacgctggtcgttcccaagcgggccgtcgccagccagttgagtgccgagcaggccgaacgcttggtcgatcagggtggttgggtggtgaaaccctgcgacgcccccgacgtgttgctggttgccatcggcgcataccagctacagcaggccctgcttgcggcgcggcgcctcgaagccgctggacatcggaccgcagtgacctgcgtcatcgagccgggccgcttcagagcaccccgcgacgaacgcgagcaggactttgtggccggcgaccaggccttgcgcgccctgttcccggagactgccgccgtgcgcgtcatcgtctcgcacatgcgacccgagccgacgctgggcctgatgcgtcggatcgatacaggggcgcggcagacccgtgccttgggctaccaggcgcgcggcgggacactcgatgtggccggcatgctgttcgcgaaccgttgcacgtgggcgcacgtcgcggcggaggcggctcaagggctcggtgtcgatccgcagagcttgctgagcgccgaggagtgggcggccgtgcaggggcgtggcgacccgcgcgtcatcacggtctcggcttaacccccttccagcacgacccacgaccggacgctgattgcgccgacgcactctgcttcttcatgtgcgttgccaggtcgcactgggttcggatgtctgacgaatggctgtgggaccgatggccacgtcgcgcctga

SEQ ID NO: 8549 - DNA, 1434 bp, Pseudomonas aeruginosa
ctgatcgctgtttcaggtcaagcccagggcgacggcaaagccagcagcagccatggccgcgtacgacgggagcactctccatgcgagcgccctaccgcccagcgacatcaacaggacaagtttggtgacctgattgacggatgcggcgatgaacaaggccagggtggccgaagcggcggtgacggcgccctcggtcaccaggcggccaatcgagagcgtgatcgcatcgacgtccaccagacccgaggcagcggcggtcagcatgacgccagcatccccgaagcgatcggcaagaaagcggcctgccagcatcaccgcggccaggaaggctgcgaactggagcgcggagcgcagctgcaatgggttgccaagctgaagttcgggcaagtcgtcggcgggcgaccgcgccgccaggaacgtccccagaacaccgccagccacggccatggccacgaagatgaccaccgggtcccagccgatgccgggggctgcgatggcgacgagagccgccatgcgcgcaaacatggctgcgcaggcgagcgccgcccccgccgctgccagtggatgccagcctggcgtctgcccggcccagcgcgccaacgtggccgtggtggcggtgctcgacacgatcccgccgagcagcgctgtgaataccagccctcgtttcctgccgagcgagcgcatcaggacgaacccagcgaacgacagcactgccagcaggacaacggcccaccaaaggcgatagggattcaacgcctcataggggccaaagccacgatcagggagtacgggcagtacgaccacgctgatcaacagcaactgcgtgccgctgctgatctccgcctcggacagcttgccgacgccggcgtgcaagagctgcttgaaacgcagcagcgccagcacgaccacggcggcgaccgccgaaacgcgccaagcgccactggtcgccagcgccccgatggcgaaagtcgcaagggcggcgacggacgtggtcagtcccatcacggcatgcatatgcgccgtcaccaggtagcccaccaccagatacaccccgacgagtacgagcagcgcgatgagcatgccggctccccagcgctgggccagcagcccgccaaggccgccgagcaggccgatcagcgcaaaggtgcgaacgcccgcgacgcgatgtccctcgggccgctcgcgttgctgccatccccgttccaggccgatcagaagtcccgaagcgagtgccagcccgagcccgaccagcgcgggatcatcgaattcactcatcgtcgaacctggacgcggtcacggatgaaatcacgctgcagtcccagcgaagcatcggtgcgcgccatcgacacctggggatcggtctcgatgccgctcaaggcgcgaatggcatcgatggtctcggggattacgatcgcctggttgaagacctggtag

SEQ ID NO: 8550 - DNA, 195 bp, Pseudomonas aeruginosa
tcgtgcaccacatccgcgacgccggctagcgccatgtcctcctggagtgcgaccgcatccgccacccgcttgccgatcacaccgtatccgttcaccgccactctgaccttgttcatgcctgactccttgcttgatgaggcgcctcagccgcggctgcgcgcgatggaaaacgtgaaccggatcgccagcgcatag

SEQ ID NO: 8551 - DNA, 768 bp, Pseudomonas aeruginosa
cccagcagcgcgagtaccggcatgtcgccccagcgcgggcccacgccgtgctgcatcaacaagctcgatgcgatgtacaggccgagcgtcacgagcgccagcgcgacgcgacggccgaggcggtcgatcccgctcagcatcctggcatccggcttgatcgacagttgcagcaggtcaccctgccgcaagacgctgtgcagacgccgcgccatcagggagggcagggcgtgggccgcgttccccagttcatatggcagacgctgcgatgccgcagacttgggctcgtcgaagacgcccgtggtcgtgtggcgagagatggcttcgatgatggaaaactcgggtgccagcagtcgcaccgtcccttcgagcaacaacagggtacgcgtgagcacgaggaggtccctgggcagccggacttcctgggtccggcccgccgccacgagctgcgcgagagcacctgagagcgaccagtccttcagcggcctctgtgcgcagtctgcgaccagggcacgcacgacaggcacgaacacggcccgatcggtgccgtcgccgagcaggcccaggtcgagccaggcatcgaccacccattcggcatcctgctcgacgaaggccagggcgaacgccaccagcgcccgccgcatgttgccgtcgacccggcccacgatgccgaagtcgtgcacgcatatgcggccatcgtccatcacgaagacgttgccgggatgggggtcgccgtggaagaagccatcgcggaagatctgggcgacgtag

SEQ ID NO: 8552 - DNA, 1377 bp, Pseudomonas aeruginosa
gacggccagcacgtcgcgggcctccagtgccgggccgatcccgcggccgaccggctgctcaccatcggtgacgcgcaaggccacgtgcaggccgatggcgctgcccacctcctgcaggcgccgaccgagcgccgccgcggcctgcgcgctgcgcactttggcggtggcacccacgggcaggtcgatcagcacatgggtcgagcccgcagcggccttcttggacaggaccgaggcgacgagctggccctcgctgtccaggtccagcggccgctcgacgcggatgaggatgtcgtcggcggggctgagccgtaccgagccgccccagacgatgcagccgcccgtgcgttcgaccacgcgccgcatgcttcgcacatccaggttcaccggcgccagcacctccattgtgtcggccgtcccggccggcgaggtgatggcgcgcgaggaggtcttgggcatcgtgaggccgcaggcggccacgatgggcaccacgagcagggtcgtgcggttgccgggcaggccgccgacgcaatgcttgtccaccaccagcgggcgcccccaatcgatgcggtcaccgacgccaatcatggctttcgtgagcgagacggtctccgcgaggtccaggcgatcgccggcgcaggcggtgatgaaggtggccagatgcaggtcagagtaatggcccgccgcgacgtcggagatgatggcgctgaactcggcatcgcccagggcattgccgtagaccttggcccggacatggctgagcgaatccagcggcggtgcatgggtcaccgtgaccagctggcccggctgcgcccccagcgacgcccatgccgattcggacaggccagcgacgttctcggccagccaatccccatcgacgacgctgagcgtcgccacgatgctgcggcggccggccgtcagctgcacgcgcgcctgggtcgtgaaaccctccgaccggcagacagggcagtcgcgccgcatgtagaccaccggctcctgatgggtgtcgatgccggtgcgccacgcctgcagcgtgttcacgccatcctctccggtgccggtgccggtctcgtgcaggtgcgccgtcataccagatccaccgtctgcaggtactcgggcacggcaaccgaccagcccagttcatggtcgatccgcgcgcgcagcgcatcggccgcctccggctcgccgtgggtcacgaaggttcggcgcggtgtttgcgtgaagccgcgcatccacgcgaggatctcgtcggcatcggcgtgggcggaaaggttgtcgagcgaggccacctcggcgcggatcggcacgtcctggccatggatgcggacggtggacgcgccgtgcacgatcgcggcgccacgggtgccgcccgcctggtag

SEQ ID NO: 8553 - DNA, 1161 bp, Pseudomonas aeruginosa
tctgttcggcgcctgccggcgatgccgccgtcgaaatcgccctggcgcaggcgcggcgtgatcacctcgtcgatgatgcgccgcgataccacgtcgctcagcgcaccctcgatgccgtatccgacttcgatgcgcacggtgcggtcgtccttggccaccaggagcaacgcgccgtcgtccaccttgcgacggccgagcttccattgctctaccacccgcagggtgtactgctcgacgggttcgggccgcgtcgagcggaccatcagcacggcgatctgcacgcccttgcgttgctcgaaggcccgaagctgcgcatccagcgcggcgacacgatcggcggcgagcgttcccgtgagatcggtgacgcgcgcctgcagcgggggaacggcgaccaactcctgcgcggacgcgaccgaaaggaacaggctcagcagcagccaggccagagcgtgggccagccgaagaggggccgccggagagagcaccgctgttctgggcgttctcatgtcaggggcgcgccgccggcgacgaggcgccgaaatcgacctgtggcggcgccgccatggccttctcgtcggcgaccgagaaattgggcttgacgacgtagctgaacagcttggccgtgatgttggtcgggaagctgcgcgtgagcacgttgtaatcctgcaccgccttcacgtagcgcccacgcgccacggtgatgcggttctccgtgccctcaagttgggcacgcaggtcttgaaaagcttggttcgccttgagttgcgggtagttctcgctcaccaccagcagccggctcagcgcgccggacagttcgccctgtgccgcctggaacttctggaacgcctcggggttgttgacgagttccggcgtggcctggatcgaggtcgccttcgcgcgggcctcgaccacccgggtcagcgtctcctgctcgaagttggtctcgcccttgacggtcgcgacgatgttggggatcaggtcggcgcgccgctggtactggttcagcacctcggaccaggcggacttggtctgctcgtccagccgctggaagtcgttgtagccgcatccgctcagcgacagggcaagcgctgcgagcaggggacatcaggatcagtctcatggttcggtttccgtggaagtgagaaaagtgcgggacggtga

SEQ ID NO: 8554 - DNA, 480 bp, Pseudomonas aeruginosa
tcgcggcacttgcgaggaagaaaagaaagagcttgtcgtccagcccgaacggcgtctggaagtcgccgaacatcttccccatcggggaatagaagaacacgggaatggcgaagaccagggccacgaagaagcgattgcgcatgtcccgagccatgtcctgcatcgagcccgacccgtggcccatgtcgtgcatcatgtcgtccatcgcagggtcgcctgcgtgggcctggtgcgcagcatgggcggcgggcgtcgtggccgcagccttcgcgcgtgcggccgtggcgggggcatgcgcgtggtgcccctcatgccccatctcttgcgcctgacgtgcgggtgcgccgtgatggccgtgcaccgcatggctggggtcggcagagacgccagcggcgggcgcgcacacgtgcttgggcgtctgctcgccacggcagtgatagccgcattcggcgatgcgctggcgcagatcctcgacactga

SEQ ID NO: 8555 - DNA, 441 bp, Pseudomonas aeruginosa
tcgacttcatggctgttcttcctgttcgctgtgttcgtggtctcaacgagcgagtcggcccgagtccaggcagtcctgcgagaactcgaagacgatctcccggtcgggagcgatgaccttgtgcttcttgccggcgtagtgcagccgggagaggatgtctctgatcaggttgagcctcgccaaccgtttgttgtcggcgtgcacgacagaccagggcgccgcggccgtatgggtgcgcatgaacatctcgtcgcgcgcccgtgtatagccgtcccagtgcttaagcgcgacggcatccaccgggctcgacttccactgtttgaggggatcacggcggcgttccccgagccggcggctctgctccttcttgccgatgtcgaggtaatacttcagcagcttgataccggagttgaccagcatctcctcgaacttgggcactga

SEQ ID NO: 8556 - DNA, 438 bp, Pseudomonas aeruginosa
acagtggatcgctcgatgaacgaaggtttgggtgattggatgacggttggcaggctggcgaaggtcgctggcgtcggcgtggagacaatccgctactaccagggacgcggcctgttgccgatcccgaagaacgccggcagcttccggcgctaccccgcttcgatgatccagcggatcggcttcatcaagcgcgctcagagccttgggttctcgctggacgaggtgaagtcgctcttggatctggaggatgggcggaatcgccgggctattcagacggtgacacggcggcgccttgaccagatcgatgagaaggttggcgaccttcagcgcatgcgaggcgctctgagagacatgctggagaggtgcgaagacacgggagaggcgcttccttgccctatcattgctgcgctcatggggcctttgaatacgtccgaatga

SEQ ID NO: 8557 - DNA, 270 bp, Pseudomonas aeruginosa
aggctgcaggcgtgcttgctgcagtacatgatccacgccgagacgatgatgaaacaacgatctgtacgaacagccaccccgacgacggtggtcgccaagccttttgccacggaacgtgtgccaattgttggcgacgtcgccagcctcggcggcgtaaccgtgtccaacgttcgtttctatgaagcagagaggttgatccatgctacgcgcacggcaggcaaccagtgcctctatgggcccgtatctagcacctatgccagtttcaagtag

SEQ ID NO: 8558 - DNA, 663 bp, Pseudomonas aeruginosa
agtgaatcctgtctcaaacctgcctgggagatcaccatgcccaatgccattgaattcattgccgaccatctgccgcgcgtcacggtggaggatgtgcgccgcttcgcggataccgtcgaaatccgggatgccacggctttcgcggccgagttgcaggcgttcgtccacgagcgtgtggaggcggtgaagctgcccgccagcctggaagcggagacggtgcaagaggccctggcacgcaaagcgggcgcgctgcgcgccgagacgcgctgggcgccgagtgaaaccgacgtccagcgtggccgcgctgcgctgctggaaaccttcaaccagccgcacaacctggcgatccccgagtacgccaagctggcggacaagtcgcgccagcagatctacaaggacatcctcgcgcgccggctgctggcgctgaatgtggggccgcgcggccagaagctgcccgactggcagctcgacccggtgaagcagcagttgacccaaaccgtgcttcaggaggtcgagggcatcgaccactggacgatctaccgcgcgctgtccgaaccgctcgaaggcttgggcggacgctcgccggtggatacggtgacgcatggcacgatcgatgacgtggccgaagcggtgttcaacgtgctgggcgtccaggtgcattga

SEQ ID NO: 8559 - DNA, 645 bp, Pseudomonas aeruginosa
ggcaagactgccatgagccgcgaactgcctttgttcctgatcgatgcgggtgaactgctccagcatgtgagccgcgtcgtctatcggggcagcccgctgtactatggccgcagcggcaccaatcgctacgacgacccggcgcggacctacggcgtgctctacctgggccgcgacctgcccacggcgctgatggagtcggtgtttcacaagcaccagtggctggcggatgaaaagcgctcgatcgcgctgaaggaagtcgagagccggctcttgcgcgccgtgggcgtcctggacgacgtgcggctggccgatctcacggccgagggtgtcatggcgggttacttcggcctgaacctggaacagttggccagccgcgactacacgcacacgcagcaggtgtccgcgcaggtgcatgcgatgctcggagacgacggccagccgctgttcgacggggtgctctatccgtcgcgcaacaactatcccgccaagagcatcgccctgttcgagcgtgcggcagcaaaggttggcgttgtcgatgacatcgacctggtggaccatgtggactggccgcgcttcgttgccacgtatcgcgtcggcgtggaacccgaccccggcccggtggaaccggatgacgaagcgtcctga

SEQ ID NO: 8560 - DNA, 1374 bp, Pseudomonas aeruginosa
gccccaccgcgacttcatcgaggcccaggtccggctgggccgcaacggtgtggcgatctaccaggacctggtcgaccagcacggctttgccggcgcctacaactcggtcaagcgcttcgtggccaagttgcggcacgaggagcccgagcggttcgaccggctgtcgttcctgcccggcgaggagatgcaggtggactacggcgagggggcgccgacgcgggtgccggggacggaccgctaccgcaagccccggctgttcgtggccacgctgcgctactcgcggcgcagtttccggcgcgtggtctggaagtccagccagcaggtgtgggcagaactgcacgagcaggcctggcgctacttcggcggctcgtgccgctacgtggtgctggacaacctcaaggagggcgtgctcaagcccgacctgtacgagcccgagctcaacccggtgtttgccgccacgctggcgcactacgaggtggtggccgacccggccagggtcagggacccgaaccgcaagggcaccgtggagagcgccattggccacacccaggccacggcgctgaagggaaagcgcttcgagaccatcgaggcccagaacgagcatctggagcgctgggagacgcgctgggcggcccagcgcatccacggcaccgagcgccgccaggtgcaggccatgttcgaggacgaacgcgcccacctgcagcggctgccgctgaccggcatgcagtacttcaagcaggaggagcgcaccgtttgcgacgatggctgcgtgcgcgtggaccacagcagctactcggcccgtccgatggccatcggtgccaaggtcctggtgcgcatcttcgagcggcgcatcgagatccgcgagctgaccacggggcggctggtgcgcacccacgagcgcgccgaacggccgggcacggtggtgatgccgcaggccgagcgcgtcttcaatccctcgcgcgagacgcgcttcatcctcaagcaggccgaccagatcggcccccaggcggcacgcctgtgccgcatgctgttcggcatcgaaggccgggtgggccagcgcaagctgcacggcatcgtcaacctcagccgacgctacccaagccgcttcgtgaacgccgcctgcgcggccgccatcgagcagggcatccacagctacaagcacgtcaaggcgctgaccgagcgcctggtggccgaggccctcgcatccatcgatgccgccggcgatgggaccgaccctggccgcgccgatctcgcccaggagcacgtactcatccgcgacaccgaggagtacggctcgctgttcaacctggccgccacccaggccggcgtcgataccagcgagggaaggcggcctgtgaccttgatcgagattga

SEQ ID NO: 8561 - DNA, 1092 bp, Pseudomonas aeruginosa
gcatggcggtggccagcagcaccaggaagcgattggccaccgaccatcgaatcagcttggcgatcatggctgcaccttttcgatggcggtgatcacgtagccctcaccttgcttggagaaggtgaatcgcacctgctgccgaaccgaaagacccgcggcgagctgcgggctgctcagcttgaagcccatggtcatggccggccattggagggctggcacggcctcgtgcgccagcgtcagctcggtgggcgacatctcctcgatcacgccgcgcaccacgaaagcgttggtggccgcggccgttggcgacgaggtgccgtgcccgttgtgcggcgatgcaggcgcggacgccgcggcacctgcaggcagcacgccccgcaggctggcttccgaatcgatcaggaactgcgccgaggccaccacctgctgtcccgccgcgagcccgccgttgaccaccagttgatcgcctacctccgcgcccacctggacctccacgggatggaacttgccgggtccatcgaccacataggccagtgcgcgcttgccggtgcggatgaccgcttcgctgggaacaagcagcgcgggctgttcgttgcctttgagcgcgatctggccggacatgccggccttcaggcgctggccgggattggccatttcaagccgcactcgcaccgtacgggtgtcgcggttggcttcgggcaggatgctcacgatgcgcgcctggagcacttcaccgggaaacgccgccagccggacctgcgccgtttggccgacctgcaatggtccgctttgtgcttcggggacggccgcttcgatccacaccgaggccaagccattcaccctgaccaggctttccccggcggaaaccgtcatgccctggcgcaccatcagttcggccaccaagccgccttgaggtgttgtgaccgtgtacagccccttgggctcgcctgtgcgctccacctgggcgatcagggcttgcggcatgccgagcagcagcagccgttggcgggcagctgcggtcaacggtgcgtcgcccatcgcgcgaaccgagagaaactcgcgctgtgcggcgatccacttcggcagcaatag

SEQ ID NO: 8562 - DNA, 699 bp, Pseudomonas aeruginosa
ggcttgcaccgcttgcgccgacacgctgaggcccgtgctgtcttgcgtgtcttcatccgcgtacttcggcatcaacggcatgtccatgtagggcgacttgccgggcttgtcgaacttctgggtcggcaccatcgggtcgtaccaatacagcaccttgcgctcggtcggagcgcttgcaacggtgacgttggcagcgggggagccgctgaggtggccggcgcgccattgggcgacgccccatccaacggcaataccggcagcaaccagcgtcaagccggtaaggatgtttctcgaagaggtattcatggcgagggtctccactcagtccgcgatcaggctgttcagtcgggcgacgaggctgtcgcgctgcgctccaaggtcgatcagacgcatgcgcgtctccagcacctgggcgcgtgcactgagcacagcgctcaggtcccccttggcggatcggtagttgctcaatgcaagtgccgctcggttccgtaccagttgcaagccggcggtctgcaggcggtcgatctggctgttcaacgcttggagttcggcggcgctgtcgtccagctcctgcaaatgccgccgcgccacgtcttcgcgttcggcgtccagacgttccaactcgtgccgttttgcctcgatcatgggcacttggcgtcgatccttctgccaaggcagatcgaatgtcacctgaaatga

SEQ ID NO: 8563 - DNA, 360 bp, Pseudomonas aeruginosa; identical to SEQ ID NO: 3519

SEQ ID NO: 8564 - DNA, 1971 bp, Pseudomonas aeruginosa
gcgtcggcctggccgtgcgctgcatggtcgttctgtgcttgtgcctgggcggcgacgcttaccagggccagaagcgtcgtggccagtgcgcgagtggggagtgctttggacattcttggtcttccttgtgcgctgggttcaagacaccacgacttcgcggaacatgccggcatccatgtggaacatcaggtggcagtgccacgcccagcggccgagcgcgtcggctgtcaccaggaagctgatgcgttgtgccggctgcaccggcagggtgtggcggcgcgcaaggaagcgaccgtcggggctttccagctcgctccacatgccgtgcaggtgcatgggatgggtcatcatggtgtcgttgtgcagaatgacccgcagccgctcgccgtgtttgaagtgcaccggcgtggactttccgaactccagcccgtccagggaccatgcgtagcgttccatgttgcccgtgaggtgcagttcgacctcccggccggggcctctcttgtccagcggccccgacggggtatgcagatccgcgagggtcaacacgcgccgaccgttgttgcgcagtccgatgccggggtcatcgaggttggtgcgcgccatgtcaacgcgcatgtccgtgctggcaccatactcggtgcgagcgtggcgagcagtagtgctgggcacggccagtccccccgccgccgcggcgtgttggctgtgatccatcgccatgccaccgtggttcatggcgccgtgattcatgcctgccatcgccccatgatccatcccggacatcgaacccgagcccatcccggtcatcccggtcatgcccgtcatgcccgtcatcccggtcatctccatggcctggccggacccgccatggtccatgccccccatcatgccgcccatcatgtcgttcatggtcagccattcgaccggatcgagggcaggcacgggagcttgaagaccttcacgcacggccagcgtggcacgcgcgtagcctgtccggtccatcgcctgggcgaagatcgtgtaagcgtcatcccgtggctggacgatcacgtcgacggtttcgccaggaccgaatcggaactcatcgacggtcaccggctccacgtcaacaccatcgacgtgcaccaccgtgagtttcagtcctggaatgcgtacgtcgtagaaggtgttgcccgcaccgttgaccatgcgcagccgcacgcgctcacccggtcggaacagcgccgtccaattgccggcgggggtgacgccgttggccagataggtcagcgtggtggcagacagatctgcgagatccgtcggattcatccgcatctcgttccacatcttgcgcttgtcgatcgcagcggccgtgccttcgcgcgaggcgtcccggaagaagtcgaagacggtaggttggttgtagttgtaatagtcgctttgggacttgagcttggtgaacacccgcatcgggtcttcgtcggtccaatccgagaacagcagcacgtggtcacggtcggcgtggatggtctcggcgccagcggggtcgatgatgatcgccccgtacatgcccgtgagttcctggaagccggagtgcgagtggtaccagtaggagccgctctgctgaaccttgaagcggtacgtgaaggtctcgccgggagcgatgccattgaagctgatgcccggcacgccatccatctgatacggcaggatgatcccgtgccagtgaatggatgtggcttcacgcagcttgttggttacacggattgtgacggtgtcaccctcgcgccaacgcaatgtcggtgccggcagcgagccgttgatggtcgtagccacgcctggcttgcccgtgaagttcacgggcgattcggcgatcaccaagtcgaactcggtgcccttcagcacaggggcggcaccgcgcgtcgcggagccttgctgggcaaatgccttgaacgccggcgtggacagcccagcgagaacgccgccggcggctaa

SEQ ID NO: 8565 - DNA, 1494 bp, Pseudomonas aeruginosa
acgatgcgttcaatccgaagctcatccacaccgtgcgtggaatgggatacacgctcgatgcgcccgatgatgcccctgcgccataagccgcggcaaagccgtccagcgtcgcttgcattgagggtcacggccctcgttggtatcgccacgaccttggtgtttcttgtgttcaattgggtcattctccggtcgttggagcaccactttgctcaacaggatgcccacgaactggaggcagtgacaaccgctttggctcagcccttgcaccagcttgcaagtgacatcgcaagcgacgaactgaagcaacacttggccaacgcagtcgcaggacatcatgggatgacgtacggcgtctacgatggggctggcaatagcatctatgccacgcccggtcctgacctgtctaaacttgccagtagcaaaaagttggtcaaccgcatcaccgctgacgatttgatcgtgtggcaggaggatcagaggtcatatcgaggtgtggtgctgcaactgcctgctgacgattcagcggcgcccggctaccgcatcgtcgctgccatggacatcggctttcatctcgacttcctggcggagttcaagcgcatgctctggtgggcaaccggcttggtcatgtgtctggcgctcggtgtggcttggctggcggtgcagtggggccacctgccgattcgcaaggtcaatgaagagattcgggcgattcgctcttcaaagctggatgtgaggctggatcctcgggatgtgccgatcgaactggcggaactggtattcgccttcaacgatatgttggcgagaatcgaggaaggcttcacccggctatcacacttttccgcagacatcgcgcacgagttgcgcacgcccgtcaccaacctggtcacgcagactcacgtggcgcttggccagccgcgcagcaacgaggaatacagagaaatcctctattcaaatttggaagagtttgatcggatgggacgcatgattggtgacatgctgtttcttgcccaaacggaaaatgatccccgcaacttgcgtctgtctaccattgatctgtccgaattggtgcggagtctgttcgactatttcgaggcgctggcagaagatagcggcattacgcttggtgttaaaggggcgatcggcagcatagcggcggatcgggaaatgctcacccgggcgctgaacaatcttctctcgaatgcaattcgacacacgcctcgcggcaagagcatcacggtcttgctttcgcaggacgagcagtggacaacgatcagtgtggtcaatcccggtgagagaattcctgagcgcgatctaccaaagctcttcaaccgcttctaccgagttgatccggcacggcaacgaaatacggcgggcgccggtcttggccttgccatcgtgaaatcgattgcggaggcacatggtggctccgttgccgtgacctccagtgagcttgtcaccaggtttgacttggtattgccccatctgcggcagtag

SEQ ID NO: 8566 - DNA, 423 bp, Pseudomonas aeruginosa
acccagtgtcgaggcatcgtgtgcacgatgaacatcacgcacactatggcgaacgacacgatcgcccagcgccccaagcggcactactactccccggaacttaaaggccagatcgtggccgaatgccaggtctccggcgcgtcagtggccggcgtagcgcttgcacacggaatcaacgccaacatcgttcatcgctggatgcgcgagcaagcagactccctgttgccagcgccccggaatgagttcgttgcgctgaatctgcctccaccagttgaacagctcccagcaaccgagaccagctcgccgcccgtgtcgcgtgcgattcgcgttgatgttcggcgcagcgccagcgtagtcaccgtgaactggcccctggaagatgcagcgtcatgtgcagcgtggctgcgcgactggctccgatga

SEQ ID NO: 8567 - DNA, 1758 bp, Pseudomonas aeruginosa
atagcggcaagttcgtctggccgcgcgatgccgccaccaccgccacactcagccgaacgcagttcgatgcgctcgtgctgggcctgccctggaagaacgtcggcgaggctggagtcatcactgtactttgagtgctccggtcgttggccaggcaatcagcgcttgcaccgatgcgcgaatgtgatgttagccgcatcatcttctcccgtgatcaccgcagaccaccttgacaccctggagccgcagcagatgcgagcggccctgctgtcgttgatgggtgagctggccgagcgagacggcgtgatcgcacgccagggccaagaggcggtcttcaagcaggcgcagatcgacaagctcacgcacgagaacgcactgctcaagcgcatgaagttcgccgcacagtcggagcgcttcagcgccgagcagaagagcctgctcgatgaatcgctggatgaggacctgcaggcggtggccgatgagatcgagcaggccacgccgccagtggcaggccgccaagacaagcaagtccccaaacgcgcacccctgccggccaacctgtcgcggcgcgagatccgccacgagcccgagtccaccacctgcgcctgcggttgccagatgaagcgcatcggcgaggacgtggccgagaagctggactacgcgcccggcgtgttcacggtggagcgccacatccggggcaagtgggcctgtgcccagtgcgagacgattcaccaggtgcctgtcgatcctcacatcatcgacaaaggcatccctaccactgggctactggcgcaagtgctggtggccaagtacgccgaccacctgccgctgtaccgccaggaagcgatcttcggccgcgccggcctagccatcccccgctccacgctggcgcaatgggtgggctcgtgtggcgtgcagttgcagccactggttgacgccatgaggacagagctgctgcagcgccgcgtgctgcatgccgacgagacgccggtgtccatgctcaagccgggcaacggcaaggcgcaccgggcgtacctatgggcctatgccacgggcgccttcgagaacatcaaggcggtcgtctacgacttctgcgaatcgcgctcgggcgaacacgcccggcgcttcctgggcgactggagaggcagcctcacctgtgacgacttcagcggctacaaggccttgatcgcaagtggtgtgaccgaggtcggctgcctggcgcacgcgcggcgcaagttcttcgatttgcacgcggcgaaccaaagccagatcgccgaggtcgcgctgcagcagttcgcgcgggtctacgagatcgagcgtgaggtcaaggagattgcgaccgatcagcgccaaaccatccggcaacaacaaacgaagccgctgcttgatgccttgcaccagtggatggtgctgcaacgccagaaggtgccggaaggctcggcaagcgccaaagcgctggactacagcttgcggcgctgggaggctttgacccggttcgtcgatgacggacagctgcccgtggacaacaactggatcgagaaccagattcggccgattgccattggccgcagcaactggctctttgcgggcagcctacgagctggtcagagggcagcagccgtcatgacgctcatccagtcagcacgactcaatgggcatgatccctatgcgtatctcaaggacgttttggctcgcttgccgacgcaacgggttagcctggttcacgagttgctaccgcatcgttggttcgcaccgagctga

SEQ ID NO: 8568 - DNA, 402 bp, Pseudomonas aeruginosa
cgacgcaatcagcgggcacgaaacattcccctttcgggcatggcaggcgcacacaagattagacaggacggcctccatgcgcgccaggtcggccatcttttcgcgcacgtcttggagcttgtgctcagccaagctgctggcttcctcgcagtgggtgccatcgtcgagccgcaacagctcggcaatctcatccaggctgaagcccagccgctgggccgactttacaaagcgcacccgcgttacatccgccgcgccatagcggcgaatgctgccgtaaggcttgtccggttccggcaacaagcccttgcgctggtagaaccggatggtctctacattgaccccggccgccttggcaaaaacgccaatggtcaggttttccaaattcttttccataccacttga

SEQ ID NO: 8569 - DNA, 564 bp, Pseudomonas aeruginosa
tgccggggtgagcgtgcatatcgtgcgcgactacctgctgcgcggactgctgcggccggtggcgtgcacgccaggcggctacggcctgttcgacgaggcggccttgcagcgtctgtgcttcgtgcgatccgccttcgaagcgggcatcggcctcgatgcgctggcgaggctgtgccgggcgctggatgcagcggacggcggcgaagcggccacgcagcttgccgtgctgcgccagttcgtcgaacaccggcgcgaagcgttggccgatctggaagcgcagttggccaccctgccgaccgagccggcacagcacgcggagagtctgccatgaacggcccggaacgcctgccgaccaagacacgcaagccgttcaccggctacctgtggggcgcgctggccgtgctcacctgtccctgtcatttgccgattctcgccgttgtgctggccggaacgacagccggcgcattcatcggggagcattggggtattgcagccctcacgctgaccggcttgtttgctctgtccgtgacgcggctactgcgggccttccggggcggatcatga

SEQ ID NO: 8570 - DNA, 1767 bp, Pseudomonas aeruginosa
ttcctcgccgggcattgcggcgggtgccggtgcctcccatgcgccggccgctgcccgttcaaaggggcatggcggctgctgctgccgctgatcgacgccatggacgcacgcacgaactcccagggtatcgccgccgcaccgcttgggctctttgctgcctactggggcgacatgctgtggcggaccgtcgcgtccggcgaagcgctgagacagcgcgccaacaacatgaccgaacacgaagcggcgggtatgccgccgctgctccacttcgagtcagagcaggtggctgacggccacgacttgcaaccggcgagcaactaccggctcctgcgtgtcactcgctgtggcaccgacgccttggagaagcatgtgcgcaaaggcgccgcgccggtgctggtggtcgatccacgcgccggccacggccctggcattggcggcttcaaacgcgattctgaagttggcatggcactgctcgaaggccatcccgtgtacttcgtagtgttcgatccggagcccgtcgagggccagaccatgggcgcagtcgtccagaccctggccacattcatcgacatggtggccaagcgccaccgaggcaaggccccgatcgtctacggcaactgccaaggcggttgggcgatcacgctggcgctgtcgcactgcgagcaccgtgccgccttggcagtgctcaatggctcgccgctgtcgtactgggcaggcgagagaggcatcaaccccatgcggctgctcggtgggttcacgggcggcatctggccggcgcactgggcgtcggacctcggcgccgggcgattcgacggtgcctggctggtccagaacttcgaggcgttgcggcccgagggcgtgttcaagaaatacgacacgctcttcgcgcagccggagactgagcgcgatcgcttcctggagttcgagcgttggtggaatggcttctaccagcttgcccgcgaggaaatgttgtcgatcgcaggcgatcttttcgtaggtaatcacctggagagcggcgaggtcgtggtcgatggccactgccgcgcggatctcagccgcattggcgcaccgctggtggtcttttgctccaacggcgacaacatcacaccgccccaccaggcgctcggctggctcaaagcggtatatccgacgaccgcagacctggtggcggcgggccagcgcgtggtgtacctgctgcaccaacatgttggccaccttggcatcttcgtctccgcgggggtggcgcgacgcgagcaccgcgccatcttgcatcatgccgaatcgatccaggcactcaagcctggactctacgagatggttctggaggacagcgcctcttcggagtcggccgccgctgcgcagttccagccgcggcggctggaagacctgccttacgacgccaacccggcggggttcgacaaggtcgaagcactctcggagatcaccgagcgcttctattcgcagtgggtgtcgccgtgggtccgcttcgccgtcacccccgactcggctcgtgaacttcgcgcgctgcaccccatgcgcgtcagtcgcaaggtctggtccgagcaggtgaccccggccctggcgctgctgccatgggtgcaacgatggcttgagcagtggagtgcgcaggatccccatcgggtcgaaaatccttggtatcagcttgagcgaactggtgcagacgcgattgggcaggccatggaatcatggcgcaagagccgggacctgtgggctgagcttgtgttcgagcaggcctatgccaactga

SEQ ID NO: 8571 - DNA, 1371 bp, Pseudomonas aeruginosa
gtcgtctatccacttcgcagcatccgctgcacacgagcgagcgaggcgcccccaatgagccacctcacgacacgggatcgaaccgtatcgcccgatggatatgccgccgcgctacggatcttgcgccggctgctggccggcatcgagcgcccgccggcgttgcgtctgggcgatatgctcttgcacgagctcgaatcgcacccggaatacaccctgatcatccgtgacccgggtctgctgcgtcgcttggtcctgcgcccggatccgctgctgctggcggaagcctatttccgcggcaccatcgacattgagggagacctgtacaccgcgctcgggctcaaggcgcatttcgagaggttttcgctctcttggcgcgacaaactggccctgttgcgcgacgcactgctgctgcgcgtgtccgaccaggacgggttgaagccctcgcggagtctggcctcgcgcgtcgcacgtcgcttctcccatcgccattcgcgtcaaaccgatcaggccgcgatctcctttcactacgatgtgtccaacgcgttctatggactctggctcgatgccgagagggtctactcatgtggctatttcaaggcgacggatgacacgctggaccaggctcagcgcaacaagctggagcacatctgccgcaagctgcgcctgcagcgaggcgaacgcctgctcgacatcggctgcggctggggcgcgctcgtgtgctgggcggcaagagaacatggcgtccgtgcgcacggcatcacgctcagccaacagcaactcgaatacgcgcgcgagcgcatccgctcggagggcctgcaggatctcgtcaccgttgaactgcgcgactaccgtgacctcgaaggcacggccgttttcgacaaggtgtcaagcattggcatgttcgagcacgtgggactcgcgaacctaccggcctactacgcggtggtccagcgggttttgcggccaggaggactcttcctcaaccacgggatcacccatgacgaggagggctggagccgaaccgtcgcgaccgagttcatcaaccgctacgtcttccccgacggcgaattggactgcgtcagcaatatccagctagggatggagcgctccggcttcgagatccatgacgtcgaaggtcttcgaccccactacgcgctgaccttgcgtcattgggtccagcgactcgaagcgcgccgggaggaggccttgcgggaggtcgatgaggtgaccttccgcatctggcgcttgtacatggcggcgtgtgcactggaattcgaggccggggggactgggatctaccagatcgtcgcgtccaaacgcgacggcggaagctggcccgtgcccttgacccgctctgatctttatggataa

SEQ ID NO: 8572 - DNA, 2547 bp, Pseudomonas aeruginosa
cacagccatgaacgctacatggccgtgccgctggcgcgcgaaagacgatcacagacgccagccttcccaatctcgccgtcgcgcttacctgcgtgccggctctcaaggactttccacatgaaccacgagcttccctgggtcgccgagcgcgtccgcgtgttccgcgagtctgatcccgagttcgcccgctgggcgcgcggccacggccccatcacccacaacgatctcacgcaactgcgagtccacgatctcgcacaggtgctggttgccgaaggcaaggcgagcgacacaaccgcggtgtatcgcacgctctggtcggcggaccgcctggccgtggcaggcatgtggttgacggttcacatgacctatgccgaccgggtctatcccgatggccgggagatgagagccgaggatttcaaggagacgccggaggggcataccggtggggcgctgaacatcgtgccggcctatgtcggctacctggccgcgaacgcgctcagtgggttgacgcgtggctggttgatgggccagggccattgcgtcgcgggcatcgatgcctgcaaccttctggtgggcaacatgacgccgcgccacgccgagagatacgaccgcagcgaaagcggcctcacgcgctttgcccgggatttctatagctacgcgatcgacgcacaggggcgtcccgcctcgccgctgggcagccacgtcggcccgaatacggcaggcggtctgtccgagggcggctatctcggctttgccgaactgcagtacgtgcacatgcccttgcccggcgagcggctggtggtgttcctcagcgacggcgctttcgaggagcagcgtggcagtgactgggcgccgcgctggtggcgggcagaagacagcggcttcgtggcaccgttcatgatcctcaacggtcgccgcatcgaacagcgcagcaccatgcagcagcaggggggccgagaatggttccaccagcatctgcggctgaacggcttcgacccgatggagatcgacggcaccgaccccgccgcgttcgcctgggccgttcacgcgatggaggagcggttgtcggcctgcgcggctggagtttcgcagggcaccgttcagtacccggtacccctccactacaccatcgccgaagcgcccaagggattcggcttccccggtgctggaaccaatgccgcgcacaacctgccgctggaggggaacccccgggtcgaccagatagcgcttcagcagttcaacgagggtgctcgcgctctcttcgtgccgtcgcacgaactcgacgaagcggtcgcactactgcgccggcacgaagtgcagcatcgtcccctggagcgggaccatgccctggcgcaccgccaggtggcggcccccagacttccggttccgcagtggcatgttgcgggccagggcgaggtctcgccaatggcggcactcgacggagccttcgcggccctcgtccaagccaacccacagctgcgtccgcgggtaggcaatccggacgagctgcgcagcaaccgcatgggccagacattggacctgctcaaacaccgcgtcttcacgcccgaaccgggcctggcggaggccgtcgatggcgccgtgatcacggcgctcaacgaagaagcggtggtcagcgcggcgctgggcaacaagggcggcatcaacttggtcgtctcttacgaggcatttgccgtcaagatgctgggcgcgctgcgccaggaaatcctgttcgcgcgacatcaggcgcaggcaggcacaccacccggatggctgtcggtggtcacggttgcgacgtcccacacctgggagaacggcaagaacgagcagtcgcaccaggatccgacgctggccgaagcgctgttgggcgaaatgtccgacacctcgcgcgtgttgttcccggtcgatgccaacagtgccgttgcggcgctgcgcgcggcctacgcctcgcatggccagttctggacgctggtcgttcccaagcgggccgtcgccagccagttgagtgccgagcaggccgaacgcttggtcgatcagggtggttgggtggtgaaaccctgcgacgcccccgacgtgttgctggttgccatcggcgcataccagctacagcaggccctgcttgcggcgcggcgcctcgaagccgctggacatcggaccgcagtgacctgcgtcatcgagccgggccgcttcagagcaccccgcgacgaacgcgagcaggactttgtggccggcgaccaggccttgcgcgccctgttcccggagactgccgccgtgcgcgtcatcgtctcgcacatgcgacccgagccgacgctgggcctgatgcgtcggatcgatacaggggcgcggcagacccgtgccttgggctaccaggcgcgcggcgggacactcgatgtggccggcatgctgttcgcgaaccgttgcacgtgggcgcacgtcgcggcggaggcggctcaagggctcggtgtcgatccgcagagcttgctgagcgccgaggagtgggcggccgtgcaggggcgtggcgacccgcgcgtcatcacggtctcggcttaa

SEQ ID NO: 8573 - DNA, 852 bp, Pseudomonas aeruginosa
gtaaaccacaggagtgcatttatgtccagacattggttcctcaccggcgcatccagcggcatcggtcgccatcttgctgaaatcatcctggcttcgggggatgacctcacggccaccgtcaggcgtcccgagacgctcgacgacctggcagcacgctacggtgaccagctcgttgtcgaacggctcgacgtgaccgtgaagggggacatcgcacccgtggtccagcgcgccgaggcccgccgcccggtcgatgtcctggtcaacaacgccggcggcggcatcatcggcgccaccgaagagttttccgacgcggacatcgaagggcagatcagcctcaacctgctggcgccggtgcacgtcacgcgggccttcattcccgccatgcgcacacggcgagccggtcggatcatccaaatctccagcgccagtggccaaggctccctgccgaccagcagtctttaccacgccgcgaaatggggtctggaaggcttcagcgaatgccttcgccaggaactggaggggtttggggtcttcgtcacactcattgaaccgggcggcgctcgcacgagcttcagccgcaatttgcagtacgcgccggcgaaccccgcctatcaggacacgcccgctggacagattcgcgcgatgttcgagaacgcgggtgacgagttgtacacgctcgatccgcagaagatcgcgcaccggatcttcgacacggccacgagcgagaagccaccgcttcgggtggcgctgggcggtgacgccttcggcgtcatccaggcggcgctcaagggcaggctgtctgcccttgaagcgcaggagagtctggcgcgatcggtggccttcgatagctga

SEQ ID NO: 8574 - DNA, 453 bp, Pseudomonas aeruginosa
gcacgaggaggtccctgggcagccggacttcctgggtccggcccgccgccacgagctgcgcgagagcacctgagagcgaccagtccttcagcggcctctgtgcgcagtctgcgaccagggcacgcacgacaggcacgaacacggcccgatcggtgccgtcgccgagcaggcccaggtcgagccaggcatcgaccacccattcggcatcctgctcgacgaaggccagggcgaacgccaccagcgcccgccgcatgttgccgtcgacccggcccacgatgccgaagtcgtgcacgcatatgcggccatcgtccatcacgaagacgttgccgggatgggggtcgccgtggaagaagccatcgcggaagatctgggcgacgtagctgtccacgagtttgcccgcggccgccaccgcggtggacgaaggcagaccgtgcaggtgagctccgtggctga

SEQ ID NO: 8575 - DNA, 1272 bp, Pseudomonas aeruginosa
cgatctgcgtggcccggcgcagcgccgagcgttgcgttgggcggcccgcaagacgcacggtggaaacggggcggttcggtcgcgtcatggctcatccaacctgttgcgcaggcggcccgcatgccaggctgcgatgttcgagatggtctcgtcgaggatgcgcgcgatcgcctccgacgtattgaacccgacatgcggtgtcacgagcacacgcggatgcgtcagcagtgggctggatgccgaccagccggtatcgcaacccagtccgccgcagcccgtgggcacttcgggagacagatccccttcctgttccagcacgtccagtcctgctgcggcgacggtacctgcctccagtgcgtgcagcagggcggcgtcgtcgatgagcgcaccccgtgccgtgttgatcagtaccatgcccggtttcatgcgcgcgaaggcctggccatcgagaaggtggtgcgtggcctgcgtggccggaacatgaaggctcagaacatcgctgctttgcaggatctgctcccacgtcaccacgcggacgccggcgatgggtgctgccgtgatgtcgagcgatggggcgagggccgggtcgtacgcgagaacttccatgccgaagcccagggcgatacgggccacgtggcgcccgatccggcccagcccgacgatgcccagcgtctttccttccagctcgaagccggtgaggccgcggtaagcgaaagaaccttggcgcgcccgctcgtgggcttgtgtcagatggcgagccacgcccagcagcagcgcgaaggcatgttcggcgacgctggcggacccatagtccggcacgttgcacacggcaatgccgcgtcggcggcaagcctgcaggtcgatgtgatcgaagcccgcggagcgcgttgccacgagccgcacgcgcggcagcaaccggagcaccgattcgtcaacgcgcgtgcgcacgaagacgcacagcacctcggtgtcttcatcgccgacatcggataccaccaggcgttcgttctggacgaagtgcgcgtgccagtgggtcggaagccgttgctgcagcgcggcctggtccgccggtgcgatgtcggagaacagaacggacagacggttttgtgcggtcatgagccctcctcgattacccggtgcagggacaggatgcagaacgcggcgatgaagtgcccggtcttggtgccttgcgcgagttccgcttgcgcgaataccgtcggcagccggccggcgaccgcatcgcgcatggtctcgaatccgtcgagcaactga

SEQ ID NO: 8576 - DNA, 1074 bp, Pseudomonas aeruginosa
gccagctcgcccggcgcctgggcgtgcagcgtgaagagcggctgtcccgcttcgacctggtcgcccaggcgcgcatgcacgtcgatgccggcggcagcggcggtcggtgctccggcgagcttggccgcccgcgcgagcagccggttgtcgattcgggagacccgtcccgtggacggcgatgcgacggtgtgccgatgcgttgccaccgggatgctgcgcaggccgccctgctcagcgcagatcgcctcgaacgtggcccaggcgcggccgtcggccagcacctgcgtggcgagcgtcaggccgccgccggcgggcgctgcaccgcccatttcgaggatgtccgccgccagccgcaacgctcgctcccgcaggtcggccggggcctcgggcgtcccttgtaggacggccagcacgtcgcgggcctccagtgccgggccgatcccgcggccgaccggctgctcaccatcggtgacgcgcaaggccacgtgcaggccgatggcgctgcccacctcctgcaggcgccgaccgagcgccgccgcggcctgcgcgctgcgcactttggcggtggcacccacgggcaggtcgatcagcacatgggtcgagcccgcagcggccttcttggacaggaccgaggcgacgagctggccctcgctgtccaggtccagcggccgctcgacgcggatgaggatgtcgtcggcggggctgagccgtaccgagccgccccagacgatgcagccgcccgtgcgttcgaccacgcgccgcatgcttcgcacatccaggttcaccggcgccagcacctccattgtgtcggccgtcccggccggcgaggtgatggcgcgcgaggaggtcttgggcatcgtgaggccgcaggcggccacgatgggcaccacgagcagggtcgtgcggttgccgggcaggccgccgacgcaatgcttgtccaccaccagcgggcgcccccaatcgatgcggtcaccgacgccaatcatggctttcgtgagcgagacggtctccgcgaggtccaggcgatcgccggcgcaggcggtgatgaaggtggccagatgcaggtcagagtaa

SEQ ID NO: 8577 - DNA, 1146 bp, Pseudomonas aeruginosa
cgcggccgctgggacactgacacgcgacgtcacgcgcttgatccccggcaggcgcgtgcgcttgagcatcagcgcattgatcgcgacgatcgcggaactgcccgacatggacaatgcagcgacctcgggcgacaaggtgaacggatacagcaccccggccgccagcgggaaggcgatcacgttgtaggccacggcccaccagaggttctggtgcatcttgcgcagcgtcgcccgggacagttcgatggccccgaccacgtcgtaggggtcactcttcatcaacaccacctgggcgctttccatcgcaacgtccgtccccgcgccaatcgcaaagcccacgtcggcctgcgtcagcgccggagcgtcgttgatgccgtcgccgaccatgccgaccttgtgaccctgctgctgcagttccttgatcttggaggccttctgcccgggcaacacatccgcaagcacgatgtcgatacccagttccttgccgatgcgctcggcggtcgcctggttgtcgccggtcagcatcgcgaccttcacgccgcgtgcctgcagcttggcgatcgtctcgcgcgaggtcggccgcacggcatcggcgatcgcgatgaggccgatcagccggccaccgcgcgcgacgtggaccacagtgcgccccccgccttgcagccgcgccgcctcgctggcaaggggggccagatccacctgttccgactgcatcagcagccggttgcccaggagcaccgtctcgcccccgatagtggcccgtgcgccttgcccatcgatgttggtgaagttctcggtgacctccgtcggcatgtctcccgcacgcttgagcactgcgagcgcgagggggtgctcggagaacttctccaccgcggcggccgtcgccagaagccgcgtctcctcgacaccgggcgcggccaccatctcgacgacatcgggctgccccagtgtcaaggtgccggtcttgtcgaacaccacgaccgtcaacttggtggcgttctccaatgcggccgcattcttgaagagaatgccgttcattgcgcccagcccggtcccgaccatgatggccatcggggtggccagccccagcgcatcagggcatgcgatcacgaacacggtgatggtcaaggtgagtgcgaacagtaa

SEQ ID NO: 8578 - DNA, 1440 bp, Pseudomonas aeruginosa
tgtctgtcccatcacccagtaccagacgctgaaggtcagcaggccaatcacgatcgccgccagcaccagccactgggatgcgtggtcggccagcagctggccgggggccttcgagttctgggcctcctggaccagcttgacaatctgcgccaaggccgtgtccgcgccgaccttcgtggccttgtagcgaaagctcccgctcttgttgatgctggcgcctacgacggtgctgcccacgcccttcttgaccggcatggactcgcccgtcagcatcgactcgtccacttgcgacgcgccctcgacgatctcgccatccaccgggatcttgtcgccgggcttgatcacgaccagttccccggctgcaacctcggcggtcggtaccttggtctccaccccgttgcgcacgaccgtggccatgggtggggcgagatccatcaacgcgcgaatcgcgtcggatgcgcccgcgcgggcgcgcatctccagccagtgccccagcaggatgaagaccagcagcaccgatgccgcttcatagaacacctcaccctcgtagaagaaggtcgcgccgatgctgaacaggtagccggtgcccaccgacagcacgaccaacgtggccatgttggcgacgccgttgcgcagcgcgcgccacgccgccacgtagaaaggccaacctggatagatgatcgcggcacttgcgaggaagaaaagaaagagcttgtcgtccagcccgaacggcgtctggaagtcgccgaacatcttccccatcggggaatagaagaacacgggaatggcgaagaccagggccacgaagaagcgattgcgcatgtcccgagccatgtcctgcatcgagcccgacccgtggcccatgtcgtgcatcatgtcgtccatcgcagggtcgcctgcgtgggcctggtgcgcagcatgggcggcgggcgtcgtggccgcagccttcgcgcgtgcggccgtggcgggggcatgcgcgtggtgcccctcatgccccatctcttgcgcctgacgtgcgggtgcgccgtgatggccgtgcaccgcatggctggggtcggcagagacgccagcggcgggcgcgcacacgtgcttgggcgtctgctcgccacggcagtgatagccgcattcggcgatgcgctggcgcagatcctcgacactgagttgtccctcatcgagatggaccgttgcgcttcccgcaacatagttgacatctgcatgatggacgccgggaagctgcagcagcttgcggcgtactccctccgcgctcaggctcgatacgagccctccgacttcaacgttgatcgacttcatggctgttcttcctgttcgctgtgttcgtggtctcaacgagcgagtcggcccgagtccaggcagtcctgcgagaactcgaagacgatctcccggtcgggagcgatgaccttgtgcttcttgccggcgtag

SEQ ID NO: 8579 - DNA, 1041 bp, Pseudomonas aeruginosa
  unsure (922),(924),(1021): Identity of nucleotide at the above locations are unknown.
cctgaactcacgcgagcggaacgccgcgccgttgtccgtcagcagtcgctgcacggtgatgcccaggcgggtgtaataggccacggcattgcgcaggaacaggaccgcctgcgccgtcttctcatcgggatgcatggcggtgaacgccaaccttgcgtgatcatcgatggccacgaacagcgtctcccagcctgcaccatcgaccgagtcgcgacggttgcctgtgacgcggtggctgggccgcacgatgcgcccgagcttcttggtgtcgatgtgcagcaggtccccgggcgcctcgtgctcgtagcgcacaacggcttcgacgggctccaggtcgctcaacctggacatgcccgctcgcgccagaacgcggctgaccgtggactccgagacgcccacactgcgtgcgatgcgagcctgcagcattcgacgtttgcgcagctcgacgatgagcaaagccttgcccgcatcgatggccctgggcgatcgcagcggcctggaagaggcatcggccaaggcggcttggccaccggccaggtaacgaccgagccacttcctggccgttggcgcagtgacgccgtgcgcggctgcggctcgcacggcatccaagccttccagcgtcatctgcttgaccatctcgagtcggcgggcaaaggtaagtcgggcatgcttatgggtgttcatccggttgggcgtcctgagtggattgggtgtttggcgacttccagtctctcaaacccaatccggatgaacaccggatatcacctattggagcttccaactagcagtcatcacttcttcgaaactgcattgatcgcaatgcttcccgccctcccgccaacagccttgggatctccggtggcacaacgaagccttggatcacttgccggggcgaacgcccgccaaaccagggccatgattncnaaacgtgggcagttcgaagaacatcgggcccgtgtacaacatcgggaacctttcccgaaaaccttgttcagggcccccaccgggttcaattggtttncggccggtcccgccgaaacc

SEQ ID NO: 8580 - DNA, 366 bp, Pseudomonas aeruginosa
atccggttctaccaacggaagggcttgttgccggaaccggacaagccttacggcagcattcgccgctatggcgcggcggatgtaacgcgggtgcgctttgtaaagtcggcccagcggctgggcttcagcctggatgagattgccgagctgttgcggctcgacgatggcacccactgcgaggaagccagcagcttggctgagcacaagctccaagacgtgcgcgaaaagatggccgacctggcgcgcatggaggccgtcctgtctaatcttgtgtgcgcctgccatgcccgaaaggggaatgtttcgtgcccgctgattgcgtcgctacagggcgaaacaagcttggcaaggtcggagacgccttag

SEQ ID NO: 8581 - DNA, 1071 bp, Pseudomonas aeruginosa
ctaaacgatcctgcgggcgaattctttcgcaaaaggctgcgcatgggttctcctagcgtccacatgcagataactgtaatctttgccgtgcaatgtgataatcacctgcttattccgattactaaggaattggagtctttaatgactgctggggtagatcgcttcgcggggattgatgcattcgtctcgacagctcaagccggcaatttcactgctgcagcgcaagctctgggcatgacgccttcgggcatcgccaagagcgtcgcgcgcctggaggcgcgattgggagtgaagttattgcatcgcacgacccggcgagtgagtctgacgcctgaaggtgaggcctatttggagacctgtcatcaggtgatcgaggcactccagtcaaccgagggagcgctctcgccgatcgaccgggcaccacgtggccgcgtgcacctgcaattgcccggtgcttttgggcgccggcatgtgcttcctgaactactcgccttggcaaacaagtttgatggcctcgacctatcggtggccttcaccgagcgcaccgttgatctggtcgaagcgggttacgacctggccgtacgcatcggtgacttggccgacgaagcaaatttagtggccaaacggcttggcacgcagaggctcgttatctgcgcggcgccgagctatctgcaacgctatggagcagttcttacgcccgaagagttaatgcatcgggactgcatcactggtcctcggggacggcagagacccacttggttgctccgcgtctcggaccagcgcgtacgtcggcaggaaatctatccgcgccatgagttcagtgatggtgaagcaatgctggcggcgggtctggccggctgcggcatcatgcagatgccgacatggctggtggccgaagatatacggcaggggcgcttgatccccgtgctgccggactgggcaggtggtgagatgcctatccatgcagtgtggccgcaatcgcgttacctgcagcccaaggttcgggctgtcatagccccggcggccacccaaactcccccactgatggccaccccaaactccgccacctga

SEQ ID NO: 8582 - DNA, 2463 bp, Pseudomonas aeruginosa
gttgatcggggacaggaggtaagagccggcgccgtcggcacctgttggcaggacacattgaactgggtcttcccgagggaaggccaaggagtgaatgtcttgaagcccaataagcgcgcgacgatcctgacgctgctcgaacgcggaaagtcccagagggagatagcccggcttaccggcatcgaccgcaagacggtcaagggctaccgggagcggtggctggccgaaggagcaaattcccccggggtggccaccggctctgaagtggccgtggccacccccggccagcaaactcccccaccctggccaccggctggcatgccggtggccaccagtcggtgtgagccccaccgcgacttcatcgaggcccaggtccggctgggccgcaacggtgtggcgatctaccaggacctggtcgaccagcacggctttgccggcgcctacaactcggtcaagcgcttcgtggccaagttgcggcacgaggagcccgagcggttcgaccggctgtcgttcctgcccggcgaggagatgcaggtggactacggcgagggggcgccgacgcgggtgccggggacggaccgctaccgcaagccccggctgttcgtggccacgctgcgctactcgcggcgcagtttccggcgcgtggtctggaagtccagccagcaggtgtgggcagaactgcacgagcaggcctggcgctacttcggcggctcgtgccgctacgtggtgctggacaacctcaaggagggcgtgctcaagcccgacctgtacgagcccgagctcaacccggtgtttgccgccacgctggcgcactacgaggtggtggccgacccggccagggtcagggacccgaaccgcaagggcaccgtggagagcgccattggccacacccaggccacggcgctgaagggaaagcgcttcgagaccatcgaggcccagaacgagcatctggagcgctgggagacgcgctgggcggcccagcgcatccacggcaccgagcgccgccaggtgcaggccatgttcgaggacgaacgcgcccacctgcagcggctgccgctgaccggcatgcagtacttcaagcaggaggagcgcaccgtttgcgacgatggctgcgtgcgcgtggaccacagcagctactcggcccgtccgatggccatcggtgccaaggtcctggtgcgcatcttcgagcggcgcatcgagatccgcgagctgaccacggggcggctggtgcgcacccacgagcgcgccgaacggccgggcacggtggtgatgccgcaggccgagcgcgtcttcaatccctcgcgcgagacgcgcttcatcctcaagcaggccgaccagatcggcccccaggcggcacgcctgtgccgcatgctgttcggcatcgaaggccgggtgggccagcgcaagctgcacggcatcgtcaacctcagccgacgctacccaagccgcttcgtgaacgccgcctgcgcggccgccatcgagcagggcatccacagctacaagcacgtcaaggcgctgaccgagcgcctggtggccgaggccctcgcatccatcgatgccgccggcgatgggaccgaccctggccgcgccgatctcgcccaggagcacgtactcatccgcgacaccgaggagtacggctcgctgttcaacctggccgccacccaggccggcgtcgataccagcgagggaaggcggcctgtgaccttgatcgagattgaccgtaccttgcgccagttgcgcctgtcgggcttcgccgacaccttgaacacccgcatcatgcaggcccaggccgcccagcagcccttcgtcgagaccctcgcggccttgctgcaggacgaactggatcgacgccgcaccagccagaccgagcgcagctacaagcgctctggcctggacgagcggcccacgctcgtggacttcgactggcagttcaaccccaagctgccgcgcgcggcctgcttcgagctgcacacgctgaagttcgtcgccgagggcgccaacgcgctgatcgtgggcaagcccggcaccggcaaaagccacacggccaaggcagtggcctaccaggccacgctgcaggggctgcatgtgcgctatatcgaggccgacaccgcgctggctcagtacgcactggccagtgcccaggagcaggccgccttgatcaagtcctggagcgaaccggacctgctggtcctggatgacctgttcctggcccgtcgcatcccggaggccgcggccgagttgctccaggccgtcgtgcatcgccgctacaagctgcgccgctccatcgccatcacctccaaccgcgtggtcaccgactggggcaagtacctcaaggacgtcaccatggccaccaccatcctcgaccgcctcatgcaccgctgctcaatgctggagttcgagggcaagagctaccggctcaaggaggccgccagccgcctggccctcaacaccgagccttcataa

SEQ ID NO: 8583 - DNA, 405 bp, Pseudomonas aeruginosa
cagttcttctcgcgttgggttgcgcccatcggggcaacgttccgccaaggcctgcttcaaatagatgagcatcaccacgccgaactccgccgccacacctgccagcgcaatgaatcccacgccggtggcgatggacaggttgtaattcagcaggtacaggaaccagatgccccccgtgagcgcgaagggcaaggtcgccatgatcaagcccgcttcgtccacacgcgcgaaggtcaggtacaacagaacgaagatgatcaacagggtggcaggcaccacaaccttcaggcgtgcattggcccgctccatgtattcgaactgcccggagtaggtgatgctcacacccggctccagcttgacctgctgcccgatggcatcgcgcagttcgttggccaccgaggctag

SEQ ID NO: 8584 - DNA, 660 bp, Pseudomonas aeruginosa
cgacgtcacgccgggaatgcccttggcgacctgctcgacctctgcagcgatgcgatcgatcacgcccaggtcgttgccggtcaccttcaccccgatcgggctcttgatgccggtagccagcatatcgatgcgattgcggatagggggaatccagatattggacaggcccgggatcttcacggcacgatccagctcttccacgagcttctcgggcgtcatgcctggacgccattgttccctgggcttgagcttaaccgtggtctcgaacatctccaggggcgccggatcggtcgcagtttcggcccgtcctgccttgccgaacaccttgtccacttcaggtacggtcttgatcatgcggttgctcagctgcagcaactccgtggcgcgctgcgccgagagtcccggcagggccgagggcatgtagagcaggtccccttcgtccaacctcggcagaaactcaccgccgagccgcgccaagggccaggccgtggtcgccaaggccagcacggcgatcagcagcgtcgccttgggccggcgcagtacccactccagtgctggccggtaggctgcaatcaggatgcgggtgatggggttcttctgctcatccgggatacgcccgcgaatccagtagcccatgagtacgggaatcagcgtcactga

SEQ ID NO: 8585 - DNA, 282 bp, Pseudomonas aeruginosa
ggagttgaattgatcaaggtcagtttccaggatgaattgatgcgtctggacggcgccttggcccgaaccggcacccgctgcaaatccaccggcaagggcgggcaccgcacgtggttgtcatgctttacgcgcctcggcaactcgcaaggctctaagctcaaatcgatcagctacaagattcgtctgtcccgagagtcgctgcaggtgcgtaatgacctcgtaggggccatcggctattgggcgcgtgcagattccgcactggctagcggtttcgatgcgtga

SEQ ID NO: 8586 - DNA, 210 bp, Pseudomonas aeruginosa
ttctcggcagtagccttcgcaggccagtttgtcgcacagaaccagtgggtgaccctgaagttcgttcagcggaacttgcttgtgcgcaagaagcgagtgccgcgctggcacggcgatcacaatcgggtctcgccagatcggttcagccacgatgccttcgccaacatccgccgcgtgtgcaaatccgatcgtgaagtcgccagaccgtag

SEQ ID NO: 8587 - DNA, 546 bp, Pseudomonas aeruginosa
gaacgaaatgccgagataaggcttgcacctttgcaacggcgtggaacgaaagaaacggtttgctgggcgatagcaggctcctgtagtttcagaaagaaaatccggtcacagtcggctcgctctcaggcgcaaggcgttgccaacgaccgacgccgaactcaggctcatcgccaatgctgcgatcagcggcgacagcagccagcccgtgaggggatagagaaccccggcggcgatggggatgcccagcgcgttgtagaggaaggcgaacatgaggttctgcttcatgttgcgcacggtactcaccgagagcgtgcgagcgacagcgatgccacgcaggtcacccttgaccagcgtgacctgggcgctgttcatcgccacgtcggttcccgttcccatggcgatgcccacgtctgccttcgccaaggccggcgcgtcgttgatgccgtctccggccatggcgacgatgcgtccttctttctgcagtcgctcgatcaacatgagcttgtccgccggcttgacctcaccatgcacctcgtcgatgcctag

SEQ ID NO: 8588 - DNA, 831 bp, Pseudomonas aeruginosa
gcgtgcaccgacggctttggcggtggtctgcccgtccccggtggccatgatgacccgcaggcccgcagccttcaacgcggccagggcctcgggggtgctgcccttgaccggatcggacacggcgagcaagcccgcgagctgcccgtccaccgccaggtacatgacgctggccccttcgccgcgcagagcttcggcctggggtacgagcggttccaccgatacgccagactgttccatcagcactgtgttgcccaacgccagttgccggtgctcaacctttccgcgcacgccgatgccggttcccgattcaaagctctgaggcttcacgagttggaggccctgggcacgcgcggcctgcacgatggcgtcggccagggggtgttcactgccctggtccaggctggccgcaagacgcagcacctcatcgttcgtaaagccgggggctgcgacgacctgatcgaaagcaggtcggccttcggtcagggttcctgtcttgtcgatgacgagggtatcgaccttgcgaagattctcgatcgccgcggcatcgcggaacagcacgccctgcgtggcgccacggcccgttgcgaccatgatcgacatcggcgtggccagacccagcgcgcacgggcaggcgatgatcaggacggccaccgcattgatcagtccatagacccaggtgggctgtggcccgaagaatccccatacaaggagcgtcgttaccgcaatggcgacgacggccatcacgaagtagccggcaacgacatcggccatgcgttgcatcggtgccttggaacgctgcgcctgggcgaccatctggacgatctgcgatag

SEQ ID NO: 8589 - DNA, 858 bp, Pseudomonas aeruginosa
aacggtgtccgagccgatccgctccgaacgcatgaccagcgcgccgctggtgttgagtgtggccccgatgaccttgtcgcccacgcgcttgctgacgggcagcggttcgccggtcagcatggattcgtcaatcgagctgctgccctcgtgcacgatgccatccaccggcaccttctcgccgggtcggatgcgcagcaggtcgccgacgtgcacatggctgagtggcacgtcttcctcgctgccgtccgcattgatgcgccgcgccgtcttgggtgccagccccagcagcgacttgatggctgccgaagtctgggagcgggccttgagttccagcacctggccgagcagtgtcagcgagatgatgacggcggcggcctcgaaatacacgccgacccgtcccatggacatgaaggaagctggaaacacttccggcgcaacggttgccacaacgctgtagatgaatgccgcacccgttcccaggccgatcagtgtccacatgttcgggctgcggttgaccacggacagccagccgcgggagaagaagggccagccggcccacagcacgatcggcaacgacagcaccaactcgacccagctctgtgtagccatgtccatcaggtgcagccgctcgcccagcatcgccagcgccaagaccacgagcgtcagcggcaaggtccaccagaagcgacgcgagaagtcacgcaactccgggttgtcgtcatcgaggtcgggcagcagaggctccagcgtcatcccgcacttggggcaggttcccggatgatcctggcggatctccgggtgcatcgggcaggtgtagatggttccgggcgcggttggcgatgccgccggggccggtga

SEQ ID NO: 8590 - DNA, 297 bp, Pseudomonas aeruginosa
ggcgtctccgaccttgccaagcttgtttcgccctgtagcgacgcaatcagcgggcacgaaacattcccctttcgggcatggcaggcgcacacaagattagacaggacggcctccatgcgcgccaggtcggccatcttttcgcgcacgtcttggagcttgtgctcagccaagctgctggcttcctcgcagtgggtgccatcgtcgagccgcaacagctcggcaatctcatccaggctgaagcccagccgctgggccgactttacaaagcgcacccgcgttacatccgccgcgccatag

SEQ ID NO: 8591 - DNA, 705 bp, Pseudomonas aeruginosa
acccgaacctggggcgctcggcagcgttgtttccgcgatgggttgcgccgcgtgctttccggccatcgccagcttgggcgcggccatcggcctgggctttctacaggaatacgaaggattgttcatctccaagctgctgccgctgttcgctgtcgtggctttgctggcgaacgcattgggctggctcagtcatcgccaatggcaccgcagtctgctcggcatgatcgggccagccatcgtgttcgccggaactgtctggctgcttggcaactggtgggcagcacacctcgtatacaccggcctggcgctgatggtcggcgtgtcgatctgggacttggtttcgccggcaaatcgccgttgcggcccggacggttgcgaacttcccacgaaacaaggctgacggcgggagccggcagccaatacagaaaaggaacgattaatgaccaccctcaaaattaccggcatgacctgcgactcctgcgcggttcacgtcaaggaggctctggagaaagtgcccggcgtgcaatcggcggaggtttcctatgccaagggcagcgccaggctcgccatcgaggccggcacattgccggatacgctgaccgctgccgtggccggactcggctatcgggctacgcttgccgatgcgcccgtggctccggcgggcggcggattgctcggcaaggtgcgcgaatggctgggcagtga

SEQ ID NO: 8592 - DNA, 594 bp, Pseudomonas aeruginosa
agaaggcagcggacggctcatcggcgtgcaggcggttgcaccggaagccggcgagctgatccagacggcggccctggccattcgcaaccgcatgacggtgcaggaactggccgaccagttgttcccctacctgacgatggtcgagggcttgaagctcgcggcgcagaccttcaacaaggatgtgaagcagctttcctgctgcgccgggtgagaaaaaggaggtgttcgatgaacgcctacacggtgtcccggctggcccttgatgccggggtgagcgtgcatatcgtgcgcgactacctgctgcgcggactgctgcggccggtggcgtgcacgccaggcggctacggcctgttcgacgaggcggccttgcagcgtctgtgcttcgtgcgatccgccttcgaagcgggcatcggcctcgatgcgctggcgaggctgtgccgggcgctggatgcagcggacggcggcgaagcggccacgcagcttgccgtgctgcgccagttcgtcgaacaccggcgcgaagcgttggccgatctggaagcgcagttggccaccctgccgaccgagccggcacagcacgcggagagtctgccatga

SEQ ID NO: 8593 - DNA, 408 bp, Pseudomonas aeruginosa
cagagatcgccgaccttggtttcaggctgccccatcgccgccatcgccagccgcagcttggcggcggtcatcttgaacggccggccgccttttcggccgcgtgcccgcgccgatgccagaccggcaatcgtgcgctcggcgatcaattcgcgctcgaactcggccagcgcagcaaaaatgccgaagaccagtttgccggcggcggttgtggtgtcgatggccgccccgtgcccggtcagcaccttcaggccgataccgcgcccggtcaggtcgtgcacggtattgattagatgccgcaggtcgcgcccgagccgatccagtttccacacgaccagcgtatctcccggccgcaatgccttcaggcaggccaccaagccggggcggtcttcgcgcttgccagatgcctga

SEQ ID NO: 8594 - DNA, 204 bp, Pseudomonas aeruginosa
gattccagccagcagccatgcagcgggcagctcagcatcaggggcagcttccatgcaagcagtacggcttggtttgccgggtcgttcagacagagcgggcaggcgcgatgtatcggctggctgggcagccaggcacgccagctcgtgatggatcgcgtcctacggcggagtttcggcagcagcaccgagagctggaacgcatag

SEQ ID NO: 8595 - DNA, 471 bp, Pseudomonas aeruginosa
cgctgttgccggccaggacgttgtgcaattcgtcgatcaccagcatgcgcacgccgaccttgcgtagcagtgccagcgccaattgctccatttccggcagccgtgggcgcgggcgcaatggcgcgcccatcgcggcaagtagcgcgacgtagaagcggattaccgacggttcggatggcatctgcacgaccagtaccggaatgtgctcctggtcggcgtcggagctggccgggtgggtgcggcggaatttctcgacgatcatcgacttgccgttgttggttggaccgaccaacagcaggttgggcatgcgttgtttgttcggccacgcatacagggcttccagccgattcagcgcctcgactgctcgcggatagccgatccagcggtcagcgcgaaggcgatggatgcgttcgtccgccggaagacgggccaagccctgggccaccggcatcaggtgggacaagtcgatga

SEQ ID NO: 8596 - DNA, 873 bp, Pseudomonas aeruginosa
tgggatattcttccacggctaccactcctcaatctggtcgaacggtttggcaggtggctggttgtctgcctgcgggtcagccatgtccgcgtccggtggtggcgtggttttgaaaagaactgccgttgccttgagatgctggcgtcgatccgcgtcgcgccgcgccttgcgcgtagctttctgcgcggtggacacgatttcgcgcatctggccgatcatgcgaaacagcgccgactcatccacctgttcgcgcccttgctgccgcaatttcgccagcgcctgtcgttgttcccagagggtgacagccgggtgcgacaaggtgcggtatggaatttccagatagtgctgcccctccggctccagcacccaaatgcggctgatgtcgcgcgggtcgcgccggatcaggaacgcaggcaagcggtcgcgccgagctatccacggcttgagcgcatcggcgtagtaatggatgtggtcgatgacgaagccggtgcgggtcagcgtgcggcggatgatgggcagaaaatcgaccagaaaagccgtggtgcgagtgatgacggttggcacgccggtccgcgcgatagcttcggcccagcgcgctgccggcggctggagcaggccgttgtgcacggagccgtggtaggtgccgaccgccaatgtgagccagcgctccagctcacgcagcgtcagggcggccttgttttcggaatcgtagtcgccgcgctggtcagggttggagaaggtcgtccctggcaattcgtcgtggatcatctgcatcgccgtgccgatgatccgttccacgatgccgccgtagtgcggctgcccgagcgggcgatagtcaagccggatgccatgctgctcgcagcctcggcgtag

SEQ ID NO: 8597 - DNA, 183 bp, Pseudomonas aeruginosa
cggcaggcgccgacatcatgcgcttgtgtatcccatcgctacgtccacaccgcacgggagggcctttgctcggccgcgatccggtcacagttccggacaccgttcgtagatagcctccgatcggtgccgaacgtctgcctgctcggcacatctggcgcgcgctcacttggcggtgtgcgctga

SEQ ID NO: 8598 - DNA, 318 bp, Pseudomonas aeruginosa
aaccaccggagcatcatcatggaaaccatcgaactcaaggttgccggcatgacctgcgcctcctgcgcgaactcggtcagcaaggcgctcaagcgcgtagctggtgtgcaagacgtgcatgtcgatctcgctcgcggcgcagcgagtgtcaccggcgaccagacggcccagaagacgcctgagctgatcgcggccttagctgccgcgggctacgaggcatccgctgattcctcgccgggcattgcggcgggtgccggtgcctcccatgcgccggccgctgcccgttcaaaggggcatggcggctgctgctgccgctga

SEQ ID NO: 8599 - DNA, 1146 bp, Pseudomonas aeruginosa
cggagctccgacatgcgcgtcctcgccatcaatgccggcagtgcgaccctgaagttcggagttttcgagtcggctcgtaccttgccattgatcgactcggcgattgatcatcctgcggtggatgctgcgaccttcgaggagatcgagcggcacttgcacagggcgggtgtcacaacgctcgatggcattggtcaccgcgtcgcacacggtggcccactgttgagcaacgcggtgctcgtggatgaagaagtcgaacgcgagatcggcaaggcttcggctctggcgccgcatcacaatcctgccgcattggccggcatacgcctgacccgtgagcgttggcccggcgtgcgccacgtcgcggtcttcgacaccgctttccatgacgacatgcccgaatacgcccattcctatgctgttccgccatcgtggcgcgcggcaggggtacggagatacggcttccatggcctgtcccaccagggtgtactggccgccgtcagcaccgagctgaaacggccgccgtcagaacttcgtatcgtgagctgccacattggaagcggcgccagcgtctgcgcgatcgatcgcggaaggtcggtcgatacatctatgggaatgaccgcgcttgaaggtcttgtgatgggcacgcgctgtggagacctcgaccctggcgtacccggcttcgtcgcacgcgcactgggtttgacgttggcgcagatcgaggcggcgctttacagcgacagtggactcaaaggattgtcgggtgagagttcggacctgcggattgtggagaagcgcgcgggagaaggagtcgcagccgcccaactggcaatgcaggttcacgcgtaccgcgtgcgcaaatacatcggcgcctacgccgccgcgatgggcggttgcgatgctgtggccttcactggcggagctggagaaaattcggccgcgttgcgtcggcgcatcgttgatggcctggagttcatcggcctggaactagacgaagagcgcaatcgcgcctactcgcccaacactgaagtcgcccagttgcagtcatcccgatccgccgtcgccgtgctggtggttcaagcacgcgagcagttagcgatcgcgcgtgagacgttccgagcgctgaatgaccaggcaagtggtttggtatag

SEQ ID NO: 8600 - DNA, 660 bp, Pseudomonas aeruginosa
agccctcgcggagtctggcctcgcgcgtcgcacgtcgcttctcccatcgccattcgcgtcaaaccgatcaggccgcgatctcctttcactacgatgtgtccaacgcgttctatggactctggctcgatgccgagagggtctactcatgtggctatttcaaggcgacggatgacacgctggaccaggctcagcgcaacaagctggagcacatctgccgcaagctgcgcctgcagcgaggcgaacgcctgctcgacatcggctgcggctggggcgcgctcgtgtgctgggcggcaagagaacatggcgtccgtgcgcacggcatcacgctcagccaacagcaactcgaatacgcgcgcgagcgcatccgctcggagggcctgcaggatctcgtcaccgttgaactgcgcgactaccgtgacctcgaaggcacggccgttttcgacaaggtgtcaagcattggcatgttcgagcacgtgggactcgcgaacctaccggcctactacgcggtggtccagcgggttttgcggccaggaggactcttcctcaaccacgggatcacccatgacgaggagggctggagccgaaccgtcgcgaccgagttcatcaaccgctacgtcttccccgacggcgaattggactgcgtcagcaatatccagctag

SEQ ID NO: 8601 - DNA, 777 bp, Pseudomonas aeruginosa
agggggacatcgcacccgtggtccagcgcgccgaggcccgccgcccggtcgatgtcctggtcaacaacgccggcggcggcatcatcggcgccaccgaagagttttccgacgcggacatcgaagggcagatcagcctcaacctgctggcgccggtgcacgtcacgcgggccttcattcccgccatgcgcacacggcgagccggtcggatcatccaaatctccagcgccagtggccaaggctccctgccgaccagcagtctttaccacgccgcgaaatggggtctggaaggcttcagcgaatgccttcgccaggaactggaggggtttggggtcttcgtcacactcattgaaccgggcggcgctcgcacgagcttcagccgcaatttgcagtacgcgccggcgaaccccgcctatcaggacacgcccgctggacagattcgcgcgatgttcgagaacgcgggtgacgagttgtacacgctcgatccgcagaagatcgcgcaccggatcttcgacacggccacgagcgagaagccaccgcttcgggtggcgctgggcggtgacgccttcggcgtcatccaggcggcgctcaagggcaggctgtctgcccttgaagcgcaggagagtctggcgcgatcggtggccttcgatagctgatcgctgtttcaggtcaagcccagggcgacggcaaagccagcagcagccatggccgcgtacgacgggagcactctccatgcgagcgccctaccgcccagcgacatcaacaggacaagtttggtga

SEQ ID NO: 8602 - DNA, 1506 bp, Pseudomonas aeruginosa
gagcgaccagtccttcagcggcctctgtgcgcagtctgcgaccagggcacgcacgacaggcacgaacacggcccgatcggtgccgtcgccgagcaggcccaggtcgagccaggcatcgaccacccattcggcatcctgctcgacgaaggccagggcgaacgccaccagcgcccgccgcatgttgccgtcgacccggcccacgatgccgaagtcgtgcacgcatatgcggccatcgtccatcacgaagacgttgccgggatgggggtcgccgtggaagaagccatcgcggaagatctgggcgacgtagctgtccacgagtttgcccgcggccgccaccgcggtggacgaaggcagaccgtgcaggtgagctccgtggctgaactgctggaccatgacggtcggcgtgcacaggccgtccaccacgtcggggatcacgatgtcggcagagccgcgccaggcgtcggcgaaacgtcgcacggaagctgcctcgcgcgacaaatccatctcgtagcggaagttggccgcaacctcgtccacgatggctgccagcccccagcgacgcagcgagggcacgagcccctgcatgaccaggacgatgcggcgcaggatgcgcatgtcggtctcggcctgctcggccgcgccagggcggcggatcttcaccaccacttccgtcccgtccggcagggctgcacgatgaatctgggcgatcgaggccgcggcgagcgcgtgcatgtcgaagcgtgcgaagagctgctgccatgggcggccgagcgccgcctcgacctcctggaccgcctgctcgggaggaaacggcgccacattggcctgcaggctggccagagcctcttgcgcatcgggcgccagaatgtcggcccgcaggctgagatgctggcccagcttcacgaaggtcgtgcccaatcgctgcagcacttcggcgaagcggtcggccgcccggtgggtatcgcagcgcatcaggccccggtgccaggccacccagagcaggaacccgctcagggccatagcgatctgcgtggcccggcgcagcgccgagcgttgcgttgggcggcccgcaagacgcacggtggaaacggggcggttcggtcgcgtcatggctcatccaacctgttgcgcaggcggcccgcatgccaggctgcgatgttcgagatggtctcgtcgaggatgcgcgcgatcgcctccgacgtattgaacccgacatgcggtgtcacgagcacacgcggatgcgtcagcagtgggctggatgccgaccagccggtatcgcaacccagtccgccgcagcccgtgggcacttcgggagacagatccccttcctgttccagcacgtccagtcctgctgcggcgacggtacctgcctccagtgcgtgcagcagggcggcgtcgtcgatgagcgcaccccgtgccgtgttgatcagtaccatgcccggtttcatgcgcgcgaaggcctggccatcgagaaggtggtgcgtggcctgcgtggccggaacatga

SEQ ID NO: 8603 - DNA, 582 bp, Pseudomonas aeruginosa
atctggccggaggattcgtcatggcacggccagcctcgctcggggctcacggaactgccacagcacgatgaagctgagcacagcggcaaagaagcaccacaccgagatgaaccaggttgcatagaacatgtaggcggcgattgcggagacaaaggcggccaccccaaaagccgccacgcgccggtggctagaaaccatcaggcttgcgcaggtgccgatcagatacagggccatcgtggtcatcacgtagaagtgcggagagtcgtagaggatgtgctggccgaccacgcgggccgtgatgggcagcttcaccagcatcgccagcaggtacagaccgacgagcgcgcccgcgactgcaatggccaccagaacccgacggcgccaacggacgctctccagcgccagcgcagccagcgggacgtagatcggccacaggacgtgcgagaagaacgagtagagatgcgtcagcgccacgttcagcaagggcgcgcggtcggggaacgtcagccacagcatgccttcgagcagttgctggaccccgaacagcagcgggatggcggcatacggcagttcgcgccgtga

SEQ ID NO: 8604 - DNA, 438 bp, Pseudomonas aeruginosa
agagcggctgtcccgcttcgacctggtcgcccaggcgcgcatgcacgtcgatgccggcggcagcggcggtcggtgctccggcgagcttggccgcccgcgcgagcagccggttgtcgattcgggagacccgtcccgtggacggcgatgcgacggtgtgccgatgcgttgccaccgggatgctgcgcaggccgccctgctcagcgcagatcgcctcgaacgtggcccaggcgcggccgtcggccagcacctgcgtggcgagcgtcaggccgccgccggcgggcgctgcaccgcccatttcgaggatgtccgccgccagccgcaacgctcgctcccgcaggtcggccggggcctcgggcgtcccttgtaggacggccagcacgtcgcgggcctccagtgccgggccgatcccgcggccgaccggctgctcaccatcggtga

SEQ ID NO: 8605 - DNA, 1398 bp, Pseudomonas aeruginosa
cggccacgatgccttccagggctccggcctcgaagcgtccctgcgcaaactgggcttccatgcgctggcacacagccgaccacctttcggcaccgcaacaggcatggatgccgcgatcggccacgatctccacggcccggtcggccagcagcacgtagatcaggacgccgctgttgtgcgccgtatcccacacacccaggcgtgcgaacaggtccagcgcccgctcgcccggcgattggttgcgccacagtggcgatccgtccagcgcaccctcgaccacgaagcgcagttggcccccatgctggaactctcccgtgcggatggcctgctcgatcgcatccagggcacgcggggggaaggcgcggcggactgcgcgatccgtggtcgcaaggtggcgaagaagtcgttgcatgttcatctcaccaccgtcctgacgcgccgccgccaccgaagccgccgccgccgccgcggaatcctccgcccggccagccgcctccccggtggcgcccgtgcaggccgccgtggccacccatgccgatgcccagcagcgtgacgaggaatcccgccagtccagccaccgcggccaccgcgaaggtgcccaccaacagccacgcagcggcacccagcacgccagccgtgaccagggagcctggaaggcggccgagggcgttgcgcagcaatccgcccagcatcagggcccggacgaacatgaatggccacgcctgcccgatgtcgttggtctgcccctgccgccgtgggtcccccgcaggcagggcttcgccatcgatcacccgcatgatctgttcggcgcctgccggcgatgccgccgtcgaaatcgccctggcgcaggcgcggcgtgatcacctcgtcgatgatgcgccgcgataccacgtcgctcagcgcaccctcgatgccgtatccgacttcgatgcgcacggtgcggtcgtccttggccaccaggagcaacgcgccgtcgtccaccttgcgacggccgagcttccattgctctaccacccgcagggtgtactgctcgacgggttcgggccgcgtcgagcggaccatcagcacggcgatctgcacgcccttgcgttgctcgaaggcccgaagctgcgcatccagcgcggcgacacgatcggcggcgagcgttcccgtgagatcggtgacgcgcgcctgcagcgggggaacggcgaccaactcctgcgcggacgcgaccgaaaggaacaggctcagcagcagccaggccagagcgtgggccagccgaagaggggccgccggagagagcaccgctgttctgggcgttctcatgtcaggggcgcgccgccggcgacgaggcgccgaaatcgacctgtggcggcgccgccatggccttctcgtcggcgaccgagaaattgggcttga

SEQ ID NO: 8606 - DNA, 933 bp, Pseudomonas aeruginosa
ccctgctgctgcagttccttgatcttggaggccttctgcccgggcaacacatccgcaagcacgatgtcgatacccagttccttgccgatgcgctcggcggtcgcctggttgtcgccggtcagcatcgcgaccttcacgccgcgtgcctgcagcttggcgatcgtctcgcgcgaggtcggccgcacggcatcggcgatcgcgatgaggccgatcagccggccaccgcgcgcgacgtggaccacagtgcgccccccgccttgcagccgcgccgcctcgctggcaaggggggccagatccacctgttccgactgcatcagcagccggttgcccaggagcaccgtctcgcccccgatagtggcccgtgcgccttgcccatcgatgttggtgaagttctcggtgacctccgtcggcatgtctcccgcacgcttgagcactgcgagcgcgagggggtgctcggagaacttctccaccgcggcggccgtcgccagaagccgcgtctcctcgacaccgggcgcggccaccatctcgacgacatcgggctgccccagtgtcaaggtgccggtcttgtcgaacaccacgaccgtcaacttggtggcgttctccaatgcggccgcattcttgaagagaatgccgttcattgcgcccagcccggtcccgaccatgatggccatcggggtggccagccccagcgcatcagggcatgcgatcacgaacacggtgatggtcaaggtgagtgcgaacagtaatgtctgtcccatcacccagtaccagacgctgaaggtcagcaggccaatcacgatcgccgccagcaccagccactgggatgcgtggtcggccagcagctggccgggggccttcgagttctgggcctcctggaccagcttgacaatctgcgccaaggccgtgtccgcgccgaccttcgtggccttgtag

SEQ ID NO: 8607 - DNA, 345 bp, Pseudomonas aeruginosa
cgaaagctcccgctcttgttgatgctggcgcctacgacggtgctgcccacgcccttcttgaccggcatggactcgcccgtcagcatcgactcgtccacttgcgacgcgccctcgacgatctcgccatccaccgggatcttgtcgccgggcttgatcacgaccagttccccggctgcaacctcggcggtcggtaccttggtctccaccccgttgcgcacgaccgtggccatgggtggggcgagatccatcaacgcgcgaatcgcgtcggatgcgcccgcgcgggcgcgcatctccagccagtgccccagcaggatgaagaccagcagcaccgatgccgcttcatag

SEQ ID NO: 8608 - DNA, 633 bp, Pseudomonas aeruginosa
cgggcgagtatctccgctgatttccggacgtgcgttcgctctggatcaggcccttggactcgtagaagtggatcgtggatacgggcaggccgctgcgctgtgacacctctccaaccgtcatgcgaggctcgcaacctagccttgtcagtcttgcgggtgagttggcctatggagcgattgtttccgcggatcatcctggcgcttcggtgcgggaaatggttttgctcagcgccgcaaggcagactgccttacgtggcgggcgaggacgtggcgcgcaccgctgcggcggtactgcgggcggaccctgttccgcccggagagctggcgatcaccggcccgcaggctctcaccgccgaggcgctggtgaacagcatcaatatcatcttcggagccagcatcgacctggtgcccgtcagtgaggaagccctggcgctgcatctgcaggtctcgggctttccgaaatccacggtgcgagaggcgctgatcatcgaagaggtgtccaaacgcgggctggcgccgttctccgacggtgtcatcgagcagatgaccggtcagccgccgcgcagcatcgaggcggtgctggtcgaacaccgcctcgatttgctgttgtccaccagcaccccccggctttga

SEQ ID NO: 8609 - DNA, 372 bp, Pseudomonas aeruginosa
caagagacgaccatgaacaccacgacccgcatcagcactgcagaacgcctcggccgcacctttggccgcggatggcgcgcctacgcgcgcggcgaacgtcgggcgtcgaactggttggtgtccaagggggtgccggcggccattgccaccgcgctcgtgcgggtggtcaagcttgttgcgctcgggattctggtgtacaccaccttctggctggccctgctgctggtgtgcgtcatggtcgttgcctggatggcccgtaacgccgacttgggcgaagggttgcccgagccagagtggcgaaacggaccagcaggattcggcctatacacctatgacggttttcgcattgatcctcatgtcgaggacgactag

SEQ ID NO: 8610 - DNA, 1539 bp, Pseudomonas aeruginosa
tgcgggtcgtggtgttcatggtcgtctcttgctacagaggcctattccagtttggtccatttcattctgtttggggcttcaatgtgctctcttgctgcttcaggacgcttcgtcatccggttccaccgggccggggtcgggttccacgccgacgcgatacgtggcaacgaagcgcggccagtccacatggtccaccaggtcgatgtcatcgacaacgccaacctttgctgccgcacgctcgaacagggcgatgctcttggcgggatagttgttgcgcgacggatagagcaccccgtcgaacagcggctggccgtcgtctccgagcatcgcatgcacctgcgcggacacctgctgcgtgtgcgtgtagtcgcggctggccaactgttccaggttcaggccgaagtaacccgccatgacaccctcggccgtgagatcggccagccgcacgtcgtccaggacgcccacggcgcgcaagagccggctctcgacttccttcagcgcgatcgagcgcttttcatccgccagccactggtgcttgtgaaacaccgactccatcagcgccgtgggcaggtcgcggcccaggtagagcacgccgtaggtccgcgccgggtcgtcgtagcgattggtgccgctgcggccatagtacagcgggctgccccgatagacgacgcggctcacatgctggagcagttcacccgcatcgatcaggaacaaaggcagttcgcggctcatggcagtcttgcctcaatgcacctggacgcccagcacgttgaacaccgcttcggccacgtcatcgatcgtgccatgcgtcaccgtatccaccggcgagcgtccgcccaagccttcgagcggttcggacagcgcgcggtagatcgtccagtggtcgatgccctcgacctcctgaagcacggtttgggtcaactgctgcttcaccgggtcgagctgccagtcgggcagcttctggccgcgcggccccacattcagcgccagcagccggcgcgcgaggatgtccttgtagatctgctggcgcgacttgtccgccagcttggcgtactcggggatcgccaggttgtgcggctggttgaaggtttccagcagcgcagcgcggccacgctggacgtcggtttcactcggcgcccagcgcgtctcggcgcgcagcgcgcccgctttgcgtgccagggcctcttgcaccgtctccgcttccaggctggcgggcagcttcaccgcctccacacgctcgtggacgaacgcctgcaactcggccgcgaaagccgtggcatcccggatttcgacggtatccgcgaagcggcgcacatcctccaccgtgacgcgcggcagatggtcggcaatgaattcaatggcattgggcatggtgatctcccaggcaggtttgagacaggattcactctagtctcccttgtcgcgtttgtcaactttgtcgccttacgcacctgcctggcggaagtggcgtccaggcagcatagagccgcgaccggcaccggctcgctgtccaatccattccagcgggttccccattga

SEQ ID NO: 8611 - DNA, 471 bp, Pseudomonas aeruginosa
gccaactcacccgcaagactgacaaggctaggttgcgagcctcgcatgacggttggagaggtgtcacagcgcagcggcctgcccgtatccacgatccacttctacgagtccaagggcctgatccagagcgaacgcacgtccggaaatcagcggagatactcgcccgctatcttgaggtatctggccatcgtcaaagtcgcgcagcgggccggactatcgctggacgaagtgctcgacgctctcgggcagtatcagccgggcgttcatctgactgctgcgcattggcgccgtgtggcgtctaggtggcgtgaagaccttgacgaccgcattacgcagttgatgcggctgcgggacgaactcgggggatgtatcgggtgcggttgtctctctctcaaagagtgcccgttgcgtaatccgggcgacatactcgcaggccaggggcccggtgcgcgtatccttgagcgagaatag

SEQ ID NO: 8612 - DNA, 471 bp, Pseudomonas aeruginosa
ggctttgtccgcttgcggcgacatcggtttcgccccaatggcaggcacccgcggctaaaggagagagaaatgaaattcacgcattcgatcgcggccatcgttggcgccgcactggtcaccttgtctgcgttcgcgcaggacaaccatcaggcccatcaccccgcaggtgcgagtccgaccgcggccgagacgccaagggcgccgaccaccgagggcatggatgcgcaactgaagtcgatgcaggccatgcacgaacggatggtggctgcgaagacgcctgcgcagcgcaaggcgctcatggccgaacacatgcaggccatgcgggctggcatggcgatgatgggcgcaatgaaggatggagccgagtcggcgccgacagctgagcggcagcaaatgctcgaaatgcgcatggacatgtgccagtccatgatgcagatgatgatggaccggatgcctgagccggcgaagtga

SEQ ID NO: 8613 - DNA, 894 bp, Pseudomonas aeruginosa
tcgcctgcgaccagacctaacggagaacccatggcaaagaacaagaagggcgccaaaggcgccaagcacaaggccgatgtggacggcaccggcactgcccacggctcagcgcgcgacgagacagcgacacgctcgatcggccgcgaggactacgaagcacagttgcacatgctgcagatcgaactggtgaaactgcagcggcatttcatcaaatgcaacgaccgtatcctgatcctcttggagggaagggacggcgcaggcaaggacggcagcatcaagcggctggtcgaacacctgagtcctcgggaaacacgggtcgtcgcgctaggaaagccctccgaccgggatcgcacgggctggtacttccagcgctacgtcccgcacctgccagttggcgaagagctcgtggtgttcaaccgcagttggtacaaccgtgcgggcgtggaaccggtgatgggcttctgtaccgccgaggagcacgaggaattcatgaactcagtgcccaagttcgaggagatgctggtcaactccggtatcaagctgctgaagtattacctcgacatcggcaagaaggagcagagccgccggctcggggaacgccgccgtgatcccctcaaacagtggaagtcgagcccggtggatgccgtcgcgcttaagcactgggacggctatacacgggcgcgcgacgagatgttcatgcgcacccatacggccgcggcgccctggtctgtcgtgcacgccgacaacaaacggttggcgaggctcaacctgatcagagacatcctctcccggctgcactacgccggcaagaagcacaaggtcatcgctcccgaccgggagatcgtcttcgagttctcgcaggactgcctggactcgggccgactcgctcgttga

SEQ ID NO: 8614 - DNA, 1377 bp, Pseudomonas aeruginosa
cgtcgcgtgtcagtgtcccagcggccgcgtcagcctgagcggcgggccaccatggtagagagccgcgccatgcgatcaccgcgcgaatccgggcccacccgccagcaagacctcggcgtcgcgcagctgggttggctcgctgcggccgtattcgtcgtctcggccggatatggggcactgatgcccttgatccccgactggctgcggcccttgatgggcgacgcggatcctgcggcgcttgcgcgccatgtcggctacctcagcggcatctacacggcgggcatcctgctgggtgcgcccctgtggggcatgctggcggacaggctggggcgtgcccgcgtgttgctggtgggcctgatcggctacgtggccagcctgctcccgctgctgcgccccgagtccctgggcgtggtcggcatctatgcgctgcgcggcgcgacgggcttttttgtggccgcggtcgtgccggtggtgccggcgctcgtcgcgcagtacaccccagaatcgattcgcgccaggcgctttgcatggctgggtgcgatgtcgctgctcgggttcctgttcggccccggcctgaacgccgctgcagaacggcttgtcggcctgggcttcttgagcgtgctggtacagggctcatcgaccacgctcgtaatcgcactctcggccgcgctcggcgcgctgatgatgctgggcctggccgcaacgcttcccgcaccttcctcccttggagaggcggacgcagccgatcacgacggagcaccccggagccgctccctggcgctctggattctcaacggtgtggtcatgttcgtgcttgccggctttgaactcggcatcgtgctgcagggccagcgccaccccgatctctcctcccgagaggtgtcgttgatgttcgccgagtgcagtctggtgatgctgggcgtcaacgcggtgctgttcttcaccggcctgctggagcgcgccgacccacgccgcgtactggcctgcggcatggtcctgggcatcgccgggctcctgatgctggcccgccatggcagcgagatgtggctgtacgtcggcgtgagtttcacggctgcgggcacgggtctcgtgctccccaccctggcctacctcgctgccggcacctcggcgcggcggctcggtatcgcgatgggagggctcgccgcggcagccggcctcggacaaacactgggatcggccgccaccggatggctattcggcgctgtgatgcagagcacctttgcgtggctgtcgattccactggccgccaccctcgcgctgctgctcattccgcggcgttggtggccagccaaccccgtcctggtgagcgcttcaccgtcccgcacttttctcacttccacggaaaccgaaccatga

SEQ ID NO: 8615 - DNA, 597 bp, Pseudomonas aeruginosa
tgtcccctgctcgcagcgcttgccctgtcgctgagcggatgcggctacaacgacttccagcggctggacgagcagaccaagtccgcctggtccgaggtgctgaaccagtaccagcggcgcgccgacctgatccccaacatcgtcgcgaccgtcaagggcgagaccaacttcgagcaggagacgctgacccgggtggtcgaggcccgcgcgaaggcgacctcgatccaggccacgccggaactcgtcaacaaccccgaggcgttccagaagttccaggcggcacagggcgaactgtccggcgcgctgagccggctgctggtggtgagcgagaactacccgcaactcaaggcgaaccaagcttttcaagacctgcgtgcccaacttgagggcacggagaaccgcatcaccgtggcgcgtgggcgctacgtgaaggcggtgcaggattacaacgtgctcacgcgcagcttcccgaccaacatcacggccaagctgttcagctacgtcgtcaagcccaatttctcggtcgccgacgagaaggccatggcggcgccgccacaggtcgatttcggcgcctcgtcgccggcggcgcgcccctga

SEQ ID NO: 8616 - DNA, 771 bp, Pseudomonas aeruginosa
tgctgggcggattgctgcgcaacgccctcggccgccttccaggctccctggtcacggctggcgtgctgggtgccgctgcgtggctgttggtgggcaccttcgcggtggccgcggtggctggactggcgggattcctcgtcacgctgctgggcatcggcatgggtggccacggcggcctgcacgggcgccaccggggaggcggctggccgggcggaggattccgcggcggcggcggcggcttcggtggcggcggcgcgtcaggacggtggtgagatgaacatgcaacgacttcttcgccaccttgcgaccacggatcgcgcagtccgccgcgccttccccccgcgtgccctggatgcgatcgagcaggccatccgcacgggagagttccagcatgggggccaactgcgcttcgtggtcgagggtgcgctggacggatcgccactgtggcgcaaccaatcgccgggcgagcgggcgctggacctgttcgcacgcctgggtgtgtgggatacggcgcacaacagcggcgtcctgatctacgtgctgctggccgaccgggccgtggagatcgtggccgatcgcggcatccatgcctgttgcggtgccgaaaggtggtcggctgtgtgccagcgcatggaagcccagtttgcgcagggacgcttcgaggccggagccctggaaggcatcgtggccgtcagccacctgctggtgcagcactttccgcggggcgcggaccacggcaacgagttgccggatcggccggtccttctttga

SEQ ID NO: 8617 - DNA, 1599 bp, Pseudomonas aeruginosa
actgggctggtcggttgccgtgcccgagtacctgcagacggtggatctggtatgacggcgcacctgcacgagaccggcaccggcaccggagaggatggcgtgaacacgctgcaggcgtggcgcaccggcatcgacacccatcaggagccggtggtctacatgcggcgcgactgccctgtctgccggtcggagggtttcacgacccaggcgcgcgtgcagctgacggccggccgccgcagcatcgtggcgacgctcagcgtcgtcgatggggattggctggccgagaacgtcgctggcctgtccgaatcggcatgggcgtcgctgggggcgcagccgggccagctggtcacggtgacccatgcaccgccgctggattcgctcagccatgtccgggccaaggtctacggcaatgccctgggcgatgccgagttcagcgccatcatctccgacgtcgcggcgggccattactctgacctgcatctggccaccttcatcaccgcctgcgccggcgatcgcctggacctcgcggagaccgtctcgctcacgaaagccatgattggcgtcggtgaccgcatcgattgggggcgcccgctggtggtggacaagcattgcgtcggcggcctgcccggcaaccgcacgaccctgctcgtggtgcccatcgtggccgcctgcggcctcacgatgcccaagacctcctcgcgcgccatcacctcgccggccgggacggccgacacaatggaggtgctggcgccggtgaacctggatgtgcgaagcatgcggcgcgtggtcgaacgcacgggcggctgcatcgtctggggcggctcggtacggctcagccccgccgacgacatcctcatccgcgtcgagcggccgctggacctggacagcgagggccagctcgtcgcctcggtcctgtccaagaaggccgctgcgggctcgacccatgtgctgatcgacctgcccgtgggtgccaccgccaaagtgcgcagcgcgcaggccgcggcggcgctcggtcggcgcctgcaggaggtgggcagcgccatcggcctgcacgtggccttgcgcgtcaccgatggtgagcagccggtcggccgcgggatcggcccggcactggaggcccgcgacgtgctggccgtcctacaagggacgcccgaggccccggccgacctgcgggagcgagcgttgcggctggcggcggacatcctcgaaatgggcggtgcagcgcccgccggcggcggcctgacgctcgccacgcaggtgctggccgacggccgcgcctgggccacgttcgaggcgatctgcgctgagcagggcggcctgcgcagcatcccggtggcaacgcatcggcacaccgtcgcatcgccgtccacgggacgggtctcccgaatcgacaaccggctgctcgcgcgggcggccaagctcgccggagcaccgaccgccgctgccgccggcatcgacgtgcatgcgcgcctgggcgaccaggtcgaagcgggacagccgctcttcacgctgcacgcccaggcgccgggcgagctggcctatgcgctgcagttcgtccgctcgcgcccaccgatcttccagatttcggagaacctatga

SEQ ID NO: 8618 - DNA, 549 bp, Pseudomonas aeruginosa
tggaagccggcgcgccatgagccgctgcgccgcgctcgccatgacgctcacgatcgaggggagatgactgcccatgtgcttttccgcacccgccagtttcacggccgcagcggttctgctgggcctggggaccgtcaccatgcgccgggcccgctcacggcgcgaactgccgtatgccgccatcccgctgctgttcggggtccagcaactgctcgaaggcatgctgtggctgacgttccccgaccgcgcgcccttgctgaacgtggcgctgacgcatctctactcgttcttctcgcacgtcctgtggccgatctacgtcccgctggctgcgctggcgctggagagcgtccgttggcgccgtcgggttctggtggccattgcagtcgcgggcgcgctcgtcggtctgtacctgctggcgatgctggtgaagctgcccatcacggcccgcgtggtcggccagcacatcctctacgactctccgcacttctacgtgatgaccacgatggccctgtatctgatcggcacctgcgcaagcctgatggtttctag

SEQ ID NO: 8619 - DNA, 279 bp, Pseudomonas aeruginosa
gccccgagcgaggctggccgtgccatgacgaatcctccggccagattcaagcccgcactggcctacgcggactgcggccgcacgcagggcccgatgcgccgcgcggcgttcttcacggttcagttgctcgacggattcgagaccatgcgcgatgcggtcgccggccggctgccgacggtattcgcgcaagcggaactcgcgcaaggcaccaagaccgggcacttcatcgccgcgttctgcatcctgtccctgcaccgggtaatcgaggagggctcatga

SEQ ID NO: 8620 - DNA, 1437 bp, Pseudomonas aeruginosa
caccgcatgtcgggttcaatacgtcggaggcgatcgcgcgcatcctcgacgagaccatctcgaacatcgcagcctggcatgcgggccgcctgcgcaacaggttggatgagccatgacgcgaccgaaccgccccgtttccaccgtgcgtcttgcgggccgcccaacgcaacgctcggcgctgcgccgggccacgcagatcgctatggccctgagcgggttcctgctctgggtggcctggcaccggggcctgatgcgctgcgatacccaccgggcggccgaccgcttcgccgaagtgctgcagcgattgggcacgaccttcgtgaagctgggccagcatctcagcctgcgggccgacattctggcgcccgatgcgcaagaggctctggccagcctgcaggccaatgtggcgccgtttcctcccgagcaggcggtccaggaggtcgaggcggcgctcggccgcccatggcagcagctcttcgcacgcttcgacatgcacgcgctcgccgcggcctcgatcgcccagattcatcgtgcagccctgccggacgggacggaagtggtggtgaagatccgccgccctggcgcggccgagcaggccgagaccgacatgcgcatcctgcgccgcatcgtcctggtcatgcaggggctcgtgccctcgctgcgtcgctgggggctggcagccatcgtggacgaggttgcggccaacttccgctacgagatggatttgtcgcgcgaggcagcttccgtgcgacgtttcgccgacgcctggcgcggctctgccgacatcgtgatccccgacgtggtggacggcctgtgcacgccgaccgtcatggtccagcagttcagccacggagctcacctgcacggtctgccttcgtccaccgcggtggcggccgcgggcaaactcgtggacagctacgtcgcccagatcttccgcgatggcttcttccacggcgacccccatcccggcaacgtcttcgtgatggacgatggccgcatatgcgtgcacgacttcggcatcgtgggccgggtcgacggcaacatgcggcgggcgctggtggcgttcgccctggccttcgtcgagcaggatgccgaatgggtggtcgatgcctggctcgacctgggcctgctcggcgacggcaccgatcgggccgtgttcgtgcctgtcgtgcgtgccctggtcgcagactgcgcacagaggccgctgaaggactggtcgctctcaggtgctctcgcgcagctcgtggcggcgggccggacccaggaagtccggctgcccagggacctcctcgtgctcacgcgtaccctgttgttgctcgaagggacggtgcgactgctggcacccgagttttccatcatcgaagccatctctcgccacacgaccacgggcgtcttcgacgagcccaagtctgcggcatcgcagcgtctgccatatga

SEQ ID NO: 8621 - DNA, 1281 bp, Pseudomonas aeruginosa
ccgcgtccaggttcgacgatgagtgaattcgatgatcccgcgctggtcgggctcgggctggcactcgcttcgggacttctgatcggcctggaacggggatggcagcaacgcgagcggcccgagggacatcgcgtcgcgggcgttcgcacctttgcgctgatcggcctgctcggcggccttggcgggctgctggcccagcgctggggagccggcatgctcatcgcgctgctcgtactcgtcggggtgtatctggtggtgggctacctggtgacggcgcatatgcatgccgtgatgggactgaccacgtccgtcgccgcccttgcgactttcgccatcggggcgctggcgaccagtggcgcttggcgcgtttcggcggtcgccgccgtggtcgtgctggcgctgctgcgtttcaagcagctcttgcacgccggcgtcggcaagctgtccgaggcggagatcagcagcggcacgcagttgctgttgatcagcgtggtcgtactgcccgtactccctgatcgtggctttggcccctatgaggcgttgaatccctatcgcctttggtgggccgttgtcctgctggcagtgctgtcgttcgctgggttcgtcctgatgcgctcgctcggcaggaaacgagggctggtattcacagcgctgctcggcgggatcgtgtcgagcaccgccaccacggccacgttggcgcgctgggccgggcagacgccaggctggcatccactggcagcggcgggggcggcgctcgcctgcgcagccatgtttgcgcgcatggcggctctcgtcgccatcgcagcccccggcatcggctgggacccggtggtcatcttcgtggccatggccgtggctggcggtgttctggggacgttcctggcggcgcggtcgcccgccgacgacttgcccgaacttcagcttggcaacccattgcagctgcgctccgcgctccagttcgcagccttcctggccgcggtgatgctggcaggccgctttcttgccgatcgcttcggggatgctggcgtcatgctgaccgccgctgcctcgggtctggtggacgtcgatgcgatcacgctctcgattggccgcctggtgaccgagggcgccgtcaccgccgcttcggccaccctggccttgttcatcgccgcatccgtcaatcaggtcaccaaacttgtcctgttgatgtcgctgggcggtagggcgctcgcatggagagtgctcccgtcgtacgcggccatggctgctgctggctttgccgtcgccctgggcttgacctga

SEQ ID NO: 8622 - DNA, 318 bp, Pseudomonas aeruginosa
tcacacggtcatcgacctgatcgtggtggacgagcgcgaccggcaaccgattggccgtccgtatctgaccatcgccatcgacgtgtttacccgctgcgtgctcggcatggtcgtcacgctggaagcgccgtcatctgtttcggtcggcctgtgccttgtgcatgtcgcctgcgacaagcgtccctggctggagggtctgaacatagaaatggagtggccgatgagcggcaagcccaggctgctctacctggacaacgcggccgagttcaagagcgaagcgctacgccgaggctgcgagcagcatggcatccggcttga

SEQ ID NO: 8623 - DNA, 438 bp, Pseudomonas aeruginosa
gctggagcgctggctcacattggcggtcggcacctaccacggctccgtgcacaacggcctgctccagccgccggcagcgcgctgggccgaagctatcgcgcggaccggcgtgccaaccgtcatcactcgcaccacggcttttctggtcgattttctgcccatcatccgccgcacgctgacccgcaccggcttcgtcatcgaccacatccattactacgccgatgcgctcaagccgtggatagctcggcgcgaccgcttgcctgcgttcctgatccggcgcgacccgcgcgacatcagccgcatttgggtgctggagccggaggggcagcactatctggaaattccataccgcaccttgtcgcacccggctgtcaccctctgggaacaacgacaggcgctggcgaaattgcggcagcaagggcgcgaacaggtggatga

SEQ ID NO: 8624 - DNA, 921 bp, Pseudomonas aeruginosa
ggagtggtagccgtggaagaatatcccatcatcgacttgtcccacctgatgccggtggcccagggcttggcccgtcttccggcggacgaacgcatccatcgccttcgcgctgaccgctggatcggctatccgcgagcagtcgaggcgctgaatcggctggaagccctgtatgcgtggccgaacaaacaacgcatgcccaacctgctgttggtcggtccaaccaacaacggcaagtcgatgatcgtcgagaaattccgccgcacccacccggccagctccgacgccgaccaggagcacattccggtactggtcgtgcagatgccatccgaaccgtcggtaatccgcttctacgtcgcgctacttgccgcgatgggcgcgccattgcgcccgcgcccacggctgccggaaatggagcaattggcgctggcactgctacgcaaggtcggcgtgcgcatgctggtgatcgacgaattgcacaacgtcctggccggcaacagcgtcaaccgccgggaattcctcaacctgctgcgtttcctcggcaacgagctgcgcatcccgctggtcggggttggcacacgcgatgcctacttggcgatccgctcggacgaccagttggaaaaccgcttcgagccgatgatgctgccggtgtgggaggccaacgacgattgctgctcactgctggccagcttcgcggcttcgctcccgctgcggcgaccctcgtcgattgccacgctggatatggcccgctacctgctcacgcgcagcgagggcaccatcggcgagctggcgcacctgttgatggcggcggccgtcgctgccgtggagagcggtgaggaagcgatcaaccatcgcacgctcagcatggccgattacaccggtcccagcgagcggcggcggcaattcgagcgggaactgatgtga

SEQ ID NO: 8625 - DNA, 1125 bp, Pseudomonas aeruginosa
cggcggcgaatcgcaagtgttttgttcggcgctggtttcggtcgcggccttggcgcgtgcctggaagcgctgatagcactccagtccgcagaagtgctcgacgtactccacgccttccggggtaaaggcggcatcgagcgggatttccttgcagcacacgcagcaactggtggcagtcggatcatttgcattcatggtggcacccctccattgactgacaaaggcggcgaatgccgccgccggcattggcttggcgaacaggaagccttgtcccgtatcgcacgccgcttgccgcaacagtgcgagactggtcggcgtttccacgccctcggccaccacgtccatgcccagcccgtgcgcaagctgaatgacggagcgcacgatggttcggtcgcggtggtcgtcggcgagtccggcgacgaaggactggtcgatcttgagcgtagtaatcgggcagcacttcaggtgttgcaggcaggaataccccgtcccgaaatcatcggcggcgaagcgcacaccgatttgtcgcaaggcttccagggcggggaagatcgccggatcaccgaacgcgaccgattcggtcagctcgatttcaagagactcggcgggcaactcggcgtcagccagcacgccctttacccatccgtcgaaatccggtctcacttggctcgccgaaacattgacggccagccggaacggttgccatgccagcatccgccactcgcgcatctggcggcaggctgcgcccagcacccaagcaccgatttcaggcatcaagccggacgattcgaccaaggggagaaactggcccggcagcaacaagccgagccttgggtgccgccagcgcaacagggcttccgcaccgacaatctggtcactgcgcagatcgactatcggctggtagtgcaactcaagctgcccgcgcacaaccgcctgcgccaactcggtcgccgtccatccggcgggctgcgaggtcgtcatgatccgccccggaaggcccgcagtagccgcgtcacggacagagcaaacaagccggtcagcgtgagggctgcaataccccaatgctccccgatgaatgcgccggctgtcgttccggccagcacaacggcgagaatcggcaaatga

SEQ ID NO: 8626 - DNA, 1296 bp, Pseudomonas aeruginosa
ccggtgaacggcttgcgtgtcttggtcggcaggcgttccgggccgttcatggcagactctccgcgtgctgtgccggctcggtcggcagggtggccaactgcgcttccagatcggccaacgcttcgcgccggtgttcgacgaactggcgcagcacggcaagctgcgtggccgcttcgccgccgtccgctgcatccagcgcccggcacagcctcgccagcgcatcgaggccgatgcccgcttcgaaggcggatcgcacgaagcacagacgctgcaaggccgcctcgtcgaacaggccgtagccgcctggcgtgcacgccaccggccgcagcagtccgcgcagcaggtagtcgcgcacgatatgcacgctcaccccggcatcaagggccagccgggacaccgtgtaggcgttcatcgaacacctcctttttctcacccggcgcagcaggaaagctgcttcacatccttgttgaaggtctgcgccgcgagcttcaagccctcgaccatcgtcaggtaggggaacaactggtcggccagttcctgcaccgtcatgcggttgcgaatggccagggccgccgtctggatcagctcgccggcttccggtgcaaccgcctgcacgccgatgagccgtccgctgccttcttcaacgaccagcttgatgaagccgcgtgtgtcgaagttggcgagcgcgcgcggcacgttgtccagcgtgagcgtacggctgtcggtctcgatgccgtcgtggtgcgcttccgcctcgctgtagcccacggtggccacctgcgggtcggtgaacaccacggccggcatggcggtcaggttcagggtagcgtcgccaccggtcatgttgatcgcggcacgggtgccggccgccgctgccacatagacgaactgcggctgatcggtgcagtcgccggcggcgtagatgttggagctactcgtgtgcattccttggtcgatgacgatcgcaccttgcttgttcaccatcacgcctgccacgtccagtgccaggctgcgcgtgttgggtgcacggccggtggcgaccagcagcttgtcggcgcgcagttcgccgtgcgccgtggtgagcacgaattcgccgtccctttcaccattgatgtacgcgacctggctggcctgggtgtgttccctcacctcgatgccttcggcacggaacgcggccgtgacggcttcgccgatggccgggtcttcgcggaagaacagcgtgctgcgcgccaggatcgtcaccttcgctccgagtcgagcgaacgcctgcgccagctccagcgccaccaccgatga

SEQ ID NO: 8627 - DNA, 834 bp, Pseudomonas aeruginosa
gccaattacggccaggcgcttagggatcgtttcgctgaccagtgcctcagtggaagtccagtaaggggtgtctttcaggccgggaatcggcggcacggccggactcgcgccggtggcgaccagacagcggtcaaacgtcaccatgcgctcactgccgccgttgagttgcacgaccaggttgcggttgtctttgaagcgggcagcgccatgcagcacggtaatggccgggttgccctccaggatgccttcgtatttggcgtgacgcagttcatcgacgcgggcctgctgctgggccagcagcgccgtgcgctggatgaccggcgctaccgcttggatgccgttgtcgaacgggctttcccggcgcaggtgggcgatatgggcggcgcggatcatgatcttcgacggcacgcagccgacattgacgcaggtgccgccaatcgtgccgcgctcgatcagcgtgacgcgtgcgccctgctcgacggccttcagtgctgccgccattgcggccccgccgctgccgatcacggcgacatggagctttccactatccccgccagccttgtcatcactgcccagccattcgcgcaccttgccgagcaatccgccgcccgccggagccacgggcgcatcggcaagcgtagcccgatagccgagtccggccacggcagcggtcagcgtatccggcaatgtgccggcctcgatggcgagcctggcgctgcccttggcataggaaacctccgccgattgcacgccgggcactttctccagagcctccttgacgtgaaccgcgcaggagtcgcaggtcatgccggtaattttgagggtggtcattaa

SEQ ID NO: 8628 - DNA, 726 bp, Pseudomonas aeruginosa
aaagcccaggccgatggccgcgcccaagctggcgatggccggaaagcacgcggcgcaacccatcgcggaaacaacgctgccgagcgccccaggttcgggttcagtggttcactgcttgacgctggagggatagcccgcatcggtggttgctttggtgagcttctggacgctggtcttggcatcatcgaaagtgacaaccgcttcgcgggtctcgaaggtcacgtcaaccttgctgacgccttcgaccttggaaatcgccttcttgacggtgatcgggcaggcggagcaggtcatgcccggtacggacagcgtgacggtctgagtggcggcccacacgggggcaacaatggcggcgagggcgagggaggcaaacagttttttggcttgcgccgaaacttgcgttttcatggtgaactccgatcagtagaaaaatggcatgacgtagggaaatccgagtgcgaccaggaccagcacggccacgacccagaaaatgagcttgtaagtcgctcgcatttggggaatcgcgcagacctcacccggtttgcaggcttgcgtagggcggtagatgcgccgccaggcgaagaacaacgccaccagcgctgcgccgatgaaaatcgggcgatacggctccagcacggtcaggttgccgatccatgccccgctgaagcccaaggcaaccagaaccagcggcccgaggcagcaggtcgaggcgaggatggcagctag

SEQ ID NO: 8629 - DNA, 699 bp, Pseudomonas aeruginosa
acggcggatggctacatcgatgacgttgctgtcgctgtcgaaattcatgtcccatacctgcgacgcgatcagagaccgtggaaggacctccccctggcgacgggccaggagctcaagcaacgcgaactccttgctggtgagattgatgcgttggccagcgcgcgttgcgcgccggcgcgccaagtccagcaccaaatcggcaacctggatgcgatcaggctggctcggagcgcttccgcgtcgcagcagcgtccgcacccgcgccagcaactcagagaacgcgaatggcttgacgaggtagtcgtccgctcccagttccaatcccttgacacggtcgtctacaccgccacgcgccgtcagaaagagcacagggacctgtttaccggcatctcgaagggcacgcacgatgcgccagccatcgacatccggcagcatgacatccaagaccaccagatcgtatgtctcgcccatggccaggtggtgtccgtccaatccgttgcgcgccagatccacgacgaatcccgcctccatgagaccttggcggacgtaatccgccgtcttgttctcgtcttcaacgaccagcagtttcatcgcatgtcccatgaaatcgctacggcgcggaaaaatagccgctcacgatgtacgcattcatccactttcaatcagcaatttactggttgccagcttccacgaacatga

SEQ ID NO: 8630 - DNA, 432 bp, Pseudomonas aeruginosa
ccaacaagctgcgtgaagccacatccattcactggcacgggatcatcctgccgtatcagatggatggcgtgccgggcatcagcttcaatggcatcgctcccggcgagaccttcacgtaccgcttcaaggttcagcagagcggctcctactggtaccactcgcactccggcttccaggaactcacgggcatgtacggggcgatcatcatcgaccccgctggcgccgagaccatccacgccgaccgtgaccacgtgctgctgttctcggattggaccgacgaagacccgatgcgggtgttcaccaagctcaagtcccaaagcgactattacaactacaaccaacctaccgtcttcgacttcttccgggacgcctcgcgcgaaggcacggccgctgcgatcgacaagcgcaagatgtggaacgagatgcggatga

SEQ ID NO: 8631 - DNA, 657 bp, Pseudomonas aeruginosa
tgttccacatggatgccggcatgttccgcgaagtcgtggtgtcttgaacccagcgcacaaggaagaccaagaatgtccaaagcactccccactcgcgcactggccacgacgcttctggccctggtaagcgtcgccgcccaggcacaagcacagaacgaccatgcagcgcacggccaggccgacgctcaaacggccgcgccatccactcagaccgtggctcctgccgccgacccgcacgcgggtcacgcgacgtcggcgagcggctcgaccgcggccccggccatggatcacggcaacatgcagatgcagggcgggtcggcgcctcctgacgcccgcgatccgcatggctactccaatggcctgacattgggatcgggcgactacgccgtacccggtgtgccgcggctgatgctggccgacgaacacaggttcttttcgttgcgcggcgaaactctggaacgccgcttcacgcgcaaaggagacgactccacggcctacgacctccaggcgtggtatgggacgacctacaacaaggccgtcgtgaaggccgaaggcgatatcgcccaaaggaaagctcgaagaatcgcgtaccgagcttctctgggggcacgccgtcgcaccgtactgggacacccagctcggcgttcgggtggataa

SEQ ID NO: 8632 - DNA, 1557 bp, Pseudomonas aeruginosa
tcaccgccatcgaaaaggtgcagccatgatcgccaagctgattcgatggtcggtggccaatcgcttcctggtgctgctggccaccgccatgctcacggcatggggcgtgtggggcgttcgcagcacgcccgtggatgcgctgccggacttgtcagacgtgcaggtcatcattcgcaccaactacccaggacaggcgccgcagatcgtcgagaaccaggtcacctacccgttggccaccaccatgctgtcggtgccaggggccaagaccgtgcgcggcttctcgttctttggcgactcgttcgtctatgtcttgttcgaggacggaaccgacctgtactgggcccgctcacgggtactggaatacctgaaccaggtccagggccgattgcccgccacggcgaagccggccctgggtccggacgccacaggcgtcggctggatcttccagtacgcgctcgtggatcgcacgggcaagaacgatctggcgcaactgcgtgcgttgcaggactggttcctgaagttcgaactcaagagcctgcccaacgtggccgaggtggcatcggtggggggcatggtcaagcagtaccaggtcgtgctcgacccgatcaagttggcgtcctatggcctcagtcaggctcaagtccgcgatgccctgatgggggccaaccaggagaccggcggctccgtcctggaattgtcaggcgcggagtacatggtccgcgcgagcggctacctcaagaccctggacgagttccgggagatccccttgacggcacgcggcggtgtgccggtgcggctgggggatgttgcgacgctccagataggcccggagatgcggcgtggcattgccgaactcgacggagaaggcgaggtcgccggcggcgtggtggtgctgcgctccggcaagaatgcccaggagacgatcgctgccgtcaaggccaagctcgcggagctgcagggcagcctgccgccgggcgtcgagatcgtcaccacctacgaccgcagcgcgctgatcgagcgggccattcgcaatctcacgaccaagctaggcgaagagtttctggtggtggcgctggtctgcgcactgttcctttggcatcttcgttctgcgctggtggccatcatctcgctacctctgggcgtgatgacggcgttcttggtcatgcgctaccagggcatcaacgccaacatcatgtcgctgggggggattgccatcgccgtgggggcgatggtggatgcagcggtggtgatgatcgagaacgcccacaagaagctggaggcttggcagcacgcgcacccagatcaacggctgcagggcaaggaacggtgggacgtgatcacacaggccgcggaggaagtcggtcctgcgctcttcttctcgctgctcatcatcacgctctcgttcatcccggtcttcaccctagaagcgcaggaaggccggctgttcggcccgctggcgttcaccaagacctacgcgatggccgcggccgcagggctgtcagtgacgctgattcccgtactcatgggctactggattcgcgggcgtatcccggatga

SEQ ID NO: 8633 - DNA, 510 bp, Pseudomonas aeruginosa; identical to SEQ ID NO: 4421

SEQ ID NO: 8634 - DNA, 1917 bp, Pseudomonas aeruginosa
aggccaaagggccgaaacggcaagggaatggggtgcaaggggaaaggccctacctcgaaaaggcgaaaaggcctcccggccggccccccagaggacacccgcatgctctccctgttccagcgaaaacggcccccggtcgctgccccgtcgccagcgcccgccaccgacctcccgaaagggttgctgcggcccgaatcggccgcatcgctgctggcaacaccgcgccggcagaagctgctggaacacatctggcagcgcacgtcgctgtcgcggcggcagttcgccaccctataccgcacgccgctggagcactacgccgagttggtccaacaattccccgcatcggaaagccatcaccacgcttaccccggcggcatgctggatcacgggttggagatcgtcgcctatgcgctcaagctgcggcagtcccatctgctgcccattggcgccagtcccgaagaccaggcggcgcagtctgaagcctggactgccgcagtcgcttatgccgcgctgctgcacgacatcggcaagatcgccgtcgatctgcacgtcgaactggccgacggctcgctgtggcacccctggcacggcccgctgcaccagccataccgcttccgctaccgcgacgatcgagaatatcggctccacagcgctgcgacaggtttgctctaccgccaactcctcgaccgtgatgccctggactggctcagtggctatcccgacctgtggggaccgctgctctacgtcctggccggccagtacgagcacgccggcgtgctgggcgaacttgtcgtacaggccgaccgcgcttccgtggcccaagagttgggaggcgatcccgcgcgcgctatggccgcccccaagcacgcgctgcaacgcaagctgctggacgggttgcgctacctgctcaaggaagagttgaagctgaaccagcccgaagcctccgatggctggctcaccgaggacgccttgtggctggtgagcaagacggtttcggacaagctacgtgcgcacctgctgtcagagggcatcgatggcatccctacgaacaacactgcggtgttcaacgtgcttcaggaccacggcatattgcagccgacgtcggacgggaaggcggtctggcgcgcgaccgtgaccagtgcgaccggctggtcccactcatttaccctgctgcgtctagctcccgcgctgatctgggaagctggcgaacggccagcatcgtttaccggcacggtggcaatcgacgctgcggcaatcgagaaggatgctggctcggaggctgccccgcctatgactgccgcgaagcctgtcttggaagaacagacgacgccaccttgggaaggcagcagccccgctaacttggcttcaccgcccgcagttcagcccctgcctgacgtcatggaagacatgctggcgatggtgggctccggacacctccttgcgacgcgacaggatgcagagcccgtcccggccttcgcaacgagttcgctggtactgcctgtgccagcgtctaaatcttcggcatcgacacagcagccttcgggcgagcacttcatgggctggcttaggcatggcttgcagagccgaaagctgatcctcaacgatgccaaggcactggtgcataccgtggacgacacggtgttcctggtaagccctggggtgtttcagcgctatgtccaggagcatcctcaagttccagcactcgccaagcaggatgccgttgtcgactggcaatgggtccagaagcgcttcgagaagctgcaggtccatcgcaagcagcccagcagcttaaacatctggacctgcgaggtcaccggcccgcgcaagtcgcgcaagctgcatggctacttactcgatgaccctggccaactgttcgatgagcggccaccgaacaatccctacttgaaactggcatag

SEQ ID NO: 8635 - DNA, 246 bp, Pseudomonas aeruginosa
gtcggccgtgagattgctgaaaattcattcggcatttttgtgcagcgaacagtccgcacgaccattaccaacgaagtgcgacaggcctcgttcgctttccttgggtctcgtctgttcctcacagcgcgcaatcattcggacgtattcaaaggccccatgagcgcagcaatgatagggcaaggaagcgcctctcccgtgtcttcgcacctctccagcatgtctctcagagcgcctcgcatgcgctga

SEQ ID NO: 8636 - DNA, 684 bp, Pseudomonas aeruginosa
caaggcgaatccaccgtacccgggagagcgcaaatgaaccacgatgcgcccgcttatgggctttggctgctcgtcctcgtgaactcggcggtcttcatcatgttcgccttcagcttcttcaaaccgcagacctcgcgcgactggagaaccttcgggacattcgcagcgttcattgttgccttgttcgtcgagatgtacggctttccgctgacgctgtacgtgctgtccggctggcttcagaccaagtatcccagtctggacttgctgtcgcacaacagcggccatctctggtcgaccctgctgggcgagagcggcgaccctcacttcagcccgcttcatatcgcgagctacatcttcatcgggggcggcttctggcttctgtcgagcgcctggacggtgctctaccacgcgcaacggcacgcccaacttgccgtgagcggcccatacgccaggattcggcacccgcagtatgtggccttcgtggcgatccttttcggctttctgctgcagtggccgacgctgttgacgctgctgatgttccccttcctcgtcgtgatgtattcgaggctggctgtcaacgaggagaaggacatgcgcaagcagttcggcgccgagttcgacgcctatgccgcgcgcacgccgcgcttccttccctccctctcggacacgcgccagcgaggctga

SEQ ID NO: 8637 - DNA, 579 bp, Pseudomonas aeruginosa
agcggcatcggtgctgctggtcttcatcctgctggggcactggctggagatgcgcgcccgcgcgggcgcatccgacgcgattcgcgcgttgatggatctcgccccacccatggccacggtcgtgcgcaacggggtggagaccaaggtaccgaccgccgaggttgcagccggggaactggtcgtgatcaagcccggcgacaagatcccggtggatggcgagatcgtcgagggcgcgtcgcaagtggacgagtcgatgctgacgggcgagtccatgccggtcaagaagggcgtgggcagcaccgtcgtaggcgccagcatcaacaagagcgggagctttcgctacaaggccacgaaggtcggcgcggacacggccttggcgcagattgtcaagctggtccaggaggcccagaactcgaaggcccccggccagctgctggccgaccacgcatcccagtggctggtgctggcggcgatcgtgattggcctgctgaccttcagcgtctggtactgggtgatgggacagacattactgttcgcactcaccttgaccatcaccgtgttcgtgatcgcatgccctga

SEQ ID NO: 8638 - DNA, 1059 bp, Pseudomonas aeruginosa
aggcggtgcaggattacaacgtgctcacgcgcagcttcccgaccaacatcacggccaagctgttcagctacgtcgtcaagcccaatttctcggtcgccgacgagaaggccatggcggcgccgccacaggtcgatttcggcgcctcgtcgccggcggcgcgcccctgacatgagaacgcccagaacagcggtgctctctccggcggcccctcttcggctggcccacgctctggcctggctgctgctgagcctgttcctttcggtcgcgtccgcgcaggagttggtcgccgttcccccgctgcaggcgcgcgtcaccgatctcacgggaacgctcgccgccgatcgtgtcgccgcgctggatgcgcagcttcgggccttcgagcaacgcaagggcgtgcagatcgccgtgctgatggtccgctcgacgcggcccgaacccgtcgagcagtacaccctgcgggtggtagagcaatggaagctcggccgtcgcaaggtggacgacggcgcgttgctcctggtggccaaggacgaccgcaccgtgcgcatcgaagtcggatacggcatcgagggtgcgctgagcgacgtggtatcgcggcgcatcatcgacgaggtgatcacgccgcgcctgcgccagggcgatttcgacggcggcatcgccggcaggcgccgaacagatcatgcgggtgatcgatggcgaagccctgcctgcgggggacccacggcggcaggggcagaccaacgacatcgggcaggcgtggccattcatgttcgtccgggccctgatgctgggcggattgctgcgcaacgccctcggccgccttccaggctccctggtcacggctggcgtgctgggtgccgctgcgtggctgttggtgggcaccttcgcggtggccgcggtggctggactggcgggattcctcgtcacgctgctgggcatcggcatgggtggccacggcggcctgcacgggcgccaccggggaggcggctggccgggcggaggattccgcggcggcggcggcggcttcggtggcggcggcgcgtcaggacggtggtgagatga

SEQ ID NO: 8639 - DNA, 1626 bp, Pseudomonas aeruginosa
tctacgtgctgctggccgaccgggccgtggagatcgtggccgatcgcggcatccatgcctgttgcggtgccgaaaggtggtcggctgtgtgccagcgcatggaagcccagtttgcgcagggacgcttcgaggccggagccctggaaggcatcgtggccgtcagccacctgctggtgcagcactttccgcggggcgcggaccacggcaacgagttgccggatcggccggtccttctttgaacgacaacatccttggagacctaccatgcaacttcagtttctgggtgccaccggcaccgtgaccggttccaaatacctgctgtgccatggcgacgcgaccattctggtggactgcggcctgttccagggattcaagcagctgcgcctgcgcaactgggagccgctgccggtcgcgcccaagaccgtcgacgcggtcgtgctcacccacgcccacatcgaccacagcggctacctgccactgctggcgcgacaaggctttcgcggccgggtttactgcacgtccgcgacgcacgagctgtgcaagatcctgctcaccgacagcggccatctgcaggaggaagaggcgaagttcgccaaccggcacggtttctccaaacaccagcccgcgctgccgctgtacacccgtgaggacgccgagcgctgcctgaagctgttcgcgccacgtccgttctctcaggacttcgaggcgctgcccggactcaccgcgcggttgacgccttccgggcacatgctcggctcggccttcgtgcacctcaacgacggccggcgatccgtgctcttctccggcgacatcggccggcccaacgacccggtgctgcgcccgccggtgcaggtccccggcgccgactacctgctggtggaatccacctacggcaaccgcaagcatgaagcgtccgacgcactggcgcagctggagactgtcatcaacaatacggccgcccgtggaggggtcgtggtcatcccagcgttcgctgtcggccgagcgcagagcctgatgtacggcatctaccagctcaagaagcaagggcgcatccaccagcacctgcccgtgtacctggacagcccgatggccatcgatgccacacggctgtaccacgcccatcgcgacgagcaccggctctcgcccgaggaatgcgagggcatgtgccatgccgcgaagatcgtcaacaaggtcgaggagtccaaggcgctcagcgccggtcgtggaccgatggtcatcatctccgccagtggcatggccactggaggacgcgtggtgcaccacctcaagtcattcgcgcccgaccatcgcaacaccatcctgttcgccggctaccaggcgggcggcacccgtggcgccgcgatcgtgcacggcgcgtccaccgtccgcatccatggccaggacgtgccgatccgcgccgaggtggcctcgctcgacaacctttccgcccacgccgatgccgacgagatcctcgcgtggatgcgcggcttcacgcaaacaccgcgccgaaccttcgtgacccacggcgagccggaggcggccgatgcgctgcgcgcgcggatcgaccatgaactgggctggtcggttgccgtgcccgagtacctgcagacggtggatctggtatga

SEQ ID NO: 8640 - DNA, 1008 bp, Pseudomonas aeruginosa
cgctcgccacgcaggtgctggccgacggccgcgcctgggccacgttcgaggcgatctgcgctgagcagggcggcctgcgcagcatcccggtggcaacgcatcggcacaccgtcgcatcgccgtccacgggacgggtctcccgaatcgacaaccggctgctcgcgcgggcggccaagctcgccggagcaccgaccgccgctgccgccggcatcgacgtgcatgcgcgcctgggcgaccaggtcgaagcgggacagccgctcttcacgctgcacgcccaggcgccgggcgagctggcctatgcgctgcagttcgtccgctcgcgcccaccgatcttccagatttcggagaacctatgaaacctctcgtttttcacctgccgggcgacgaagacttcgccgatggactgatccgggcgttgggcgcgcagcgggctgccctgcaactgcaccggttcccggacggcgagtcgctggtgcggctggacgccgacgtcaccggccgcaccgtcgtgatcgtggccagcctggcacagccggacgccaaggcgctgcccttgttgttcgccgcggacgcagcgcgcgacctcggcgccacccgcgtgttgctggctgccccgtacctggcgtacctgcgtcaggaccggcgcttcaacacgggcgaagccatcacgtcccgcacgttcgctgcgctggtgtcgacggtgttcgacggtatcgtcaccgtcgatccccatctgcaccgctaccgctcgctcggcgaggtctaccgggtgccgacccgtgtggtccagtccgcgcccgccatcgcggcctgggtcgcagcccatgtggaccgtcccgtgttgatcggacccgatgcggaaagcgagcaatgggtccaggaagtcgcgcgcttggctggcgcgccgttcacggtgttgcagaagatccgccggggcgacaaggacgtggaggtcagccttcccgacaccgcggccctggcagaccgccagcctgtgctcatcgatga

SEQ ID NO: 8641 - DNA, 651 bp, Pseudomonas aeruginosa
ctgcccatgtgcttttccgcacccgccagtttcacggccgcagcggttctgctgggcctggggaccgtcaccatgcgccgggcccgctcacggcgcgaactgccgtatgccgccatcccgctgctgttcggggtccagcaactgctcgaaggcatgctgtggctgacgttccccgaccgcgcgcccttgctgaacgtggcgctgacgcatctctactcgttcttctcgcacgtcctgtggccgatctacgtcccgctggctgcgctggcgctggagagcgtccgttggcgccgtcgggttctggtggccattgcagtcgcgggcgcgctcgtcggtctgtacctgctggcgatgctggtgaagctgcccatcacggcccgcgtggtcggccagcacatcctctacgactctccgcacttctacgtgatgaccacgatggccctgtatctgatcggcacctgcgcaagcctgatggtttctagccaccggcgcgtggcggcttttggggtggccgcctttgtctccgcaatcgccgcctacatgttctatgcaacctggttcatctcggtgtggtgcttctttgccgctgtgctcagcttcatcgtgctgtggcagttccgtgagccccgagcgaggctggccgtgccatga

SEQ ID NO: 8642 - DNA, 1626 bp, Pseudomonas aeruginosa
gccatgacgcgaccgaaccgccccgtttccaccgtgcgtcttgcgggccgcccaacgcaacgctcggcgctgcgccgggccacgcagatcgctatggccctgagcgggttcctgctctgggtggcctggcaccggggcctgatgcgctgcgatacccaccgggcggccgaccgcttcgccgaagtgctgcagcgattgggcacgaccttcgtgaagctgggccagcatctcagcctgcgggccgacattctggcgcccgatgcgcaagaggctctggccagcctgcaggccaatgtggcgccgtttcctcccgagcaggcggtccaggaggtcgaggcggcgctcggccgcccatggcagcagctcttcgcacgcttcgacatgcacgcgctcgccgcggcctcgatcgcccagattcatcgtgcagccctgccggacgggacggaagtggtggtgaagatccgccgccctggcgcggccgagcaggccgagaccgacatgcgcatcctgcgccgcatcgtcctggtcatgcaggggctcgtgccctcgctgcgtcgctgggggctggcagccatcgtggacgaggttgcggccaacttccgctacgagatggatttgtcgcgcgaggcagcttccgtgcgacgtttcgccgacgcctggcgcggctctgccgacatcgtgatccccgacgtggtggacggcctgtgcacgccgaccgtcatggtccagcagttcagccacggagctcacctgcacggtctgccttcgtccaccgcggtggcggccgcgggcaaactcgtggacagctacgtcgcccagatcttccgcgatggcttcttccacggcgacccccatcccggcaacgtcttcgtgatggacgatggccgcatatgcgtgcacgacttcggcatcgtgggccgggtcgacggcaacatgcggcgggcgctggtggcgttcgccctggccttcgtcgagcaggatgccgaatgggtggtcgatgcctggctcgacctgggcctgctcggcgacggcaccgatcgggccgtgttcgtgcctgtcgtgcgtgccctggtcgcagactgcgcacagaggccgctgaaggactggtcgctctcaggtgctctcgcgcagctcgtggcggcgggccggacccaggaagtccggctgcccagggacctcctcgtgctcacgcgtaccctgttgttgctcgaagggacggtgcgactgctggcacccgagttttccatcatcgaagccatctctcgccacacgaccacgggcgtcttcgacgagcccaagtctgcggcatcgcagcgtctgccatatgaactggggaacgcggcccacgccctgccctccctgatggcgcggcgtctgcacagcgtcttgcggcagggtgacctgctgcaactgtcgatcaagccggatgccaggatgctgagcgggatcgaccgcctcggccgtcgcgtcgcgctggcgctcgtgacgctcggcctgtacatcgcatcgagcttgttgatgcagcacggcgtgggcccgcgctggggcgacatgccggtactcgcgctgctgggctatgcgctggcgatccggttcacgttttccatcgcgcgcagccgcggctga

SEQ ID NO: 8643 - DNA, 1083 bp, Pseudomonas aeruginosa
ggcgcctcatcaagcaaggagtcaggcatgaacaaggtcagagtggcggtgaacggatacggtgtgatcggcaagcgggtggcggatgcggtcgcactccaggaggacatggcgctagccggcgtcgcggatgtggtgcacgactatcgcctgcaggtggccgcgcagcgcgctttcccgatttacgcggcgaccgctgaagccgcacaatcgatgcgtgctgcggggcttcctgtcgcgggcgatctggccgacctgctcgccaacgcggacgtcgtggtcgattgcacacccaagaaagtcgccgcggtcaacaagagggcgtacgacgctgccggtgtgaagtccatcttccatggcggcgagtcccacgcgttgaccggtcattcgttcgtcgcgcaggagaactacgcaaccgcgatcggccgcacctccacccgggtggtgtcctgcaacacgacgtcgatcgtgcgcaccctgggggcgcttcggacagcgggcctgctcaagcgagcccgcgggacgctgatccgccgggcttccgacccgtgggaggcgcatgcggagggcatcatcaacacgctcgtgccggagaagacgatccccagccatcagggaccggacgcgcgcactgtgatcccggacctggacgtcgtcacgatcgcggtcaaggcgccgcacaacagcagccacctgcacacctggtgggtcgaactgacgaggccggccacgcgcgacgaggtgctggcggcctttcgcgctgcgccacggatcgcgttcgtgcgatcctcggatggtctcgtggccctcaacagcacggtggaactgatggccgatctcggccgcccgcgcggcgacctgtgggaggtcgcgttgtgggaggacgtgctttcggtcgatggcgatcaggcgtactacacctaccaggtcttcaaccaggcgatcgtaatccccgagaccatcgatgccattcgcgccttgagcggcatcgagaccgatccccaggtgtcgatggcgcgcaccgatgcttcgctgggactgcagcgtgatttcatccgtgaccgcgtccaggttcgacgatga

SEQ ID NO: 8644 - DNA, 504 bp, Pseudomonas aeruginosa
tggggccgtggccgcgcgcccagcgggcgaactcgggatcagactcgcggaacacgcggacgcgctcggcgacccagggaagctcgtggttcatgtggaaagtccttgagagccggcacgcaggtaagcgcgacggcgagattgggaaggctggcgtctgtgatcgtctttcgcgcgccagcggcacggccatgtagcgttcatggctgtgttatccataaagatcagagcgggtcaagggcacgggccagcttccgccgtcgcgtttggacgcgacgatctggtagatcccagtccccccggcctcgaattccagtgcacacgccgccatgtacaagcgccagatgcggaaggtcacctcatcgacctcccgcaaggcctcctcccggcgcgcttcgagtcgctggacccaatgacgcaaggtcagcgcgtagtggggtcgaagaccttcgacgtcatggatctcgaagccggagcgctccatccctagctggatattgctga

SEQ ID NO: 8645 - DNA, 462 bp, Pseudomonas aeruginosa
ttccaggccgatgaactccaggccatcaacgatgcgccgacgcaacgcggccgaattttctccagctccgccagtgaaggccacagcatcgcaaccgcccatcgcggcggcgtaggcgccgatgtatttgcgcacgcggtacgcgtgaacctgcattgccagttgggcggctgcgactccttctcccgcgcgcttctccacaatccgcaggtccgaactctcacccgacaatcctttgagtccactgtcgctgtaaagcgccgcctcgatctgcgccaacgtcaaacccagtgcgcgtgcgacgaagccgggtacgccagggtcgaggtctccacagcgcgtgcccatcacaagaccttcaagcgcggtcattcccatagatgtatcgaccgaccttccgcgatcgatcgcgcagacgctggcgccgcttccaatgtggcagctcacgatacgaagttctga

SEQ ID NO: 8646 - DNA, 597 bp, Pseudomonas aeruginosa
cggcggccgtttcagctcggtgctgacggcggccagtacaccctggtgggacaggccatggaagccgtatctccgtacccctgccgcgcgccacgatggcggaacagcataggaatgggcgtattcgggcatgtcgtcatggaaagcggtgtcgaagaccgcgacgtggcgcacgccgggccaacgctcacgggtcaggcgtatgccggccaatgcggcaggattgtgatgcggcgccagagccgaagccttgccgatctcgcgttcgacttcttcatccacgagcaccgcgttgctcaacagtgggccaccgtgtgcgacgcggtgaccaatgccatcgagcgttgtgacacccgccctgtgcaagtgccgctcgatctcctcgaaggtcgcagcatccaccgcaggatgatcaatcgccgagtcgatcaatggcaaggtacgagccgactcgaaaactccgaacttcagggtcgcactgccggcattgatggcgaggacgcgcatgtcggagctccgtcagcgccggtcagtgccgacgtcgccgccattggcaacgttcatcagatcgaattgccaagtttcgctcggcgctag

SEQ ID NO: 8647 - DNA, 1794 bp, Pseudomonas aeruginosa
cggggcgtaacgccagatgtgcaggcgactcctgacaacgcaatatcagaagtcatctgcaccaatctcgactatgctcaatactcgtgtgcaccaaagcgaggtgtgagcatggcgtcagacacatcattgattgccgagcaaggcgtggccaccctgcccgatgcggcttgggcgcaggcccggcaacgggcggaaatcatcgggccgctggcagcgcttgatgtggtcgggcatgaagccgccgatgccgctgctcacgcgcttggcctgtccaggcggcaggtgtatgtcctaatccgccgtgcccggcaaggtgctgggcttgtgacggacctggctcgcagccgatccggcggcggaaaaggcaagggacgcttgccggaatcagttgagcgcatcatccgcgagttgctgcaaaagcgcttcctgaccaagcagaagcgtagcctggcagcgttccaccgcgaggtcgcgcaggcttgcaaagcgcaaaagctgcgggcgccggcgcgcaacaccgtggctctgcggatcgccggcctcgatccgctcaaggctactcgccgccgggaaggtcaggatgcgtcccgcagcctgcaaggtgtcggtggtgagcctcccgccgtgaccgcgccactggaacaagtgcagattgatcacacggtcatcgacctgatcgtggtggacgagcgcgaccggcaaccgattggccgtccgtatctgaccatcgccatcgacgtgtttacccgctgcgtgctcggcatggtcgtcacgctggaagcgccgtcatctgtttcggtcggcctgtgccttgtgcatgtcgcctgcgacaagcgtccctggctggagggtctgaacatagaaatggagtggccgatgagcggcaagcccaggctgctctacctggacaacgcggccgagttcaagagcgaagcgctacgccgaggctgcgagcagcatggcatccggcttgactatcgcccgctcgggcagccgcactacggcggcatcgtggaacggatcatcggcacggcgatgcagatgatccacgacgaattgccagggacgaccttctccaaccctgaccagcgcggcgactacgattccgaaaacaaggccgccctgacgctgcgtgagctggagcgctggctcacattggcggtcggcacctaccacggctccgtgcacaacggcctgctccagccgccggcagcgcgctgggccgaagctatcgcgcggaccggcgtgccaaccgtcatcactcgcaccacggcttttctggtcgattttctgcccatcatccgccgcacgctgacccgcaccggcttcgtcatcgaccacatccattactacgccgatgcgctcaagccgtggatagctcggcgcgaccgcttgcctgcgttcctgatccggcgcgacccgcgcgacatcagccgcatttgggtgctggagccggaggggcagcactatctggaaattccataccgcaccttgtcgcacccggctgtcaccctctgggaacaacgacaggcgctggcgaaattgcggcagcaagggcgcgaacaggtggatgagtcggcgctgtttcgcatgatcggccagatgcgcgaaatcgtgtccaccgcgcagaaagctacgcgcaaggcgcggcgcgacgcggatcgacgccagcatctcaaggcaacggcagttcttttcaaaaccacgccaccaccggacgcggacatggctgacccgcaggcagacaaccagccacctgccaaaccgttcgaccagattgaggagtggtag

SEQ ID NO: 8648 - DNA, 537 bp, Pseudomonas aeruginosa
atgacggagcgcacgatggttcggtcgcggtggtcgtcggcgagtccggcgacgaaggactggtcgatcttgagcgtagtaatcgggcagcacttcaggtgttgcaggcaggaataccccgtcccgaaatcatcggcggcgaagcgcacaccgatttgtcgcaaggcttccagggcggggaagatcgccggatcaccgaacgcgaccgattcggtcagctcgatttcaagagactcggcgggcaactcggcgtcagccagcacgccctttacccatccgtcgaaatccggtctcacttggctcgccgaaacattgacggccagccggaacggttgccatgccagcatccgccactcgcgcatctggcggcaggctgcgcccagcacccaagcaccgatttcaggcatcaagccggacgattcgaccaaggggagaaactggcccggcagcaacaagccgagccttgggtgccgccagcgcaacagggcttccgcaccgacaatctggtcactgcgcagatcgactatcggctggtag

SEQ ID NO: 8649 - DNA, 507 bp, Pseudomonas aeruginosa
acggcttgcgtgtcttggtcggcaggcgttccgggccgttcatggcagactctccgcgtgctgtgccggctcggtcggcagggtggccaactgcgcttccagatcggccaacgcttcgcgccggtgttcgacgaactggcgcagcacggcaagctgcgtggccgcttcgccgccgtccgctgcatccagcgcccggcacagcctcgccagcgcatcgaggccgatgcccgcttcgaaggcggatcgcacgaagcacagacgctgcaaggccgcctcgtcgaacaggccgtagccgcctggcgtgcacgccaccggccgcagcagtccgcgcagcaggtagtcgcgcacgatatgcacgctcaccccggcatcaagggccagccgggacaccgtgtaggcgttcatcgaacacctcctttttctcacccggcgcagcaggaaagctgcttcacatccttgttgaaggtctgcgccgcgagcttcaagccctcgaccatcgtcaggtag

SEQ ID NO: 8650 - DNA, 438 bp, Pseudomonas aeruginosa
atgttggagctactcgtgtgcattccttggtcgatgacgatcgcaccttgcttgttcaccatcacgcctgccacgtccagtgccaggctgcgcgtgttgggtgcacggccggtggcgaccagcagcttgtcggcgcgcagttcgccgtgcgccgtggtgagcacgaattcgccgtccctttcaccattgatgtacgcgacctggctggcctgggtgtgttccctcacctcgatgccttcggcacggaacgcggccgtgacggcttcgccgatggccgggtcttcgcggaagaacagcgtgctgcgcgccaggatcgtcaccttcgctccgagtcgagcgaacgcctgcgccagctccagcgccaccaccgatgagccaattacggccaggcgcttagggatcgtttcgctgaccagtgcctcagtggaagtccagtaa

SEQ ID NO: 8651 - DNA, 222 bp, Pseudomonas aeruginosa
ctgagccagcccaatgcgttcgccagcaaagccacgacagcgaacagcggcagcagcttggagatgaacaatccttcgtattcctgtagaaagcccaggccgatggccgcgcccaagctggcgatggccggaaagcacgcggcgcaacccatcgcggaaacaacgctgccgagcgccccaggttcgggttcagtggttcactgcttgacgctggagggatag

SEQ ID NO: 8652 - DNA, 189 bp, Pseudomonas aeruginosa
cccgcatcggtggttgctttggtgagcttctggacgctggtcttggcatcatcgaaagtgacaaccgcttcgcgggtctcgaaggtcacgtcaaccttgctgacgccttcgaccttggaaatcgccttcttgacggtgatcgggcaggcggagcaggtcatgcccggtacggacagcgtgacggtctga

SEQ ID NO: 8653 - DNA, 426 bp, Pseudomonas aeruginosa
gcaaatatgaaaatcggtgaactatcgtcattggcagggtgctccgttcccgcggtgcgcttttatgaagcagagggccttctgcaggcgcccctgcgggccgccaacaactatcggcaatatggccaacagcatgtcgacaggttggccttcatcgttcggtgccgctcgctggacatgtcgcacgacgatatccgggctctgctgcagttgcaggacgaccccgccatgtcctgcgacgaggtcaatgccttgctagacgatcaaatgcgcttggtagagcagcgaatcgccgagttgcaggcgctgcgcaagcaactgcgtgccatccgcagtacctgtgcgggaggggtatgcgttggcgattgcggtgcacttgaatcgctgcgcagcgccactggggcaagctggccaaccgttcgctga

SEQ ID NO: 8654 - DNA, 441 bp, Pseudomonas aeruginosa
ccctcaatgcaagcgacgctggacggctttgccgcggcttatggcgcaggggcatcatcgggcgcatcgagcgtgtatcccattccacgcacggtgtggatgagcttcggattgaacgcatcgtctatcttcgcgcgtagacggcggatggctacatcgatgacgttgctgtcgctgtcgaaattcatgtcccatacctgcgacgcgatcagagaccgtggaaggacctccccctggcgacgggccaggagctcaagcaacgcgaactccttgctggtgagattgatgcgttggccagcgcgcgttgcgcgccggcgcgccaagtccagcaccaaatcggcaacctggatgcgatcaggctggctcggagcgcttccgcgtcgcagcagcgtccgcacccgcgccagcaactcagagaacgcgaatggcttgacgaggtag

SEQ ID NO: 8655 - DNA, 510 bp, Pseudomonas aeruginosa
aggccgaaggcgatatcgcccaaaggaaagctcgaagaatcgcgtaccgagcttctctgggggcacgccgtcgcaccgtactgggacacccagctcggcgttcgggtggataacggggaaggcccgagccgtcaatggttggctttcggcatccagggcctcgccccctactggttcgagctggaggcgacgggctacgtgggaagtggtggacgtacggcgctgcgtgtcgaaggcagctacgagctgctgctgacccagcgactgattctggagcctcgcgccgagttgcagttttatggcaaggacgacccggaacgcggtatcggcaagggcctggccgaagcgtctgctggcttgcgcctgcgctatgaattcagtcgccagttcgccccctatatcggcgtggaacgggcgggcagcttcggacgcaccgcggactatgtgcgtgccgaaggcggccgtgcgcagcagacgcgctgggtggctggcgtgcgattctggttctag

SEQ ID NO: 8656 - DNA, 2502 bp, Pseudomonas aeruginosa
cggcggagggcacttgtcactatgaattcacccagcaagtcttcaggacatgagcacgcaggcatggcggcgggtgccacaacgtccggcccgcatacgcaccaccatcacgccagccatgctggaagtgacgacgcgggcgggtcctcaagccacacgcagcccgatgccgcgacgcgagatccggtgtgtggcatggcggtcacggcggcgtcggagcaccgttccacgcacttggggaacacgtacttgttttgcagcaccggatgcaaggccaaattcgacgccgatccggcgcgatatgccagcggtgacgcgggcataggcacaggcagcggccatgcaccgcatcaccatgccagcaccgcagtttcaccggccccggcggcatcgccaaccgcgcccggaaccatctacacctgcccgatgcacccggagatccgccaggatcatccgggaacctgccccaagtgcgggatgacgctggagcctctgctgcccgacctcgatgacgacaacccggagttgcgtgacttctcgcgtcgcttctggtggaccttgccgctgacgctcgtggtcttggcgctggcgatgctgggcgagcggctgcacctgatggacatggctacacagagctgggtcgagttggtgctgtcgttgccgatcgtgctgtgggccggctggcccttcttctcccgcggctggctgtccgtggtcaaccgcagcccgaacatgtggacactgatcggcctgggaacgggtgcggcattcatctacagcgttgtggcaaccgttgcgccggaagtgtttccagcttccttcatgtccatgggacgggtcggcgtgtatttcgaggccgccgccgtcatcatctcgctgacactgctcggccaggtgctggaactcaaggcccgctcccagacttcggcagccatcaagtcgctgctggggctggcacccaagacggcgcggcgcatcaatgcggacggcagcgaggaagacgtgccactcagccatgtgcacgtcggcgacctgctgcgcatccgacccggcgagaaggtgccggtggatggcatcgtgcacgagggcagcagctcgattgacgaatccatgctgaccggcgaaccgctgcccgtcagcaagcgcgtgggcgacaaggtcatcggggccacactcaacaccagcggcgcgctggtcatgcgttcggagcggatcggctcggacaccgttctatcgcagatcgtccagatggtcgcccaggcgcagcgttccaaggcaccgatgcaacgcatggccgatgtcgttgccggctacttcgtgatggccgtcgtcgccattgcggtaacgacgctccttgtatggggattcttcgggccacagcccacctgggtctatggactgatcaatgcggtggccgtcctgatcatcgcctgcccgtgcgcgctgggtctggccacgccgatgtcgatcatggtcgcaacgggccgtggcgccacgcagggcgtgctgttccgcgatgccgcggcgatcgagaatcttcgcaaggtcgataccctcgtcatcgacaagacaggaaccctgaccgaaggccgacctgctttcgatcaggtcgtcgcagcccccggctttacgaacgatgaggtgctgcgtcttgcggccagcctggaccagggcagtgaacaccccctggccgacgccatcgtgcaggccgcgcgtgcccagggcctccaactcgtgaagcctcagagctttgaatcgggaaccggcatcggcgtgcgcggaaaggttgagcaccggcaactggcgttgggcaacacagtgctgatggaacagtctggcgtatcggtggaaccgctcgtaccccaggccgaagctctgcgcggcgaaggggccagcgtcatgtacctggcggtggacgggcagctcgcgggcttgctcgccgtgtccgatccggtcaagggcagcacccccgaggccctggccgcgttgaaggctgcgggcctgcgggtcatcatggccaccggggacgggcagaccaccgccaaagccgtcggtgcacgcctaggcatcgacgaggtgcatggtgaggtcaagccggcggacaagctcatgttgatcgagcgactgcagaaagaaggacgcatcgtcgccatggccggagacggcatcaacgacgcgccggccttggcgaaggcagacgtgggcatcgccatgggaacgggaaccgacgtggcgatgaacagcgcccaggtcacgctggtcaagggtgacctgcgtggcatcgctgtcgctcgcacgctctcggtgagtaccgtgcgcaacatgaagcagaacctcatgttcgccttcctctacaacgcgctgggcatccccatcgccgccggggttctctatcccctcacgggctggctgctgtcgccgctgatcgcagcattggcgatgagcctgagttcggcgtcggtcgttggcaacgccttgcgcctgagagcgagccgactgtga

SEQ ID NO: 8657 - DNA, 528 bp, Pseudomonas aeruginosa
ccggattttctttctgaaactacaggagcctgctatcgcccagcaaaccgtttctttcgttccacgccgttgcaaaggtgcaagccttatctcggcatttcgttcttaaaccacacctcacacatccaggtagaaacttctatgacccgttcacatttcatcgccaagctcgtcgcgccgatcgctgctggtctgttcgccaccgccgcattcgcgcatccttcgctggtgtcttcaacgccggccgacaagtcgcaggtttctgcgccagccaccatcgaactgaagttctccgagacgctggtgccgcagttctccgccgcgagccttgtcatgactggcatgccgggaatggcgagccatggcccgatgaagatcaacgccagcgtcgcggctgccggcgacggcaagaccatggtcatcacgccggcacaggcgctccagcccggtgactatcgcgtcgaatggcgtgccgtctcctcggacacgcatccgatcacgggtaacgtcaccttcaaggtgaagtaa

SEQ ID NO: 8658 - DNA, 360 bp, Pseudomonas aeruginosa
gcgctctgtagaccgcctgcttctacatttaacgacgcggcgcaagttgtcgtcgtttttacaaaggagtcgatcatgaaatcgcaaattgtcattgccgccctgttgagcgctctctccgtgccagccttcgccggtcatgcagcagcccaagcagccaaggaaatggttcccttggctgacgggggaacgctgtacatcttcaaggacggaaagatggcacaggaaagccgcttcgggcgcgccgtctatctcaatgtcggagcttcggtgtcgacgaaggatgggcgcaacatcgcgatcaccagcaatgaagtcgctcgcctcgggtcgctgctacaaaaagagcacggcggatga

SEQ ID NO: 8659 - DNA, 942 bp, Pseudomonas aeruginosa
ttcgtccacgggacatctggcgcgaatgagaacttgcgaggagcccgatttatggagttgcgtcatctacgatgctttgtcgtcttggcagaggagttgcatttcacgcgggcggccgagaggctgcatatagagcaaccccccttgtctcgcgcgatcaaggaattggaagatgagcttggggtcacgctgtttgaccgcgaccgcaggggcacacggctgaccgtggcgggggcggcattcttgcaggacacccgccgactcttcactgtcctggagcaagcgcgtgaaaatgccagagccattgccgcgggcctgaggggcagcctgcgcattgcaatttccgatggtgcgatggacccacgactatcggcgttcctagctcgttgccgcgcggaagagcccgaggtcgagatacgtctctccgaggtaccgctgaccgagcagatacggggcctacggtctggcgacttcacgatcggatttgcacacgcggcggatgttggcgaaggcatcgtggctgaaccgatctggcgagacccgattgtgatcgccgtgccagcgcggcactcgcttcttgcgcacaagcaagttccgctgaacgaacttcagggtcacccactggttctgtgcgacaaactggcctgcgaaggctactgccgagaattaaatcggctgctacaggttctggaacacagactcaacgttgtcgaagaagtgtcgtcgctggacatgatgctaacgctcgtcggcgcaggctatgggattggtttcatgacggcgaccaagattcccatcagccagaggccggacgtggtgattcgccctctggcgcaggacacggcggtaatcacaacctatctgcttcggccagaaagcagcaactcatcggtttcgctggatcgcttcatcgaacgtctgcgaggacctccggatgactaa

SEQ ID NO: 8660 - DNA, 789 bp, Pseudomonas aeruginosa
ttcctgggggacggcctcgtcggacagttcgcttctccatgcttggaagcgtcgaacagtccaaacaatttaaccacgttacgtttaactcaaactagctatcatgaagactttccatccttgtcttatcgcttcttggggcctctcatgcacgacgccaccagcccacgcccacagctcaggctcgccatagcgcctggtgtggcctcttcgtacctagctgcattgcttgccctgcagcgcgcggaggagcccgaagtttctatggaatttaatgaggttacggcgagcgatctcattacgggcctctacaaacggcgcttcgacgtcggcctttctctgaagcaggtgagcgattcttcgctgaagagtctttctatttggttcgaggcgacagctcttgccacgccgctgcgatacccactgctccggcagcagtcaatcagaatagacgaacttaaggagcactccgtgtttcgatggaaggccgaatattctccttcgctggaccagtacctgtcctccatgtcatcaacggaaaggccgaatgtccagcatgtcagttcttttgagatgttattgctctgggtcgcagctggatatggcgtagggatttcctcgcgatcacgcatcgaaaccgctagccagtgcggaatctgcacgcgcccaatagccgatggcccctacgaggtcattacgcacctgcagcgactctcgggacagacgaatcttgtagctgatcgatttgagcttagagccttgcgagttgccgaggcgcgtaaagcatga

SEQ ID NO: 8661 - DNA, 3156 bp, Pseudomonas aeruginosa
gggctacgtgatcaccgccatcgaaaaggtgcagccatgatcgccaagctgattcgatggtcggtggccaatcgcttcctggtgctgctggccaccgccatgctcacggcatggggcgtgtggggcgttcgcagcacgcccgtggatgcgctgccggacttgtcagacgtgcaggtcatcattcgcaccaactacccaggacaggcgccgcagatcgtcgagaaccaggtcacctacccgttggccaccaccatgctgtcggtgccaggggccaagaccgtgcgcggcttctcgttctttggcgactcgttcgtctatgtcttgttcgaggacggaaccgacctgtactgggcccgctcacgggtactggaatacctgaaccaggtccagggccgattgcccgccacggcgaagccggccctgggtccggacgccacaggcgtcggctggatcttccagtacgcgctcgtggatcgcacgggcaagaacgatctggcgcaactgcgtgcgttgcaggactggttcctgaagttcgaactcaagagcctgcccaacgtggccgaggtggcatcggtggggggcatggtcaagcagtaccaggtcgtgctcgacccgatcaagttggcgtcctatggcctcagtcaggctcaagtccgcgatgccctgatgggggccaaccaggagaccggcggctccgtcctggaattgtcaggcgcggagtacatggtccgcgcgagcggctacctcaagaccctggacgagttccgggagatccccttgacggcacgcggcggtgtgccggtgcggctgggggatgttgcgacgctccagataggcccggagatgcggcgtggcattgccgaactcgacggagaaggcgaggtcgccggcggcgtggtggtgctgcgctccggcaagaatgcccaggagacgatcgctgccgtcaaggccaagctcgcggagctgcagggcagcctgccgccgggcgtcgagatcgtcaccacctacgaccgcagcgcgctgatcgagcgggccattcgcaatctcacgaccaagctaggcgaagagtttctggtggtggcgctggtctgcgcactgttcctttggcatcttcgttctgcgctggtggccatcatctcgctacctctgggcgtgatgacggcgttcttggtcatgcgctaccagggcatcaacgccaacatcatgtcgctgggggggattgccatcgccgtgggggcgatggtggatgcagcggtggtgatgatcgagaacgcccacaagaagctggaggcttggcagcacgcgcacccagatcaacggctgcagggcaaggaacggtgggacgtgatcacacaggccgcggaggaagtcggtcctgcgctcttcttctcgctgctcatcatcacgctctcgttcatcccggtcttcaccctagaagcgcaggaaggccggctgttcggcccgctggcgttcaccaagacctacgcgatggccgcggccgcagggctgtcagtgacgctgattcccgtactcatgggctactggattcgcgggcgtatcccggatgagcagaagaaccccatcacccgcatcctgattgcagcctaccggccagcactggagtgggtactgcgccggcccaaggcgacgctgctgatcgccgtgctggccttggcgaccacggcctggcccttggcgcggctcggcggtgagtttctgccgaggttggacgaaggggacctgctctacatgccctcggccctgccgggactctcggcgcagcgcgccacggagttgctgcagctgagcaaccgcatgatcaagaccgtacctgaagtggacaaggtgttcggcaaggcaggacgggccgaaactgcgaccgatccggcgcccctggagatgttcgagaccacggttaagctcaagcccagggaacaatggcgtccaggcatgacgcccgagaagctcgtggaagagctggatcgtgccgtgaagatcccgggcctgtccaatatctggattccccctatccgcaatcgcatcgatatgctggctaccggcatcaagagcccgatcggggtgaaggtgaccggcaacgacctgggcgtgatcgatcgcatcgctgcagaggtcgagcaggtcgccaagggcattcccggcgtgacgtcgtcactcgcggagcgcttgacgggcgggcgctacgtggatgttcagatcgaccgcgtagccgccggtcgctacggcctgaacatcgccgatgtccaggcggtcatcgccggcgcggtgggtggcgaaaacgtctcggaaacggtcgaggggcttgcccgctttccgatcaatctgcgctacgcgcgagaatggcgtgattcaccacaacggctggcagaactacccatcttcacgccgatgggtcagcagatcacgttggggaccgtggcacgcatcgcgatcaccgatggaccgcccatgctcaagagcgagaacgcacggccctccggttgggtctatgtcgatgtgcgcggccgtgatctagcctcggtggccaacgaactgcgcgatgccatcgggcagcaggtcaagctggagccgggtgtgagcatcacctactccgggcagttcgaatacatggagcgggccaatgcacgcctgaaggttgtggtgcctgccaccctgttgatcatcttcgttctgttgtacctgaccttcgcgcgtgtggacgaagcgggcttgatcatggcgaccttgcccttcgcgctcacggggggcatctggttcctgtacctgctgaattacaacctgtccatcgccaccggcgtgggattcattgcgctggcaggtgtggcggcggagttcggcgtggtgatgctcatctatttgaagcaggccttggcggaacgttgccccgatgggcgcaacccaacgcgagaagaactgctagctgcgatccgggaaggggcggtgctgcgcgtgcgcccaaaagcgatgaccgttgcggtcatcctggcgggcctggtacccattgtttggagcagcggcacgggctctgaagtcatgagccgcatagcagctccgatgctcggcgggatggtgaccgcaccgttgctgtcgctgttcgtgattccggctgcctatctgctgatgcgtaagccgcgctaa

SEQ ID NO: 8662 - DNA, 2748 bp, Pseudomonas aeruginosa
gcagcggtgcatgaggcggtcgaggatggtggtggccatggtgacgtccttgaggtacttgccccagtcggtgaccacgcggttggaggtgatggcgatggagcggcgcagcttgtagcggcgatgcacgacggcctggagcaactcggccgcggcctccgggatgcgacgggccaggaacaggtcatccaggaccagcaggtccggttcgctccaggacttgatcaaggcggcctgctcctgggcactggccagtgcgtactgagccagcgcggtgtcggcctcgatatagcgcacatgcagcccctgcagcgtggcctggtaggccactgccttggccgtgtggcttttgccggtgccgggcttgcccacgatcagcgcgttggcgccctcggcgacgaacttcagcgtgtgcagctcgaagcaggccgcgcgcggcagcttggggttgaactgccagtcgaagtccacgagcgtgggccgctcgtccaggccagagcgcttgtagctgcgctcggtctggctggtgcggcgtcgatccagttcgtcctgcagcaaggccgcgagggtctcgacgaagggctgctgggcggcctgggcctgcatgatgcgggtgttcaaggtgtcggcgaagcccgacaggcgcaactggcgcaaggtacggtcaatctcgatcaaggtcacaggccgccttccctcgctggtatcgacgccggcctgggtggcggccaggttgaacagcgagccgtactcctcggtgtcgcggatgagtacgtgctcctgggcgagatcggcgcggccagggtcggtcccatcgccggcggcatcgatggatgcgagggcctcggccaccaggcgctcggtcagcgccttgacgtgcttgtagctgtggatgccctgctcgatggcggccgcgcaggcggcgttcacgaagcggcttgggtagcgtcggctgaggttgacgatgccgtgcagcttgcgctggcccacccggccttcgatgccgaacagcatgcggcacaggcgtgccgcctgggggccgatctggtcggcctgcttgaggatgaagcgcgtctcgcgcgagggattgaagacgcgctcggcctgcggcatcaccaccgtgcccggccgttcggcgcgctcgtgggtgcgcaccagccgccccgtggtcagctcgcggatctcgatgcgccgctcgaagatgcgcaccaggaccttggcaccgatggccatcggacgggccgagtagctgctgtggtccacgcgcacgcagccatcgtcgcaaacggtgcgctcctcctgcttgaagtactgcatgccggtcagcggcagccgctgcaggtgggcgcgttcgtcctcgaacatggcctgcacctggcggcgctcggtgccgtggatgcgctgggccgcccagcgcgtctcccagcgctccagatgctcgttctgggcctcgatggtctcgaagcgctttcccttcagcgccgtggcctgggtgtggccaatggcgctctccacggtgcccttgcggttcgggtccctgaccctggccgggtcggccaccacctcgtagtgcgccagcgtggcggcaaacaccgggttgagctcgggctcgtacaggtcgggcttgagcacgccctccttgaggttgtccagcaccacgtagcggcacgagccgccgaagtagcgccaggcctgctcgtgcagttctgcccacacctgctggctggacttccagaccacgcgccggaaactgcgccgcgagtagcgcagcgtggccacgaacagccggggcttgcggtagcggtccgtccccggcacccgcgtcggcgccccctcgccgtagtccacctgcatctcctcgccgggcaggaacgacagccggtcgaaccgctcgggctcctcgtgccgcaacttggccacgaagcgcttgaccgagttgtaggcgccggcaaagccgtgctggtcgaccaggtcctggtagatcgccacaccgttgcggcccagccggacctgggcctcgatgaagtcgcggtggggctcacaccgactggtggccaccggcatgccagccggtggccagggtgggggagtttgctggccgggggtggccacggccacttcagagccggtggccaccccgggggaatttgctccttcggccagccaccgctcccggtagcccttgaccgtcttgcggtcgatgccggtaagccgggctatctccctctgggactttccgcgttcgagcagcgtcaggatcgtcgcgcgcttattgggcttcaagacattcactccttggccttccctcgggaagacccagttcaatgtgtcctgccaacaggtgccgacggcgccggctcttacctcctgtccccgatcaactcaggtggcggagtttggggtggccatcagtgggggagtttgggtggccgccggggctatgacagcccgaaccttgggctgcaggtaacgcgattgcggccacactgcatggataggcatctcaccacctgcccagtccggcagcacggggatcaagcgcccctgccgtatatcttcggccaccagccatgtcggcatctgcatgatgccgcagccggccagacccgccgccagcattgcttcaccatcactgaactcatggcgcggatagatttcctgccgacgtacgcgctggtccgagacgcggagcaaccaagtgggtctctgccgtccccgaggaccagtgatgcagtcccgatgcattaa

SEQ ID NO: 8663 - DNA, 999 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtcgaatgctgcaggctcgcatcgcacgcagtgtgggcgtctcggagtccacggtcagccgcgttctggcgcgagcgggcatgtccaggttgagcgacctggagcccgtcgaagccgttgtgcgctacgagcacgaggcgcccggggacctgctgcacatcgacaccaagaagctcgggcgcatcgtgcggcccagccaccgcgtcacaggcaaccgtcgcgactcggtcgatggtgcaggctgggagacgctgttcgtggccatcgatgatcacgcaaggttggcgttcaccgccatgcatcccgatgagaagacggcgcaggcggtcctgttcctgcgcaatgccgtggcctattacacccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccagtcagcgttgcgcgagtgggcctacggctggacctaccagaactcagcccatcgaaccgatgccctggcaagctggcaacaccactacaactggcatcgcccgcacagcggcatcggcggcatcgcgcctatgtccagactcaactcgtcaagaaataacctcttgacgcttcacagctag

SEQ ID NO: 8664 - DNA, 1020 bp, Pseudomonas aeruginosa
agccgcgaccggcaccggctcgctgtccaatccattccagcgggttccccattgacgctggagccgcaccccatgccccgctataccgaaacggttaaaggccaaagggccgaaacggcaagggaatggggtgcaaggggaaaggccctacctcgaaaaggcgaaaaggcctcccggccggccccccagaggacacccgcatgctctccctgttccagcgaaaacggcccccggtcgctgccccgtcgccagcgcccgccaccgacctcccgaaagggttgctgcggcccgaatcggccgcatcgctgctggcaacaccgcgccggcagaagctgctggaacacatctggcagcgcacgtcgctgtcgcggcggcagttcgccaccctataccgcacgccgctggagcactacgccgagttggtccaacaattccccgcatcggaaagccatcaccacgcttaccccggcggcatgctggatcacgggttggagatcgtcgcctatgcgctcaagctgcggcagtcccatctgctgcccattggcgccagtcccgaagaccaggcggcgcagtctgaagcctggactgccgcagtcgcttatgccgcgctgctgcacgacatcggcaagatcgccgtcgatctgcacgtcgaactggccgacggctcgctgtggcacccctggcacggcccgctgcaccagccataccgcttccgctaccgcgacgatcgagaatatcggctccacagcgctgcgacaggtttgctctaccgccaactcctcgaccgtgatgccctggactggctcagtggctatcccgacctgtggggaccgctgctctacgtcctggccggccagtacgagcacgccggcgtgctgggcgaacttgtcgtacaggccgaccgcgcttccgtggcccaagagttgggaggcgatcccgcgcgcgctatggccgcccccaagcacgcgctgcaacgcaagctgctggacgggttgcgctacctgctcaaggaagagttga

SEQ ID NO: 8665 - DNA, 468 bp, Pseudomonas aeruginosa
gatcacaggtgtcaatgggtcaataggccgcacatgcgcacacttctcaaccaccgcaggattcgcgccatcgcgtggatggtgctcggggtatggctgtttgcgctcggggccggggtggccaatgcctgccttctggagtctccgcagcaacatcggcatgctgtcgggtatgagcatgtcccatcgtccgggcatggaaatcatgaaggcctccatggtgagcacgaagaaggttcccacgacccgtcgaaggccccgtgcctgaagctctgcggcgacgtcaaccagtccgccattcagaaagcaccaaccttcgcgttcgacctcgtcggtttggcgcctcccgcctatggagaccagctgctggctccgacgttggctctgcgagccatcccatcgaggggtcaccagcgaccacctcccaagcggccgtcgtggctgctgttcgagcgtctcgcgctgtag

SEQ ID NO: 8666 - DNA, 2736 bp, Pseudomonas aeruginosa
gcactgggacggctatacacgggcgcgcgacgagatgttcatgcgcacccatacggccgcggcgccctggtctgtcgtgcacgccgacaacaaacggttggcgaggctcaacctgatcagagacatcctctcccggctgcactacgccggcaagaagcacaaggtcatcgctcccgaccgggagatcgtcttcgagttctcgcaggactgcctggactcgggccgactcgctcgttgagaccacgaacacagcgaacaggaagaacagccatgaagtcgatcaacgttgaagtcggagggctcgtatcgagcctgagcgcggagggagtacgccgcaagctgctgcagcttcccggcgtccatcatgcagatgtcaactatgttgcgggaagcgcaacggtccatctcgatgagggacaactcagtgtcgaggatctgcgccagcgcatcgccgaatgcggctatcactgccgtggcgagcagacgcccaagcacgtgtgcgcgcccgccgctggcgtctctgccgaccccagccatgcggtgcacggccatcacggcgcacccgcacgtcaggcgcaagagatggggcatgaggggcaccacgcgcatgcccccgccacggccgcacgcgcgaaggctgcggccacgacgcccgccgcccatgctgcgcaccaggcccacgcaggcgaccctgcgatggacgacatgatgcacgacatgggccacgggtcgggctcgatgcaggacatggctcgggacatgcgcaatcgcttcttcgtggccctggtcttcgccattcccgtgttcttctattccccgatggggaagatgttcggcgacttccagacgccgttcgggctggacgacaagctctttcttttcttcctcgcaagtgccgcgatcatctatccaggttggcctttctacgtggcggcgtggcgcgcgctgcgcaacggcgtcgccaacatggccacgttggtcgtgctgtcggtgggcaccggctacctgttcagcatcggcgcgaccttcttctacgagggtgaggtgttctatgaagcggcatcggtgctgctggtcttcatcctgctggggcactggctggagatgcgcgcccgcgcgggcgcatccgacgcgattcgcgcgttgatggatctcgccccacccatggccacggtcgtgcgcaacggggtggagaccaaggtaccgaccgccgaggttgcagccggggaactggtcgtgatcaagcccggcgacaagatcccggtggatggcgagatcgtcgagggcgcgtcgcaagtggacgagtcgatgctgacgggcgagtccatgccggtcaagaagggcgtgggcagcaccgtcgtaggcgccagcatcaacaagagcgggagctttcgctacaaggccacgaaggtcggcgcggacacggccttggcgcagattgtcaagctggtccaggaggcccagaactcgaaggcccccggccagctgctggccgaccacgcatcccagtggctggtgctggcggcgatcgtgattggcctgctgaccttcagcgtctggtactgggtgatgggacagacattactgttcgcactcaccttgaccatcaccgtgttcgtgatcgcatgccctgatgcgctggggctggccaccccgatggccatcatggtcgggaccgggctgggcgcaatgaacggcattctcttcaagaatgcggccgcattggagaacgccaccaagttgacggtcgtggtgttcgacaagaccggcaccttgacactggggcagcccgatgtcgtcgagatggtggccgcgcccggtgtcgaggagacgcggcttctggcgacggccgccgcggtggagaagttctccgagcaccccctcgcgctcgcagtgctcaagcgtgcgggagacatgccgacggaggtcaccgagaacttcaccaacatcgatgggcaaggcgcacgggccactatcgggggcgagacggtgctcctgggcaaccggctgctgatgcagtcggaacaggtggatctggccccccttgccagcgaggcggcgcggctgcaaggcggggggcgcactgtggtccacgtcgcgcgcggtggccggctgatcggcctcatcgcgatcgccgatgccgtgcggccgacctcgcgcgagacgatcgccaagctgcaggcacgcggcgtgaaggtcgcgatgctgaccggcgacaaccaggcgaccgccgagcgcatcggcaaggaactgggtatcgacatcgtgcttgcggatgtgttgcccgggcagaaggcctccaagatcaaggaactgcagcagcagggtcacaaggtcggcatggtcggcgacggcatcaacgacgctccggcgctgacgcaggccgacgtgggctttgcgattggcgcggggacggacgttgcgatggaaagcgcccaggtggtgttgatgaagagtgacccctacgacgtggtcggggccatcgaactgtcccgggcgacgctgcgcaagatgcaccagaacctctggtgggccgtggcctacaacgtgatcgccttcccgctggcggccggggtgctgtatccgttcaccttgtcgcccgaggtcgctgcattgtccatgtcgggcagttccgcgatcgtcgcgatcaatgcgctgatgctcaagcgcacgcgcctgccggggatcaagcgcgtgacgtcgcgtgtcagtgtcccagcggccgcgtcagcctga

SEQ ID NO: 8667 - DNA, 948 bp, Pseudomonas aeruginosa
actcggcatcgtgctgcagggccagcgccaccccgatctctcctcccgagaggtgtcgttgatgttcgccgagtgcagtctggtgatgctgggcgtcaacgcggtgctgttcttcaccggcctgctggagcgcgccgacccacgccgcgtactggcctgcggcatggtcctgggcatcgccgggctcctgatgctggcccgccatggcagcgagatgtggctgtacgtcggcgtgagtttcacggctgcgggcacgggtctcgtgctccccaccctggcctacctcgctgccggcacctcggcgcggcggctcggtatcgcgatgggagggctcgccgcggcagccggcctcggacaaacactgggatcggccgccaccggatggctattcggcgctgtgatgcagagcacctttgcgtggctgtcgattccactggccgccaccctcgcgctgctgctcattccgcggcgttggtggccagccaaccccgtcctggtgagcgcttcaccgtcccgcacttttctcacttccacggaaaccgaaccatgagactgatcctgatgtcccctgctcgcagcgcttgccctgtcgctgagcggatgcggctacaacgacttccagcggctggacgagcagaccaagtccgcctggtccgaggtgctgaaccagtaccagcggcgcgccgacctgatccccaacatcgtcgcgaccgtcaagggcgagaccaacttcgagcaggagacgctgacccgggtggtcgaggcccgcgcgaaggcgacctcgatccaggccacgccggaactcgtcaacaaccccgaggcgttccagaagttccaggcggcacagggcgaactgtccggcgcgctgagccggctgctggtggtgagcgagaactacccgcaactcaaggcgaaccaagcttttcaagacctgcgtgcccaacttga

SEQ ID NO: 8668 - DNA, 441 bp, Pseudomonas aeruginosa
tcacgccgcgcctgcgccagggcgatttcgacggcggcatcgccggcaggcgccgaacagatcatgcgggtgatcgatggcgaagccctgcctgcgggggacccacggcggcaggggcagaccaacgacatcgggcaggcgtggccattcatgttcgtccgggccctgatgctgggcggattgctgcgcaacgccctcggccgccttccaggctccctggtcacggctggcgtgctgggtgccgctgcgtggctgttggtgggcaccttcgcggtggccgcggtggctggactggcgggattcctcgtcacgctgctgggcatcggcatgggtggccacggcggcctgcacgggcgccaccggggaggcggctggccgggcggaggattccgcggcggcggcggcggcttcggtggcggcggcgcgtcaggacggtggtga

SEQ ID NO: 8669 - DNA, 504 bp, Pseudomonas aeruginosa
tgtacggcatctaccagctcaagaagcaagggcgcatccaccagcacctgcccgtgtacctggacagcccgatggccatcgatgccacacggctgtaccacgcccatcgcgacgagcaccggctctcgcccgaggaatgcgagggcatgtgccatgccgcgaagatcgtcaacaaggtcgaggagtccaaggcgctcagcgccggtcgtggaccgatggtcatcatctccgccagtggcatggccactggaggacgcgtggtgcaccacctcaagtcattcgcgcccgaccatcgcaacaccatcctgttcgccggctaccaggcgggcggcacccgtggcgccgcgatcgtgcacggcgcgtccaccgtccgcatccatggccaggacgtgccgatccgcgccgaggtggcctcgctcgacaacctttccgcccacgccgatgccgacgagatcctcgcgtggatgcgcggcttcacgcaaacaccgcgccgaaccttcgtga

SEQ ID NO: 8670 - DNA, 1188 bp, Pseudomonas aeruginosa
gcagggcggcctgcgcagcatcccggtggcaacgcatcggcacaccgtcgcatcgccgtccacgggacgggtctcccgaatcgacaaccggctgctcgcgcgggcggccaagctcgccggagcaccgaccgccgctgccgccggcatcgacgtgcatgcgcgcctgggcgaccaggtcgaagcgggacagccgctcttcacgctgcacgcccaggcgccgggcgagctggcctatgcgctgcagttcgtccgctcgcgcccaccgatcttccagatttcggagaacctatgaaacctctcgtttttcacctgccgggcgacgaagacttcgccgatggactgatccgggcgttgggcgcgcagcgggctgccctgcaactgcaccggttcccggacggcgagtcgctggtgcggctggacgccgacgtcaccggccgcaccgtcgtgatcgtggccagcctggcacagccggacgccaaggcgctgcccttgttgttcgccgcggacgcagcgcgcgacctcggcgccacccgcgtgttgctggctgccccgtacctggcgtacctgcgtcaggaccggcgcttcaacacgggcgaagccatcacgtcccgcacgttcgctgcgctggtgtcgacggtgttcgacggtatcgtcaccgtcgatccccatctgcaccgctaccgctcgctcggcgaggtctaccgggtgccgacccgtgtggtccagtccgcgcccgccatcgcggcctgggtcgcagcccatgtggaccgtcccgtgttgatcggacccgatgcggaaagcgagcaatgggtccaggaagtcgcgcgcttggctggcgcgccgttcacggtgttgcagaagatccgccggggcgacaaggacgtggaggtcagccttcccgacaccgcggccctggcagaccgccagcctgtgctcatcgatgacatcgtgtccagcgcgcgcacgatgatccaggcaatcgccagtgtgcgcagcgtgggattgccgccaccggtgtgcattggggtgcacgccctgttcgccgccgacgcgtaccacgcacttcttgcggcagggccccagcgggtggtgacctgcgacaccgtgccgcatgtctctaacggcatcagcgtggtggcaccgctggcgacagcggtgcaggaactgatggaagccggcgcgccatga

SEQ ID NO: 8671 - DNA, 1458 bp, Pseudomonas aeruginosa
tggtttctagccaccggcgcgtggcggcttttggggtggccgcctttgtctccgcaatcgccgcctacatgttctatgcaacctggttcatctcggtgtggtgcttctttgccgctgtgctcagcttcatcgtgctgtggcagttccgtgagccccgagcgaggctggccgtgccatgacgaatcctccggccagattcaagcccgcactggcctacgcggactgcggccgcacgcagggcccgatgcgccgcgcggcgttcttcacggttcagttgctcgacggattcgagaccatgcgcgatgcggtcgccggccggctgccgacggtattcgcgcaagcggaactcgcgcaaggcaccaagaccgggcacttcatcgccgcgttctgcatcctgtccctgcaccgggtaatcgaggagggctcatgaccgcacaaaaccgtctgtccgttctgttctccgacatcgcaccggcggaccaggccgcgctgcagcaacggcttccgacccactggcacgcgcacttcgtccagaacgaacgcctggtggtatccgatgtcggcgatgaagacaccgaggtgctgtgcgtcttcgtgcgcacgcgcgttgacgaatcggtgctccggttgctgccgcgcgtgcggctcgtggcaacgcgctccgcgggcttcgatcacatcgacctgcaggcttgccgccgacgcggcattgccgtgtgcaacgtgccggactatgggtccgccagcgtcgccgaacatgccttcgcgctgctgctgggcgtggctcgccatctgacacaagcccacgagcgggcgcgccaaggttctttcgcttaccgcggcctcaccggcttcgagctggaaggaaagacgctgggcatcgtcgggctgggccggatcgggcgccacgtggcccgtatcgccctgggcttcggcatggaagttctcgcgtacgacccggccctcgccccatcgctcgacatcacggcagcacccatcgccggcgtccgcgtggtgacgtgggagcagatcctgcaaagcagcgatgttctgagccttcatgttccggccacgcaggccacgcaccaccttctcgatggccaggccttcgcgcgcatgaaaccgggcatggtactgatcaacacggcacggggtgcgctcatcgacgacgccgccctgctgcacgcactggaggcaggtaccgtcgccgcagcaggactggacgtgctggaacaggaaggggatctgtctcccgaagtgcccacgggctgcggcggactgggttgcgataccggctggtcggcatccagcccactgctgacgcatccgcgtgtgctcgtgacaccgcatgtcgggttcaatacgtcggaggcgatcgcgcgcatcctcgacgagaccatctcgaacatcgcagcctggcatgcgggccgcctgcgcaacaggttggatgagccatga

SEQ ID NO: 8672 - DNA, 957 bp, Pseudomonas aeruginosa
ggcgctcgcatggagagtgctcccgtcgtacgcggccatggctgctgctggctttgccgtcgccctgggcttgacctgaaacagcgatcagctatcgaaggccaccgatcgcgccagactctcctgcgcttcaagggcagacagcctgcccttgagcgccgcctggatgacgccgaaggcgtcaccgcccagcgccacccgaagcggtggcttctcgctcgtggccgtgtcgaagatccggtgcgcgatcttctgcggatcgagcgtgtacaactcgtcacccgcgttctcgaacatcgcgcgaatctgtccagcgggcgtgtcctgataggcggggttcgccggcgcgtactgcaaattgcggctgaagctcgtgcgagcgccgcccggttcaatgagtgtgacgaagaccccaaacccctccagttcctggcgaaggcattcgctgaagccttccagaccccatttcgcggcgtggtaaagactgctggtcggcagggagccttggccactggcgctggagatttggatgatccgaccggctcgccgtgtgcgcatggcgggaatgaaggcccgcgtgacgtgcaccggcgccagcaggttgaggctgatctgcccttcgatgtccgcgtcggaaaactcttcggtggcgccgatgatgccgccgccggcgttgttgaccaggacatcgaccgggcggcgggcctcggcgcgctggaccacgggtgcgatgtcccccttcacggtcacgtcgagccgttcgacaacgagctggtcaccgtagcgtgctgccaggtcgtcgagcgtctcgggacgcctgacggtggccgtgaggtcatcccccgaagccaggatgatttcagcaagatggcgaccgatgccgctggatgcgccggtgaggaaccaatgtctggacataaatgcactcctgtggtttacttaccaactagtttgtaa

SEQ ID NO: 8673 - DNA, 609 bp, Pseudomonas aeruginosa
cggcccatggccaagagacgtcccgccgagacccagcaaatgctgctggacgctgcgctgggggaatttgccgacaacgggctggcgggggcacgaattgaccggatcgcggcggcagcaggcatcagcaagccgatgctttatgtccatttcggggacaaggaggctctcttcgacgccgtgctcagccgggaaatcctcgccgcggcgcaggacgagcgcttcgatgcggacgatcttcccggctatgcggggcgcacctacgatttgctcaccgagcggccgcacctatggcggctcatgacctggttccacctggagcgaggccaagaagtgctcctgctccccgccggtcacagcgtactggaagccaaacatgcggccatcaccgctgcccaggcggaaggacgcatcacagcggatttcacgcctgatgagatcgtgcgactggtagcgacgatcgtgcaaacgtggtgcatggcaccggcggcgagggattcgcaggagcacgaggcgcgcagacgggcgattcagttggcgattgcgcggatgctttcgcctggcaaatcccctctccagcgcgggaaaatggttgacgcctcgcgctga

SEQ ID NO: 8674 - DNA, 1431 bp, Pseudomonas aeruginosa
ttccatggcctgcccaatcgcgtctgcaccagttcgctcaagctgataccaaggattttcgacccgatggggatcctgcgcactccactgctcaagccatcgttgcacccatggcagcagcgccagggccggggtcacctgctcggaccagaccttgcgactgacgcgcatggggtgcagcgcgcgaagttcacgagccgagtcgggggtgacggcgaagcggacccacggcgacacccactgcgaatagaagcgctcggtgatctccgagagtgcttcgaccttgtcgaaccccgccgggttggcgtcgtaaggcaggtcttccagccgccgcggctggaactgcgcagcggcggccgactccgaagaggcgctgtcctccagaaccatctcgtagagtccaggcttgagtgcctggatcgattcggcatgatgcaagatggcgcggtgctcgcgtcgcgccacccccgcggagacgaagatgccaaggtggccaacatgttggtgcagcaggtacaccacgcgctggcccgccgccaccaggtctgcggtcgtcggatataccgctttgagccagccgagcgcctggtggggcggtgtgatgttgtcgccgttggagcaaaagaccaccagcggtgcgccaatgcggctgagatccgcgcggcagtggccatcgaccacgacctcgccgctctccaggtgattacctacgaaaagatcgcctgcgatcgacaacatttcctcgcgggcaagctggtagaagccattccaccaacgctcgaactccaggaagcgatcgcgctcagtctccggctgcgcgaagagcgtgtcgtatttcttgaacacgccctcgggccgcaacgcctcgaagttctggaccagccaggcaccgtcgaatcgcccggcgccgaggtccgacgcccagtgcgccggccagatgccgcccgtgaacccaccgagcagccgcatggggttgatgcctctctcgcctgcccagtacgacagcggcgagccattgagcactgccaaggcggcacggtgctcgcagtgcgacagcgccagcgtgatcgcccaaccgccttggcagttgccgtagacgatcggggccttgcctcggtggcgcttggccaccatgtcgatgaatgtggccagggtctggacgactgcgcccatggtctggccctcgacgggctccggatcgaacactacgaagtacacgggatggccttcgagcagtgccatgccaacttcagaatcgcgtttgaagccgccaatgccagggccgtggccggcgcgtggatcgaccaccagcaccggcgcggcgcctttgcgcacatgcttctccaaggcgtcggtgccacagcgagtgacacgcaggagccggtagttgctcgccggttgcaagtcgtggccgtcagccacctgctctga

SEQ ID NO: 8675 - DNA, 306 bp, Pseudomonas aeruginosa
cccgcggcagctaaggccgcgatcagctcaggcgtcttctgggccgtctggtcgccggtgacactcgctgcgccgcgagcgagatcgacatgcacgtcttgcacaccagctacgcgcttgagcgccttgctgaccgagttcgcgcaggaggcgcaggtcatgccggcaaccttgagttcgatggtttccatgatgatgctccggtggtttcagtggtggtgcccggactggtcgacggatttcgggcggctccggtcgtctgattggcgcgcaggcgaacccccttcatcgccccgaggcggctga

SEQ ID NO: 8676 - DNA, 720 bp, Pseudomonas aeruginosa
ccgctggatcggctatccgcgagcagtcgaggcgctgaatcggctggaagccctgtatgcgtggccgaacaaacaacgcatgcccaacctgctgttggtcggtccaaccaacaacggcaagtcgatgatcgtcgagaaattccgccgcacccacccggccagctccgacgccgaccaggagcacattccggtactggtcgtgcagatgccatccgaaccgtcggtaatccgcttctacgtcgcgctacttgccgcgatgggcgcgccattgcgcccgcgcccacggctgccggaaatggagcaattggcgctggcactgctacgcaaggtcggcgtgcgcatgctggtgatcgacgaattgcacaacgtcctggccggcaacagcgtcaaccgccgggaattcctcaacctgctgcgtttcctcggcaacgagctgcgcatcccgctggtcggggttggcacacgcgatgcctacttggcgatccgctcggacgaccagttggaaaaccgcttcgagccgatgatgctgccggtgtgggaggccaacgacgattgctgctcactgctggccagcttcgcggcttcgctcccgctgcggcgaccctcgtcgattgccacgctggatatggcccgctacctgctcacgcgcagcgagggcaccatcggcgagctggcgcacctgttgatggcggcggccgtcgctgccgtggagagcggtga

SEQ ID NO: 8677 - DNA, 1302 bp, Pseudomonas aeruginosa
ggaagcgatcaaccatcgcacgctcagcatggccgattacaccggtcccagcgagcggcggcggcaattcgagcgggaactgatgtgaagccagcgccacactggccactgcatccggctcccagggaaggcgaagccttgtcttcgtggctcaaccgcgtggccctttgctatcacatggaggtgtccgagctgctggagcacgatcttggtcacggccaggttgatgacctggacaccgcgccaccactggcgctgctggcgatgctctcccagcggagcggcatcgagccggaccggctgcgttgcatgagtttcgccggctgggtgccttggctactggacagccttgatgatcagattccagacgcattggaaacctatgcgttccagctctcggtgctgctgccgaaactccgccgtaggacgcgatccatcacgagctggcgtgcctggctgcccagccagccgatacatcgcgcctgcccgctctgtctgaacgacccggcaaaccaagccgtactgcttgcatggaagctgcccctgatgctgagctgcccgctgcatggctgctggctggaatcctattggggcgtgcctgggcggtttctcggctgggagaacgccgacactgcgccgcgcaccgccagcgacgcgattgcggtgatggaccggcgcacctggcaggcactgacgaccggccatgtggagctgccgcgccgacgcatccacgctggattgtggtttcggctactacgcacgctgctcgatgagctgaacaccccgctttcgacgtgcggaacctgcgcggggtatctccgccaagtctgggaaggctgcgggcatccgctgcgtgctgggcaaagtctgtggcgaccgtatgaaaccctgaacccggcagtacggttgcagatgctggaggcggcggcaacggcaatcagcttgattgagatgagggatataagcccgccgggcgagcatgcaaagctgttctggtccgaaccccaaaccggtttcaccagtggcctgtcggcgaaaacgccgaagcccgaacccgtcgatcactggcaacgggcagtccaggccatcgatgaggccatcattgaagcgcggcacgaccccgagacggcacgctcgctgttcgcgttggcttcctatggtcggcgcgaccccgcttccctggaacagttgcgcgccaccttcgcaaaggaaggcatccccccggaattcctgtcacattacgtgcctgatggaccctttgcatgtcttagacagaatgacgggttaagtgacaaattttga

SEQ ID NO: 8678 - DNA, 675 bp, Pseudomonas aeruginosa
cgaccagaactttccggtgcacactgtcacataatcgaacgtatatgtgacaggtgcaagatgctgattggctacatgcgggtgtcgaaggcggacggctcccaagcaaccgatttgcagcgcgacgcgctgatcgccgccgatgtcgatccggtgcatctctacgaagatcaggcatctggcaagcgcgaagaccgccccggcttggtggcctgcctgaaggcattgcggccgggagatacgctggtcgtgtggaaactggatcggctcgggcgcgacctgcggcatctaatcaataccgtgcacgacctgaccgggcgcggtatcggcctgaaggtgctgaccgggcacggggcggccatcgacaccacaaccgccgccggcaaactggtcttcggcatttttgctgcgctggccgagttcgagcgcgaattgatcgccgagcgcacgattgccggtctggcatcggcgcgggcacgcggccgaaaaggcggccggccgttcaagatgaccgccgccaagctgcggctggcgatggcggcgatggggcagcctgaaaccaaggtcggcgatctctgtcaggaactcggcatcacgcggcagacgctctacagacacatttccccaaaaggcgaattgcgcccagatgggacgaaactactcaaccgtatctga

SEQ ID NO: 8679 - DNA, 456 bp, Pseudomonas aeruginosa
ccgcgtcacggacagagcaaacaagccggtcagcgtgagggctgcaataccccaatgctccccgatgaatgcgccggctgtcgttccggccagcacaacggcgagaatcggcaaatgacagggacaggtgagcacggccagcgcgccccacaggtagccggtgaacggcttgcgtgtcttggtcggcaggcgttccgggccgttcatggcagactctccgcgtgctgtgccggctcggtcggcagggtggccaactgcgcttccagatcggccaacgcttcgcgccggtgttcgacgaactggcgcagcacggcaagctgcgtggccgcttcgccgccgtccgctgcatccagcgcccggcacagcctcgccagcgcatcgaggccgatgcccgcttcgaaggcggatcgcacgaagcacagacgctgcaaggccgcctcgtcgaacaggccgtag

SEQ ID NO: 8680 - DNA, 456 bp, Pseudomonas aeruginosa
tcatgtacggagtcaagtggtatggaaaagaatttggaaaacctgaccattggcgtttttgccaaggcggccggggtcaatgtagagaccatccggttctaccagcgcaagggcttgttgccggaaccggacaagccttacggcagcattcgccgctatggcgcggcggatgtaacgcgggtgcgctttgtaaagtcggcccagcggctgggcttcagcctggatgagattgccgagctgttgcggctcgacgatggcacccactgcgaggaagccagcagcttggctgagcacaagctccaagacgtgcgcgaaaagatggccgacctggcgcgcatggaggccgtcctgtctaatcttgtgtgcgcctgccatgcccgaaaggggaatgtttcgtgcccgctgattgcgtcgctacagggcgaaacaagcttggcaaggtcggagacgccttag

SEQ ID NO: 8681 - DNA, 246 bp, Pseudomonas aeruginosa
cgctgcatcttccaggggccagttcacggtgactacgctggcgctgcgccgaacatcaacgcgaatcgcacgcgacacgggcggcgagctggtctcggttgctgggagctgttcaactggtggaggcagattcagcgcaacgaactcattccggggcgctggcaacagggagtctgcttgctcgcgcatccagcgatgaacgatgttggcgttgattccgtgtgcaagcgctacgccggccactga

SEQ ID NO: 8682 - DNA, 1938 bp, Pseudomonas aeruginosa
aacgacttccgagtcatctatggaggatttcaggccatgccgcctcgttcacccttttttatcgtgcccacacagggcctttctcgtcggcgtttcgtccaagggttagccgccggcggcgttctcgctgggctgtccacgccggcgttcaaggcatttgcccagcaaggctccgcgacgcgcggtgccgcccctgtgctgaagggcaccgagttcgacttggtgatcgccgaatcgcccgtgaacttcacgggcaagccaggcgtggctacgaccatcaacggctcgctgccggcaccgacattgcgttggcgcgagggtgacaccgtcacaatccgtgtaaccaacaagctgcgtgaagccacatccattcactggcacgggatcatcctgccgtatcagatggatggcgtgccgggcatcagcttcaatggcatcgctcccggcgagaccttcacgtaccgcttcaaggttcagcagagcggctcctactggtaccactcgcactccggcttccaggaactcacgggcatgtacggggcgatcatcatcgaccccgctggcgccgagaccatccacgccgaccgtgaccacgtgctgctgttctcggattggaccgacgaagacccgatgcgggtgttcaccaagctcaagtcccaaagcgactattacaactacaaccaacctaccgtcttcgacttcttccgggacgcctcgcgcgaaggcacggccgctgcgatcgacaagcgcaagatgtggaacgagatgcggatgaatccgacggatctcgcagatctgtctgccaccacgctgacctatctggccaacggcgtcacccccgccggcaattggacggcgctgttccgaccgggtgagcgcgtgcggctgcgcatggtcaacggtgcgggcaacaccttctacgacgtacgcattccaggactgaaactcacggtggtgcacgtcgatggtgttgacgtggagccggtgaccgtcgatgagttccgattcggtcctggcgaaaccgtcgacgtgatcgtccagccacgggatgacgcttacacgatcttcgcccaggcgatggaccggacaggctacgcgcgtgccacgctggccgtgcgtgaaggtcttcaagctcccgtgcctgccctcgatccggtcgaatggctgaccatgaacgacatgatgggcggcatgatggggggcatggaccatggcgggtccggccaggccatggagatgaccgggatgacgggcatgacgggcatgaccgggatgaccgggatgggctcgggttcgatgtccgggatggatcatggggcgatggcaggcatgaatcacggcgccatgaaccacggtggcatggcgatggatcacagccaacacgccgcggcggcggggggactggccgtgcccagcactactgctcgccacgctcgcaccgagtatggtgccagcacggacatgcgcgttgacatggcgcgcaccaacctcgatgaccccggcatcggactgcgcaacaacggtcggcgcgtgttgaccctcgcggatctgcataccccgtcggggccgctggacaagagaggccccggccgggaggtcgaactgcacctcacgggcaacatggaacgctacgcatggtccctggacgggctggagttcggaaagtccacgccggtgcacttcaaacacggcgagcggctgcgggtcattctgcacaacgacaccatgatgacccatcccatgcacctgcacggcatgtggagcgagctggaaagccccgacggtcgcttccttgcgcgccgccacaccctgccggtgcagccggcacaacgcatcagcttcctggtgacagccgacgcgctcggccgctgggcgtggcactgccacctgatgttccacatggatgccggcatgttccgcgaagtcgtggtgtcttga

SEQ ID NO: 8683 - DNA, 507 bp, Pseudomonas aeruginosa
tcatctgatgagaggcgatccatgaacatgcactacgacagaagccagggcaaagtgccgagacgccaggcattgatcgctggcttgttggtgatggcactcgcaggaccgagcctggcgcagagccgaccgattgccaaggtctggaaggacccgagctgcggatgctgcaaggactgggtctcacacctgcaaggcgcaggcttcgatgtgcaggttctcgacaccgggaacaccgcagcgcgcacgcggatgggcatcccgcagaagtacggttcttgccacacggcgcagatcggcggctatgccatcgagggtcatgtgcctgcctcggacattcaacgcttgctgcgcgaagccccgcaggccatcggcctcgcggcgcccggcatgccggtcggttcgcccggcatggatggtccggcctatggtggacgcaaggacgcctacgacgtgctgctgattgggaaaaacggtagcagcacggtctatcagtcgcatcgctga

SEQ ID NO: 8684 - DNA, 306 bp, Pseudomonas aeruginosa
ccatccatcaacccttctccgtggagatatgccatgcagcatcagcacacacagacccccagcgatcgcccccggttctggcgatcgcgctacggcgtggcgttcctcatcatcgccgctgtcgccgcgtatttcctgctcaaggagcatacggcacatgttgccggctatctccccttcctgctgctggcggcttgtccgctgatgcacctgttcatgcaccgtggtcacggccacggcggacacgatcatgccgcgcgtcagggtaaggaaggtgccgcagcctccaaggagcagaagcaatga

SEQ ID NO: 8685 - DNA, 936 bp, Pseudomonas aeruginosa
agtaagcccatggccggggattggttgaccatcgtcctgcgcctggcgctgtatctggacctggcggcggcgtttggcgtcgccatgttcggtctctatgctttgggcaacgacgagcgatcctcgacgatctcgcgccgctatcgcgtcctcattggcgcatccgctgccatcggcattgccctgtcgatgtggggcatgacggtcatggccaaggccatgtccggtgcccagagctacgcggagctgtcaacgcacgtcttcgacatgctcattacgggcacgcacatgggcatcgcctggtgcattcgcatcctcgcgctgttggtgtgtgtgctcgtcgcaatgttgaaattgaacgctaccttgcgatttgcagtgatggcgctctccaccggcgtggcgctggcgacccttgcgtgggcaggccacggcgcgatggacgacggcgttcgcggctacatccatcttgcgtcggatatcacgcacctctgggcagcgggcgcttgggtgggcgcattggtggcgttcttgatgctggcatcccacaagcaggatgtcgcgcaagacccggtagcggtcctcagtcggacgtcgaatggctttgctcgcataggtacagcgatcgtggctgcactcgtcgtgagtggaattctcaattacctgttgatcgccggaccatcgtttgatccgctcatctcgacgctgtatggccggctgctgatggtaaagctcttgcttttcgcaggcatgctggcgttggctgctgccaatcggtatcggttgagcccgagcctggaggctgctttgaaggcaggcaatcgcgcacaggcagtcatcaagcttagacagagtctgttcacggaggcgaccttggccgttttggttctggcgagcgttgcatggcttggcatcttgtctcccactggaacctag

SEQ ID NO: 8686 - DNA, 1329 bp, Pseudomonas aeruginosa
ataccaattccgaggacaaccatgtttactcccttttttggcgcccccgaggggcgcccgtcggcgtacggccgaggcacaacgccggcctcgatgcgagtgcatcgtctgaaagctatcagcatcgcgttggcgggcagtgcgcttgtctcgcctgtagcctacgccctcgattttgctgaggcacgccttatcgcggagcagcagagcccacgcataagcgcgcagcagttgcaggttaacgtcgccgaatccgtgcagaaggcagcaggctcgctgcccgaccccaagctctcgctcggcatcgaaaactaccccatcagcggcatggatcgctggagcatgacgcgcgaatccatgacgatgcagcgcttggcgctcatgcaggaagtgcccaacagggccaagcgcgacgcccaggtcgccagcgcgcaggcgcgtgtggatcgagaacgcgcggcgctggttttgcagcgattgcagatccgccaggaactcagcctggcgtggatcgccgcgcaggcggtggagcaacgggagatactgctgacggaactgctcgcggagaaccagcgcctgcaagacagtctccccgctcgcgtcgccggcggcaccgcccaggctggcgatctgttggtcgcgcaacaggaggcgctgacactcacggaccgccgtgacgatctacagcgggaccgggccaaggccagggccgcgttgcggcgctgggtgggctccagggccgacgaagcactgcaaggcgatccaggcccgctcactcgccccgtcgcgcaactgcgcacagaactggcgaatcacgcggagcttgaactctatccggcgatgcaaagcatggcccgggccgagtcccgcgaagcccaatcagagacccgcggcgattgggcctgggagatagcctatagccggcgtgatcgccgatggggcgacatggtgtcatttcaggtgacattcgatctgccttggcagaaggatcgacgccaagtgcccatgatcgaggcaaaacggcacgagttggaacgtctggacgccgaacgcgaagacgtggcgcggcggcatttgcaggagctggacgacagcgccgccgaactccaagcgttgaacagccagatcgaccgcctgcagaccgccggcttgcaactggtacggaaccgagcggcacttgcattgagcaactaccgatccgccaagggggacctgagcgctgtgctcagtgcacgcgcccaggtgctggagacgcgcatgcgtctgatcgaccttggagcgcagcgcgacagcctcgtcgcccgactgaacagcctgatcgcggactga

SEQ ID NO: 8687 - DNA, 1533 bp, Pseudomonas aeruginosa
gtggagaccctcgccatgaatacctcttcgagaaacatccttaccggcttgacgctggttgctgccggtattgccgttggatggggcgtcgcccaatggcgcgccggccacctcagcggctcccccgctgccaacgtcaccgttgcaagcgctccgaccgagcgcaaggtgctgtattggtacgacccgatggtgccgacccagaagttcgacaagcccggcaagtcgccctacatggacatgccgttgatgccgaagtacgcggatgaagacacgcaagacagcacgggcctcagcgtgtcggcgcaagcggtgcaagccctagggctgcgtacagccgaagtcctgcatggcaagatcggcgcagatgtgaacgtcgtgggcaccgtgctgctcaacgaccgcgacgtcagcatcgtgcaggcgcggaccgctggcttcgtcgagcgtgtctacgcacgggctgcgggcgacgtgatcgcagcaggggcaccgctggctgacctattgctgccgaagtggatcgccgcacagcgcgagtttctctcggttcgcgcgatgggcgacgcaccgttgaccgcagctgcccgccaacggctgctgctgctcggcatgccgcaagccctgatcgcccaggtggagcgcacaggcgagcccaaggggctgtacacggtcacaacacctcaaggcggcttggtggccgaactgatggtgcgccagggcatgacggtttccgccggggaaagcctggtcagggtgaatggcttggcctcggtgtggatcgaagcggccgtccccgaagcacaaagcggaccattgcaggtcggccaaacggcgcaggtccggctggcggcgtttcccggtgaagtgctccaggcgcgcatcgtgagcatcctgcccgaagccaaccgcgacacccgtacggtgcgagtgcggcttgaaatggccaatcccggccagcgcctgaaggccggcatgtccggccagatcgcgctcaaaggcaacgaacagcccgcgctgcttgttcccagcgaagcggtcatccgcaccggcaagcgcgcactggcctatgtggtcgatggacccggcaagttccatcccgtggaggtccaggtgggcgcggaggtaggcgatcaactggtggtcaacggcgggctcgcggcgggacagcaggtggtggcctcggcgcagttcctgatcgattcggaagccagcctgcggggcgtgctgcctgcaggtgccgcggcgtccgcgcctgcatcgccgcacaacgggcacggcacctcgtcgccaacggccgcggccaccaacgctttcgtggtgcgcggcgtgatcgaggagatgtcgcccaccgagctgacgctggcgcacgaggccgtgccagccctccaatggccggccatgaccatgggcttcaagctgagcagcccgcagctcgccgcgggtctttcggttcggcagcaggtgcgattcaccttctccaagcaaggtgagggctacgtgatcaccgccatcgaaaaggtgcagccatga

SEQ ID NO: 8688 - DNA, 324 bp, Pseudomonas aeruginosa
ttatcacattgcacggcaaagattacagttatctgcatgtggacgctaggagaacccatgcgcagccttttgcgaaagaattcgcccgcaggatcgtttagctacgccagacacccgatcttcgagcaggtgatggaggcgcagcatttgaccgtgggtctgatccttcccttggagacccatgcgggcccggcaccgaccatggccgatcatttggcgatggtgtcattttcagaagacgattgcacacaatgtcaaaagtcggctgcacggtcttttctgatgctggggatgtttcagaaagcggaaaataaagcacgctaa

SEQ ID NO: 8689 - DNA, 297 bp, Pseudomonas aeruginosa; identical to SEQ ID NO: 8590

SEQ ID NO: 8690 - DNA, 495 bp, Pseudomonas aeruginosa
gggctctgttctgtaaaactccagaggacatcatgctttcttttccatagttactctgaaaagcaagcaaaaccggcacaaaccctgctgctgggagtaagagggtcttcggagaggctgagtgagactgtgtgccattgtatgcacagtggcgcatgcacccacgcccgcaccaacacccacaccacacccatgaccacacccacacttacatctacctccacacccgcgcttacacccacccacacttacacccacgcttacatctacctccacgcccacacttacacccacgcttacatctacctccacacccacggttacacccaccgttacatctacctccacacccgcactgacacccacgcttacatgtacgtccacacccacactcacacccacccacacttacacccacgcttacatctacgtccacacccacactcacacccacccacacttacacccacgcttacatctacctccacgcccact

SEQ ID NO: 8691 - DNA, 1149 bp, Pseudomonas aeruginosa
gcgcgcatgcgcgaccacctgcaaagcctcggcgacgccccggacctgcgctggcgcttcgccgaactgcaaccgccgctggacagcgccaacatgacccagggcaactggctggcgatgcgcgacgccatcgtcgccgcgctcgacgccggccacgacggcgtgctgctcctgcacggcaccgacaccctggcctacagcgccgcggcgctgtccttcctgctcctcgacctgccgatcccggtgctgctgaccggctccatgctgccggccggcgcgccgggcagcgatgcctgggacaacctggtcggcgccctgcgcgtcctccaggagggccacgcgcgcggcgtacaggtctatttcaacgatgccctgctgcacggcgcgcgggtcagcaagctgcgcagcgacgcgttcgacgccttcgccgaactgccgcgaccgcgccacgccgagcatgcgccggcgcccgcggcgctcggctaccgccagccgcgccgggaagtgaacctcgccgtgctgccgctctatccagggctgcgcgccgcgcacctgcgcgggctgctcgacagcggcgtggaagcgctgctgctggaatgctatggcagcggcaccggccccgtccgacgacgaggagctgctggcgctgctgcgcgaagcccacgcccgcggcgtgctgctcgccgcggtcagccagtgcgcctacggccaggtcgagttcggcgtttacgccgccggcagccgcctgcgcgacgccggcctgctctcggctggcggaatgacccgcgaggcggccctgggcaagcttttcggcctgctcggcgccggcctcggacgcgacgaagcgcaacgctggttcgccctcgacctgtgcggcgagaacgccgactgaccgccctgcggccgcccgccggcggccgcttccttcagccctccccgcgatacgcgacaacgccggcggcccgcccgtgcccggcgcccatcgtcaagcttcagcgaacagtgtttccggccttccccggtttatcccccggcggcgagtccacaggatgtcgccttccgctgccggccccgccggcatccgcccacaaggaggaaacacctgcatgtacgccatcgccgaagacacccttcccgcacgcgtattga

SEQ ID NO: 8692 - DNA, 585 bp, Pseudomonas aeruginosa
agcgcagcgaggtgctggaactcggcggcgagctggtgcagatcaacggccagcccagtcactaccgcctgccggccagggccgcccggcgcgccgccgtggcctgagcccgaggagccagacgatgaacgcctatctcagcgatcaaccggtacgtctctcgccgctgcgcgacgaacagggcaaccagccgcgcttcggcctgctgctggagcccggccgccccggcatgcacgtcggcgagctgccggcgcagtggctcaagggcctggctcgcagccaccacctgctgctcctgcgcggcttcgccgccttcgccgacgccgagagcctgacccgctactgccacgacttcggcgaagtcatgctgtggccgttcggcgcggtgctcgagctggtggaacaggaaggcgccgaggaccacatcttcgccaacaactacgtgccgctgcactgggacggcatgtacctggagacggtcccggaattccagctgttccactgtgtcgacgcgcccggcgacagcgacggcggccgcaccaccttcagctcgaccccggcggcgctgcaactggccgacagtag

SEQ ID NO: 8693 - DNA, 1812 bp, Pseudomonas aeruginosa
cgagctggaactctggcgtcgcgccagcggccggtaccagcgcagcgcggcgcactacagcagccgctcggcggcaccgatagtcgagcgccacccgcgccgagaattccccatcctgcgtttctgcgaaccgccggtcgagggcgacgccagcttcatcaacccctccgagttccactacgacggcatcgccccggaacagcgcggcgaactgctcgccagcctgcgccgctgcctgtaccacccacaggcgcactacgcccaccgctggcgcagcgacgacctggtgatcgccgacaacctgaccctgctgcacggtcgcgaggccttcgtccaccgcgcgccgcgccacctgcggcgggtgcatatccacgccgagccggcgctgcgcaacccgcacctgcagcgcgactgaccgccccgccggccgtgcgcgccacggccggcgtcccgacaaggaaccagcatgagccattccgtccccaacgcgctgatgaccggcgccgactatctcgacagcctgcgcgacggtcgccaggtctacctcaacggcgaacgggtcgccgacgtcacccggcacagggcgttccgcaacgcctgccgcagcatcgccgggctctacgacggcctccacggcgagcagcgcgacgtcctcacccgggtcgatgcccagggccgccgcagccaccgcttcttcacccccgcgcagaacgccgaggacctgctcggcgcgcgcgaggcgatcggctgctggtcgcgcatgacctacggcttcatggggcgtaccccggactacaaggcggcgttcatgtccgggctggaggccggcgccggcttctacggcgactaccggcagaacgcctgcgcctggcaccgcgccttcgccgaccgcgggctgttcctcaaccacgcgatcatcaatccgccgctggaccgcagcaaggcgatccacgagatgcgcgacgtgttcgtccacgtcgaacgcgagaccgaccagggtatcgtcgtcagcggggcgaagatgctcgccaccggcagcgccatcaccaacgccaccttcgtcgccccggtcgcctcggcgcagatggaggccggcaaggccgaggacttcgccctggtgttcttcgcccgcatggacaaccccggcctgcgcctgatgtgccggccatcctacgaggagcgcgcgagcagccccttcgactacccgctgtccagtcgtttcgacgagaacgacagcgtgctgctgttcgacaaggcgctgattccctgggaggacgtcctggtctaccgcgacctgcgccgcgccaccggcttctatgccgagtcgggcttcgccaacctgtacaacttccagtccggcatccgcctcggggtgaagctggaactgatgatcggcctgctttccctcggcgtgcgcgccaatggcacccagggcttccgcgggatacaggcggccctcggcgagctgatcgccctgcagcacctgctgcaggcgctgaccaccgccatggcccgcgacccggagcgcaacgccgccgggtcggcggtgccgcgcctggagtacgccaatgccctgcgcatccaggtgccgcagatctggaagcgtgtccgcgagttgctggaaggcgccctcggcggcgccccgctggtcaccgtctcgggcgccgccgacctgcgcgacggcgaggcacggcggctggtggacagctactaccgcggtgccgagctggagccggagcagcgcctgaagctgttcaagctgatctgggacgccaccggcagcgagttcggcgcgcgccacgcggtctatga

SEQ ID NO: 8694 - DNA, 882 bp, Pseudomonas aeruginosa
cgtcggcggcggataacgcctgtggcgttattcgccctcccgcccaggcacggatgcccggcgtcattcgccctgcgccaggcggaacggctcgcgaccgagatgctcgcgcagcgactcgatgaacgccctgacccgcaccggcatgtagcgcgccgaggggtacagggcgtagatgccgccctgcggcaggtgccagccgggcagcagccggaccagccgcccacgggcgatctcgcgggccaccaggaagctcggcagcacgctgacgccggcaccgtcgagcaccaagcggtacaccgccagggtgttgttcgccagcaggcgccctcgggtctgtaccgtggcacgctcgcgctggcgttcgaaggtccaggtccagggcgtgctcaggcgggtatggccgatccattcgcagcgcgccaggtcgtgcggctggagcactggcgacaagccggcgaggtatcccggcgtcgccacggcaacctgctggaagtcgcacagcttgctggcatgcaggccggaatcgcgcggccagccgatacgcaccgcgaggtcgatgcgctggccgaccagatcgctgaactggtcgtcggccagcatttccacctggaccttgggaaactgccggatgaacgccgcggaaacgctgctgatgtgccacttgacgaagtcctgcggcgcggtgatgcgcaaccggccactgggctcgccctgcaggtcgcgcacatcggagagcgcgccgtccagctcgccgagcatgcgctgggccacgccgaacagcagttcgccgcgatcggtaagggtcatgcgacgggtggtacgggtcagcaactggatcccgaggtcggcctccaggcgtcgcaactgctcgctgagtag

SEQ ID NO: 8695 - DNA, 1104 bp, Pseudomonas aeruginosa
aaccggtttcaactcctggcatccgctggcgaagaccagccggacacaccaataagaacagcaccaagaggtaccaggtccgtgaatggttcagtactgcccagccgtggccgcgtcaccatcaaccaggtggccgaggccgccggcgtctccaaggccagcgtgtcgcgctatatcggcggcgaccgccagttgctcgccgatgccaccgcccggcgcatcgagcgcgccatcgaccagctcgactaccgccccaaccagatggcccgaggcctcaagcgcgggcgcacacggctgatcggaatgctggtggcggacatcctcaacccctactccgtggccgtcatgcatggcgtggaaaccgcctgccgcgaacacggctacagcctggtggtgtgcaataccgaccgcgacgacgagcaggagcgtcatcacctggccgccctgcagtcctacaacgtcgaaggactgatcgtgaacaccctcggccaccatcccggcgaattgcgcgccctgcaccgcgaactgccgatggtgctggtggaccgccagttggccgagctggataccgacctggtcggcctggacaacgccgacgccgtcgaacaggccctcgaccacctgcagcaccgcggcttccgcgacatcctgctggtcaccgaaccgctcgacggcaccagctcgcggatcgagcgggtccaggccttcaatgcctccatcggccggcgaccggcgctcaagggccaggtcctgcaaaccgacgacttcttccgcgacggcctgcgcgccttcctttcggccagcggccccgggccgaaggcgctgttcacctgcaacggcgtcgccaccctctgcgccacccgccaactgcgcgacctcggctgccggctgttcgatgaggtcggcctgctggccctggacgaactcgactggtacccactggtgggcagcggcatcaccgccctcgcccaacccaccgacgaaatcggccgcaccgccttcgagcgccttctggcgcgactcgaaggcgaccgcgagccggcgcgccgggtgaccttcccggcgcaactgatcgttcgcggctcgacccatccacgcggctag

SEQ ID NO: 8696 - DNA, 2313 bp, Pseudomonas aeruginosa
cttcgagatcctctgcttcggcgagaccatggccatgttcgtcgccgaacagcccggcgaactggaccgggtcgagcagttcggcaagcgcatcgccggcgccgacagcaacgtcgccatcggcctcgcccgcctcggcttcacggtggcctggctgagccgggtcggcgacgactcgctcggccgcttcgtactcgacagcctgacccgcgagggcctcgactgccgcttcgtcgaggtcgacgcgcaagcgcccaccgggttccagatgaagtcccgcgaggtcgatggtgccgacccgcgggtcgagtacttccgccgcggctcggcggccagccggctgggcctcgcccatatccgcgaagaaatgctcggcgcccgccacctgcacgccaccggcattccgccggcactctcggcgagtgcctgcgaactgtcccacgaactgatgcggcgcatgcgcggcaagggcgccagcctgtccttcgaccccaacctgcggccctcgctgtggcccagcgagcgccgcatgatcgccgagatcaacgccctcgccgcgcatgcccactgggtcctgccgggcctggaggaaggccgcctgctcagcggctggcaggaacccgcggatatcgccgcgttctacctggacatgggcgtcgacgcggtggcgatcaagctcggcccgagcggcgcctactatcgcgatgcccacggcgaagggctggtccccggcgtgccggtggcgaccgtggtggacaccgtgggcgccggcgacggcttcgcggtcggggtggtcagcgcgctgctggaaggcctgccgctgcccgacgcggtggcgcgcggcaactggatcggcagccgcgcggtacaggtccgcggcgacatggaggggctgccgaaacgcagccaactgctcgaccgcgagcgccgcaagagcgcctgaacccgccgcccacgcggcacctgttgcgacaagaacaagacaagctcaggagatacccgaccatgaccatgcctcgcctcgccagcagccgctggtggtacatcatgccgatcgttttcgtcacctacagcctggcctacctggaccgcgccaactacggcttcgccgccgcctccgggatggccgacgacctgcggatcacccccgggctgtcctcgctgctgggcgcgctgttcttcctcggttacttcttcttccaggtgccgggggcgatctacgcggaaaagcgcagcgtcaagaagctgatcttcgtcagcctgatcctctggggcgggctggccaccctgaccgggatggtcgccaacgtctacctgctgatcggcatccgcttcctcctcggcgtggtcgaggcggcggtgatgccggcgatgctggtctacctctgccactggttcacccgcgccgagcgctcgcgggcgaataccttcctgatcctcggcaacccggtgaccatcctctggatgtcggtggtctccggctacctggtggagcatttcagctggcgctggatgttcatcatcgaaggcctgccggcggtgatctgggccttcatctggtggcgcctggtggatgaccgcccgcgccaggccgcctggctgagcggctcggaaaaacgcgccctggaagacgccctggccgccgagcagcagggcatcaagccggtgaagaactaccgcgaggcgttccgttcgccaaaggtcatcgtcctctcgctgcagtatttctgctggagcatcggcgtctacggcttcgtcctctggttgccgtcgatcctcaagcacggcgccaacatcgacatcatcgaagccggctggctgtcggcgctgccctacctggcggcggtgatcgccatgctcggggtgtcctgggcctcggaccggttgcagaaacgcaagcgtttcgtctggccgccgctgctcatcgcgtccatcgccttctacggttcctacgccctcggcagcgagcacttctggctgtcctacgccctgctggtgctggccggggcctgcatgtacgcgccctacggaccgttcttcgccatcgtcccggaagtcctcccggccaacgtcgccggcggcgccatggcgctgatcaacagcatgggcgcgctgggctcgttctccggctcctggctggtcggctacctgaacggcatcaccggcgggcccggggcttcctatctgttcatgagcggagcgctgctgctgtcggtgctgctcaccgtgttcctcaacccgcacgccgacaagcgcgagcccgatgccgctcgcgcgcacgcctcgcggcgggcggcgccggcccacccctga

SEQ ID NO: 8697 - DNA, 1005 bp, Pseudomonas aeruginosa
ccgactccggagcatccgatgaagaaagtggttctctacaaacgtctctccgcgcccctgatggaacgcctgcgcgaacgggtcgaggtgctcctggtcgaggagcccggccgcgacggcctggcccgcctgcgcgacgccctgcccgaggcccacggcctgctcggcgccagcctgcgcctggacgccggactgctcgacctggcaccgcgactggaagccatcgccagcgtctcggtgggcgtcgacaactatgacatcgactacctcgaccgccgcggcatcctcctcagcaatacccccgacgtgctcaccgagaccaccgccgacaccggcttcgcgctgatcctggcgacagcccggcgggtagtggaactggccggttgggtgcgcgccggggaatggaagaagagcgtcggcgccgcccagttcggtaccgacgtgcatggcaagaccctcggtatcgtcggcatgggccgcatcggcgaggccctggcccggcgcgggcaccacggcttcggcatgcgcgtgctgtaccacagccatagcccgaagccccacgtcgaagaacgctacgcagcgagctaccgccccctcgacgcgctgctcgaggaatccgacttcgtctgcctgaccctgccgctgaccgccgccaccgaaggcctgatcggtgccgcgcagttcgcccggatgcgcccgcaggcgatcttcatcaacatctcccgtggccgggtggtcgacgaggcggccctgatcgaggccctggcccagcggcggatccgcgccgccggcctcgacgtgttcgagcgcgagccgctgtctcccgactcgccgctgctgcgcctgccgaacgtggtggccaccccgcacatcggctcggccaccgaggaaacccgcgaagccatggcccgctgcgcggtggacaacctgctggccgccctcgccggcgagcggccgctgaacctggtcaatccttcggcctgggcgcgacggcgaggcgcctga

SEQ ID NO: 8698 - DNA, 1269 bp, Pseudomonas aeruginosa
ccgaggccggggctcaacgtggtggcgctggagcgcggcgagaaccgcgatacctatcccgacggcgcctaccccaacaccctcgacgagctgacctacaacacccgcggcaagctgttccagaatctctccaagagcaccgtgagcatccgccacgggatcaacgacaccgcgctgccctaccgccagctctccgccttccttcccggcgacggcgtcggtggcgccggcctgcactggtccggcgtgcatttccggatcatgcccgaggaactgcgcctgcgcagccattacgaggaacgctacggcaagaaattcatccccgaaggcatgaccatccaggactacggggtcagctacgaagagctggagccgcacttcgatttcgccgagaaggtcttcggcacctccggcaccgcgcatacggtcaagggccaggtggtcggcaagggcaatccgttcgccgccgaccgctcggacgacttcccgctgccggcactgcgccaggtgtactccgcgcaactgttccgcaaggccgccgaggaactcggcctgcacccttacgacctgccggcggccaacgcttcggggccctggaccaacccctacggggtgcagatggggccgtgcaacttctgcggcttctgcagcggctacgcctgctacatgtattccaaggcctcgccgaacctgaacatcctcccggcgctgcgccagaccccgctgttcgaactgcgcgccaactgcaacgtgctcaaggtcaacctcgatagcgatggcaggcaggccaccggcgtgacctacgtcgacgcccaggggcgcgagatcgtgcagccggcgaagctggtgatcatcagtgccttccagttccacaacgtgcgcctgctgctgctctccggcatcggcaagccctacgacccgcgcaccggcgagggcgtggtggggaagaacttcgcctaccagaacatggccaccatcaaggcgtttttcgacaaggacgtgcataccaacccctttgtcggcaccggcggcggcggcgtggcggtggacgacttcaacgccgacaacttcgaccacggaccgctgggcttcgtcggcggctcgccgatgtgggtcaaccaggccggctccaagccgatcggcggcctcgccgtgccgcccggcacgccgagctggggcagcggctggaaacaggcggtcaaggacgcctacacgcacaccgtgtcgatggacgcccacggcagcaacatgacctaccgcgacaaatag

SEQ ID NO: 8699 - DNA, 429 bp, Pseudomonas aeruginosa
tccgacatcgacccgacctacaaggacgcttacggccagccactgttgcgcatgaccttcgactggaaggacaacgagatccgcatgagccgctacgtcaccgagcacatgcgcaagatcgccgaagcgatgaacccgaaggccatctcggtgagcgtcaagaacttcggcgaccacttcaatacacgggtctaccagaccacccacctgctcggcggggcgatcatgggcagcgatccgaagaccagcgtgctcaaccgctacctgcagagctgggacgtgcacaacgtcttcgtcatgggcgcctcggccttcccccagggcaccggctacaaccccactgggctggtggcggcgctggcctactggtcggccaaggcgatccgcgagcaatacctgaagaaccccggtccgctggtgcaggcatga

SEQ ID NO: 8700 - DNA, 483 bp, Pseudomonas aeruginosa
  unsure (75): Identity of nucleotide at the above locations are unknown.
aaccgacagctttcctcgccttctccgccttcgcgtgcggcatcgcccaggccgccgcagcgccggacccggccntggtcaggcagggtgaatacctggcccgcgccggcgattgcgtggcctgccacaccgccagggacggcaagccgttcgccgggggcctgccgatggaaacgccgatcggcgcggtgtactcgaccaacatcaccccggaccgcaagaccggcatcggcgactacagcttcgaggacttcgaccgtgccgtgcgccacggcgtggccaggtccggcgacacgctttacccggcgatgccctacccgtcctacgcgcgagtcagcgaagcggacatgcgcgccctctacgcctacttcatgcatggcgtggagccggtggagcagcccaacaaggccagcgacatcccttggccgctgtcgatgcgctggccgctggcattctggcgctggaccttcgctcccgaggtga

SEQ ID NO: 8701 - DNA, 399 bp, Pseudomonas aeruginosa
acgaccaggagatcgccgacgtggtcaacttcatccgcaccagctggggcaaccaggcgccaagcgtcagcgtcgacgaggtcaggcgcctgcgcaaggacaccggcgcggcggcggtgggcgacattccgccgccgggaccggccgcggcggatcgcggctgagcgccaggcctgccattccagcccctctcccgctcgcgggagagggttgccataccaggcacggccaccccttcactcatctcccaatcgcacatgccgccccagctcgtcgaacaatgcgaccaccgagcgcaacgcccggcagtccggacgggtcagcagccacagggcgctggcgcagccctcgaggtcggcgtccagtacccgcaggccgtcgccgtcgcgtagcaggtag

SEQ ID NO: 8702 - DNA, 714 bp, Pseudomonas aeruginosa
tggacagcgggcgcgtccgccgcaccgacgccgaggccctggcctggctgctcaacggcgcgctggtggacgccgccctgcgtatcgccaacgccgaacacccgccggagagcctggccagggcctgccaggccctggacgtgctgctcgacggcctgctcatggagtgaaaagccaatggactaccgcatcagaaccagccgcgacgaggacgccgcgctgctcccggccatcgagcgctcagccggggaaagcttccgcctgctgcccgagctggcctggatcgccgacgccggggtcgccggggtggacttccatcgccgcctgatcgagcgcggcagccactggctggcggaagacgccgatggccagccggtcggtttcctcgccgccgaacgctgcgccgacgagttgcacatcgccgagttgtccatcgcccaggcccaccagcaacagggcctgggccgccgcctgctggagcgcgcggtgacctacgcccacgccagccactgccgggcgctgaccctgacgaccttctgcgacgtgccctggaacgcgccgttctacgcacgcctgggcttccagcggctgacctggcaggaagccggcgagcgcttgcgcgcgatcctcggccacgagcaggagatcggcttcggcccgccgacagccgctgcgcgatgcgcctggtgctctagacggcggcaaagggcttga

SEQ ID NO: 8703 - DNA, 1782 bp, Pseudomonas aeruginosa
cggtacagttgccaactgcaacaggatgtttcagcactgccccggacgggcttccgctctccctcttccccagtgtgcccttgcatgagcagtcaacgccgaaactaccgcttcatccttgtcgtcaccctgttcgtcctcgcctccctggccgtctccggacggttggtctatctccaggtccacgaccacgaattcctcgccgaccagggcgaccttcgctcgatccgcgacctgccgatcccggtcacccgcggcatgatcaccgaccgcaacggcgagccgctggcggtatccaccgaagtcgcgtcgatctggtgcaaccccagggaaatggccgcccacctcgacgaggtgccgcgcctggccggcgccctgcaccgccccgcggcgccgctgctggcccagctccaggccaacccgaacaagcgcttcctctacctcgagcgcggcctgtcgccgatcgaggccagcgaggtgatggccctgggcataacgggggtacaccagatcaaggaatacaagcgtttctaccccagttccgagctgaccgcgcagttgatcggcctggtcaacatcgacggccgcggccaggaaggcaccgaactgggcttcaacgactggctgagcggcaaggacggggtacgcgaggtggcgatcaacccgcgcggctcgctggtcaacagcatcaaggtgctgaagacgcccaaggccagccaggacgtggccctgagcatcgacctgcgactacagttcatcgcctacaaggcgctggaaaaggccgtgctcaagttcggcgcgcactccggctcggcggtcctggtgaacccgaagagcgggcagatcctggcgatggccaacttcccctcctacaacccgaacaaccgcgccagcttcgccccggccttcatgcgcaaccgcaccctcaccgataccttcgagccgggctcggtgatcaagccgttcagcatgtcggcggcgctggcctccggcaagttcgacgagaacagtcaagtcagcgtggcaccgggctggatgaccatcgacgggcacaccatccacgacgtcgcccggcgcgacgtactgaccatgaccggagtgctgatcaactcctcgaacatcggcatgagcaaggtcgccctgcagatcggacccaagccgatcctcgaacagctcggccgggtcggtttcggcgcgccgctgtcgctgggcttccccggcgagaacccgggctacctgccgttccacgagaaatggtcgaacatcgccaccgccagcatgtcgttcggctacagcctggcggtgaacaccgccgagctggcccaggcctactcggtgttcgccaacgacggcaagctggtgccgctcagcctgctccgcgacaacccgcagaaccaggtgcgccaggcgatggacccgcagatcgcacggcgcatccgggcgatgctgcaaaccgtggtggaagacccgaagggcgtggtccgcgcccgcgtgccgggctaccacgtggcgggcaagagcggcaccgcgcgcaaggcctcgggccggggctacgcggacaagtcctaccgttcgctgttcgtcggcatggcgccggcgtccgacccgcaactggtgctggcggtgatgatcgattcgccgaccaggatcggctacttcggcggcctggtctcggcgcccaccttcagcgacatcatggccggatcgctacgcgccctggcgatcccgccggacaacctgcaggacagcccggccgtcgccgaccgccagcaccacggctga

SEQ ID NO: 8704 - DNA, 384 bp, Pseudomonas aeruginosa
cccgccatgctcatcccctcctcctactgctgcaccgacgatcagtgcccggccgctagcgagcggtcgccgtgctacgcgcaactcatcgatatcgaggtggaacccgccagccagttgtcgctggcgctggaacagaacgcgcacctgcaacgcctggaacgctgcttcaggaactgcccgggctacctgtccgccagcctgcaccccagcgaggacggccagcacgtgctgaactacacctgctggcgttcacgcgaggactgcgaacgcgcctggcaggcccgggaggacgcgcaaggcccgctgagcgcgggcgtctggcggctgggggcgaaaagcgtgcgtttcgagaccttcctggtcgacgccgagggctgctga

SEQ ID NO: 8705 - DNA, 1080 bp, Pseudomonas aeruginosa
gcccgccggcgccgacggcccgtctcagaaggacttctgcagggaggccatgtcgatcacgaagcgatacttcacgtcgctggccagcatccgctcgtaggcctggttgatctgctggatctcgatcatctcgatgtcgcaggcgatcccgtgggccgcgcagaaatccagcatttcctgggtctcggcgatgccgccgatggccgagccggcgatcgagcggcgtcccatcaccagttgcgcaccgtgcaccgccggctccagcggctcgagcaggccgaccagtacgagggtgccgtcgcgcttgagggtcgccagatagggattgaggtcatgctggtgcggcacggtgtccaggatcaggtcgaagcgtccggcgacggcggccatccgctgtgggtcggtggaaaggatcacctggtcggcgccgagccgccgcgcttcctcttccttgcccggcgagcgggtgaacagggccacctcggcaccgagcgccctggcgaacttcaggcccatgtgaccgaggccgcccaggccgaccaccgccacccggctgccgggaccgaccttccagtgacgcagtggcgagtaggacgtgatcccggcgcacagcagcggcgccgccgtcttcggatcgagcccctggggaatgcgcaggacgaacctggccgagaccacgatgcgctccgagtagccgccgaaggtcggcaggccgtcgtggcggtcgcggccgttgtaggtcagggtcgggtattccgcgcaatactgctccaggccctcggagcaggcggcgcagtgccggcaggagtcgaccatgcagccgacgccgaccagttcgccgaccgcgaaaccgctcaccgcctcgccgacgctggcgacccggccgatgatctcgtggcccggcaccagcgggtacaggctgttgtgccattcgttgcgcgcctgatggaggtccgagtggcagacgccgcagtagaggatgtcgatcaccaggtcgtcggcgcgcggcgcgcggcgttcgaagcgatgggcggtcagcggggtgctggcggactgggcggcgtagccgcggatctgtag

SEQ ID NO: 8706 - DNA, 969 bp, Pseudomonas aeruginosa
gctggcacccagcgcgccgatggcttcggtaccgctggacgcggggatggccgatgcggtgatgcgcctgctgggctgcctgcagagcccgctggacagccatatcctcggcccgcaactggtccgcgagatcatcttccgcgccctgcgcagcgagcagggcaacgccctgcgtgcggtggccggccggcacagcggctacgggcgcatggccagggccctgcggcgcatccacaccgactacgccagtgcgctggacatcgacaccctggctcgcgaggcgaacatgagcgtgtcgaccttccaccacaacttcaaggcgatgaccttcacctcgcccctccagtacctgaagagcgtgcgcctgtacaaggcctggagcctgatggtgcaggacgggctgaacgccagtaccgccgccaaccaggtcggctacgaaagtccctcgcagttcagccgcgagttcaagcgctacttcgggcgcacgccgagcgaggaaatccaggccgcccgccgctagccggcgggagcgggggcgcttgcaatacatacggatatccgtatattcagctttccatatatccaggaaggcccagcgatgcccagccccgccgaagtgttcaagtgcctggccgacgagacgcgcgttcgcgccaccctgctgatcgtcgaccagggcgaactgtgcgtctgcgaactgatgtgcgccctcgccgacagccagccgaagatcagccgccacctggcccagttgcgcagtgccgggctgctcctcgaccgtcgccagggccagtgggtgtattaccgcctgaaccctacgctgccggcctggatccacgaagtcctgcaagtgaccctgcgggccaacggcgactggctgcaagccgacgcagcgcgcctgcgcgacatggacggccgcccgcagcgcgcctccgcctgctgccaatagcgcgagccgccccatgctga

SEQ ID NO: 8707 - DNA, 558 bp, Pseudomonas aeruginosa
ccctgccggtcctgctggcgaccctttcggccctggccctgcgcctggccatctgacggccgccggcgacggcggcaggagcatcccatgcgagtcctgttcatgtgcacggccaacagttgccgcagcattctttccgaagccatgttcaaccacctggccccgccgggtttcgaggcatgcagcgccggcagccagcccagcgggcgggtgcatccgcgcagcctggcgaccctcgaacaggccggcatcgccacccacggcctgtacagcaagggcagcgaagccttcgaaggcgcaccgccggacatcgtcatcaccgtttgcgacgccgccgcgggggaagcctgcccgctgtatctcggcgcagcgctgaaggcccattggggcctggccgatccctccgccctggatggcgacgaagccctgcgggatgcggcgttccacgccaccctggcacgcatcgaacagcgttgccgagccttcctcggcctgcccttcgctaccctggatcgcgaccagctcaagcgtgagctggagcgcatcggctcgctctga

SEQ ID NO: 8708 - DNA, 267 bp, Pseudomonas aeruginosa
gcgaggccgaaagcgccgcgatcatcggccacgaactgggccacttcgccgccggcgacaccgcccacggtgcctccctgtcgctcctgcagcggcaggtgcgcctgcgcatcgaacgcatcgccgcacccgaggatgggcgtgtcggcctgctcggcaagccgggcctgtgggccgcgctgtacttcctcgatcgcttcgagcgcgcctacctgcactggaatcgccgccaggaactggccgccgacaaggtcggggcgcgggtag

SEQ ID NO: 8709 - DNA, 1128 bp, Pseudomonas aeruginosa
  unsure (753),(880): Identity of nucleotide at the above locations are unknown.
ggcggcggcgctgtgcctgctggcggcggccgccctcctcatgtgcctggcctgcctgcagcgcaacgccaggagcgcgccgttcctcgtcctcggccaggggcgcctgcgcgcccgcagcctgtcggcgccgctggacctgctggaggtcgccgacctgcgcctggaggacggggtctggttctccgcgatagtcctcgaactgcacggcaaggcgctaccggcaccatccacgcgcccgctcgatccgttcgccgcgcgtgccgtcagcgaatgccgggacggcccacgggttcgcctgctgtcccccggctggcgcctcaacggtcgcaacctgtcgctactggaagccgcggaggtcatcgacctctacctggacatcgcccgcgcccaggcccggttccgccaactgggcgagatcccgcccagtgcttcctcttcactcccaactccaaggatatttccatgagcaaccaggaaccccgggacctcgtctccaacctcgccgaaaccctcggtgccgaacacgaagagctgaaccaggcgaagaccgccgaggtcatcgcccacctggagcgggtgatcgccaacgtaccgccggccaccgagttcaccaatacccgcaagtacgtggtgctgggtccgctgctgagcatcgtgcccttcatcatgaccggcatgtggttctcccagggcaagccgggggtcggcgtcgtcggcttgctgctcggcctgttcgggctgttcctcggntaccagcatcgcaactccggcaagacccccttcatgcgcctgacccgtacccagctctgggccgacagcctgtcggctccggtcgagctggccgacgtcatcgatttcagcgtcaaggccgacatgntgcaaaccacccagaccctccacctgcggcccgaaacgccgctgccgacccatcgcgccgtacgccaggtgttcgcctcccaggccatggccttcaaaggcaaggacccgcgcatcaccatcatgtcggccggcctgcagagcgatggcaagaagctggactgcgacgacatggcggcgatcctcgacgcctacatccaggccgcccacgcccagcgctacctgcaacaactgcgcagccagggctga

SEQ ID NO: 8710 - DNA, 1545 bp, Pseudomonas aeruginosa
  unsure (760): Identity of nucleotide at the above locations are unknown.
gtgaagggcacggtccatccgcgaaggctgctgctttgcctggtgctggttccagcgctgctggcggggctcggcgcctggcagtcctggcgcgccgagcagcaggccgagcgactgggcgccgcgcagcagcgggtcgagcgcgcgctcgccgaagcgcgggcgctgccgccgagggccagcgtccgggtggacggccgggcctatgtgcgcgacctggccctggcgcggctcgacgagcgactcgccgacacacgaagcgcacagcgcctgaatcgcttcgccgccgtcctcgccgatagcggagcctgcctggcggcgctggtcgccgtattgggagccgtctccctggccggcatcgccggcgccgcacgcagcgcactgcgctcgcgtcgctgcctgctcctgtggttcgagctgggccgacgcctgctgccctgcctgctcctcgcccagatcggcctgctcgccctggccctggcctgtgccggaacgttcgagatcctcgggctgtggcgggtcggccaggttccggtcagcgaaggacgcacccaactgagcgtggcgctgatccttctcggcctgctggcgtcggcgtggcaaatgctggcgaagatcacccgcttgcgcctgcgcccggcgccggccctggatgtcatcggccgccggctgggcgaagaggatgcaccggaactctggacgctactgcgcgagctggcggcgcgcctcgacacgccagccccgcagcacctgttggtangtctcggccagggcttctacgtgaccgccaaccgcgtctgcctgcaaccttccggcgagcatctggaaggacgcagcctatacctctcgctaccgttgctgggcctgctggaccgcgccgaactgagtgcagtgatcgctcacgaactggcccacttcgccggccgcgacgcccattacagcctgcacttcctgccgatctaccagggcgccgcgagccaactggccgccatcgaggagcaggaagccaacgtcttcgaacgtgcggcactggaaccggcgcgactgttggccgggtacttcctcgaacgtttcggcctcgccgtgaaccactggagccgcctgcgcgaattcgccgccgaccgccgcgccgcacaactggccggtgcgccggcgatggcctcggccatgctgcgcagcgcggcggccggcgcgccgatacgggcgttcctcgaacactgcctgctcgctccggcgcgcgcgccggacaacctggtggacgccatccacgtctacctgggccagtccggcctggaagcaccggcccccggggcggagggactccaggtccatccgcaggatacccaccctccgctgggcctgcgctgcacggcgctgggagagagcttcgaacgcacctgggccgggaccgccggccgggccgttccgacacgaccgccgagccaggcgctgggcgtctggttcggcgcccccctggcgttgagccgagcgctcagcgccgacctgctcggcaagacctgtgagaatccccatgcaagaaactga

SEQ ID NO: 8711 - DNA, 390 bp, Pseudomonas aeruginosa
gcctgccagtcgccgtccggcatcgccggggcggtgctggtcatgccgctgtcgcggtcgatgcgaccgacgatctgccccggattggtgaactggctgcccaccgcggcggtgccggccaggaccaccgccacgcccagcgccgcggtgcccagcggcgccggaccgtcggccagcagcgggcggcggaaccagggtagccagagcagcaggccgaagacgaaccacagagccaggcgcggcaccagttgccaccagtccaggccgacttcccacagcgcccagacggtgctggcgaacagcaccagagcgtacaggcctagcgccgcacgcttgcccagcagcagcaacagtccgctcagggccaggccgatgccggccagcaggtag

SEQ ID NO: 8712 - DNA, 1980 bp, Pseudomonas aeruginosa
ccgcgccgtccgcccattcgagcatcagccagccgtccctggcggaattgcgcaggcgcagcggcggctgggtcatgccggcacccgcagttgcgccagggcgatacgcaccgccttgcgcacctcgggatcgccgtcgccttcggcgacccgcaaggcctgggccgaggccgggtccgccagttcgccgagggccagggcggcctccttgcgcaggttgccgatgggatggccgagcaatgcttccagcgcctcccgcgccggccggtggcgcaagcgcccgagcgcccgcgcggcgcgcaggcggacctgccagtagtcgtccgccagggccttcagcagcggctcgccggcctcctcccggcccagcttgccaagggtcgtcgccgcctcttcgcgaacctgccattgagcgtccgccagcgccgcgcagagcgccggcagcaccgtcgcctcgcggctcaggccgagggcgccggtggccgcccggcgtacctccgggtcgacatcggcgctggccagcctggccagttcggccagggccggctggtggcggagccagccgagcaccgccaccgcctcgcggcgcaccgccgcctgcggatcgccgagggcggccagggccggcgcggcgctctcctccaggcgcagttcgcgcaacgcacgcaatacgctggcgcggacgaaggcatcggcatgcccgagccacggcagcaggcgccgcccggcggccggttccttgagttcgccaaggctctgcgcggcggcatcggccaccgccggcaccggatcggccagggccgcacagagcgcatcgaccactgcgtcttcctcccaggcctccagcaggcgcgcggcctcgccgcgcacgccggggtcgggatcgccgcgcagggccgcaatcagcaacggcagcgcctccggcagctccaggtcggccagttcgatcagcgccaggcggcgtacgccggggtcggcgtcctccaggcgcggcgacagttcgaggatttcgggcagggtggcgtttttacaggtcatatggcgatccgcagtcggtccggggtgatgcccggcggcaagccgagcggggtcaggcgcggcaactggcggccgtcgtcgtggtcgagcagttccaggcagtggcgtttcaggcgcacgaagtcggcgctggtcaccagccgggtgtcgcgagggcgcgggaagtccagcgccaggtcggcgatgatccgtcccggacgggggctcatcaccagcaccctgtccgccaggtacagggcctcgtcgatgtcgtgggtgacgaacagcaccgtggtgcggacccgcgcccatacgtccagcagcaaggtctgcatcttcagccgggtctgcgcgtcgagggcgccgaagggctcgtccatcagcagcaggcgcggccggttgaccagcacccgggcgatctccacgcgctgctgcatacccccggacagttggccgggccagcgcccggcgaagtccgccagccccaccagtccgagcatctccatggcgcgccggttgcgctcggcgcgggccaggccctgcatcttcaggccgaaggcgacgttgtcgcggacccgccgccaggggaacagggtgtgctgctggaataccatgccacgctgcggcgaaggtccttccacgctccggccgtcgaccctcacgctgccggcgcttggccgcaggtggccggccagggcgccgagcagggtcgacttgccgcatcccgaaggcccgagcaggcagacgaactcgcccggccgcgcctccaggctcagatcgcggaccgcctcgaaggcttcgctcccctgccccaggcggatgctcaggtcgcggatctggatgcgccccaggctgttgccggccgtcgtcatcggaccttgcctcccgccgcgtaccagggcgtcagcgacgcgccgacgcgcttcaccaacccactgctgcccatgccgaagaggccgatga

SEQ ID NO: 8713 - DNA, 531 bp, Pseudomonas aeruginosa
agatcatcgaggcctccgacgaagggaacatcaggatcgccaggggaatccaggccaccgccgggatcggccgcagcacttccagcggcggcagcagcaaggcctcggcccaggccgagcggccgatcgccaggccgagggcgatgcccagcgcggcggccagcagatagccggcgaagacccgcgccagactggcgccaaggtgcgccaggagcacgctggactgggccaggttgcaggccgccagcaacaccgcaccgggcgtcggcacgttggcgaaggtcaccaggcccagattcagttgcagaccggcggcgagctgccagaacgccaggcaggccgccagcgaagcggcgcgggtggcccagcgccagggtcgggagatcggaagcgaactcatgggcggactccgaagacgcccgcctcagcggagcgccagcgcctgctggctggcggcggcaaagtcgcgtacctcgccgccatggcggcgggcatagtcctgggcctgctcgcggagcaggaaggcgttga

SEQ ID NO: 8714 - DNA, 858 bp, Pseudomonas aeruginosa
tcgccgccatcggcccggcggtgccgccgccgatcaccacgatgtcgtattcctgctccagggtgttcatgcccgctctcccttctgccgatcgatgcgcaggcgatactggaaagcgtcgccgcggtagtagaggtattcgaagtccagcggcgcgccgtcggcggcatgggtcaggcgctcgatacgcatgatcggcgcgccctcctcgaccgccagggcgcgggtcaggtcggcatcggcgagcaccgcgtcgatggccaggtcggcatggccgaggggaatgccgcaatcgttctcgaggatcaggaagatgtcgcgggtcaccaggtcggccttctccaggcgctcgccgagcgcctgcggcaggtaggtgacttccagcgaaaccggctcgcggttgaccagccgcacccgcttgatctcgcacacagggctgccctcttccacccgcaggcgctcggccacccgcgcgccggccggcacgtagcgcaggccgtgcaggcggttgatgacctcgtagcccatctgcgtcatggactcgcccaggccttgcagggtgctgacgttctggaacgccttcggccgggcgacgaaggtgcccttgccgtggatcttgaagatcagcccttccttctgcaggtcgccgagcgcctggcgcacggtgatgcggctgacgtcgaaggccttgcccagctcgttctccgagggcatgcggctgagcggcgggtagacgccgtcgaggatgcgcccgcgcagcagctccttgagctggctgtacagcggcacgggagaaagcgggagcagtttgcccatggtcggattcgcttgtcggagtggctcggacacttgttataa

SEQ ID NO: 8715 - DNA, 2715 bp, Pseudomonas aeruginosa
ccgttgatcttcacctgttcgtcgatccgcccgaggaactccaggcaaccgtcggcgcgccagcgcaccaggtcgccgctgcggtacaggcggccgctgcccggccagccctcgtcgaggaagcgcccggcccgcctcgccggcgtcgccggcatagccgcgcgccaccccggcgccgccgatccacagttcgccgctggcgccacgggtcttgcgacgaccgaggccatcgaccacatgcagatcgacgttggccagggcgcggccgatggtcggccgcgcatgctcggcgacccgcgccaggctggcgttcaccgtggcttcggtaggaccgtagagattgaacacctggcagcggcgccagccggcggcgacctcccaggacgcttcgtcgaagcgctcgccccctaccaggatgcgcccgggcagcgccgggtgggcatcgtcgaggccggcctggagcagcaggcggaacagcgacggggtgcagtcgagcacgtcgatgcgccgttcttcgaggaaccccagcatccgctgcggatcgctgcgcacctcctgcggcaccaggaccaggcaatggccggagagcaactggagaatctgcttgatcgaggagtcgaaggagaacggcgcgttgaccgtcacccgcaggccctcgcccaccacgttcgcgtataccgtgcgcgccagggcctgggacaggttgagcgcgctggcgtgctcgaccaccacgcctttgggctggccgctggtgcccgaggtgaagatcatgtaggccgcatcgcgcccgcccggcgccggcaggctcatgccgctgccggccagcggcagcgtcgacaggtccaggcaggccccggcgaaggcctcgcgggcgcgcccggcgcactcggcatcggcaagagcgaagacgatcccgcccgcttcgcgcatccgctccacccgcgccgccggaaactccggattgaccggggtgtacaccgccgccgcgcgcatcaccccgagcagggcgacgatcgcctcgcggttgcgcccggtcatcaccgccaccgcctggccgggccgcacgccggcagccagcagcgcttcggcgaccgcttcgctgcgcgcgcacagcgtggcgaaatccaggctgccgtgggcatccagcaacgccggcgcctgcggctgcagggcggcccgcagatcgaacgcggccaccagggattccaccggcgcgggctccacgcgctcgccctgccaggcctggtagcgctcgcgctcggccgcgccgatcaacggcagcccggccaatggcagttgcctgtcggcggcgatgctttccaggcattcgacccaggcgtcgagcaagcgcccggccagcgttccgtcatggtcgcggcggacccgcaggctggccagccggccttcgccgtggggcagcacctgcaactcgaggaacccgcccagcggcggctgacggcaatccagctcggccaccccggcgccatccagttcgcccgccagccaggcgaagcccaactcggcgagcggccagtcgggggcaaagggatcgcgcagggccgctgcctcctcctgggcgaggatcgccgcctggagggcgtcgagccgctcgccgacgctgcccgcgcggacattctccaggcacagcggcgcgaccccggcgaacggtccggccagctcggcgaactcgttgaacaggcgccccgagaccagtcgcgccatttccagagggagtccctcgtcgccctggaactgcccggcgacctgggtccaggccagcagggcggccgcctccggcaagccgttggcggccaggcgttcgagcagcgcgcgcggcagcaggcgccgcgcccgtccaatcgccttcgcccaggtcgtccgccagcgccagcggactttccgccgcaacggccgcctgctctcgccagtaaccgctggcgctttcgccgtcttcgccggccagcgcctcgttggcccactcggagaaatgctggaacagcagcgcctcgtctccctcgtccgcgctcgcctggccggccggccccaggccgcggcgcagcagcgccaccaggctggccgcatcgacgacgaacgccggcgccgccagcaacagcccctggagcgtctctccggcggcgtccagcagcaggccgagcgccagtaccggctggccttccccgcccaggggcgaagcggcgagacgcgcgctttcgcgcgcgaagcgtccggcccagtcgccatctcccggcaggcgctcgaccagcagatcggccgcgcgcccatccagtacctgcaccggcaggctcatgcccggcatcgtccggtaggccacgcgcagttgcgcctcgccgtccagcgcccggcgcagccgctccagcgtcgccacggtatcggccggggcgtgcaggcgcacgccgacaaccgtattttccggccgctcggcatggcggcgccaggcgcgggtctgcaagggagacagcgggaatccttcgagcgcttcgctcgcggccggttgcacagcggattgcaggtcttctgacgcactcatggctatccctcgcacgggttcagggttggtggacatgcaggtcggtcatcgccaccagcaccttgcgctcgccggtgtacggctcgcggccgtggacgctgatgaagttgtcgagcatcaggacatcgccgcgctcccaggcgaacgcgcgggtttcctcgcggtag

SEQ ID NO: 8716 - DNA, 270 bp, Pseudomonas aeruginosa
cctggctacgcggcgaggaacgctccttgtagtcgagcagttgcggggcgaaggcagcggcggctgcgcggaagcgctctgccgagtcgacctcgaagcctctcagcaacaggccgccagccaggttcaggtcgtcgtgcagggactggccctgctcgcgaatccagtcggccagggacaggccgggagcctgtgcctcgatcagcagcggcaggccgtcgcgctccgccgccgggcgccgcaccagcgcctcgctgctgcgcgggctga

SEQ ID NO: 8717 - DNA, 1689 bp, Pseudomonas aeruginosa
cggcaacatgtagtgcggcagactttgcccaaggtgctcgttcagcgcctggagcggcggggcgaacggcgccgccaggtagccgaccagccgacgcaggccggcgctgtcctcggtgagcatggcgcaggcttcgctcaccccgggaaaactcgccaggcacgaggcgatctcgcccagctcgatgcggaagccgttgaacttgacctggtcgtcgagccggccgaggtgttccagcacgccgtcctcgcgcatgcgtacgcggtcgccggtgcgatagcggcgctcgccgctgcccggatcgacgcggaaacgctcggcggtctgctccggcttgccgaaatagccacgcgccaggccgatgccgccgaggtacagctccccggccacgcccagcggcagcggcgcctcgaagccgtcgagcacctccaccgtggtgccgggcagcggtcggccgatgggcggctcgtcgagcgcttcggcgtgcaggtccagttcgtgcgccgtcgaataggtggtgtcctcggtcggcccgtagagattgaccaggcgccgtacctggggttggccacgaatctgtcgcaccaggtggccgcgcagcggttcgccggccaggttcagcgtgcgcaccccgcccggcaggtcgccgagggcgagcagcgcggcacacaccgagggcacggtattgagcaggctgatctcgtcgcggcgcgggtagtccggcaggctgaacaggttttccaccaggtgcagcgtgccgccttcggccagggtaccgaacagctcgtagaccgacaggtcgaagcacaccgaggtcgccgccagtaccccgctccattcttcggcggcatagtgctggccggcccagcgcaggaaggcatgggcgctgccgtgctcgatggcgacgcccttggggcgtccggtggaaccggaggtgtagatgatgtaggcgaggtggtcggcgccgacctcgctcgcgggcagcgccaggtcgttcgcctggtcgccgccctcctccagcgtcaggcatggccggcccagcgcggcgacccgctcgcgggtgctcgcgtcgaccagcaccagcaggcagtcggcgtcgtcgagcatgtatgccacccgctcctccggataggccgggtccagcgggacgtatcaaccgccggcgcggagcacgccaagcaggccgaccagcaggccgctgtcgcgccgcatgcagaccccgacccgctgctccggagccaccccggcggcgcgcaggcgcacggcgagcgcggcgctttcgcgctccagctcggcatatctgaggctacggtcggcggcgtgcacggcgatgcgctgcggtgtgcgccgcgcctgggcctcgaacagatggtggagtacgccgcgcgacggggcggcctggggctcgctgcgcatggcctgcatacggcgctcttcgtcggcgtccatccagggcagccggccgacgcatgcctgggcgtcgaccatgccgcgcgccatgcgcgcgagatggccggcgatacgccgcaattcgtcgtactggggatcgcgcagagccaggccgacgctgccgtccgccgccagcaccagggccagccagccggggctgctcgccgttggccgcgccgccagcacctggaccgcgcagcacccggccagggcggcgcgctcctggccgtcggcggatag

SEQ ID NO: 8718 - DNA, 1209 bp, Pseudomonas aeruginosa
agtgggtgcgggcaagacgttactccgctttgccgccgcgccagcgcaacagttgccgagaaagttgccgtaacactccacccgtccgccgccctagcgttgcactccccagcgcttcaccgtgaggcgctcgatgctgccgaacaccaggttctccaccagcaggccgatcagcaccaccacggccaggccggcgaataccttgtcggtgtacagctcgttgcggttctggaaaatgtaccagccgagcccgcccttgccgctgctcgcgccgaacaccagttccgcggcgatcagcgtgcgccaggcgaaggcccagccgatcttcagcccggcgagaatcgacggcagcgccgccggcaccaggatcaggaggacgaagcgcaggccacgcaggccgtagttgcgccctgccatacgcagggtctccgagacaccgaggaaaccggcataggtgttcagcgccagcgcccagagcaccgaatgcaccagcacgaagatcaggctgttctggcccaggccgaaccagagcagcgccagcggcagcagcgcgatcgccggcagcgggttgaacatcgccgtgagggtcccgagcaggtcgcggcccaactgcgtggagaccgccaggctggtcagaacgaaggccaggacgatccccagcaggtagcccttgaacagcaccagcagggagatccccgccttggccggcagttcgccgctggccaggccctcgccgagggccctggccgtctgcaggaagcctggcagcagcaggtcgttgccctggacccgcgccgccagctcccaggccagcgccagcagcgccaggatcagccccttgcgcagccagccctgttgccagagacgctggctcaggggcaggcgccgctccagggagacctccagcaggggttcgagctggacttcgtattcttcgcgaacgcgcgtgactcgactcatcgatcgattcctctgctcaatgggccagccggatatcggcgaagtcgagggtcgcggccgccgtcggttcgccgccctcgtcgaacagcaagcggtggatgcgtcgcgccgcggcttgcagcggctcgccgccaaggctgtgcagcccgaacgggtggccgtgcacttcggcccggacccgccccgggtgcggcgagagcagcaggatgcggttgcccaccaccaacgcctcctcgatggagtgggtga

SEQ ID NO: 8719 - DNA, 531 bp, Pseudomonas aeruginosa
ttggccagcgcgtcgcccacaacctgctgcgcctgcgcggcaagcgcaatctctcgctggacgccctggcgcggatttccggtgtcagccgggcgatgctggcgcagatcgagtccgggcgcagcgtgccgtcgatcaaggtgctgtgcaagatcgcccagggtctcaaggtgtcgctggcagccttcctcgacgatcgcgccttcgccggtgtcgcggtgctgccggcgcaacagagcaagcgcctggtcagcgccgacggcgctttcaccagccgcgcgctgttccctttcgatgtggcgcgccaggtggagttctacgaactgcgcctgcgcggcttcggccaggaagacgccgaagcccacgcccccggcacccaggagaacctggtggtggcgcagggggtactggaagtgcgggtcaacgaggagcgcttcctgctcgccaccggcgactcgatcctgttctacgccgaccagccgcacagctaccgcaaccccgccgatagcgaagccctggcgtacctggtga

SEQ ID NO: 8720 - DNA, 657 bp, Pseudomonas aeruginosa
cctacccggagcgcctggactgacccccggccttgctgccatggacgaagaaaggcccgcccggtcatcccgggcgggccttttccatccggcgacggatcagcaggtgcagcacatcatcggcatgccgttgcaactcatcatcatcggcatgccgcactccatcatcttcgccatcagcatgcagcagttcttgaacatctccatgtccatgccctgcatcggcatcatcctgcagtgcatggcgtcgccctgcatggagcactccatcatgcacttcatcggagccatgcccatcatcggcatgcccatccccatgcccatcgtcggcatcatcgccatgcaggcctgggacatgcccatcatcgccaggttgccgcactgcattatcatgggcatgccgcagttcatcatcatcgccatcatctcggcgctgttgcggaactggcccatgtccatgcccatcgccggcatcatcttgcacagcatgccgtcgtccatcgtttcgcactgcatggtcgccatcatcatcggcatgcccatcatgggcatcatcggcatggcggcattcatgttcatcggcatctgcatggcattcatcatggcggtaactcctgtaggcgaagcgggggtaggtgcgaatggggccgattctag

SEQ ID NO: 8721 - DNA, 678 bp, Pseudomonas aeruginosa
cagcggattccgctgcatggcggaggaacgcatcgtcacagccggtatttcgacgcgatggatattcgaaacggacctatccaaataacccaggtgaataaacgttctaagacccgcagcctttttccccttgccgggcgcagccccgtctattgcgccgctttccggtgctcggacgatgccctgcggaagtcgcgcgggccgacgcggaaagcgtgcgcggcattgccccagaccagcacggcggccaagccgatcagcggtagcagggtccagggcagcatctcgctgccccagcgctgcaacaccatgccacccaacgctccgccgccggcgatggccaggttccaggccaccacgatcatcgactgggccaggtcggcgccctccccggcggcgtccgccgaggcggtctgcagcagcgtcgccgcgccaccgaacgtcagcccccagagggccaggccggcgaacgccagccagctccagcgagcgcccaggcacagcgccagcgccgccacggcgaacagcgccaggctggccaggaccatccgccgcaggtgccggtcgaccagcacgccgaccagccagattcccgccaccgcggcgctgccgaataccagcagggccaggtccaccgaggcgcccaggccgaccttggcgaggaacggcgcgatatag

SEQ ID NO: 8722 - DNA, 243 bp, Pseudomonas aeruginosa
cgatcggcttgctcaccgaggccaggcggaacaggctgtcctcgcccattatccggccggatttgcggtcggccaggccggcagcccgtcgatagagccactgcccccggtgtgccaccagcaccaccgcccccaccaggcgctggtcggcgaatgccgcctcgatcacctgatcgacattttccgccaggccgcagcctggctctcgttcgaaactggacatgcgggactctccgcagatga

SEQ ID NO: 8723 - DNA, 549 bp, Pseudomonas aeruginosa
gagcgctgcaaaagcggaaaaagacggatagagttccgttctatccggactgtcatgtccgtaatcggagccttgcatggacagcctcagcggtttcaccgtcttcgtccgcgtcgccgagacccgcagcatcgtcggcgccgcccggaccctcggcgtcagcgcctcggcggtgggcaagcgggtcgcccgcctggaagagaaactcggcgtgcgcctgttccaccgcagcacccgcagcatcaccctgaccgccgaaggcagcctgttcctcgagcgcagccggcgcatcctggccgagatcgaagccaccgagctggagctgtcgcaaagccgcgagaccccgcgcgggcgcctacgggtcagcctgccgctggtcagcgggctggtcctgccgacgctcgccgatttcatgcaggcctatccggacatcgagctagacctcgacttcagcgatcgcgtggtggatgtcgtcgacgaaggcttcgacgtggtcctgcgcaccggccagccggtggattcgcggctgtccatgcgcgaactgggtga

SEQ ID NO: 8724 - DNA, 1200 bp, Pseudomonas aeruginosa
tcggcggcggcttctccgggatcaacaccgcgcttgagctggccgagcacggcatcaccgacatcgtcgtgctggaggcccgccacctcggcttcggcggtaccgggcgcaacggcgggcagatcatggccggcatcggccacgacctggagaagatccgcaaggacgtcggcgaggacggcctgcgggcgatcttcgagatcagcgacctcggcgccgacatcatcaagggccgtatcgagaagtacgccatcgacgccgacttctgccacggctacggctacatgggcttcaacgcacgccaggcgaagaccctgctggcctgggaaaaggaattccggtcgctcggctcgccccatgagatccgttacctgcacggtgccgaggtgcgtcagatcatcggctcggacgcctacggcagcgccctgctgcacatgggcggcggccatgtgcactcgctcaacctgctgctcggcgaagccaaggcgctggccggcctcggcgcacggatattcgaatacagcccggcgctggaggtgcaatacggcgagcgcatccgcgtgcgcacggccaagggctcggtcaccgcgaacaagatgctcttgggcatgcgacagcttcctcaaccggctcgaacccgagctgcaccgcaccaccatcaatacctacgcgttccagatgatgaccgagccgctgccggacgaactgatccagcggatcagcccgatccgcggcgcctacagcgacatccgcccggtcatcgactactaccgggtgaccaacgagaaccgcctgctgttcggcgccgccacacccttcgtcgaacgcatccccggcgacctcaaggcctggaaccgcaagctgatgctgaagattttcccctacctggagcacgtccgcatcgacctcgcctggggtgggccgatggcttgcagcgccaacctgttcccgcagatcggcagcctctcggggcggcccaacgcgttcttcgtccagggttattccgggttcggcgtgacccccagccacatcgtctgcaaggtcctcgccgaaggcatgagcgaaggctcggcgcgctacgacctgctcagctcggtgcgccgcatcccgatccacggcaaggaccacttccgcccgctgctgctcagcgcgggcaagacctggcaccagctctccggctactggaacggccggcgctga

SEQ ID NO: 8725 - DNA, 1572 bp, Pseudomonas aeruginosa
aacgatttaccttcgatccggaccgcgctacaacagtcccacgcctttcatccacgtcattcgaggacccgccatgaccgccccgctccacctcgattcgctgtttcccagcctcgacgccattcccgagcagtaccgccccgacgcccccatcgagcagcgcgactacctggtcgacggccaactgcgatattgggacggcccgctggcgccggtacgcagcccggtattcctcgccgaggccgacggcgagcgccaggtgatcctcggcagcaccccgctgctcgacgccgacgccgcgctcgccgcgctcgacgccgcggtgcgggcctacgaccacggccagggcctgtggccgaacctgcgggtggccgagcgcatccagcacgtcgaacgcttcctggcgcggatgcgcgagcaacgcgaggcggtggtcaagctgctgatgtgggaaatcggcaagaacctcaaggactccgagaaagagttcgaccgcacctgcgactacatcgtcgataccatcgaagcgctgaaggaactcgaccgccgctccagccgtttcgaactggaacagggcaccctcggccagatccgccgggttccgctgggcgtggcgctgtgcatggggccgtacaactacccgctgaacgaaaccttcaccaccctgatcccggcgctgatcatgggcaatacggtggtgttcaagccggccaagttcggcgtgctgctgatccgcccgttgctggaagccttccgcgacagcttcccgccaggagtgatcaacgtcatctacgggcgcggccgggaaaccgtgtcggcgctgatggccagcggcaaggtcgacgtgttcgccttcatcggcacccattccggcgccagcgacctgaagaagctgcacccccgcccgcaccgcctgcgcgccgccctcggcctggacgcgaagaacccgggtatcgtcctgccgcaggtcgacctggacaacgcggtgaacgaggcggtcaccggcgcgctgtccttcaacggccagcgctgcaccgcgctgaagatcctgttcgtccacgaaagcgtgctgcgaccgttcctcgacaagttcagcgcgcgcctggccagcctcaagccgggcatgccgtgggaaccgggagtggcgctgacgccgctgccggagccgggcaaggtcgactacctcgaaggcctgctgaacgacgccctggccaagggcgcacgagtggtcaatgcgggcggcggcgagcatcggcaaagtttcttctaccccgctctgctgagtccggtgagcccggacatgcgcctctaccacgaggagcagttcggtccgctggtgccggtggtgccctatcgcgagctggacgaggtgatcgactacgtcctgcgctccgactacggccagcagttgagcctgttcggcaacgacccggcgcagatcggccggctggtcgacgccttcgccaaccaggtcggccggatcaacgtcaacgcccagtgccagcgcggcccggacagctacccgttcaacggccggaagaattcggcggaaggcaccatgtcggtccatga

SEQ ID NO: 8726 - DNA, 402 bp, Pseudomonas aeruginosa
tcgcggcgatccgcaccgaccagcccggcgtgcgccagagcgacgactgggacggcttcggccagcgcaccaccggcagcggcacgtcgctgttcgaggatgccgaggtggaggaagagaacctcatcgacttcgccagccgcttcaagtaccagaccgcgttctaccagttggtcctgctcgcggtgctggccggcaccggccgcgccgccttgcgcgacgtcgccgccgaggtgcgcgggcggacccgtatctacagccacggcaatgccccgcgagtcagccaggatccccaggtgcagcaggtggtcgggcgcatcgccgcgcgcgtctacgccgccgaggcggccaccctgcgcgccgccgaagcggcccagcgcgcctacctggcgcgcttcgtag

SEQ ID NO: 8727 - DNA, 540 bp, Pseudomonas aeruginosa
tcgacgactggtccggcttcagccggcgcaccccgccagcggcaccgtcatcctggacaacgtgcgggtgccggccgagcacgtcatcccggtgcaccgcgccttcgaccgccccaccgccgccggcgccgtatcgcagttcatccaggccgccatcgacgccggcatcgcccgtggcatcctcgccgagaccgtgcagcaggtgcgccgccacgcgcggccatggatagacgccaaccagcagcatgcctgggaagacccctacaccatccagcaggtcggcgacctgcgcatccgcgtgcgcgccgcggaagccgtgctcgacctggcggccgacgccatcgaagcggcgctcgccgcccccgacgaggagagcgtggccgccgcctcgatcgcggtggccgaggccaaggtgctcaccaccgaagccgccctgctcgccgccaaccggctgttcgaactggccggcacgcgctcgaccctggaggaactcaatctcgaccgccactggcgcaacgcccgcacccacaccctgcatga

SEQ ID NO: 8728 - DNA, 1056 bp, Pseudomonas aeruginosa
cccggtgcgctggaaataccatgccatcggcaactaccagttgaatggggtgaagccaccgcggcacgcctggctctaggagccgtcccgggccctggggcggatatcgccactggcgtcatccgccgtccgcccaggtcaggccggcagcgcgttgcgcccggcctccttctcccagagggcccgcaggtcgcgatagccggccgccggatgggaatccggcagccgcgggccgtcgccgaacaacttctcgcgcagggttcccggcgcatattcggtcttgtacaccccgcgcttctgcaactccggcaccagcaattcgaccacgtcgctgaaggtttcgtgggccagcgcataggccaggttgaagccatccacgtcggtgtcctccacccactcctgcaacaggtcggcgacggtcgccgggctgccgacgaacagcggtccgaagccgccgataccgacccagtcggccagctcgcggaccgtccaggtgcgcgtcggatcggcgctggaaaacgcttccaccgccgattggatcgcattggtgtggatgtgccgcagcacctggtccggccgatactggccgaagtcgatcccggtccagccggagatcagcgccagggccccttcgtagctgacgaaggcgcggtattcgtcgaacttggccctggccttggcgtcggtttcgcccagcaccaccgtctgcaggttgaacaccagtaccttgcgcggatcgcggccggcctcggcgacgcgctggcggatgtcggcgaccgcctgcttgagcacggtcttcgatggcgcggcgacgaacacgcactcggcgtgctcggcggcgaagcgcttgccacgactcgacgcgccggcctggtagagcaccggcgtgcgctgcggcgacggttcgcagagatggatgccgggtacctggaagtgctcgccgacatggcggatctcgtgaatcttgcccgggtcgctgaagatccttcggcgacggtcgcggagcaccgcgccgtcctcccaactgccttcgaagagtttgtagagcacctgtag

SEQ ID NO: 8729 - DNA, 870 bp, Pseudomonas aeruginosa
gtattcgtcggcatagtcgtagcggcggtcgtggtcgagctgggcctgctgaccgaggttgcgcgcgccgctttccaggtaggaggtcactacgttccagccgatccggcccttggtcaggtggtccagggtcgagagtcggcgggcgaagggatagggatgctcgaaggacagcgaggcggtcaggccgaagcccaggtggcgagtcaccgcggccatcggcgtgatcagcgccagcgggtcgttcaccggtacctgggcggcctggcggatcgccgcgtcgccattgccgtcgagcacatcgtagatgcccagcacgtcggcgatgaacagtccgtcgaaacggccgcgttcgagcaaccgcgccaggtcggtccagtactccaggtccttgtactgcgaggagcggtcgcgcggatgcgcccagaggccgggcgactggtggccgacacagttcatttcgaaggcgttgagacggatttcgcgcggcatggggactccttggcttgcctgtgcatccggcaccccgtgcacagcccgtgccgggccgcggggccgcgccggacaaggcctgggtggcaagcccctgtcgctgtgcgggcgcaactgctgggcaagtgttggtggatcaacacattcgcccgccccacccgagccccgaaccccgtagggcgaatagcgccccagcgctatccgccagcgcactggaaccccgtccggcggatagccgcgagcggctattcgccctacccgaacctctccattacccgtagggcgaatagcgccccggcgctatccgccaacgcaccggaaccccgcccggcggatagccgcgagcggctattcgccctacccgagcatccccattga

SEQ ID NO: 8730 - DNA, 861 bp, Pseudomonas aeruginosa
ccgcgagcggctattcgccctacccgagcatccccattgacccgtagggcgaatagcgccccagcgctatccgccagcgcaccggtaccccgtccggcggatagccgcgagcggctattcgccctacccgagcgccccgtgcgcccagcgccggtagagtccgcgcgccgccgcgtcgagcaggtagccgagcaggccgatcagcagcaccatcgccatcagctcggagtacgccaggcggtcgcgggtgtcgaggatgtagtagccgagcccggcgctgacgccaagcatctcgcagggcaccaggacgatccagaggatgccgatggccaggcgcacgccggtcagcacatggccgaggatgcccggcaggatcacccggcgcagggtttcccagggcgtggcggcgaggctgcggctcagttgcagccagcgcgggtcgagctggcgcacgccggcggcggtattcagcaggatcggccagagcgcggcgaaggccagcaggaaatagatcggctggtcgcccacgcccatcagcatcaccgcgatgggcatccacgacagcggcgagatcatccgcaggaactgaaacgccggagtggtcgccgcttccaggttgcgcgaggcgcccaccagcagccccagcggcactcccaccagcagcgccaggaacaagcccagcaggacccgtttcaggctcaccagcacgtgctcgtagagttcgcggcgttccagcagttcacccaggctgagcaacgtcgcctgcggcgagaagcgtgccgaaaggccgtcggcggcgccgaacagggccacgccgagccaccacagggcgaacagcgtcaacagcccggcgacgcctag

SEQ ID NO: 8731 - DNA, 2304 bp, Pseudomonas aeruginosa
caggatgcgttcggagagcagcagggcctcgtcgatatcgtgggtgatcaggaccacggcggtgccgcgctcgtggatcgcccgcagcagcagctgctgcatgtcggcgcgggtcacttcgtccagcgcgccgaaaggttcgtcgagcagcagcaccttcggctgccgcgccaggcagcgggccagcgcggtgcgctgggccatgccgccggagagttgcgccgggtagcgggcacgggcgtgctccaggccgaccgcggcgatcgcctggtcgacgcgggcctggcgggtggccgcgtcgaggtgcggctggcgggcgaaatcgaggccgaaggcgacgttcttctccaggttcagccagggcagcaggctggggtcctggaacgccaccgcgacgcccggatgcggtccgcgcaggggctcgccgagtacccgcacgctgccggcggccggctcctgcaggccggccagcacgcgcagcaggctggacttgccgacgccgctgggaccgaggatcgagaccacctcgccggcgcccaggcgcaattcgaaatcgccgagcaccgcctgccagccggcaccgcgcggatagccgagggcgatcccgcgagcgtcgaggagcgcctcgctcatgccttggcctcggcctggcgttgcagttcggcgcgcagttgcaccaggctcggcgtaacgatcgggacgaacgccgactcgcgccagcggcgggcgaaaccggcgccgtgctcgctcaggtatgccttgccgccgctggcctgcaactccagttgcacggcattggcggcggcttcggcgagcccgatgcggatgcggaacaggcgtgccggctggctggcgaactcgccgctggccagtccggcgtgcagcgccgccacgtgtccgtcgagggtttcgcgctgtgccgccagctcgccatccaggagcgaacggctgccgcccaggtgccgctgcacttcgtccagtgcgcggcgcgccaggccgatggccatgccgcattgcaggccgaggaaggccgggcgcacccgtggcaggaactgccgggcgtcgtcgtgcaacagccagtcgcgcccgaccgccaccgcgcgcagatcgagggcggcggtgttgctgcattgcaggccgagcaggcgcaggtccgccgagcgctgcaagccggcgagtccttcgggaatcgccaggacgaagggcttgccgccctccccgtgttcgatcgccgccgccaccacgaaatcgccgctgcgcaggttggtcacccacggcaggcgaccgtccaggcgccagccggcctcctccgcgtgcgccaccacctgcagcgcctcgatcccggagaggaacttcatcgcgttggacagcccagtggcgccggccaggcggccggccagcaggtcgccgagcaggcgttggcgcagttcctggttgggactctgcaacaggtactcgatgaaggcgcgctggccccagaagacgaacgccgcggtcagcgagcgcgccgccactgcggccacccgctccaccgcgtcggcgagcgtgccgccggcgccgccgaggcgttcctccaccgccacgccgagcacgccggcggcggccaggcgcggcagcagcgcggcgggatcggcgtcgccgcggtcgagggcgtcggcctggcggtcgagccagtcgctcagggtcgggtcaagcatggtcgtcactccttgcgccggcgcggcatgccgcccggcaagcgcaggctcaggcctgcgggttggtccagcgatattgctccagctcggcattgagcggcgtgcgggcgaacacgttggcgaagttgcagagcgtcgccaggctcaccccgaggatcacttccagggcctgggcctggtcgaaaccggcggcgcggaaggcttcgaactgctcgtcggtgaccgcaccgcggctggcgatcaccgcgcgggtgaagtcggccagggcttcgtagcgggcatcgggcagttcgccgcgggcgcgcagggcctcgatcaccggctccggcaggcgcgccttgttgcgcgccaccgcggtgtgcccggcaacgcagaagtcgcagccatgggtggtggccgccaccagttgcaccacttcccgctcgggcaggccgaggctggccttggcgttcagcccggacacggtgaggtaggtttccagggcggccggcgcattggccagcacgccgagcagattcgggatataacccgagttgttcagcgcggtctggaggaacggacgcgccgcctcgggggcgttttccagggtgagcacgggaacgcgtga

SEQ ID NO: 8732 - DNA, 2127 bp, Pseudomonas aeruginosa
cagtcaccccttcatccaggacccacacatgaatcgccgacccgcgtaccgctccatcccgtcgtcccgcagcgcaccgttccgccgtcgcctgctgcccctgtcgatctgcctggcctgcgccggaggggcgcaactggccggcgccgacgacacccccgcgggcaccgaagatgcgcgccaggcgcagccggccaccaccctgcagaccgtcacggtgacctcgcggcgacgggtggaaaactcccaggatgtgcccaccgcgatgagcgtgctcggcggcgaaaccctggagagccagcgcatctaccgggtgcaggacctgcagcaactggtgccgagcaccaacgtcgcctacgtccacgcgcgccagtccagcgtgtcgatccgcggcctcggcaacaacccggccaggggacggcctggaaggcagcgtcgggctgtacctcgacaacgtctacctcggccgccccggcatggcctcgttcgaccttctcgacatcgagcagctggaaggtcttgcgcggcccgcagggcaccctgttcggcaagaacaccacggccggggtgatcaacatcggcacccgtgcgccgagcttcactccggagcgcagcgttgagatatccggcggcgaggacggctacttccaggccaggggcacgatttccggaccgctcggcgagaccctcgccgggcgcctgtcggcctaccgcacccgcgacgacggctacgtgaagaacctccacgacggcaacaccctcaacggcggcgcacgccagggtttccgcgggcagttgctgttcaagccgaacgacgacttcagcctgcgctggatcggcgactacaacgaggaagactccgacaatggtgtccttaccctgttcagcagcggccccacggtgaacggcgtgaaccgctacgaacagcgcgccgccgcggccggcgcgacgctggtggatggccatcggcgcaaggtcaacttcgactcggaccagcaggtcacggtgttccagggcggaacctcggtggaagccaactggaagctggccaacgacttcaccctcacttccatcagcgcctaccgctggtgggatttcacgccgcgcaacgacgacggcctggacgtaccggcggcctataacgccggagtctcggtgcgcgacaagcagtggtcgcaggaaatccgcctggcttcgcccagcggcggtttcttcgactacgtgctcggcgcctactacttcggccaggacctcgacaacaagtccttcaccgactacgggcccagggcagacatgtggaacggaacccccgccggcgccctgagcgacgtcagcacccgcggtcgcgggcacatcgacaccgacagctacgcgctgttcgcccagggcacctggcacctaaccgagcgcctggacctaaccgccggcgtgcgcggcacctacgaggaaaagtccgcctgggtcgaacgctacgccccgctcggcggcgccgcggtgagcggcgcggcggcggccgcgcgcaacggcagggtcggcgcctacgacagcggcgacatcggcctgcacagcgtcagtccgtccgctctgctcagcctcagctaccgcttcagcgaccaggttctgggctacgcctcgctgtcccacggcgagaaatccggcggcgtcaacctgaccgtggccagcgctcccagcgccggtgccgactcgctgctgattggcaccgagcgcgccaacgatgccgagctggggttgaagaccaccctcctcgacaaccgcctgatcctcaacggcaacctgttctggaccgtggtccacggctaccaggccaatgcctacgacgaggccaaccgcacccagtacctgaccaatgccggcgatgtgcgctcgcgcggcctggagttcgaagcgacggccctgccgatccgcggcctgaccctgaatttcaatgcgtcctacaacgacgttcgctacctgtcctacaagaacgccccgtgcgcccccgaggtggccttccaggccggcgccccggcgtcctgcgacctcagcgggcaccaggtggtcggtgcctcgaagtacatcgccaacttcaatggcgagtatcgctggaagctcgacgatggcctgtag

SEQ ID NO: 8733 - DNA, 1638 bp, Pseudomonas aeruginosa
ccctacctcaccgccagctacgcgttccgctccagggcggtgggcaccatcgacgactccgcatacggacagatccccagctacgccctggtcaacgcctccgccgggctgcgcggcgactacggggaccgccagtgggacctgtccctgtggctgaagaacgctttcgacaagacctactcgccagcccctggaaattccgccgacggggggtaccccggcgtgctcgggacgccgcgcaccctgggcgttaacgcccggctacgaattccgaacccatctgccaggaacccgccatgcccagattcccgatgctcctgctcagcgccgcgctgctcgccgccgggcgcccatgccgcgcccagcgtctaccccaccggagtgacccgctacgacccgcagaaggccttcaaccagtacgtgatcttcagcggcgcagaccgtaagacccacctgatcgacatgaacggcaacgaggtgaaacgctgggactgccccggcttccccgccgccgtgatcgacccggccctgaacggcggcaagcgcggccatgtgctgctgcaactggccgacctggccgctccggacaagctggcctcgcccggcaacggcctggccaaccaggccctcggcgagctggactgggatggcaaggaggtctggcgctggggtgaccaggcgccgggcggcgccgcccatcagcaccacgaccagcgccggctggccaacggcaacaccctgctgctggcgaacaaggtccacgcggtgaagggcttcgccgtgccccgggtaatcgatgacgtgatctacgaggtcacgccgcagggcaagctggcctggagctggaccgcttcggagcatctcgacgaattcggattcaccgccgaccagttgaagcgggtacgggccagcgagaaccccgactacctgcacatcaacaacctcgccccgctcggcgagaaccgctggcacgctgccggcgaccggcgcttcgccccggacaacctgctgctcgactcacgcaacgccaacttcatagcgatcgtcgacaaggccagcggcaaggtggtctggcgcctcggcccgaaccttccgccgatcgacccgaagagcgcccgtaagctgccgcgcccggtggaccagatcagtggccagcacgacgcccacctcattcccgagggcctgccgggcgccggcaacctgctggtgttcgacaaccagggtgacgccggttacccctcggtacagcgcgggctggtctccggctcgcgggtactggaaatcgacccgctgaagaagcagatcgtctggcaatacactgccgaggactcgcagcagcccggctgggccttctacagcgccttcatcagcagcgcgcggcgcctgcccaacggcaatacgctgatcgacgaagggcagaacggacgcttcttccaggtaacgcccggcggcgagatcgtctgggagtacgtcagcccctacttcggcaaggcgccgcgcggcgacgcccggagcaactgggtctaccgcgcgctgccggtggcctacgactgggtgcccgaaggtacgccgcgcgaggagaaggcggtgaacctggcggttcccggcgccacgccgcaggtcacggcgcggcgttga

SEQ ID NO: 8734 - DNA, 519 bp, Pseudomonas aeruginosa
tcggcaccctggccaacgccttcggcgcacgctggttcgacgagcgatggcagcccgaattcagcggcggcgaatggaagaaggctctcgacttctatgtctccaccctcaagcggtacggcccgcccggcgcctccagcaacggattcaacgagaacctggcgctgttcaacagcggcaagtgcgcgatctgggtggacgccagcgtcgccggttcgttcgtcaccgacaagagccagagcaaggtcgccgacgccaccggcttcgccttcgccccccgggaagtcaccgacaagggcgcctcctggctgtattcctgggccctggcgattcccgccagctcgcgcgccaaggacgtggcgaaggccttcgccacctgggccacctcgcaggcgtacggcaagctggtggcggacagggaaggcgtggccaacgtgccgcccggcacccgcgcctcgacctacagcgaggcctacctggccgccgcgccgttcgcgcgggtcaccctggaatcgctga

SEQ ID NO: 8735 - DNA, 873 bp, Pseudomonas aeruginosa
tcggcaagaaccttaccgagcgcagctgaggaacccgccatgctgacactcaagcaatcccgccgcctgcgcaatgccctgctcggcctgctctgctggggcatcgccctgctgctgttcttcccgatcttctggatgctgctgaccagcttcaagagcgagatcgacgccttcgccacgccgccgcagttcatcttccagccgaccctggagaactacctgcacatcaacgagcgcagcgactacttcgcctacgcctggaactcgttgctgatctcctcctcggcgactctcctgtgcatgctcgtcgcggtgccggcggcctactccatggccttcttcgagacccgccacaccaagcgcacgctgctctggatgctgtcgaccaagatgcttccgccggtcggcgtactgatgccgatctacctgctggccaagcagttcggcctgctcgattcgcggctggcgctgatcatcgtctacaccctgatcaacctgccgatcgtggtctggatggtgtacacctacttcaaggacatccccgtggacatcctcgaagcagcgcgcctggacggcgccggcacctggcaggagatcgtccgcgtactgctgccgatcgcccgcggcgggctcgcctcgaccctgctgctgtcgctgatcctgtgttggaacgaggccttctggtcgctcaacctgacctcctcggccgccgccccgctgaccgccctggtcgcctcctattccagccccgaaggactgttctgggccaagctctcggccgtctccaccctcgcctgcgcgccgatcctggtcttcggctggatcagccagaagcagctggtacgcggcctttccttcggcgccgtgaaatga

SEQ ID NO: 8736 - DNA, 1152 bp, Pseudomonas aeruginosa
agcgcatccccatcctttcgtccacggaggtattccgccatggctgatctcaagatccgcaacctgcagaaaggcttcgacggccaggccatcatcaagggcatcgacctcgacgtccgcgaccgcgagttcgtagtcttcgtcggcccctccggctgcggcaagtcgaccctgctgcgcctgatcgccggcctcgaagaggccagcggcggcagcatcgccctcgacggcacggacatcaccgacaccccgccggcgaaacgcgacctggcgatggtcttccagacctacgcgctgtacccgcacatgacggtgcgcaggaacctctccttcgccctcgacctggccggcgtcgacaagcgcgaggtcgccgccaaggtcgacgccgccgcacgcatcctcgaactgcaagcgctgctggagcgcaagccgcgccagctctccggcggccaacggcagcgggtggcgatcggccgggcgatcgtgcgcaacccgaagatattcctcttcgacgaaccgctgtccaacctcgacgccgccctgcgcgtgcagatgcgcctggaactggcgcggctgcaccaggaactggcggcgaccatgatctacgtgacccacgaccaggtcgaggcgatgaccctggcggacaaggtcgtggtgctcaacggcgggcgcgtcgagcaggtcggctcgccgctggagctttaccaccatccggccaacctgttcgtcgccggcttcctcggcacgccgaagatgggcttcctgcgcggccatctcagccgcaaccagggcgagcgctgcgaggtcgccctcgaatgcggcgcgcgcgtcggcctgccgctatgcgccggcgagctggccaccggcagcccggtgaccctcggcatccgcccggaacacctgaacatcgcccgcccgggccatgccttccagagcctgctgcgggtcgccgccgacgtcagcgagcgcctgggcagcgacagcttctgccatgtccgcgccgactcgggggaaatgctcaccctgcgcgtgcgcggcgatttcgcaccggactacggcgcccccctggagctgggcttcgatccggagcactgccacctgttcgacagcaacggccaggccctcgacaaacgactgcaacaggcggcctga

SEQ ID NO: 8737 - DNA, 606 bp, Pseudomonas aeruginosa
agccgccagcgggaacccaccgatgaaactcaaccggcagcacctccccctgctggcgaccgctgtcgcccgcccgtcctacgaccccgcgcaactgcgccagggcatcgtccacatcggcgtcggcggcttccaccgcgcgcaccaggcggcctacaccgacgccctgatgaaccgcggcgaagccctcgactgggcgatctgcggcgccggcctgcgcagcgacgaccgcgccatgcacgacgccctggccgcccaggactacctctacaccctctacgagctgggcgaccaaccggacaccgaggtccgcgtgatcggcgccatcagcggcatgctgctcgccgaggacggcgccgaggcgctgctggaaaaacttgccgagccggccatccgcatcgtctcgctgaccatcaccgaaggcggctactgcatcgacgatggcagcggcgagttcctcgccgagttgccgctggtgcgccacgacctggccaacccgcggaccccgcgcggggtcttcggctttctctgcgaggctctgcggcggcgccgcgacacaggcgtgccggcgttcaccgtgatgtcctgcgacaacctcccgcataa

SEQ ID NO: 8738 - DNA, 2397 bp, Pseudomonas aeruginosa
cggcgaggtggcgcgcaaggcgctgctggccttcgccgaacggctcgacccggggctggcgcgctggatcgcgacgcacgtcagctttcccaacgccatggtcgaccgcatcaccccgatgaccagccccgcccaccgccgccaactggcccaacggcacgacgtggaagacgcctggccggtggtctgcgaacccttcgtgcaatgggtgctggaagatcgtttcagcgctgggcgcccggcctgggaaaaggtcggcgtgcagttcaccgacgacgtcacgccctacgaggagatgaagatcggcctgctcaacggcagccacctggcgctcacctacctgggcttcctgcgcggctaccgcttcgtccacgagaccctcggcgacccgctgctgcgccgctacgtgcgggccttcatggaccgcgacgtggccccgctgctggcaccggtaccggggatcgacctggaacgctacaaggacagcctggtcgagcgcttcgccaaccgcgccatcgcagaccaactggaacgggtctgctcggacggctcgtcgaagtttcccaagttcatcgtccccaccgccaatcggctgatcgccgccggccggccgctggaacgggtggccctggtggtggcggcctgggcgctgtacctgggcggggtcgacgagcatggcgaacgctacccgattcccgatccgcgcgccgccgaatgccaggcgctggttgccgaacgccgcggcctgggccggcgcctgctcggcgtggagaccgtgttcggcccggcgatcccggcctcggcggccttcgtcgaggccttcgagcggctctacgacagcctgcgccgacacggcgtcagcgaaaccctgcgccaggtactcggcgaatgacgccggagggccgcatgcacggattgttcctcggcatcgattgcggcacccagggtagcaaggcgctgctgctcgacgccggcagcggccgcacgctgggcctgggcagcgccgcgcagcgcccgccggaaggccgtgacggacgccgcgagcaggatccggcggactggctggaagccatggccagcgcggtacgcatggccctggaagaagccgcggtggacggccgcgaggtccgcgccctggcggtttccgcccagcagcatgggctgctcctgctcgacgccgagggccgggcgctgcgcccggccaagctctggtgcgacaccgagagcgcggcggaaaaccgcgagctgctggaagccctcggcggcccggccggctcgctggaacgcctgggactggtgctcgcgccgggctacacgctgtccaagctgctctggagcaggcgccgctttcccgagctgttcgcccgcgtcgcgcacatcctcctgccccacgactacctcaaccactggctcaccggccgcgtctgcagcgaagcgggcgacgcctccggcagcggctacttcgacgtgcgccggcgcacctgggccagcgacgtgctggagctggtcgagccgggcggacgcctggcggcggcgctgccggagctgatcgagcccggcgcctgcatcggcaacctgcgccccgaagcggccgccgccctcggcctggctccccacacgcgggtcgcctgcggcggcggcgacaacatgctcgccgccatcggcaccggcaacatccgccccggcctgctcaccgccagcctgggcacctccggcaccctgagcgcctatgccgagcggccgctggtcagtccgcacggcgagctggcgaccttctgcgcctcgtccggcggttggctgccgctggcctgcacgatgaacctcaccggcgcctgcggcctggtacaggacctgctgcacctcgacctcgacgaattctcccggctggccgcccaggcgccggtcggcgccgagggtctgctgatgctgccgttcttcgacggcgagcgggttccggcgctaccgcacgccagcgccagcctgcatggcatgaccgcggccaacctgagccgcgccaatctttgccgggcggtgctcgaaggcaccgccttcggcctgcgctacggcctcgacctgctgcgcgccagcggcctgccgggcgaggaaatccgcctggtcggcggcgcggcgaagaacccgctgtggcggcggacgctcgccgacctgctcggcctgccgctggtctgtccgcggcagaccgaggccgccgcccttggcgcggcgctccaggcggcctggagcctgggccgcgaaagcggcgccggtgaaagcctggaagccctgtgccggcgctgcgtggcgctcgacgagtcgacccgcacccagccccaggcgcgacaacaggcggcctacgaacaggcctaccggcgttacctggagcacctgcctccgcgataa

SEQ ID NO: 8739 - DNA, 672 bp, Pseudomonas aeruginosa
tggtcgctttccttcctcttctggcgttttggagatctgcatgtacctggtgtgtggcgaggcccttttcgatgtcttcagcctggaaagcgctgcgcgcagcaacgagctgggcttcaccgcgatcgccggcggctcgccgttcaacgtcgccgtcggcctgcgccggctgggcgtggaggcggcgctgttcggcgggctgtccagcgactacctgggcacgcggctgcgccgggtgctcgaagaagaaggcgtggactgcggcttcctggtgcccagcgacgccccgaccaccctggcgatggtcggcctggacgccagcggctcggcgcaataccagttccgcggcgacggctgcgccgaccgccaggtgcgcctggaacacctgccgacgctggatgggcggatacgcggtttgcacgtcggatcctataccctggtggtgacaccggtggccgacaccctgctggcgctggtccggcgcgagagcggccggcgcctggtcagcctggatcccaacgtgcgcctcgacccgcagccggacatcgacctctggcggcgccgggtcgaggccttcgccagtcatgcgcacctgatcaaggccagcgaggaagacctggcccttgttttaccccggccgcgcccccggcgaggtggcccgcggctggctga

SEQ ID NO: 8740 - DNA, 1239 bp, Pseudomonas aeruginosa
accatgaccgacgaaaccgcacccaaggatcttcgtgaccaggcgccccggctactcccggcacgcctcatcgagaacgacgcccaggcgttgcaggccgcccacgaggtagccggactggcccgtcgcgaagcggcgctacgcgaccgcgaacgacgcctgccctggcaggaactggaactcttcacccgcctcggcctgggcggcatcggcattccccgcgcccatggcggcgcgcaggtttcccatgtgaccctggccgaggtgttccgtgtcatctgtgccgccgacccggccctcggacagattccgcagaaccagttcggcctgctcagcgtgatcgacaacgtcgccagcccggcgcagaaacgcaagctgttccgtggcatcctcgacggccgccggctggccaacgccggcccggagcgcaatacccgccacaccctggagctgaaggcgcgggtccgtcgcgacggcgacggctaccgggtcagcggcgagaagttctactccaccggagccttgttcgcccactgggtggcggtcaaggccatcgacgaggaagagcgcgcggtgatgctcttcgtcgagcgcggcgctcccggcctgcgcatcgtcgacgactggtccggcttcggccagcgcaccaccgccagcggcacggtactgctggacgaggttccggtagccggcgacatgctgatccacaacggcctgctggccgagatcccgagcctccagggcgccgtctcgcaactgatccaggccgccatcgacgccggcatcgcccaggcggcgctggacgacgcccaggctttcgtccgcgaacgcagccggccctggatcgacgcccaggtcgaacgcgccagcgatgagctctacagcatcgccgaggtcggccgcctgcaaatcgagctgcacgctgccaacgccctgctggagaaggccggccaggtcctcgacgaagtggccgcgcggccggtggacgccgagtcggcggcacgcgcctcgatcgccgtggccgaggccaaggtgctgagcaccgagatcagcctggccgccagcgagaagctcttcgaactggccggcagccgtgccacgctcgccgagttcaacctcgaccggcactggcgcaacgcccgcacccataccctgcacgacccggtgcgctggaaagtccacgcggtcggcgactactacctgaacggcgcccgtccggcgcgtcactcatggatctga

SEQ ID NO: 8741 - DNA, 885 bp, Pseudomonas aeruginosa
ggagcgcccgatgagcctcgcacacgctacgcgcgacaatcccacggccgctgcccatcgcatcggcagcgacgacgaagccctggaaacggcccgcgagctggccgccctgttcgcccgcgaaagcatccagcgcgaccgcgagcggcgcctgccgctggaagaactggaactgttctcccgctccggcctgtggggcatcgcggtgccccgcgaatacggcggggccggcgtctcgcgggtgaccctggcgaaggtggtggcgatcgtcagcgccgccgacagttccctggggcagattccgcagaaccatttctacgccctcgaagtgctgcgggtgaacggctcgccggcgcagaaaggtcgcctgttcggcgccgccctggccggcgagcgtttcggcaacgccctggccgagatcggcacgcgtaccgccagcgagcgccgtacccgcctgcgcgccgacggcgacggctaccgcctggacgggcgcaagttctactgcaccggcgcactctacgcgcagcgggtgccgaccctggcggtggacgacgagggccgccagcaactggccttcgtcccgcgcgacagcgccgggctggaaatcgtcgacgactggtccggcttcggtcaacgcaccaccggcagcggttcggcgctgttcgaccgggtagcggtggccgccgaggacgtggtctcgttccaggacgccttcgagcgcccgaccaccgtcggcccgctggcacagatcctccacgcggcgatcgacgccgggatcgcccgcggcgccttcgaggacaccctgcgtttcgtccgcgagcgcgcccggccctgggtcgactccggcgtcgacaaggccagcgacgacccactgaccatccatga

SEQ ID NO: 8742 - DNA, 1749 bp, Pseudomonas aeruginosa
gatcggccgcctggcgatccgcctgcacgccgccgaagcgctgctggagcgtgccgggcgggtgctcgaccgggccaccgccgagccggacgcggaaagcgtggcggccgcctcgatcgccgtcgccgaagcccgcgcgctgaccaccgaggtcgccctgctggccggcagcaagctgatcgagcttggcggcagccgcgcctgtctcgccgaactcggtctcgaccgccactggcgcaacgcccgcgtacacaccctgcacgacccggtgcgctggaagtaccacgcggtcggcgactactacctcaacggccgcctgccgccacgccgcggcacgctctgaacgccgaagggaccgccatgagcaagaagcagattctcctaaacgccttcagcatgaattgcgtcggccatatcaaccacggcctctggacccacccacgcgaccgctccagcgactaccgcaaactgcgccactggaccgagctggcccggctgctggagcgcggcctgttcgacggcctgttcatcgccgatatcctcggcgtctacgacgtctaccagggcggcatcgaggtgaccgcccgcgaagccgtccagttgccggtgaacgacccgctgatgctggtctcggccatggccggggtcaccgagcacctgggtttcggcgtcaccgccaacctcacctacgaggcgccctacccgttcgcccggcggctctcgaccctcgaccatttgagcgacgggcggatcggctggaacatcgtcaccggctacctggaaagcgcggccaaggccatgggccagtccgcgcagatcgagcacgaccgccgctacgaccgcgccgacgagtacctggaggtcctctacaagctctgggagggcagctgggaagacgacgcggtgctcgccgaccgccagcgacgggtctacgcgcggccggagaagatccacaagatccgccaccatggcgagttctaccaggtcgagggctaccacctcgccgagccctctccacagcgcaccccggtgctgttccaggccggctcctcggagcgtggcctggccttcgccgcgcgccacgccgaatgcgtgttcgtctccggacagacccgcgaggccacccgccagttggtgcagcgcatccgcgcggcggtggtcggcgccggccgtcgcgccgaggacatcaggatcttcatgggcatcaacgtgatcgtcgcagccaccgcggccgaggcccgcgacaagcatgccgagtaccgccgctacgccagccccgaggccggcctggcgcacttcgccagctccagcggcatcgacctgtcgcgctacggactcgacgagccgatccgctacgagaagaacaacgccatcgagtcggtggtgaagaacctcaccgtggcgcgcaccgactccaccgtgcgcaagctcctcgaccagttggccctgggcggccgctacgtgaccctggtaggcgacccgcgccaggtcgccgacgacctcgaaggctggatcgccgataccggcctggacggcttcaatctgacccgcaccgtggagccggagagctacgccgacttcatcgacctggtggtgcccgagttgcaggcacgcggcagctacaagaccgcctatgcccccggcaccctgcgggagaagctcttcggcggcggccgcgcgcgcctgcaggcggaacacgccggcgccgccttccgccagcccccggccgcgcgccagcgccaggcctga

SEQ ID NO: 8743 - DNA, 1968 bp, Pseudomonas aeruginosa
ccccactttccctttcgttcaggagcccaccatgctgaacaccttgaaaaccctgagcctggccgtcctcctcggcagcggcccggcccaggccgccgacgccccgctgaagatcggcaccaccgccgccttcgccccgccgctggaagtcgccgtgagcgaagccggcaagcagggactgaaggtcgaactggtcgagttcagcgactggaacgcccccaacatcaccctcgcccagggcgacatcgacgccaactacttccagcacgtgcccttcctggaaaacgccaaccgcgaaggcggcttccagttgaagccgttcgcgccagggatcatcaacaacgtcgggctctattcgaagcgctacgccagcctcgcagagttgccggaaggcgccagcgtggccatcgccaacgacccgatcaatggcggccgcggcctgcaactgctacagaaggccggcctgctgaagctcagggacggcgtcggctacaaggcgaccctcgacgatatcgtcgacaacccgaaggacatccgcatcaccgagctggaggcggtacaactggcgcgcgccctcgacgatttcgacctggcccagggctacccgcactacctgcgcctggccgggaccatcgacccgacccgggcactgctgttcgacgggatcgacaaccgggaatacgtgatccagttcgtcacccgcggcaactaccaggaccgcgacggccgcctggcgcgcttcgtcgacatctaccagcattcaccggtggtccgcgccgcgctggacaaggcccatggcacgctgtaccagccgggctgggagtgacggccatgaccgttcccccgagcctgctgcccctcgaaccgttcccgacggcgcccgacacgcgcgcctccacgccgcacatccgtctccaaggcctgggcaagcgctaccccggtggagtccaggccctgcgggagatcgacctggaaatccgccgcggcgaagtgttcggcatcatcggccgcagcggcgccggaaagtcctcgctgatccgcaccctcaatcgcctggagcgtcccagcgaggggcaggtgctgatcgacgacgaagacatcggcggctacgacggccagcgcctggtcgccctgcgccgacgcatcggcatgatcttccagcacttcaacctgatgtcggccaagaccgtgtggcagaacatcgccctgccgctgcgggtggccggggtgccccgggcacggatcgaggagcgggtcgccgggctgctgcaactggtcggcctggaggaaaaacgcgacgcctatccggcgcagctctccggcgggcagaaacagcgcgtcggcatcgcccgcgcgctggtgcaccagccgcagatactgctctgcgacgaagccacctcggcgctggacccggagagcacccaggcgatcctcgcgctgctgcgcgacatcaaccgccggctgggcctgaccatcgtcctgatcacccacgagatggcggtcatccgcgagatctgcgaccgcgtggtggtcctcgaatgcggccgcatcgtcgaacagggcgaagtctgggaagtcttcggcgatccgcgccatgcccgtcacccgaagcctgttcggcagcctgcgcgccgccctcccggccgacctccaggcgcgcctgcgccaggctcccggcgccggcgacccggtgctgctcgatctccagtacaccggcgccagccgacgggtgccggacctgctggccatcgccagggccatcggccagcgcgtcgacctgctccacggcggcatagagcgtatccagggccgcgccctggggcgcctgctgctacaggtcggcgcgccgcccggcgagcttcccggcgtgctggccaaggccgcgctggtggcggacaaggtggaggtgctcggccatgtcgcccatgcttgaacggctctggcaaggtttcctcgatacgctgctga

SEQ ID NO: 8744 - DNA, 300 bp, Pseudomonas aeruginosa
gcagcttcactctcgccgaactcaagcgcctggacgccggctcctggttcaatcgcgccttccccgagcgcgcccggcccggcttcgtcggcctgcgcatcctcaccctcgacgagatgctcgacatcgccgagggcggcgccaacaagccgggcctgtacctggagaccaaggtaccggcgcaattccccggcatcgaagacgacctgcgcaagctgctggaacgccgcggctggctgcaaccccgcgagcgcgccgccgccgggcatgtcgacgtggcccacggcaatggccgggtga

SEQ ID NO: 8745 - DNA, 1281 bp, Pseudomonas aeruginosa
ctggttcagcgcccagtcgcccagctcgcggatcttgtagtccagcgggtcgtgcagggtctgggtgcgcaggttgcgccagtagcggtccaggcgcagggcggcgtgagtggagcgggcgccggtgacttcgaacatgcggttgcacaggtcgaggccgttgcgcgtcgcggcgaccttggcggcggcgatggccagggccaactggccgcgctcgctggcgtccagcgccgggcccttggaccaggcggcgtcgaggcgctgcgcggcgcgctcgaccagcgcccgggtgctttccaggccgacccagaattcgccgtagcgcgccagcacataggggtcggcattggcctcggcgacctcggagcggaaccacggtcgcgcttcgcgcagggtgtactggcgagcctcctcgaaggcgccttcggcgatgccgaggaacacctcggtgaagatcaactgggcgatcagcggccgcaggcaggcgaacggcgtgctcagcggcccgggatcgagcagcaactcgctctcctccacccgcacccgctcgaagatcgcgctgccgctgtcggtctgccgctggcccatgttgtcccaatcctggcccaggctgataccgctgcgcgcggtggggatggcggcaatcagcagcgccccgccctcgccgtccagtgccgaggcgatgagcatctccgaatcgcgggcgccggagcagaagctcttcttcccggagaactcgcgccagccgtcgaagcgccgggccacggtacggttgtccagcgggttcagcgcgttgccccagaaccagcggttgcgcgcggtcagctcgaaccacggctgccattgctcgggccgcgagaacaggcgcacggtggccagcatcaggtgctggaagccatagacgtgggcgatcgagctgtcgacccgggccagttcgcgcacggtttgcagggtttcgctccagctcgcccccaggccgccgtattcgcgcgggatgatcagcgacaacaggccgctgcggcgcaacgcgtcgcgctcggccttcggggtaccgccggcgacgtcgcgctcggcggcgttctcggcgaaatcggcggccaggcgccgggcgatctgcaacggcgtttgcgcctcggggcgggtcttcgcattcacagggggtttctcctcgggggcccggctgctcaagcgccggcgcgagccggcagcacgtcgttggcgatcatttcgccgaacggcccggtcaggttggtcagcccacggccggccaggctggcgtag

SEQ ID NO: 8746 - DNA, 414 bp, Pseudomonas aeruginosa
ccggagaagatgaagctgtcgatgccgagctcggcgtattccccgatgcgctccgccacctgccgcggatcgccgaccagcgcggtgccggcgccgccgcgcaccaggccgaccccggcccagaggttcggctggatctccaggcgatcgcggcggccgccgtgcagcgcggccatgcgtcgctggccttcggagtcgaaacgggcgaaggactgctgcgcggcggcgatggtctcgtcggagatgtgttcgatcagcctgtccgcggcgcgccaggcttcttcggcggtttcgcggacgatcacatgcaggcggatgccgaacttcaccgtacgcccatggcgagccgctcgctggcgcacgtcggcgattttcgccgccaccgccggcaacggctcgccccaggtcaggtag

SEQ ID NO: 8747 - DNA, 1341 bp, Pseudomonas aeruginosa
cgctcggcgtggccgagatggatgccgtcgccgcggttctcgtcgggatcgccgccggtgaccacgttgatcagcaggcgcccgccggacaggcggtcgagggtcgccgccatccgcgccgagacggtcggcgaaacgattcccggacggcatcgccaccaggaagcgcaggcgctcggtcagcggcgccagcgccgaggccaccacccaggagtcctcgcaggagcgtccggtggggatcagcacgccgtgatagccaaggctgtcggccgcctgtgccacctgcttcaggtaaggcagcgagaccggccgcgcgccctggctggtgccgaggaagtggccatcgccgtgggtcgggaggaaccagaacacgttcatcggcgcacctcaggcgatcttcaacagttcggagcgtccgccgaacagcggcgcggcgcgctcggcggcgaggcggatgcgcgccttcagcggctcgctgacgatccggtagttgtcgaagtcggcctcgctggcgtaaaccccgatgggcagggtgatcgcctggaagaagctgaacagcgggcgcaactggtggtcgaggaccagcgcgtggcgctcggtgccgccagtggcggcgagcagcaccggggtgtcgatcaaggcgttgaggtcgatcaggtcgaacaggtgcttgagcaggcccggataggagccacggtagaccggcgaggcgaccagcagcaggtcggcgctttcgatctcgtcgagcaccgcctgcagttccgccggcgcctggttgcgcgccagggtagcgcccagcggcgcggcgatgtcggtcagctcgatgacccggctgtcgatcggcaacgactggccaagctcggcgatcagggcctgggtgagtaccagggtgcgggacgggcgataggtgccgccggagacggcgacgactttgaaggggctggtcatgggatttccctgtggactgttgcgctaggtgcagtgccctggagcaagggccgtaccaacggggaaatgtgcattttccgggcagttgcggcgggtttccggcctcggcctgtcagccacgcaacagcgctgctgtccgactgttgcccgggcaacagttcagttcagcttgtaggcctggagcaggaatatctggaatgcccgcgccgaatgctggtcgcccggcggcagaacgaacggcggcaggcgccccttgcggcgcttgacgtcggcccagcgctggccattgcgcgaatggaactggcagaacggctggtcgcccaggtagaacacccccggccgcggctcgcggatgcgcggccagcggcgcaggcaatccagcagcgggcctag

SEQ ID NO: 8748 - DNA, 459 bp, Pseudomonas aeruginosa
cgcaggctggggccgcacggctgtccggggtcgatcggttcgagcagcacttccagggacagggcgttgccggaaagaggcagggtcatggggtacctcccgtgctggcgacggtggccggcaacagcgtcgcgaacggcgattgcggcgcgcgcaccggcagcggctggatggacagcggggtcttgccgcccaggctcatcaacgacaggcggaggaacatccgcgcctcgttttccgggctgtagggcgcatacaccggcagttgcaggaccagcggaaactccgtgtagtcgacgttcggcgggcgctgccgggagaagtgcgcgcgcatcatgcgcaacagcgcccaggagccctggtagctccagccggcctcgaggtcggccaccgccaggctggcctggcgcgggtcgtctgccggacgctgcgagccgttcttcgcccagcgcagcatga

SEQ ID NO: 8749 - DNA, 573 bp, Pseudomonas aeruginosa
agcgccagcgcggcgcctgtgacaccagttgccaccaggcctggacgttctgccggacctgggcggcgcgccgagtgtcgtcgtcgagcggctggtagcgctcactggcgccatgcagcagttgcgacagttcaccggcgtcgcgcagcgcgtcgcgccagacccaggtcatcaggccgccccagagcaggcacaggcacaacgcggcgaggccgatcccgcgctgccagcgctggcgcagctggaggatgcgcggcaccgcctgggccaggccttcctcggcaaggatccgccgtgcccacagttggctggcgaagctgctgcgccgacgcggcgcgtcgaccgccggcaggacatcgtcggctgccgcgcccgccgcctcgctgccgctcaggtagagaccgcgaaagcgcggcgcctcgcccctggcgttgccctggaagaccggttcgagcagcgcctgcaacgaaccgcggaggctttccaggcgtggcggcaggcaatacagctcattgtccacctggccgcgcaaggtaccgagttcgacgatcgactcggtcagggtggcggtga

SEQ ID NO: 8750 - DNA, 522 bp, Pseudomonas aeruginosa
tcaccacgtaaaccggcaggctcaggccaaggcgctgggtcagttccacgtagcgacggcgcgcggcgaggccgaggttggccgcctgctcgccatcctgcaaccgcgccagcggaatgttccagaccaccccgtccagcgcgcgcctgccgcgcaggcgcaggaacagacgcaacaggcgcagccaggcgccgctttgccggcgcaggccctcgtcgggcaggaacaccgactcgggcaccagcaggatcgccccctcgccgtccgaccaccagcggccgaaccaggccggacgcgccaccggcagcaggcgccaggtggcgcacaactgctcgccctcggtctcgttgccgagcatcagcagccagggcgattcgtagcggccctgccagccctgctcgcgctccatctgccggaccgccgcgtagaagctgcggatctccgtaccaccgcgggttcgccaccaccagcccagcgcccccagcagcagcgccagcagcaccaggaggagaaccagcatga

SEQ ID NO: 8751 - DNA, 417 bp, Pseudomonas aeruginosa
cggaccagagggatcgccaaggacaggttctgcgccgttttccctgtcatgcctgtgatccagcaagggactgcgatgatcagggcatccccccgatgcattgctcccccaccattgcatcggagtcagccgccatggccgagagtacgcagcacaagctggaccgggtgcgcccgccgcgcgtgcagatcacctacgacgtcgagatcggcaacgccatcgagaagaaggagctgcccctggtggtcggcatcctcgccgacctctccggcaagccggataccccgccggcgaagctggtcgaacggcgtttcgtcgacatcgaccgcgacaacttcaacgagatcctctcctccatctctccccgcgccaccctgcaggtcgacaacaccatcagcggcgacgacagcaagctga

SEQ ID NO: 8752 - DNA, 1656 bp, Pseudomonas aeruginosa
ccaagctcgacggcaacgacgacctcgaccagttgctgcaggacgtggtggccaacaccgaaggcctgcaggaaatcaaagcggcccgcccggaagccgaagcggccccggccggcgacagcgaacccccggccgaccagccggcctgaccctcttcccggagaagccgccatgcccaagtcatccgccgccgaacaatccggcgagagttcgacccagaccctgtccctgctcgacgagatcatcgcaaagggccgcatggcccacgacgacagccagcaggactatgcccgcgacatgctcgcggaattcgccacccaggtcctcgacgagggcatggccgtcgacaaggacaccgtggcgatgatcaacgaccgcatcagccagatcgatgcgctgatcagcgaccagctcaaccagatcatccaccaccccgagttgcagaagctggaagcctcctggcgcggcctgcaccaactggtgagcaacaccgagaccagcgcgcggctcaagctgcgcctgctgaacgtcggcaagaacgaactgcagaacgacctggagaaggcggtcgagttcgaccagagcgcactgttcaagaagatctacgaagaggaatacggcaccttcggcggacaccccttcagcctgctgatcggcgacttcaccttcggtcgccatccgcaggacatcggcctgctggagaagctgtcgaacgtcgccgcggctgcccacgcgccgttcatcgccgccgccagcccacgcctgttcgacatgaacagcttcaccgaactggccgtaccgcgcgacctgaccaagatcttcgagagcctggagctgatcaagtggcgcgccttccgcgagagcgaggattcgcgctacgtgtccctggtgctgccgaacttcctcctgcgcctgccctacggcccggagacgcgcccggtggaaggcatgaactatgtcgaggacgtcaacggcaccgaccactccaagtacctctggggcaacgccgcctgggtcctggcgcagcgcatcaccgaggccttcgccaagtacggctggtgcgcggcgatccgcggcgcggaaggcggcggcgcggtcgagggcctgccagcgcacacgttccgcaccagctccggcgacctgtcgctgaaatgcccgaccgaagtggcgatcaccgaccgccgcgagaaggaactcaacgatctcggcttcatttccctgtgccacaagaagaacagcgacgtggcggtgttcttcggcggccagaccaccaacaaggccaggctctacaacaccaacgaggccaacgccaacgcgcgcctgtcggcgatgctgccgtacgtgctggcggcatcgcgcttcgcccactacctgaaggtgatcatgcgcgacaaggtcggcagcttcatgacccgcgacaacgtgcagacctacctgaacaactggatcgccgactacgtgctgatcaacgacaacgcaccgcaggaaatcaaggcgcagtacccgctgcgcgaggcgcgggtggatgtcagcgaggtggccggcaaaccgggggcctaccgcgccacggtgttcctccggccgcacttccagctcgaggaactcagcgcgtcgatccgcctggtcgccaacctgccgccgccggtagcggcgtga

SEQ ID NO: 8753 - DNA, 876 bp, Pseudomonas aeruginosa
gctcgcccccgccggcaccgccggcggggcgcccttcccgttccagacagcccctctccaggagtcagatgcgatggatgcgatcattctcgatttcggcagcgacatcaaaggcgacagcctgctcgtcggctacgaaaacaagatcgaaatcatgtcctacagccacaacgtggcgatgcaggtcaccaacgacgtcagcaactcggaacgcacctccggcaaaccccacgtcggcgaattcaccctcaccaagttcatcgacacctcgaccccgaccctcaacgagtattgctgcgccggcaagccgatcgccgaggcgaccatcaccatcggccgcaacgccgccgagggcaacgggcagatcatgcccttcatcgtctacaccctgaacaacgtggtgctctccaacgtcagcgtcagcggcggcgccggcggcaagccggtggaaaccctgtcgctgaacttcaccaagatcaagtgggagctgaccgcgcagaaggacgacggcaccaaggaaggcacggctgcctcgacctgggacctggccgccaaccagttggtcaagtgaccgagcgccgacatgtccggagccctgccgccactgttcgagcgcctcagcgccgaggccgacgaacgtccagcgttcgacgaccgggcgctggccgagtcggtccgcggcgagctgctgcgcctgctcaatacacggcgtccggcgaatgcgcgcagcggcatcctcgcctatgggctcgccgactggaccgccgtgcaacgcctgcgcgccgaagaccggcgccagctggcgcgcgaggtgcgggtggcggtcgagcatttcgagccgcgcctgcaactggccgaggtcgaggtcgaacctga

SEQ ID NO: 8754 - DNA, 426 bp, Pseudomonas aeruginosa
cctggctacggcacgccggcggcgccttcgccgagcgctatccgaaggtcgcccggcgcctgcaactggcccccggcgaatgccccgacccgcacgtcgagcgtctgctggaaggcttctcgctgctcaccgcgcgcctgcaacggcgcctcgacgacgactacgcggagttcagcgacgccctcctcgaacagctctacccgctggcgctgcgcccgctgccgtcctgcgcgatcgtccagttcgaaccggacccgacccagggcaacctcgccgagggctaccggctgccgcgcgacaccgcgctgttcgtcaccacccgcggcggcgacagcgtgcatttccgcagcagcgccgaggcgaccctgtggccgctggcgatcgacgaagcgaccctgctcggcggcgaggaggcgcaagccctga

SEQ ID NO: 8755 - DNA, 645 bp, Pseudomonas aeruginosa
gcctgcgctgcctgggcgagtaccgctgggaggagctgtcgatcgagcgcctgcgcatccacctggcggcttcgccgatgggctgcgcgatcctctacgacctgctcgccgcgcataccgtgcaggtcatggcgggggcgcccggcacgccgccggcggcgctctgcggaatgccggcgatcgtcggcttcgccgccgacgaggcgctgctgccggaggaagacggcggacatccgggcctgcgcctgctcgccgagtacttcgcctttcccgacaagttccacttcttcgacttgccgctgtccggcgcgctcgccgacggacaggcgctctacctgtacctggtcttcgatcgcgcaccgacggcacgcctgcatttgcaggcggaagacttccagctcggctgcgcgccggcgatcaacctctttccgcagacctcggagccgctgcgcccggacggcacccgcagcgagtaccgcctggtcgccgacagtcaccgcgagaacagcgtggaaatccatagcatccgcgccgtgcgctcggttgccgggagcaccgtgcagccagtcccggcgtactatggctgccgccacgacagccacctcggcacgctctactggcacgcccggcgcatcgccgggctga

SEQ ID NO: 8756 - DNA, 1047 bp, Pseudomonas aeruginosa
agacatggcaaccccaggccggctcgccgctctccctctgagtcagcggctgcgccgcacgccgcagcgcttcgaactgttgcaggcgctgctgctgctcgaacgcgagcgtccccaggcgttgccgctgggcaccggcaacgcgccgcgggcggaggccctgcgcctgcgcgggccgctgctgccgctgttcgcctcgagcgaggtggaaagcctgctcgacgacccgcagcaaccggtgctgtccaccccggtgttcggcctcggcggccccgacggcccgttgccctatgcctaccaggaatggctgcaacaacgcgcccggcagaaggaccatgcccccgccgagttcctcgacctgttccagcaccgcctgctcagcctgctctaccgggtgctgcgccaagcatccgcttggcgctcggtttccccggtgccggcggcgaccccggtgcaggccgcagctacgtgccctcaacggcctgttgccaaaagccctgcatgagcgcctggcgctgccggacagcgcggtgctggcacgcaccgcgctgttcgccggcgggcgtcgctccctggccggcttcgccgggcctggtgcgccagcacttcggcgtggaggcacggctggacgcataccagggcgcctggaaggaaatccccacggccagccgcagcccgggtgcaacgcggcgggcgcaacctgcgcctgggtcgcgatgccatagccggcacgcgcacctgggacgaacacgccggcatcgccttcagcctcggtccgctggatgcccgcgaggccgcccgcttcttccccgacggcgacgcccatggccagttggccagcctcgccgcgctgtacttcggccccgacctggattgtcgcctgagcctgctggtgagcggcggcgcgccgctgcgcctggagcgcggtacaccgcccaggctgagctggaacaccggcctgcggcgcatcgaagacggccagcggcagcgcatcgatctcgacctgcggcagccggaggtagcttgaaatggaactcgccgccctga

SEQ ID NO: 8757 - DNA, 795 bp, Pseudomonas aeruginosa
tgggccaggaggccgccctgggcgccatcgccccagggcatccaggcctatcgcgccggactcagcgacccggccaagccggtcggcgtattcctcctgccaggccccaccggcgtgggcaagaccgagaccgcctacgccctggccgacgccctttacggcggcgaacgcaacctgatcagcatcaacctctccgagtaccaggaggcccacaccgtcagccagctcaagggcgccccgcccggctacgtcggctacggcagcggtggcgtgctcaccgaagcggtgcgccgcaagccctattcggtggtgctgctggacgagatcgagaaagcccatccggacgtgctggaagccttctacaacgtgttcgacaagggcgtgatggaagacggcaccggcctggtggtggacttcaggaacaccgtgatcctcgccaccagcaacgtcggcgccgaactgctgctggacagcccggccgaacaggtcgccaccccggccttcgacgagcgcctgcgcaaagtcctgctgcaaaccttccgcccggcgttcctcgcgcgcatgaccgtggtgccttaccggccgctggaggaagccaccctggaaggcatcgtcgtggccaagctggaaaaactgcgggaacgctacaaggccgctaccggcaaacagttcgacttcgacccggccatcgtcaaggccgtgctcgccaagtgcagcgcggcgggcgcgcgggatatcgagaacgtgctgatggcgcaggtgacggggaagttggcggagtgggtactcgaatga

SEQ ID NO: 8758 - DNA, 1179 bp, Pseudomonas aeruginosa
cggctacgacggcgcccccgacaacaccatcttcctcttcgcacccaccgggctggtgttctaccgacgctgaacgcccgccgaactgccccaccttcgaggactgccgtcatgccccgaaccatcgaatactggcgccccacgaacggcctgtatcatgcgaccccacccggaatcgccgtgctgacccaggacagcgattgggaggtgctcaacgaagccaccggcttctacgaggaaagcccgtatccctccgccttcaagggacaggtgtatcgcgcgctgaactacataaacgctacgccgacgggcgcatcgctgctctggaacctctacacgacgaacaatttcgtcgacatcaccccctcgtcgctgggcaacaatgtccagtccaccaatcagcccatggcgctcaatcaggtcgccagagaaatcatcgtaggaaccggtcccggcccccagacccagatcgcgctcaatcagacaggcatcgctccgcaggcgcagacccagtggctgacctatgtcatcaacagttcgccgcattgggccctggacggcgtgccgggcaacggtggtggcctttacggctatctagagcgcgcccgccagtatgccaaccgctggatgctgctgttcgaccaccgctacttccgctggagcgacagcaatgaaggctatttcaatgagcagagctacagcggtcatttcggtatctccgcccacaacatcgccatcaccaaccacgaagtagcggcctggcttgccggacagccgctaccccaccgcctcagcgatgcccagcagaaccatgcgcggcttgcgaccatagttgcccttaaggacgtttcgccgccttcggctggctgttccgcccatgtgagatggaatcccacagcgaccaacccgctgaaccggatacgtcctccggcaatcggcctggctcatgagctgctgcatgcctactacagttgccgaggcgcacaacccggctacgacgacaaccactactccacggtactgttcgaataccgctgcgtcggcctcggcccctgggacgaagcaccattgtcggaaaatgccctacgcaaggaatggtggagctatgcctgccagcaggtgcccggaagcgacccagagaacaggaaggccatcggcaaacgcatcagttacatgtag

SEQ ID NO: 8759 - DNA, 2043 bp, Pseudomonas aeruginosa
tcgtcgccgctgtcccgacagaaacgagggacccagatgccccgtcccaccgatagcactaccagcctctccctgaccgcctcggcgctggcagccctgttcccggagcgtctggccggggaagaacgcctgaacgcactgcccggttgggaactgctgggctacagcgccagccccttagccctggacggcgcaatcgccacccatctcaccgccaccctgcacaacgacgccgaccagcgtccgctcgacggcctggtcgcggagatccgccaactccccggcgatgccagcgccgagcgctaccaggtgctgttgcgcccctggctctggtggctgacgctggccagcaacaaccgggtgttccagaacctggccaccagcgacatcgtcacccaggtcttcgaccagcacggcttcagcgactaccagttgcagctcagcggcagctaccagccccgcgaatactgcgtgcagtatggcgagagcgacctcgccttcgtctcgcggctgctggaggaagacggcatcttctggttcttcacccatgccgccggcaagcacaccctggtgctggccgacagcaacgacgccttcccgccgattcccaacggcccgcaagtggcctacctgggccaaggaatcggcgtgcgcgagttgcagggcgtgcgttcggcgcagtacagcctccaggcggtatccgggacctacagcgccaccgactacgagttcaccaccccgggcacctcgctgtactcccaggccgaggcggtttccggcgccgccggcgtctaccagcaccccggcggctacaccgccaaggcccagggcgacagcctgaccaagcaacgcatcgacggcctgcgcagccaggagacgcgcctgatcggcgagagcgactgccgctggctggtgcccggccactggttcaccctcagcgggcatgacgacgattcgctgaatatcgactgggtgctgatctcggtcgcccacgacgccagccacgcgcactaccgcaaccgcttcgaggcgatccccaaggccaccgcctaccgccccgcgcgggtcacgcccaagccgcgcatgcacacccagaccgccctggtggtgggcaaggccggcgaggagatctggaccgaccagtacggccggatcaagatccagttcccctgggaccgcgacggcaagaacgacgagacctcctcctgctgggtgcgcgtggtgctgccctggagcggcaagggcttcggcatgcagttcgtgccgcgcatcggccaggaagtgatcgtcaccttcatcgacggcgacccggaccgcccgctggtcaccggctgcgtctacaacggcgacaacgccctaccctacgcgctgccggacaaccagacgcagtccgggatcaagaccaactcgtcgaagggcggtggcggcttcaacgagctgcgcttcgaggacaagaaggacgccgaggaagtcttcctccaggcgcagaaggacctcaacgtcaacgtgctcaacgacagcaccgccagcatcggccacgacgagaccctgacggtgcagaacgcccgcacccgcacggtgaaggaaggcgacgagaccgtcaccctggagaaaggcaagcgcacggtgaccatccagaccggcagcgacagcctggatgtgaaggacacgcgcacggtgacggtgggcgccgaccagacccacagcaccggcggcaactacagccacaaggtcagcggcaacttcgagctgacggtggacggcaacctgaccatcaaggtcagcggcaccctcgccctgcagagcggcggcagcctgaccctgaagagcgacgccgacctcgccgcccaggccggcacctcgctgaccagcaaggccgggacgtcgctgaccaaccaggccggcacctccctcaccaacaaggccggcaccagcctgaccaacgatgccggcgtcagcctgaccaacaaggccggcgccgaacagacggtggacggcggcggcatgctgaccctcaagggcggcctggtaaaggtcaactga

SEQ ID NO: 8760 - DNA, 1314 bp, Pseudomonas aeruginosa
ggagaagcgcatggcggcatccggcaagctcgacctggttcgaggcgacagccatctcgccggcaacctgctcgacggcagcctggaaggtccgttgcgcatcgacgagcacgacaggccgcaggccagcctcggctaccgacagggccagttgcacggcgccagcaccctgctccatcccaacggcaaggtctccgcgcaactcgccttcgtcgacggcaagctgcacgggccggccagtttccatgccgcggaaggctggttgcagcgcaaggcgcactaccgcaacggactgctccacggcgaagcgctcaactatttcgccaacggccaggtggccgagcgcgagcattaccgcgacggcgtgcgcgacggggtctaccagcgcttccatggcaatggccaactggccttcgacggacgctacctgaacggccagctactggacggcgcccagccgttcgccgacgacggccggccgctggacagcgagggcaagcccatggcgcgctggcgctggtggtggaccaggctggcggagccctaggcgcgcatcggccaggcggcgctcagggaatcagcatctgcacctgtcccggcacgctgatcttgatcaccccgccccaggtgcagatcagcgtgccattggcgtccagcgcgggcatcccgcccagcagcagggtcggcgggccgccggggatccacgggctggcggtggcgggaatgcacggcatcggcgtcagtacgccgagggcggcggcggtggcggcggccaccacggggttggccggactctggcagagaccgaaggtgggaatgttcagcagcgggatgtggtccatgatgttcgccgccggcatcccgctggtcagggtgcggttctgcggcaacacgttgagcaccgtcggcgccgccccgaagctgcattgcagggtggcgccggcgcagacctgcgggcagcccatgccgtcctcccgagcgcgatggcgttgtagcaggatagaccagcccatcgcgctcgccgtggggctggcttgctgtttttctgacgaatgcccgacatgcgtgtcgccagcggcgctagaattccgctgtgatgcggggcggagctccgcgacagggatcgacgaaaaaggattttcggcggatcgaacggtgcccgcagcgccctcgccggccggcccgcggccggtcgatgcaggggttgccgtaccctggccgcccccatggacgggacgacaatgcctagcacaagaagcctccccgcacgggtcatcgtcgccgatgactatcccctgttccgcgatggcctga

SEQ ID NO: 8761 - DNA, 1314 bp, Pseudomonas aeruginosa
aacctgatccatcgcctgcgctcgcgcgaactcacgcagacgacgaccaggacgaaggacctaggccttccgccacccctgcaactgattgcggatcggcaactcgcggatgcgcttgccggtggcggcgaagatcgcgttgcacagcgccggcgctatcggcggcacgccgggctcgccgaccccgcccaacggcaggtcgccatccggcttgagcagatgcaccgacaccgccttgggcgccagcggcatgcgcgccagctcgtactggtggaagttgtcctgctggaccttgccatccttgaagctgatctcgcccagcgccgccaggcccaggcccatcacgcaggcgccttcgagctgcgagcggatgcgctcggggttgatctgcggaccgcagtcggcggcgatggtggccttgtgcaccagcagcgcgccgtcgtccttcacctccacctcgatcaccaccgccacgtaggtgacgaagctgtagtgcgcggcgattccccgcgccctgcccctgggcagctcgccgccccagccggactggcgcgccgcctcctcgatcaccccgcgcaggcggccaacatcgagcgggtagcgctccggcgactcgccgtagttccagctgtcgccgagttcggcggtgtcgattcgccgcgccgggccgagcagcttgagcaggtagtccttcgggtcctggccggccttcgccgccagttcgccgacgaagctctggatggcgaaggcgagggggaagaaggagaccgagcggaaccagccgacccgggtgtgcgccggggcctcggggttctccaggcgcacgttggggatggcgaacggcaggttggtcaggcccatgcccaggtcgaaggcgccctggagcttgctgtccgggccgaacagtgcggtgatgctcggcgccaccgagcgatgcagccaagcctgccggaaccccgtcgggcgccgaccacggcctggcaggcgctccaccggatactgtgtgggaaattgggggaaatgcagatggtccccccgggttccactggcacccgcaagtggcgaccggggaacgccttggccaggatcgccgcttccagcacgaagtcgggcttggacttgcggccgaaaccgccgccgagcagggtcacgttgaccgtgaccttgtcgaacggcagcttcaggcgctcggcgatgcgctcgcgggtcacttgcggcgcctgggtcggggcccagacttcgcaggcgccgtccttgtaccaggcggtggagaccggcggttccatcggcgcctgggccaggtgcggcaggtag

SEQ ID NO: 8762 - DNA, 918 bp, Pseudomonas aeruginosa
cgctcatgcagtccactccttcgggggtggctggatggtagagcgcgacgtaccgccgcaggcggaataattgtcggcatcggcggaaggaaattccgccgtttcagtcgtccgccgccggaaggaattccctgccctgggccaccgcctcgcggcagatcgccgccagccaggcggcgaaacgctggctggccggcgaggcctggtggctgcgcaggtggtaatggtgggtgggcgccgaacgcagcgggaacagcaccaccagccgcccctcggcaagccaggcgcgcgccagcgagggtcgcgcgagggccacgccctggccgttggcggcggcttccagggtcatgcccaaatcgagcaggcgcggcccggcgcagggctccggccagtccagcccggccacgcggaaccacggctgccagggctccagcggcgagcgcagcaacggcaggccagcgagcatggctggcgtccagggccgcggcaggccgagcagcagccccggcgcggccatcggtagcacgcgctcctccagcagccgctcgccggccgccacgccatggctgtcgccgcgcacctcgacatcggccagcggcaggtcctggccgtccgaaggactcgacaggagaatctccagctcgatttccggacaggcctcggcgaaggacgccaggcgcggaatcaggatctgccgggcgaaggtcggcggcgtgcgcagggtcagccgctgctggcgctggacctggcgacgatgcagcggaaccgccgcgagctgggcgaggatcggcgcgatctgttcgaggtactcgcggccgtgggaggtcagcgccagcgagcggccgtcgcgctgcaacaggctcaccccgagcatcccctcgagaccggaaacccgcttgctggcggcgctgccggtga

SEQ ID NO: 8763 - DNA, 1467 bp, Pseudomonas aeruginosa
cgcctcgacgcgccgacgcagatcggcgacgtcgctggcctggttgatcgagtaccactgctgcagtacccgggtgttctccaggttggcgtcacgcagcgcataggcctcgctgcggttccagtccagcttgccgggccagaccaccagcgggccgtagatcgactggtagaccttgtgctcgacgcgcgacagcttgccgtcggcgccgcgtacctcgatcgcgacggacttctcctccagcggcagcgaacgaccgtcgaccaggtagcgccgcgggtccttcgggtccagcgccaggcgatacagggtgaagtggctggaggtatccaccgtgtgggtccaggccaggtggcggctgaagccgatgttgaccaccggcaggccgggcagcgaggcccccatcacgtcgagccggccgggaatggtcaggtgcatctggtagaaacgcatcgcgccgttccaggggaagtgcgggttggccaggagcatgcccttgccgtccgccgaacgttcgctgccaacggcaatggcgttgctgccgcgctccaggcggaagcgctggcgccgctgctcggcgacctggaacgcctgctcgccgctcagggcgaccttctccgtgccgggcggcgcggcggccaccagcgcgtcggcgaactggccgaccccgccttcgaccagcaggcgccgggtcaggcgcagcaggtcatcggtcgcgatggcccgcagccagggctggccaaggcaactggtggtcttgccgtctgcctcgcggaggaagcggttgaaaccggcggcgtagccttcgagcaactggcgtaccgcgggcgtctgcgcctgccagaaggcttgcagcgcctcgggttggttgagccaggcgtagaagatgtcggacggcaggttgtccagctcggccgacgacttgccctcgctgccgaaatagcgcgcccgctcgccgcgcgcggtgacgatctcctcggccagcaggcaggcgttgtcgcgcgcgtaggcgtagccgatgccatagcccaggccgcgctcatccttggcccggatgtgcggcacgccataggcggtccagcggatgtccgcggccagcccggtcggccgcggcatatcggcctggaccggcatcatcgaacccaacagcatgccggccaggccggtcagtacggtacgcatccccatcgatgtcgtttctctgcaaagtggtggccggaacggccgggacatgcaacgaaaacgccctgcgtgccgggcatcccctggcggggaaacgggcaacacagggcgtggcggcgtggcgccgatcagctggccagggcgtgctcgtgcagggcgcgggccgcagtaccgggcttcaggtgctggtacagggagccggagatttcctcggcacgcaccggcagcaccgacagcagggtgtcgctgaggccatggctggcctggctgaagccctgcgcgtag

SEQ ID NO: 8764 - DNA, 1008 bp, Pseudomonas aeruginosa
ctggaaccctcgatgaagacaccctctcccgccgacagcgacacccttgtgcaggacgccgcgcattggtgcatgcgcctgcacgccgaggacctctccgaggaagagcgtggcgagttccagcgctggctggcagccgatccccggcacgccgccgaatacgcagaaatggaggagatctgggcgctcagcgaactgctgccgcgaacgccggcgcccgagcttcgcaaccacgccgcaacccgcccgctcggccgtcgccgcaggggctggaagagccaggcacgcgccgccgccctcgccctgcttatgttaccgacggccggctacctcggctggctgcaaggctggattccttccaactaccagcgctacgaggccgagggcaacgtcaggcatgccgttcttcccgacggcagcgaggtcgaactggacctcaatacgcagctgagcttcgccaatttcaaggacatccgccgggtttccctggacaggggcgaggcctacttccatgtcacccacgacagcgcgcaccccttcgtggtcaaggccggcaacggctcgatcaccgtcaccggcacccgcttcaacgtctggaagtaccaggacaacgtggtagtcaccgtcaccgagggctcggtgaaggtccgcagcgaaggctcgggcaacgacagcagcctgactcccggcatgcaggccagctactatccgggcctgctgcaaccgttggtcgaagccgtggatacccgccagacgctagcctggcgcgagggccgcctggtactcgacgacctgcccctgtccaaggccctgccgctgatcaaccgctacctcgacgctccgctggtcctgggcgacaggagcgctgcgaaactgcgcattggcgggatctacagcacccgcgacatccgcagcctggtcgacgccctgccgaaagtcctgcccgtggacctggaacatcgcgaggacggcagcatccgcatcagcagccgttacgcccagctctga

SEQ ID NO: 8765 - DNA, 3150 bp, Pseudomonas aeruginosa
tactcgtcgcgcactgctcgtcgcagtctgcctcagccccctgatcgccctggccgcctggcaggcctatccgttccgcagcaacagcttcgataccgtgagcgtcagccgcggcagcatcgagagcagcgtctcggcgctcggcaccctgcaaccgcggcgctacgtcgacgtcggcgcccaggcctccgggcagatccgcaagttgcacgtcgaggccggggacgatgtgacggaaggccagttgctggtcgagatcgacccctccacccagcaggccaaggtcgatgccggccgctattcgatcgagatgctcaaggcccagctggccgagcaacgtgcccaatacaccctcgcccgccagcagtaccagcgccagcagcggctggccgccggcggcgcgacgcgtaccgaggacgtgcagagcgcccaggcgcagatgctcgccacccaggcacggatcgagatgtaccaggcgcagatccgccaggcccaggcctcgttgcgcagcgacgaagccgagctcggctatacccgcatctacgcgccgatgtccggcacggtggtggcggtcgatgcgcgcgaaggccagaccctcaatgcccagcagcagaccccgttgatcctgcggatcgccaaattgtcgccgatgaccgtctgggcccaggtttcggaagccgacatcggccgggtcaagcccggcatgccggcctacttcacgaccctcagcggcgaaggccggcgctggaccggcaaggtccggcagatcctcccggtgccgcccaagccgctggaccagagcaaccagggcggcggcagccccaccagcggcagcggcgggcagagcggcagcggccgggtggtgctgtataccgtgctggtcgacgtggacaacggcgaccaccaactgatggcggaaatgaccgcccaggtgttcttcgtcgccgccaccgcggaaaacatcctcaccgcgccggtcgccgccattcacgacgacggcaagggcggccaggtcgcctgggtggtcggcagcaatggcaagccgcagagccgccagatcaggaccggcatcagcgaccgcctgcgggtacaggtgcttgccggcctggaggaaggcgaccgcctgttgatggccgctcccgacggcagcgacagctgatggaaaacgccacgcaacccgtccccctgatcgaactgcgcgacatccgcaagcgctacggcggcaatggcactccggaagtcgaggtactcaagggcgtatcgctgtcgatccacgccggcgagttcgtcgccatcgtcggcgcctccggctccggcaagtcgaccctgatgaacatcctcggctgcctcgaccggcccagctccggcagctaccacttcgccggccacgacgtcgccgaactggacagcgacgagcaggcctggctgcgccgcgaggcattcggcttcgtgttccagggctatcacctgatcccctccgcctcggcccaggaaaacgtcgagatgccggcgatctacgccggcatcccggcgagcgagcggcacacccgagcgcgggccctgctcgaacgcctgggcctggccgagcgcaccgccaaccgtccgcaccagttgtccggcggccagcagcagcgggtgtcgatcgcccgcgcgctgatgaacggcggccatatcatcctcgccgacgaacccaccggcgccctcgacagccacagcggcgcggaagtcatggcgctgctcgacgagctggccagccagggccacgtggtgatcctgatcacccacgaccgcgacgtcgccgcccgcgccaagcgcatcatcgaggtgcgcgacggcgagatcgtcagcgacagcgccaacgacgagcgcccggcgcaaccgagcgccggcgtcgagcgccacctgcaggccgacgatctcagccagcgcctcgccgagggcagcagcgaaccctcgggggcctggcgcgccgaactgctggaggcggtgcgcgccgcctggcgggtgatgtggatcaatcggttccgcaccgcgctgaccctgctcgggatcatcatcggcgtcgcctcggtggtggtcatgctcgccgtcggcgagggcagcaagcgccaggtgatggcgcagatgggcgcgttcggctcgaacatcatctatctcagcggctactcgccgaacccgcgcgcgccgatgggcatcgtcagcagcgacgacgtcgccgccatcgccaccctgccccaggtgaagaaggtcatgccggtgaacggcggcgagctggtggtgcgctacgggaacatcgactaccacgcctacgtcggcggcaacaacaccgacttcccggaaatcctcaactggccggtggccgagggcagctacttcaccgagcgcgacgaagacgccgccaccacggtcgcggtgatcggctacaaggtgcgcaagaagctgttcggcagcgccaacccgatcggccgctacatcctcatcgagaacgtgccgttccaggtcatcggcgtgctcgccgagaaaggctccagctccggcgacaaggatgccgacaaccgcatcgccatcccctactccgctgccagcatccgcctgttcggcacgcgcaaccccgagtacgtgatcatcgccgccgccgacgcccagcgcgtgcaccaggccgaacgcgccatcgaccagttgatgctgcgcctgcaccgcggccagcgcgactacgagctgaccaacaacgcggcgatgatccaggccgaggcgaagacccagaacaccctgtcgctgatgctcggctcgatcgccgcgatctccctgctggtaggcgggatcggcgtgatgaacatcatgctcatgaccgtgcgcgaacgcacccgcgagatcggcatccgcatggccactggcgcccgccagggcgatatcctccgccagttcctcaccgaggcggcgatgctctcggtggtcggcggcctggccgggatcgccctggccctgtgcatcggcggcgtgctgctgctcggccaggtcgcggtggccttttccctgtcggccatcgtcggcgccttcagttgcgcgctggtcaccggcctggtgttcggcttcatgccggcgcgcaaggccgcccagctggacccggtggccgccctggccagccaatga

SEQ ID NO: 8766 - DNA, 423 bp, Pseudomonas aeruginosa
acgaccgtcgtacctttctcaagcaggccggcattctcgccgccggcctgccgctgctttccgctgcccagtcgctccgcgccgaaggcgtaccgagcgacgccggcaataaatggaaagcgctgcgccagcaattcgatctcgacccgcagtatctgcacttcgccaacttcctcctcacctcccaccctcggccggtgcgggaggccatcgagcgcctgcgggtccgcttcgaccgcaacccgggcgaagcggtggactggcatcgcgaggaaatctggaaatacgaggacgaggctcgcgcctgggcaggtcgctacttcgccgtgcaacctggccaggtggcgctcaccggcagcaccaccgacggcctggcggcgatctacggcggcctgctggtgcagccgggcaaggagatcctga

SEQ ID NO: 8767 - DNA, 939 bp, Pseudomonas aeruginosa
acgacgaggcggagatcgaccgggtgctggaaatcctcgccccgcaactcgcctgacccctttcgccactcaacgagaaccgccatgcacgcattatcgcccctggccctggccgcactgatcgtcgccaccgcccccgccttcgccgacgaagcgaagaaacccggcacggtgttcaaggattgcaaggactgcccggagatggtcgtactgcccgccggcagcttcaccatgggcaccccggacgacgaggtcggccgccagcccgacgagggcccgctgcacgacgtgaccttcgccaagccgttcgccatcagccgctaccaggtcaccgccggcgaactggacgcctacctgaaagccaccggcgtcaagctggccgacggcgatacccgccccggccgcgaatgcatcgccggcaagccgcgctaccagcaaggccctcgccagccggcggtgtgcgtcgactacaacgacgtgaagaactacgccgcctggctgtcgaagaagaccggcaagcactaccgcatgctcagcgaggccgagcgcgagtacggcgcccgcgccggcagcgccggccccttccccttcccgttcgacgaaggcaaggaatacagcatcgccaagcacgccaacacctacggcgccagcgatggctacaacttcacctcgccggtgggcagcttcccgcccaacgccttcggcgtctacgacatgcacggcaacgtctacgagtgggtcgccgactgctggcacgaccactacaacggcgcgccgagcgacggcagcgcgtggatggaggacaagtgcgagctggtgcagatccgcggcaacgactggggcgagccgccgatcttctcgcgctcgggcaaccgcaacaatgcggcccccagcgaccgcggcgactggatcggcttccgcgtggcgcgcgaactctga

SEQ ID NO: 8768 - DNA, 210 bp, Pseudomonas aeruginosa
ggcgtttttgatgcgccgtgccttccaacgcaggattcttccccactcgctcgccatggccctgagcctgccgctggcgggatatgtccaggcgcaggaagtcgagttcgacatccctccccaggcgctgggcagcgcactccaggagttcggccgccaggcggatatccaggtgctgtatcgcccggaagaggtccggaacaagcgtag

SEQ ID NO: 8769 - DNA, 549 bp, Pseudomonas aeruginosa
tccatcgctttcaggcgctcgtcgaggatctgtttcaactcccaggacacttccagttcgttgctctgtgcgatttcgctgcgcagtgtcgcgaactcggcgccgatctccgcttccgcccagtcgctcatcctcgtccagcgctgctcatcgtccgtcgtggcggagcagatcgatgaccaggcccgttcgatatgctcggcccgctccggaaacatgacaccgagcagttccacccgcatctcgcccacggataggttcgggactgcctccggcgtcggcccgatctcgttccagaacgcttcgaccctgaccggtgccggcgcatcgatccagccgacgaaagccacctgccgcccacgctgctccagccgggccgcgacatccatcgccaggttgccgccgagcgaccatcccgccaggttgaaaaccccttcggggtgctcctgcagcaattgctcggcgtattccgcaaccatatcgtcccactccggcacctcgcgaccagcgcccagcagggcacggcagacaacacccttgaccggatga

SEQ ID NO: 8770 - DNA, 810 bp, Pseudomonas aeruginosa
  unsure (803): Identity of nucleotide at the above locations are unknown.
cctgggtggccagcaacgagtggccgccaagctcgaagaagttgtcgtcgagcccgacctgttgcaattgcaggacctccgcccagatccccgcgacctgttgctccagatcgcttcgcggcgccacgtagacctgctgcaacaggctcgcatccggctgcggcaggcccttgcggtccagcttgccgttcggcgtcagcggcatccgcgccaggaacaacaggtgcgatggcaccatgtattccggcaggcgctcgcgcagcgccgtcttcaactgcgcccggcactccgcctgcgcttccggcgaatccgcgaccgccggcgcctgcgccaccacgtagcccaccaactgctggcccaccgcacccggctgggccaccaccaccgcctcgcgcaccgccggatgctcgcgcaggcgcgcctcgatctctcccagttcgatgcggaagcctcggatcttcacctggtggtccacccgtccgaggtagtccaccaccccatccgcacgcccacgggtcaggtcgccgctgcggtacagccggctgcccggcgcgccaaaggggtccggcacgaaacgctcggcggtcagcgccggacgctccaggtagccgcgcgccaccccttccccgcccaggtacagttcgcccgccacgcctaccggcagcaggttcaactgcccgtcgaggatgtagccgctacggttgcccagcagcgtaccgatcggcatgtatgccgcgccgcaggcatcgcccgcccgtgctttccacagcagcggcgtcaccaccgtctcggtcgggccgtanccgttga

SEQ ID NO: 8771 - DNA, 312 bp, Pseudomonas aeruginosa
ggcgggcttcgacctcccccagctcgatgcggaagccgcggatcttcacctgatggtcggcacgccccatgtactcgatcacgccgtcaccgcgtcggcgcgccaggtcgccggtccggtagagccttgagcccggttcgccgaaggggtcgggcaagaagcgctcggcggtcaagccgggccgatcgtggtaggcacgggccagcccggcacggctggcaatataaagctcgcctaccgcccctacgggcagtaggccgagatgttcatccagcaccagcaacgtacggccgggtagcgcctggccgatag

SEQ ID NO: 8772 - DNA, 429 bp, Pseudomonas aeruginosa
gctcggcgtagctcaacgcctgcccctccagcgccagtgcttgcgcctgcggacgcagacgggcctgctcctggatctgcaactggaccaggggcggcaacccaccctcgtcggcgttctctgcccaggcccgcaacaggcaatcgcgctcctcgtccagcaacagcggcaactcggcgaccggccggcccggttcggccacgatgccgcgcaggagattctgccagtgccgagccaggcgctcgacggtcgaggcctcgaacagatccgtggcatagccgaacgatgcccagataccgtcctcggcctcgtgcacgtccagcgtcaggtcgaaggccacggagctgctccgccactccatccgctccagcgacaggcctggcagttgcacgccctggttggccgaacgagagtcggcctggtgattga

SEQ ID NO: 8773 - DNA, 357 bp, Pseudomonas aeruginosa
acatggtcacacccttgcgctgaaccagctgtttcaaggcaagggccaggtgtggctccagctccaggtccaattgcgctccacgatagctgcgcagcggctgccgcgggtgatcgaggggcaactcgatcaccggctgctcgccgcccagcaggccggtccagtacgccaactggcgctccttttcccccgcctccatccagctgcgctgccacagggcgtagtccgcgtactggatcggcagggccggcaaccccacgtcgagcccttggctataggcggcatagagctggaccagttcctcgaccatcaattgcatcgaccaaccgtcggagacgatatggtgctggaccatga

SEQ ID NO: 8774 - DNA, 951 bp, Pseudomonas aeruginosa
attcacgaaggtcatcgaaatcggtgtcattgctggaagtctgcgccgcggcaagctcggcataggcttgcagcgactcggtctggaacaacgccgccagcggcagctccacgccgacctcgctctgcatccgggcagtcacctggatcgccagcaacgagtggccgccaagctcgaagaagttgtcgtcgagcccgacctgttgcaattgcaggacctccgcccagatccccgcgacctgttgctccagatcgcttcgcggcgccacgtagacctgctgcaacaggctcgcatccggctgcggcaggcccttgcggtccagcttgccgttcggcgtcagcggcatccgcgccaggaacaacaggtgcgatggcaccatgtattccggcaggcgctcgcgcagcgccgtcttcaactgcgcccggcactccgcctgcgcttccggcgaatccgcgaccgccggctcctgcgccaccacgtagcccaccaactgctggcccaccgcgcccggctgggccaccaccaccgcctcgcgcaccgccggatgctcgcgcaggcgcgcctcgatctctcccagttcgatgcggaagcctcggatcttcacctggtgatccacccgtccgaggtaatccaccaccccatccgcacgcccacgggtcaggtcgccgctgcggtacagccggctgcccggcgcaccaaagggatccggcacgaaacgctcggcggtcagcgccggacgctccaggtagccacgcgccaccccttccccgcccaggtacagttcgcccgccacgcctaccggcagcaggttcaactgcccgtcgaggatgtagccgctacggttgcccagcagcgtaccgatcggcatgtagcccgcgccgcaggcatcgcccgcccgtgctttccacagcagcggcgtcaccaccgtctcggtcgggccgtagccgttga

SEQ ID NO: 8775 - DNA, 759 bp, Pseudomonas aeruginosa
actggatgcccgccgcacggcatcgactcaccacctggatcgaaacgatggaatcgccacccagggcaaagaagttgtcggtggcgcccacctcctccagcttcagcacgtccgcccagacggccgcgatacgtcgctccatttcattctgcggcgcaacatgcgtctgccccgcagcagcttgcggtcgcggcaacgccttgcgatccagcttgccgttcggactcagcggcatccgctccagcgccagccactgcgccggcaccatgtattccggcaggctcgccgccaggtgcgcggtcagggcttcgcgccagtcgccgctctcgctctccagcaccacgtagccgaccaactgcctgccgtccaccgccagcaccgccgcctcgcgcacccacggatgctccagcaggcgcgcctcgatctcgcccagctcgatgcgcaggccgcgcagcttcacctggtggtcgatccgcccggcgtactcgatcaccccgtcggcgcggtagcgcgccaggtcgccggtgcggtacatccgctccccagccacgaacgggctggcgacgaaacgctcggcagtcagccccggacgctggtggtagccacgggccaggccccgaccggccaggtacagctcgccgagcacgcccaccggtaccggctccaggttgccatcgaggatgtagcaggccaggttggcgatcggccggccgatcggcaccgcgtccttgccctcctccatgcaggtccagtgggtga

SEQ ID NO: 8776 - DNA, 597 bp, Pseudomonas aeruginosa
ggatcgccatcagggccacgaccatctcgatggaacgttccatggccacgcccaccaggcggtccgcaccgaccccgcgctcgatcagggcatgcgccaggcggttggcccggcggttcagctcggcgtagtccaggcgctcctcgccgaaggccagcgccggcgccgtcggtgtgcgctcgacctgctcctcgaacaaccggtgcacgccgcgttgcagcgggtactcggccgcagtggcgttccagccttccagcaactgatagcgctcctcggcatcgagcatcggcagcgagtcgacgctggcctgcgggttttccagcatgccgcgcagcaggttctgccaatgccgcgccatgcgctcgacggtccgcgcctcgaacaggtcggtcgcgtaggtcagcgcggcgtacaggcgaccgcccttctcgtaggtatccaggctcaggtcgaactgggtggtacggctcttccagtcgagctggccgaagctcaggccggccacgctgtccagcgcctcgatgtcggccaccagcggctggtggttgtacatcacctggaacagcgggctgtggctcaggctgcgctcgaccttga

SEQ ID NO: 8777 - DNA, 231 bp, Pseudomonas aeruginosa
actcgtaacggctgccacggtagctgggaaccgccggacgcgggtggtcggtcggcaactccaggaccggatgccgctcgccgagcttgccgcgccagtactccagctggcgctcctgctcaccggcctccagccagctgcgctgccacagggcgtaatcggcgtactggatcggcaaggccggcaggccgggctccgcgccagtcgcataggcactgtagaaacgactga

SEQ ID NO: 8778 - DNA, 555 bp, Pseudomonas aeruginosa
attcttcgatcagcacgttcatcgaccagccgtcggacacgatgtgatgcagggtcaacagcagcacatgccgctcctcgcccaggcggatcaggcggacccgcagcaacggcccctcgcacaggtcgaacggctgcaacgactcgcgctgcgcctcctcgcgcaggcgggcttcctgctcggcctcaggcaggccgctgcaatcctcgaaggcaacctccagcgggcgttgcaggggcgcctgcgccaggctgtcgtcggcgccgcgcgggaacaccgtacgcagggtttcatgacgctgcaccaggctggcgaaggcgcgctccagcgcctggcgatccagcggtccgttcaggcgcaccgcgctgggcaggttgtaggcgccactctgtggctccaggtgccagaggaaccacatgcgctgctgggcgtaggacaggcggtcgcgctcggccgaagacacgccggccggaaacgggaacagcgagaaatcgattccctcccctcgcagggtttcgaggaagacccgacgcttctcaacgggtagttcgataa

SEQ ID NO: 8779 - DNA, 1764 bp, Pseudomonas aeruginosa
cctaccgttagcctcatgtcgaaaaagtcccgctccagactctggttcctcgtccacagctggctggccctgcccatctggttcttcgtcctgatcgtctgcgtcaccggcaccctggcggtggtcagccaagagatcgtctggctggccaacccggacgtccgggccagcaagccctacgaagatgccgagccgctcagcttcagccaggtcctgaaggcgatcaacgaagcccaaccggacctcctggtcgaatccatccagcgccccgacgaagagcatttcgcccttactgccgaggtcagctatcccggcggcagcgaggcgaccctgtacatcaacccctacaccggcgccatccagggcgaaagcccctccttcgactttcgtcagttcacccgtgccctgcacggatggtggctggttccgttcaacaacggctacagctggggctggtacatggtctcgctgctcggcctccccatgctggcatcgctcatcaccgggctggtggtctataaacgattctggaagggctttctcaaacccagattacgcatcaaccagggcgcccggatcttctggggcgacttccatcgcctgagcggcatctggtcgatctggttcatcgccctgatttccatcaccggcacctggttcctgatccaggccatccttgccgacaaccacgtcaccctgaccaacgacggcatccctccggtcatcgcacgcgccgacgtgccccgcgccgcacccggtcagaaggttccatacatcgagctggacgaggcggtgcggctcgtcaccgggcgcatccccagcctggaggccagcgcggtgttcctgcccggcaacgcctacagcccgatgttcgtggccggacgcggctggtatccgctcatgttccagtcggccgcgctgaacctttatacggggcaagatcgaaaccacccgcctgctcagcgaccgtacccccctgcagttcgtcaccgaatccatgcgccccctgcacaccggcgatttcggcggtatctgggtcaagctgatctggttcgtcttcggcctgctgctgagcatgatggtgctcagcggcctgctgatctggagcaagcgcaccgcacaggccaccgccgcgctggtcaagcgcggcaagcgcccggcgcgccagccgaaaccggccaagccggcgccggtaatggccaaccagaccgcggagggacagccatgagcaaggccgccgtcgcccagcccgtttcgccgctgcgccagttctggctgcgctggcgtttccacctgaacgttctgctgatcctgatcccgctcggcttcatgccacgttatttcgccgacatggcgttgttctctggcagcagcggactgggtgaacgcgagatcggcgaagtccaggtaggcccctggagtctcaagctcgccgaatggcgtatcgaaccgccgcacgacgaaggccccgccggcttcatgaaggacttcaatgccgccctctgccaggcctgcattccccaggtcaaggcgacctacttgcgcatcggcaagccgcgcagcctgcgtgccgccggggtgatcttcttcggcagcccctaccgcatgggcaccagcgtgccgatcccgccgcgcacccggcccgacgccgagctgtggatcaccatggaaggttgggacggctccatgcaccaggcttccattcccctggccgaggcatcccccgccaccgtggcctggctgaacaaacgaggtaagcaatga

SEQ ID NO: 8780 - DNA, 1425 bp, Pseudomonas aeruginosa
agcgcaagccctggacgcccaccaggtggacgcccggctcgacctgaatgccgccgaacagggcatctacgccgacctgcaggtcgccgccgaagacatccaggcgcgcctggacgacggcgaagccgcgccctccgtcgacgaactggccgccgagggcttcccgcccttcgtcgccgacatcgccgcgagcagtcgcggcgagcaccgctggagccacggcgaaaccgccgggcgtccgagctacctgggcgtcagcggcaaacccgaggtggccggctcgttcctcctgctgctcggccccgccgaagtctggctgaagcccgccgcggccgctgccggcgccgtaccgggcgacgcccgagccctggccgacgccggctggcgccaggtggtcagccgcttcgacgccggcgtgacccgtcagcaccgccattgatcgcacatcgactccacagaaggcgtttttccatgctgttctcccgtcgctcatcccgtccgcgcggcctcgccgccctcctcccgggccgcgccctgctggccgccctgctgctggccctgctcgccccgctgacccaggccgaagacggcaaacgcctgcgcatcggcatcaccctgcatccctactacagctacgtgagcaacatcgtcggcgacaaggccgaggtggtgccgctgatccccgccggtttcaacccgcatgcctacgagccgcgcgccgaggacatcaagcgcatcggcacgctcgacgtggtggtgctcaacggcgtcggccacgacgatttcgccgagcgcatgatcgcctccagcgaaaagcccggcatcccggtgatcgaggcgaacgccaaggtgccgctgctggccgccaccggcatggccgcgcgcggcgccggcaaggtggtcaacccgcataccttcctgtccatcagcgcctcgatcacccaggtcaacaccatcgcccgcgaactgggcaagctcgacccggccaacgccaaggcctacacccgcaacgcccgggcctacgccaagcgcctgcgggccctgcgcgccgacgccctggcgcggctgaacaaggccccggccgccgacttccgcgtcgccaccatccacggcgcctacgactacctgctgcgcgaattcggcctggaagtcaccgccgtggtcgagccggcccacggcatcgagccgagtccgagccagttgaagaagaccatcgaccagctcaaggcgctggacgtgaaggtgatcttctccgagatcgacttcccctccacctacgtcgagaccatccagcgcgagtccggggtgaagctctattcgctgtcgcacatttcctatggcgactacagcgccggcaagtacgaggaagaaatggcgcgcaacctcgacaccgtggtccgcgccatccaggagtccggcgcatga

SEQ ID NO: 8781 - DNA, 621 bp, Pseudomonas aeruginosa
gcctcggcggcagccgcatcctcgatggcgtgcgcctgcgcgtcgaggccggtagcgtgcacgcgctggtcggaccgaacggcggcggcaagagttcgctggtcaagaccctgctcgggcagatgccgcatcgcggcgagctgcgcctggagtggcccggcgcgcccggctgcatcggctacgtgccgcaggcgctggagttcgaccgcggcctgccgctcaccgtcgacgatttcatggccgccatgtgccagcgccgtccggctttcctcggcctgtcgcgcagccggcgcccggcgatcgacgcggccctggaacgggtcggcatgctggccaagcgcggtcggcgcatgggcgccctctccggcggcgagcgccagcgcgtgctgctggcccagggcctggtaccgccgccgcaactgctggtgctggacgaaccgatgtcggccctcgacgagggcggcatccaggtcttcgagcggctgctgctggactggcgccaggccggcgtcaccgtgctctggatcgagcacgacctggaggccgtcggccgcctcgccgaccgggtcagcggtctcaaccgccacctgctgttcgacggtccggcggccagcagcctga

SEQ ID NO: 8782 - DNA, 528 bp, Pseudomonas aeruginosa
ccccggaacgcctgctcacgctgttctccacccagccccggaagaacgcggaggccagccgatgaacgacgcctacgaacaactgcgccaggccgtccaggcctgggccgccgccggctaccttccggagaccctggcctacggcttcgtcgtcaacgcgctcctcgccggcctgctgatcggcccggtgctcggcggcctcggcaccctggtggtggtcaagcgcttcgccttcttctccgaggcggtcggccacgccgcgctcaccggcgtggccatcggcatcctcctcggcgagccctacaccgggccctacggcagcctgttcggctactgcctgctgttcggcgtcctgctcaactacctgcgcaaccgcaccggcctggccccggacaccctgatcggggtgttcctctcggtgtccctggcgctcggcgccagcctgttgctggtgctggcgggcaagatcaacgtgcatatcctcgagaacgtgctgttcggctcggtgctgaccgtgaacggccatga

SEQ ID NO: 8783 - DNA, 1353 bp, Pseudomonas aeruginosa
cctcgcggtgctggcggcggtcgccgtgctggtgccgtgcctggccctgccgctgtacaaccgcatcatgctggccagcttcaacccgcaactggcggcggtgcgcggggtcgcggtgaagagcctggactacctgttcgtggccctggtgaccctggtcaccgtcgccgcggtgaaagtgatcggcgcgatcctggtcggagccctgctggtgatcccggcggcggcggcgcgcctggtcagccagtcgctgaaagggttcttctggctggcggtgctgatcgccaccgtcagcacgctggccggtatcctgttgccgatcatgttcgacctgccgattccctccggcgccgcgatcatcctggtcgccggcctggccttcggtctcgccgccatcgctcgcggctgcctgccgcacctgaaaggaacccccggatgaacctgaaaccccattgcctcgccctggccctggcttgcgccggactcgccggcccgctcccggccctcgccgcgacgccggccgcggcccagtccgcgccagtcacggtactggccagcctgccggtcacccacgccctcgccgaacgcctgctgcgggacaccgaggtcaagctgcaacgggtcgccccggccaacctgccggccagccgccaggcctcgttcttcgccgggcgcggcgccggcggcctggccaaggccgccgggcaggccgacgcggtgatcgacctgcgctcgatctggagcgacgacccgctctacccgctggcccgccgtagcaatatccgtatcgtcgagatcgacgccgcgcgtccggtggacggcgccctgcccggcatcgccctgcgccccggcagcgacctgcatgcctacccctggctcaacccgaccaacctggggcgcatggccgatgtcctcgccagcgacctggaacgcctggcgcccggcgccgcagcgaccatccaggccaacctggcgacgctgaagaagcaattgctggaagcgaccgccagtaacgagactcgcctggcgaaggccgacaacctcagcgtgatcagcctctccgaacgcctcggctacctgctcgccgggctcaacctggacccgctggacgtggagatccaggccgacgacggctggaccgagaccaatatccaggctttcgccgaggagctgaagagcgaggatatcgccctggtcctgcaccatcgccagccacccaagcccctcgccgatgccatcgccgccagcggcgcacgcctggtagtggtggacaccgaggcggcggacccggtggccggcctggaaagcgacatgaaagcgatagtcgaagggctgctggccggtaaaggctga

SEQ ID NO: 8784 - DNA, 288 bp, Pseudomonas aeruginosa
accaccaccgccagcggcaggctgccgccgatggccttggacagcaccaccacgtcggggacgatgccggcgtgctcgaaggcgaacatcctgccggtacgggcgaagccgctctggatctcgtcgacgatcagcgccaccccggcctgctcggtgatccgccgcaagccgcgcagccagtcgagatcggccgggaccacgccgccctcgccctggaccacctcgacgatcaccgccgccggcaactgcacgccgccttccggatcgttcagcaggttctccaggtag

SEQ ID NO: 8785 - DNA, 1695 bp, Pseudomonas aeruginosa
agcgtttcgccctccgccggggtggcgcggagcggctggtcttcgatgacgctggtggcgacgtgcatgtcttcaaccctcaaggcgtggtggtgttccactggcaaccggcgatccggccgccaggggcggcattcgcggatcggatgcacaggagacgcaggagggacgcacggatttactgcgccggaccgcagcaccgagcccggaccgccagcttcggcccggacaccgtcgagcaggccgctagtcggtgcccgcggcgctcacccgccagatcgcgttgccgacgtcgtcggcgatcagcaacgccccgtcggccgcctgcgccaaccccaccggcgcgccgaacaactgcttctcgtccgcggagacgaacccggtcaccaccggctgcggcgcaccggcgggcttgccgtcggcgaacggcacatggaccacctggaagccgctgaccggcgagcggttccaactgccgtgctcgctgacgaaggcgccgttgcgatagcgctcgggcaactcgttgccggtgtagaagaacaggcccagcgcggccacgtgggaacccagcgcgtagtcggggacgatggccttcgccaccaggtcgggacgctgcggcttcacccgcgaatccaggtgctggccgaagtagctgtagggccagccgtagaagccgccctcccgtaccgaggtcaggtagtccgggaccaggtcgttgccgatctcgtcgcgctcgttgacgatggtccacagcttgccggagaccggttcccactgcaggccggtcgggttgcgcaggccggaggcgtagatgcggctgccgcggctggcgacgtccacctcgagaatcgccgcacgacggtattcgatcgccgcgccgttctcggtgatgttgctgttcgaaccgacgcccacgtagagcttgcgcccgtcgggactggcgagcagcgccttggtccagtggtggttgatggtgtccggcaggtcggtgaactccatccccgggtcggcgacccgggtttcacccggcacgtagcggtagcgcatgatgttcccggtattggcgacatacaggtaatcccccacccgctgcacgccgaacggcgagtccagcccttccaggaacacgtacttctgccactggcctccggcgccggctcggcgcagcagggtgatgcggttgccgcccttgccggccttgccggacttccccttgaccatccccgcgatgagttgcttcggcgtggtcaccggcgcggtgccgggcgagttggcctccaccaccagcacatcgccgttgggcaagaccagcaactggcgagggtgttgcaggccatcggcgatcttctcgatcttcaggccctgggccaccgtcggcttggcctctcccgaccagcccacgccttccggtaccttcatcggcggcagaaggaagtgcttcggttccggaagcgccggattggcgccggtctgctgctgcggatcgttctgcgacccctggttgcagccggccaggaccaggccgagggcaagcgcgacggggcgcagcgagtggaggctagccatgcgccacctcctccgcggataccgccaggagcgcctctcccagcgccagcagcagcaccgtcgcgatcgacagccatagcccggccggcatcaccgcataggcgtcgcggctgtgcacgaaggcattga

SEQ ID NO: 8786 - DNA, 501 bp, Pseudomonas aeruginosa
cgaccttcccggccctcccgccgggttgccgcgccgccccaggcgcaccccgccggcgaccgatccgcgcccggcgtttgccgaagaggagacagccgatgcctgatcgaaccgctttaccccgcgccatgctcgcggcctgggtcctgctcctgctggcggcctgcagccagggcccggcgcctaccccgcccgcgtcctggggttggcaggacgccagcggcgaacgcgcgatcgcccccgacgaagcctatcccgagctgttccaggcggtgcaggaaagccggctgttcagcgaccagaagcacttcgtcgatgcgctcccgctgcgcgagcctgcacggatccgcgccgactacctgcgcgagagggagcggcccggcttcgacctgcgcgccttcgtcggccgcaacttcgaggagtccggcagcgtcgagaccgccccgccggaagcgggtgccgatctcgccagccacatcagcgacctgtggccggcgttga

SEQ ID NO: 8787 - DNA, 183 bp, Pseudomonas aeruginosa
cccgccactacgagcaggtgccggcccacagcagcctgctgccgctgccgaaaccctacgtggtccccggcggacgcttccgcgaggtgtactactgggactcctacttcaccatgctcggccttgcggagagcgggcagcaccaacgggtgcgcgacatgctcgacaacttcgcctacctga

SEQ ID NO: 8788 - DNA, 498 bp, Pseudomonas aeruginosa
aggcctgcgagcaaggctacggagcccgcgcggagaagcgacgacaggccatcgaaggccacctctggcacccggcgggctactacgccgactacgactggcaacgccggcggcccatcgagcggatcaacgccgccagcctcttcccgctattcaccgggctggcctccgccgaacgcgccggtcgtaccgccgacagcgtcgccgcccaactgctgcgcccgggcggactggccaccaccacccgtgccagcggccagcaatgggacgagccgaacggctgggcacccttgcagtgggtcgccgtacagggcctgcgcgcctacggccgggacgccctggcggaagacatcggccggcgattcctcgcccaggtgcagcaggtctacgaccgcgaaggaaaactggtggagaaatacgacatcagcggcaaccagggcggcggcggcggtggcgagtacccgttgcaggacggcttcggctggtccaacggcgtga

SEQ ID NO: 8789 - DNA, 897 bp, Pseudomonas aeruginosa
cgtatcgctccatcgactcaatcgaggagcaccgacgtgaaaaaggtcctgggaatctacggcaacgccaaccgccactgggtgggcgacggattccccgttcgttcgctcttttcctacaacacactgggccagcatatcagcccgttcctcttgctggactacgccgggcctgctgatttcccccccgcacagcagcgccgcggcgtaggccagcatcctcatcgcggcttcgagacggtgaccatcgtctaccagggcgaggtcgagcaccacgactccaccggtgccggcggacgcatcgggccgggggatgtgcagtggatgacggcggcctccgggatcctccacgaggagtaccactcggaacgcttccgtagcacaggtggaacgctggaaatggtccagctatgggtcaacctgccctccagcgacaagatgaacccgccgcgctaccagaccctgctggatgccgacattccccgcgtcggcctgcccgacagggccggcgaactgcgggtgatcgccggacgctacggccgccaccaggggccggcgctgacccactcgccgctggcggtctgggacgtgcagctgaaggccggcaagcacctcgccctcgacctgcccaagggacatacctgcgccgtggtggtcatgcgcggcaccctcgcggtcggcgacgagatcgttcgcgaagcccaggtcgccatgctcgaccgcgacgacccgcggctggaactggaagccaacaacgacgtgcagttgctggtactcagcggcgagccgctggacgagccgatcatcggctacggccccttcgtgatgagcagccgcgaggaaatcgaccaggccatcgaggacttcgagaacgggcgcttcatccgcgcccactga

SEQ ID NO: 8790 - DNA, 3111 bp, Pseudomonas aeruginosa
ttcctccatgaagcgcggggctacgctctgccttgcccttgccataggtccgggctcgctcctggccgacgactccctgggccatcgcgacaacatcagcaccggcctgaaccagcggcagaaagccgaaatgaaggtgccgccgggcttcgtcgaaggctcgacgctgaacggtttcatccgcaactactatttcgcccgcgacaaccacgacaccccgtcccgccgcgaccagcgcgaatgggcccagggcctgatgctgtcgttccgctccggctataccgacacgccgataggcatcggcctggatgcgcacgccttctacggcctgcgcctggacggcggtggcggcagcggcggtgccggcgtgctgccgctggactccgccggtcgccccgccgacagcttctcggcggccggcgcggccctcaagctgcgcggcctggacagcctgctgaagatcggcgaccagttgctggagaacccggtgatcgccagcggcgtcagtcgcatggtgccgcagagctaccgtggcgtgaccctgaagaactaccatttccgcgcgctcgaactggacgccggcttcgtcgaagccacccgcctgcgcaaccagagcggccacagtcatctcaccagcggctacggcaacggcaccaagggcggtatcgccgccgatcgcgaaagcccgcacatcgcctggctgggcgccagctacagcgcccccggcggcagccaggcgacgctctacagcggccgcctggcggatatctggaaccagcactacctcggcctcagccagccgtggcggctttccagccaattgaccctgacgccctggctgcattactacaagacccgcgaccagggccgcagccagctcggccggatcgacaacgacctctacaacgccgggctgaccctggccggcggcggccagtcgctgagcctcagcctgcaaaaggtcgatggcgacaccccgttcgacttcatcgcgcagaacgaccggaccttcctctacgaaagcaacgccatgcagtacgccgacttcaacggccccggcgagcgctcgtggaagatccagtaccaggccagcctggccttcctcgccgccccggactggcagttcggcgccgcctacggccgtggccaggccgacctgacccgggtcgacccggacagcgcgggctacggctacctctacaaccccaatggcaagaacgcccagcactgggaacgcgacctgtcgctgcgctacgccttccccgccggcccggccaagggcctcagcgtgaccctgcgctgggccacccaccgccccggcgaaggctacaccgcccccggcaacacccgcggcaactccagctccgacgaataccgggtggtggtcgactacccgatcaggttgctctgaacccacggaaccagaaaaaagagaaactccctcatgcgtgcagccctgctacccaccttcggcgccctctccgccgcactctgcctggaggcccgcgccgacgccgtcgcgctgccgccgctggcgctcggcaacgccagcttcatggacggcgtcagccgtcccggcatgctcttcgaactgcccctgcaatacgttcgggcaaacaacgccagcgacgccggcgggcattcggttcccggtcggcaacgggttcgtggcaccatgctgttgccgcacttcgcctacctcagccagaacaccctgctcggcgcccactacggcgccgaagtgctgctgccgctggtacgcctggacctcgatatcgacggcggcccggacggccggcgcacccgccagggcgacctgatcgtcagtccgctgatgctgcaatgggggcccgctacgctgttcggccgcccctactggcagcgcctgaacttcgtcttctccctgcccaccggcgactacgacaaggacgccgcgatcaacaccggcagcaacacctggatcttcaacccgcactacgccttcacctgggaactgggcgagcgcctggaactcagcggccgcctgcactacgcctggatcagccgcaacgacgacccctcgccgcgcctgggcgcaaacgacgtacagccgggacaggcgctgcacgcgaacttctcgatctcctacgcgctggacccgcactggcggatcggcctggccggctaccagttgaaacagatcagcgccgaccgcatcgacgaccaccggcaggccgactcgcgcgagcaggtcttcggcataggcccgggggtgatgtacagccagggcaggcaaacgctgttcgccaacctctacgccgaaagcggcgcgcgcaaccgcagcgaaggcaaccaactgaccctgcgctacctgctggcgttctgaatcggcggataacgccctggaaacgccgacacctccccagctccgtagggcgaataaccgctcgcggttatccgccgcttatccggggtatcggcggataccgcctgtggcggtattcgccctacgcaccccggaaacgccggacagctccccaactccgtagggcaatgaaatggactcctccctcctacggcgtcaagcgccagactaatggtgcagccacaagtcccggagggggagtcagcatgaaccttagtcgcattggtctggatctggcaaaacaagtattccaggtgcacggcgttgatcgtcacgagcatgtggtatgtcgtcgccaactcaagcgggcacaggtgcgggatttctttcgccaactgccgccgtgcctggtggcgatggaggcctgcggcagtgcgcactactgggcgcgcgagttgcgggagctgggccacacggtacgcctgatcgcaccgcagttcgtcaaaccctacgtcaagggggacaagcacgatgcacacgacgccgaggcgatctgcgaagccgccagtcgtccgagcatgcgctatgtcccggtgaagagcgcagagcagcaggccgtgcagtcggtgcatcgggtgcgcagtcgtctggtgcgggcccgcacggcgttgtgcaatgaggtgcgtggcttgctgggcgagttcgggctgatcgcgacgcgacgtgggcgagcggcgacgaggaccttgctcttcaccaagccaacc

SEQ ID NO: 8791 - DNA, 384 bp, Pseudomonas aeruginosa
acctcgccgtgctgccgctctatccagggctgcgcgccgcgcacctgcgcgggctgctcgacagcggcgtggaagcgctgctgctggaatgctatggcagcggcaccggccccgtccgacgacgaggagctgctggcgctgctgcgcgaagcccacgcccgcggcgtgctgctcgccgcggtcagccagtgcgcctacggccaggtcgagttcggcgtttacgccgccggcagccgcctgcgcgacgccggcctgctctcggctggcggaatgacccgcgaggcggccctgggcaagcttttcggcctgctcggcgccggcctcggacgcgacgaagcgcaacgctggttcgccctcgacctgtgcggcgagaacgccgactga

SEQ ID NO: 8792 - DNA, 2094 bp, Pseudomonas aeruginosa
ccgccctgcggccgcccgccggcggccgcttccttcagccctccccgcgatacgcgacaacgccggcggcccgcccgtgcccggcgcccatcgtcaagcttcagcgaacagtgtttccggccttccccggtttatcccccggcggcgagtccacaggatgtcgccttccgctgccggccccgccggcatccgcccacaaggaggaaacacctgcatgtacgccatcgccgaagacacccttcccgcacgcgtattgaaagaactgttgctctatcgccgccgttaccccgagcatcgccagagcgccagcgaagcggacgagatccgccgcatcgaacaggtccagttgccgcgcatcgccgccttcatcgaagccggcgagcccatcgaattcgtcctgccggcgtttccggccaagtcgccgaaccccggcaaggtcctcgacagccgtccggacatggccgagcgcctgtcgctgtcgttcctcaaccacctgtgccagcgcatccagctgttctatgcaccgggcgcgaagatcaccgtctgctccgatggccgggtgttcggcgacctggtgaggatcggcgatgcgcacatcagcgcctaccaggatgccttgcgcctgatgatcgaggagatcggcgccacccatatcggcgtgttcaacctggaggacgtacgcgccttcgaggcccagcgcgacaaccacgagcagctccgccagttgctgatcgacggctacgccgagccgctggaaagcatccgcgagaccctgctggccagcgaagaaggcctgctgctgtaccgcgccatcacccgtttcctctacgaggacggcctgacccccgactaccagggctcgaagactgccctgcaacgcgacgccaaggagcgcgcctacggggtgatccagcgcagctgggcctggggcgcgctgctggccgaccagttcccccgcgcgatccgcctgtccatccatccgcagccggcggacagtctgaagttcggcatccacatgatgccgacccgcgacgactggctgacgccctggcacggcgtggcggtgaacaccgaggaccgcttcgtgctgatgaagcgcagcgaggtgctggaactcggcggcgagctggtgcagatcaacggccagcccagtcactaccgcctgccggccagggccgcccggcgcgccgccgtggcctgagcccgaggagccagacgatgaacgcctatctcagcgatcaaccggtacgtctctcgccgctgcgcgacgaacagggcaaccagccgcgcttcggcctgctgctggagcccggccgccccggcatgcacgtcggcgagctgccggcgcagtggctcaagggcctggctcgcagccaccacctgctgctcctgcgcggcttcgccgccttcgccgacgccgagagcctgacccgctactgccacgacttcggcgaagtcatgctgtggccgttcggcgcggtgctcgagctggtggaacaggaaggcgccgaggaccacatcttcgccaacaactacgtgccgctgcactgggacggcatgtacctggagacggtcccggaattccagctgttccactgtgtcgacgcgcccggcgacagcgacggcggccgcaccaccttcagctcgaccccggcggcgctgcaactggccgacagtagcgagctggaactctggcgtcgcgccagcggccggtaccagcgcagcgcggcgcactacagcagccgctcggcggcaccgatagtcgagcgccacccgcgccgagaattccccatcctgcgtttctgcgaaccgccggtcgagggcgacgccagcttcatcaacccctccgagttccactacgacggcatcgccccggaacagcgcggcgaactgctcgccagcctgcgccgctgcctgtaccacccacaggcgcactacgcccaccgctggcgcagcgacgacctggtgatcgccgacaacctgaccctgctgcacggtcgcgaggccttcgtccaccgcgcgccgcgccacctgcggcgggtgcatatccacgccgagccggcgctgcgcaacccgcacctgcagcgcgactga

SEQ ID NO: 8793 - DNA, 1554 bp, Pseudomonas aeruginosa
ccgccccgccggccgtgcgcgccacggccggcgtcccgacaaggaaccagcatgagccattccgtccccaacgcgctgatgaccggcgccgactatctcgacagcctgcgcgacggtcgccaggtctacctcaacggcgaacgggtcgccgacgtcacccggcacagggcgttccgcaacgcctgccgcagcatcgccgggctctacgacggcctccacggcgagcagcgcgacgtcctcacccgggtcgatgcccagggccgccgcagccaccgcttcttcacccccgcgcagaacgccgaggacctgctcggcgcgcgcgaggcgatcggctgctggtcgcgcatgacctacggcttcatggggcgtaccccggactacaaggcggcgttcatgtccgggctggaggccggcgccggcttctacggcgactaccggcagaacgcctgcgcctggcaccgcgccttcgccgaccgcgggctgttcctcaaccacgcgatcatcaatccgccgctggaccgcagcaaggcgatccacgagatgcgcgacgtgttcgtccacgtcgaacgcgagaccgaccagggtatcgtcgtcagcggggcgaagatgctcgccaccggcagcgccatcaccaacgccaccttcgtcgccccggtcgcctcggcgcagatggaggccggcaaggccgaggacttcgccctggtgttcttcgcccgcatggacaaccccggcctgcgcctgatgtgccggccatcctacgaggagcgcgcgagcagccccttcgactacccgctgtccagtcgtttcgacgagaacgacagcgtgctgctgttcgacaaggcgctgattccctgggaggacgtcctggtctaccgcgacctgcgccgcgccaccggcttctatgccgagtcgggcttcgccaacctgtacaacttccagtccggcatccgcctcggggtgaagctggaactgatgatcggcctgctttccctcggcgtgcgcgccaatggcacccagggcttccgcgggatacaggcggccctcggcgagctgatcgccctgcagcacctgctgcaggcgctgaccaccgccatggcccgcgacccggagcgcaacgccgccgggtcggcggtgccgcgcctggagtacgccaatgccctgcgcatccaggtgccgcagatctggaagcgtgtccgcgagttgctggaaggcgccctcggcggcgccccgctggtcaccgtctcgggcgccgccgacctgcgcgacggcgaggcacggcggctggtggacagctactaccgcggtgccgagctggagccggagcagcgcctgaagctgttcaagctgatctgggacgccaccggcagcgagttcggcgcgcgccacgcggtctatgagagccattattccggcaatgccgagcagatccgcctcgactcgctggcctgggccagccgtcgcgggcacctggcctactgcgaggcgatggtccagcgctgcatggccgactacgacatccacggctggctgcgggggccctggcagcatgactga

SEQ ID NO: 8794 - DNA, 576 bp, Pseudomonas aeruginosa
acaccctcggccaccatcccggcgaattgcgcgccctgcaccgcgaactgccgatggtgctggtggaccgccagttggccgagctggataccgacctggtcggcctggacaacgccgacgccgtcgaacaggccctcgaccacctgcagcaccgcggcttccgcgacatcctgctggtcaccgaaccgctcgacggcaccagctcgcggatcgagcgggtccaggccttcaatgcctccatcggccggcgaccggcgctcaagggccaggtcctgcaaaccgacgacttcttccgcgacggcctgcgcgccttcctttcggccagcggccccgggccgaaggcgctgttcacctgcaacggcgtcgccaccctctgcgccacccgccaactgcgcgacctcggctgccggctgttcgatgaggtcggcctgctggccctggacgaactcgactggtacccactggtgggcagcggcatcaccgccctcgcccaacccaccgacgaaatcggccgcaccgccttcgagcgccttctggcgcgactcgaaggcgaccgcgagccggcgcgccgggtga

SEQ ID NO: 8795 - DNA, 1749 bp, Pseudomonas aeruginosa
aaccggtttcagaggatcgccaatgtcccttcaccccgtctccatcagtctttccagctatggcgcggacctcgttcgcagtcgcggccaggccagcttcctgcccttgctggcgatggccggcgcgcagcgcgtggaactgcgcgaggaactcttcgccggcccgccggataccgaggcgctgaccgccgccatccagttgcaggggctggagtgcgtgttctcctcacccctcgagctgtggcgcgaagacggccagttgaaccccgagctggagccgaccctgcgccgcgccgaagcttgcggagccggatggctcaaggtctcgctcggccttctgccggaacagcccgatctcgccgccctcggccggcgcctggcgcgccacggcttgcaactgctggtggagaacgaccagacgccccagggcggccggatcgaggtgctggaacgcttcttccgcctcgccgaacgccagcagctggacctggcgatgaccttcgacatcggcaactggcgctggcaggagcaggcggccgacgaagccgccctgcgccttggccgctatgtcggctacgtgcactgcaaggcggtgatccgcaaccgcgacggcaagctggtcgcggtgccgccgtcggccgccgacctgcagtactggcagcgcctgctgcagcatttcccggaaggcgtggcgcgggccatcgaatacccgctgcagggcgacgacctgctcagtctcagccgccggcacatcgccgccctcgcccgccgtcggccagccccaggaggaacgccagcatggctgacttcgagatcctctgcttcggcgagaccatggccatgttcgtcgccgaacagcccggcgaactggaccgggtcgagcagttcggcaagcgcatcgccggcgccgacagcaacgtcgccatcggcctcgcccgcctcggcttcacggtggcctggctgagccgggtcggcgacgactcgctcggccgcttcgtactcgacagcctgacccgcgagggcctcgactgccgcttcgtcgaggtcgacgcgcaagcgcccaccgggttccagatgaagtcccgcgaggtcgatggtgccgacccgcgggtcgagtacttccgccgcggctcggcggccagccggctgggcctcgcccatatccgcgaagaaatgctcggcgcccgccacctgcacgccaccggcattccgccggcactctcggcgagtgcctgcgaactgtcccacgaactgatgcggcgcatgcgcggcaagggcgccagcctgtccttcgaccccaacctgcggccctcgctgtggcccagcgagcgccgcatgatcgccgagatcaacgccctcgccgcgcatgcccactgggtcctgccgggcctggaggaaggccgcctgctcagcggctggcaggaacccgcggatatcgccgcgttctacctggacatgggcgtcgacgcggtggcgatcaagctcggcccgagcggcgcctactatcgcgatgcccacggcgaagggctggtccccggcgtgccggtggcgaccgtggtggacaccgtgggcgccggcgacggcttcgcggtcggggtggtcagcgcgctgctggaaggcctgccgctgcccgacgcggtggcgcgcggcaactggatcggcagccgcgcggtacaggtccgcggcgacatggaggggctgccgaaacgcagccaactgctcgaccgcgagcgccgcaagagcgcctga

SEQ ID NO: 8796 - DNA, 402 bp, Pseudomonas aeruginosa
tcatcagtgccttccagttccacaacgtgcgcctgctgctgctctccggcatcggcaagccctacgacccgcgcaccggcgagggcgtggtggggaagaacttcgcctaccagaacatggccaccatcaaggcgtttttcgacaaggacgtgcataccaacccctttgtcggcaccggcggcggcggcgtggcggtggacgacttcaacgccgacaacttcgaccacggaccgctgggcttcgtcggcggctcgccgatgtgggtcaaccaggccggctccaagccgatcggcggcctcgccgtgccgcccggcacgccgagctggggcagcggctggaaacaggcggtcaaggacgcctacacgcacaccgtgtcgatggacgcccacggcagcaacatga

SEQ ID NO: 8797 - DNA, 1764 bp, Pseudomonas aeruginosa
atacctggcccgcgccggcgattgcgtggcctgccacaccgccagggacggcaagccgttcgccgggggcctgccgatggaaacgccgatcggcgcggtgtactcgaccaacatcaccccggaccgcaagaccggcatcggcgactacagcttcgaggacttcgaccgtgccgtgcgccacggcgtggccaggtccggcgacacgctttacccggcgatgccctacccgtcctacgcgcgagtcagcgaagcggacatgcgcgccctctacgcctacttcatgcatggcgtggagccggtggagcagcccaacaaggccagcgacatcccttggccgctgtcgatgcgctggccgctggcattctggcgctggaccttcgctcccgaggtgaaggacttccaggccgccgccgggctggacccggtgctggcgcgcggcgcctacctggtcgaaggccttggccactgtggcgcctgccataccccgcgtgggctgggcatgcaggagaaggccctggcggcgagcgatggcgcggcctacctgtccggcagcgcgccgctggagaactggatcgccaacagcctgcgcggcgaccaccggaccggactgggcagctggagcgaagccgacctggtcagcttcctgcgtaccggccgcagcgagcgcagcgcggtgttcggcggcatgtccgacgtggtggtgcacagcatgcagtacatgaccgacgccgacctcaccgccatcgcccgctacctcaagtcgctgccgccggcggaccccgccgaccagccgcacgtctacgacgagagcgtagcccaggcactgttccacggcgacgacagcaagaccggcgcggcgctctacgtcgacaactgcggggcctgccaccgcaccgacggcaagggctatgcgcgggtcttcccggccctggccggcaacccggtagtgaccggcagcgacccgacctccctggtgcacatcgtgctcaagggcggcaccctgccggccacccaccaggcaccgtcgagcttcaccatgccgccgttcggctggcggatgaacgaccaggagatcgccgacgtggtcaacttcatccgcaccagctggggcaaccaggcgccaagcgtcagcgtcgacgaggtcaggcgcctgcgcaaggacaccggcgcggcggcggtgggcgacattccgccgccgggaccggccgcggcggatcgcggctgagcgccaggcctgccattccagcccctctcccgctcgcgggagagggttgccataccaggcacggccaccccttcactcatctcccaatcgcacatgccgccccagctcgtcgaacaatgcgaccaccgagcgcaacgcccggcagtccggacgggtcagcagccacagggcgctggcgcagccctcgaggtcggcgtccagtacccgcaggccgtcgccgtcgcgtagcaggtaggcagggatcgccgccaggccgaggccggcgcgggccatctcggcgaccgccagcacgccgttgcagcggtaggccggcagcaccccaggatagtgtcgacgacgccagaccacgctcgggtggtcgggaagaaaatcgtccggggcgatccagtgcagcatggcgggctccgtcgcgtcgcggccctccaggtagcgttcgctggcgcagagcacgtagcgcacctcgccgaggttgcgcccgaccaagtgttccggcggcgtgcgggtcatgcgcagggcgatgtcggcgtcgcgccggctga

SEQ ID NO: 8798 - DNA, 1122 bp, Pseudomonas aeruginosa
agtgagcgccagggcccgccaaccggcgtggcgaaactggagcgaaaacggatgtccacccctcccgcggcgccgctgcgcattgccctggtcggcgaccacgacccgcacatcaccgcccaccgggcgattcccctggccctgcgcctggccggcgaggcactcggcctggagatcgcattcgactggctggccagcgaccgcctgcccgccgagccggcgctggagcgctatgacgggttctggtgcgtgccgggcagcccctatcgcgacgccgacgcggtgctgcgcctgatcgcccatgcccggggccggcgccggccgttcctcggtacctgcgccggcttccagcacacgatcctcgagttcgcccgcaacgccctcggctggcaggcggcgacccatggtgaggagcatccgcacagcgaccaggcggtgatcgccgccctgccctgcgctctgctcgaagcccgcgaggatgtccgcctgctgcgcggctcgcgcctggccctggcgtatgccgccgactggatcgaggcggactaccattgccgctacgcaatcgccccgcgcttcgccgcggaacttaccggcggcgcactgcgggccagcgcctggagcgccgacggagcgatccgcgcggtggagctggaacagcatccgttcttcgtcgccaccctgttccaacccgagcgggcagccgtggccggcgtcctgccgccactgccgaaggcattcgtcgaggcgtgccggacgcagcgccgcgaccacccccggcgcggcccgacaccttattacgcagtgatcttcagctcccatcgcagcgccgtcgacgacggctacgccgaagcggccgagcgcatgctggaactggccagccgccagccgggctatctcggcgtggagtcggtccgcggcgccgacggtttcggcatcaccgtctcctactgggacaacgaggcggcgatccgtgcctggagccgccacgcggagcaccgcgacgcccaggcgcgcggccggcgcgactggtacgccggtttcagcgcgcggatcgcccgggtcgaacgcgaatacgccttcccggctcagccggacaccgcgcagtctccggcctcgtcctga

SEQ ID NO: 8799 - DNA, 906 bp, Pseudomonas aeruginosa
gggttgctcatggaaagcctcggctggccggctccagcggaaccggcgacgacgggagaagacgaaattcacatacgctgcgtatgtcaaaaatcatggagacatacgcagcgtatgtcaattatcctgaagccccttcgccacccggagacctcgcatggcccgcaagcctcgcgccgagatgatcgaggaaacccgcgccaagctgatcgacgccgcgcgccgagcgttcgccgacaacggctacgccggcgcctcgatggacgaactgaccgccagcgccggcctcacccgcggcgcgctgtatcaccacttcggcgacaagaaaggcctgctggccgcggtggtgcagcagatcgacgacgagatgaatcttcgcctcggcgccatcctggctgccggcgaggacctctggagcggcttccgtgcctacaaccgggcctacctggaaatggccctggaagcggaaatccagcgcatcgtcctgcgcgatgccccggccatcctcggcagccccagcagcgaggccagccaactgcgctgcctaagctcgatgaccgggcaactgcgcgaactgatggacagcgggcgcgtccgccgcaccgacgccgaggccctggcctggctgctcaacggcgcgctggtggacgccgccctgcgtatcgccaacgccgaacacccgccggagagcctggccagggcctgccaggccctggacgtgctgctcgacggcctgctcatggagtgaaaagccaatggactaccgcatcagaaccagccgcgacgaggacgccgcgctgctcccggccatcgagcgctcagccggggaaagcttccgcctgctgcccgagctggcctggatcgccgacgccggggtcgccggggtggacttccatcgccgcctga

SEQ ID NO: 8800 - DNA, 1119 bp, Pseudomonas aeruginosa
ccgcggatctgtagggtcatcggtgtgtcctctgcgcaggatggcgggccgcgacggcttgctggcggcggtccgttcggggggcaattgttcgccggatgggcgccgccgcagaatgtccattcctgtcgaagccttgcccattcgtgccgatgttgcgtgccgccactgcccaggcgcgcacggggttgctacgtttgcctcccctcctggagaaacagccaaggcatgagcactacttccaccgacatggcgtcgctgatcgccaccctgcaagacgaaccgggtttcgacgccacccgcatccccggggttcgcctgatgcgcgccgaacaggcctatccgcgcagcccggtgttctatgagccgcgcatctgcatcctcgcccagggccagaagatcggtttcctcggcggcgaaacctaccgctacgacgccgaacgctacctggtgatgtcggtgcccctgccgttcgaatgcgaaacccacgcctccgccgccgaacccttgctgggagtgagcgtcgacgtggatatcggcaccttgaaggaactgctgctacagatggaagaggctcccggcagcgacgacgacaatgagctggcacccagcgcgccgatggcttcggtaccgctggacgcggggatggccgatgcggtgatgcgcctgctgggctgcctgcagagcccgctggacagccatatcctcggcccgcaactggtccgcgagatcatcttccgcgccctgcgcagcgagcagggcaacgccctgcgtgcggtggccggccggcacagcggctacgggcgcatggccagggccctgcggcgcatccacaccgactacgccagtgcgctggacatcgacaccctggctcgcgaggcgaacatgagcgtgtcgaccttccaccacaacttcaaggcgatgaccttcacctcgcccctccagtacctgaagagcgtgcgcctgtacaaggcctggagcctgatggtgcaggacgggctgaacgccagtaccgccgccaaccaggtcggctacgaaagtccctcgcagttcagccgcgagttcaagcgctacttcgggcgcacgccgagcgaggaaatccaggccgcccgccgctag

SEQ ID NO: 8801 - DNA, 429 bp, Pseudomonas aeruginosa
ccggcgggagcgggggcgcttgcaatacatacggatatccgtatattcagctttccatatatccaggaaggcccagcgatgcccagccccgccgaagtgttcaagtgcctggccgacgagacgcgcgttcgcgccaccctgctgatcgtcgaccagggcgaactgtgcgtctgcgaactgatgtgcgccctcgccgacagccagccgaagatcagccgccacctggcccagttgcgcagtgccgggctgctcctcgaccgtcgccagggccagtgggtgtattaccgcctgaaccctacgctgccggcctggatccacgaagtcctgcaagtgaccctgcgggccaacggcgactggctgcaagccgacgcagcgcgcctgcgcgacatggacggccgcccgcagcgcgcctccgcctgctgccaatag

SEQ ID NO: 8802 - DNA, 1617 bp, Pseudomonas aeruginosa
cgcgagccgccccatgctgatcgccttcgccatcttcctgttcaccctggtcctggtcatctggcagcccaggggcctcggcatcggctggagcgccagcatcggtgccctgctcgccctggcgctgggcagcgtcgcgccgggcgacatcccgaccgtctggaacatcgtctggaatgccaccgccaccttcatcgcggtgatcgtcatcagcctgctgctggacgaggccggcttcttcgaatgggccgcgctgcacgtcgcgcgctgggctggcggcgacggccggcgcctgttcgccttctgcgtgctgctcggcgcggcggtctcggcgctgttcgccaacgacggcgcggcgctgatcctcacgcccatcgtgatgtcgatgctgctggccctgcgcttcagcccggcggcgaccctggccttcgtcatggcggcgggcttcatcgccgacagcgccagcctgccgctggtggtctcgaacctggtgaacatcgtctcggccgactacttcgggctcggcttcggcgagtacgccgcggtcatgctgccggtaaacctggtgagcgtcgcgacctccctgctggtgctgttcctctatttccgccgcgacctgccgccggtttatgcgctggagcaattgaagccgccgcgggcggcgatccgcgaccgcgcgaccttcatcgtcggcggctggatgctgctggtcctgctcgccgggctgttcgccctggagccgctgggcgtccccgtcagcgcggtggccgcgacctgtgcggcgctgctgctggcggtggccgggcgcgggcgggtgatctcgacccggcgggtgctgcgcgaagcgccctggcagatcgtggtcttctcgctgggcatgtacctggtggtctacggcctgaagaacgccggtctcacagacctcctggcgcagctcctgaaccgcctggccgagcacggcgtatgggcggccgcgctgggtaccggactgctttccgccgccctctcgtcggtaatgaacaacatgcccagcgtgctgctcggcgccctgtcgatccaggccagcgacaccgccggcgcggtgcgcgaagcgatgatctacgccaacgtcatcggctgcgacctgggtccgaagatcacccctatcggcagcctggcgacgctgctctggctgcacgtgctggcgcgcaaaggcatgcgcatcacctggggctactacttcagggtcggcgccctgctgaccctgccggtcctgctggcgaccctttcggccctggccctgcgcctggccatctgacggccgccggcgacggcggcaggagcatcccatgcgagtcctgttcatgtgcacggccaacagttgccgcagcattctttccgaagccatgttcaaccacctggccccgccgggtttcgaggcatgcagcgccggcagccagcccagcgggcgggtgcatccgcgcagcctggcgaccctcgaacaggccggcatcgccacccacggcctgtacagcaagggcagcgaagccttcgaaggcgcaccgccggacatcgtcatcaccgtttgcgacgccgccgcgggggaagcctgcccgctgtatctcggcgcagcgctga

SEQ ID NO: 8803 - DNA, 468 bp, Pseudomonas aeruginosa
atgcgccccttttacatcgcgttgccaaagggggcgagaatgatagcaaagtggactgcggcactgctgatgggcgcactggcgtggggatcctgcacggcgcaggccgaagaggcgcggccgccagtcgccgacaaggtggtggcctaccagggccagcaggggctcaaggtctggaccctgcgtatcggcgaagcggcggccggcgaagcgctgttgcaggtcgaaggtctggaccacgactgggaccgcctgatccacaaggtaaaggtggaaaagagcgccagggacagtcgctactccaccgaactgaacggcagcaagtatgtgatcctgatcgtgcgcgacggctggggcgagctctacctgcccggcgaacagcagacgcggcaggtcgcctatagcgagtcgctgtcgtccgcaggcgagccccaggcattcctgaccgactacctcgagcagaaataa

SEQ ID NO: 8804 - DNA, 2133 bp, Pseudomonas aeruginosa
acgcggatgagccacgatacgctgcgggtaaggctgctcgcattcctcttcctgattcccctggcgctctacgcctggtccgccgtgcaggccttccgggtcgactcgaccctgcgcgacgaacagttcatgcgcgactggagcgcctcggtgcgcaacgacccggacgccgccggtgccattccccgtcacctgttccgtccggcctatggcgtcgaaggtcatcttcaccagttcgccgaagacgccgaggccatccgccgcgaccatccttggctggctctgcgcggctggctggccgctatcggcaagctctgcgcgctggcgtcggcgctggtcgcggccgccttgctggcgagactggaatacgacgggcgccgctcgatgcgctcgcaagcctacctgctcggccacctcgcgccggcctggcggcgcctcggtcgactggtcccgctgcacgctggcctgctggtcgccgccctggccagccagttgctctacgaagcgctgtggagctacagccactggcacagccacggcttcgtcgccctggctcttctcgctgccgctgtggctgctgttcctcggcggcctgctcatgctgcggcgcctgcgcggcgaactgctgccgctggaggaaccggtgctccacctgctcggccgcgaactcgaccgggtcgccgcgcccggcctctggcaatggctgggacagatcgccgaccgcgccggagcgccgctaccggaccatgtcgtcaccggcatcgagcactgctacttcgtcacccaggccaaggtcctgctggcgccccgcggcattccgctggaggggcgtaccctgtacatcccgctgacctatgcctcggtcatgagcgaggccgaaagcgccgcgatcatcggccacgaactgggccacttcgccgccggcgacaccgcccacggtgcctccctgtcgctcctgcagcggcaggtgcgcctgcgcatcgaacgcatcgccgcacccgaggatgggcgtgtcggcctgctcggcaagccgggcctgtgggccgcgctgtacttcctcgatcgcttcgagcgcgcctacctgcactggaatcgccgccaggaactggccgccgacaaggtcggggcgcgggtagccggcgcgcgggtcttcgccatcgcgctgctacgcacctgcgcccttgcaggactgatcgaacgcctgctggccagcccgcagacgcgcaacctggtgcatgcgctgaccgaccatctgcgcgggaactccctggaactggacgaacacgacagcgctcgccgcctggaacaccccttcgacagtcacccgccgacctaccagcggatcgcggacctttccctggcgctcgacgacgatctgctgcgacaggcaaggcgcatcgtcagcgccgacgacacgcagtggctcaaccgcctgctcgatgcaggccacggggaaagccggtgatcccgccgggcgcgcaaacgccctgccccgccgggacaaggggcgacgaagccacgcagttgcggcgcttcgtcgccagcgtccccaaccggataagcatcggcgccgcccgtggcgcggcgccgctgtccgccctgctcggcctgctgctgctcggcggcgcctggaccttgcgcgaccaccccggtcccgggcatgaggcggcggcgctgtgcctgctggcggcggccgccctcctcatgtgcctggcctgcctgcagcgcaacgccaggagcgcgccgttcctcgtcctcggccaggggcgcctgcgcgcccgcagcctgtcggcgccgctggacctgctggaggtcgccgacctgcgcctggaggacggggtctggttctccgcgatagtcctcgaactgcacggcaaggcgctaccggcaccatccacgcgcccgctcgatccgttcgccgcgcgtgccgtcagcgaatgccgggacggcccacgggttcgcctgctgtcccccggctggcgcctcaacggtcgcaacctgtcgctactggaagccgcggaggtcatcgacctctacctggacatcgcccgcgcccaggcccggttccgccaactgggcgagatcccgcccagtgcttcctcttcactcccaactccaaggatatttccatga

SEQ ID NO: 8805 - DNA, 336 bp, Pseudomonas aeruginosa
  unsure (84): Identity of nucleotide at the above locations are unknown.
cccgtacccagctctgggccgacagcctgtcggctccggtcgagctggccgacgtcatcgatttcagcgtcaaggccgacatgntgcaaaccacccagaccctccacctgcggcccgaaacgccgctgccgacccatcgcgccgtacgccaggtgttcgcctcccaggccatggccttcaaaggcaaggacccgcgcatcaccatcatgtcggccggcctgcagagcgatggcaagaagctggactgcgacgacatggcggcgatcctcgacgcctacatccaggccgcccacgcccagcgctacctgcaacaactgcgcagccagggctgagtga

SEQ ID NO: 8806 - DNA, 684 bp, Pseudomonas aeruginosa
gccgagcgctcagcgccgacctgctcggcaagacctgtgagaatccccatgcaagaaactgacgaaaccctcgacgaactgccgccgctgaaagcccgctgcgagatccgcgaggtctcgcggggcaccgcctgcgttgccctgctcgctggcctggtggctggcgccaccggtctctggctcgcttcgctgcccaacgcctggcgcctggccagtggccaatggctgttctggctgccagccgcgctgctgctgggcggcggcctgtacgcctgcctggcgggcgtgttcctctaccggcgccacggccaggtcgcgctcaccctgacgccggagagcatcgccttcgccaacgcgccgcaggtgccgatgtacaccttccagtcgctggagatcgagcgcgggcgctggctggaactcaccttcgcgaccaccttcgactgcacggcgccgagcttcgacaaccatgcccgtttcgacccgcgggctttcgcccgccccgaagcccgcgcggtggccggcggcaagcgggtcaagctggcgctgtgcggcgccgcgctgaacggccagaaaatggagctggagccgctcgcacgactgatctaccggtacatcctcgccggccatcgccagcgcgccctgcaacatcatcgcgcacccgggagcgacggcagcggggcctga

SEQ ID NO: 8807 - DNA, 1323 bp, Pseudomonas aeruginosa
ccgggtataggccaggttggcgttccagtgctcgctcagttcgctctccaggcccagttcgaagccgcgacgcagggtcttgccggcgttctggtagctggtgcgaccgccgagggagctggcgacgacgatctcgtcctcggtgcggatctggaagatcgccgcgttgacccgcgtattgccccacaggcgcgccttcagcccggcttcgtactggctgctggtggctggcttgaggccgaagttgaagacgtccggcgcgttcgccgccaccggcgcataggccatctccgcctgggtcggagtctcgaagcccttgccggcgctgaggtagccgtgcaggtcgggggtgaaggcgtacatcaccgagaacgacggggtgttcttccggtagcgccgcgagccgctggcatcgccgttgctcaggtagcggtcgtcgacctccatcttcatggtgctgtggcgcaccccggcctgcagggtccaggcgtcgatggcccagctcgcctgcaggtagggatcgaggctggtggcggtgtccacctcgtcgcggcgcaactcgcccttcacgccgagctggtcgccgttgaagttctggtagccgcgacggtcgtcgcggctctggtcgtagtcgaggccgacggtcaggttcagctcgcccggcgcctggcttaccggttgcagccagcgcacggtgccaccgtggaagtcgcggtcgaagtcgatcaccgcgccgtttctctggcaacgcggattactctcgcatcctatctgcttgggtatcgcctgatactgcacgacactgcgcttgcccacgtaggcgttgacctgcaaggtcgcctcgccgaagtagcgctcgtagttcatcccggcctgctggtggtcgatgctcttgcgcgtgtcgtacagctcggcgttggcggtgacggagcgcgggtcgtgcttgtaggcgtcccaggtctgccccagcggatcttcagtgtcgttctgttccaggctgctgtagatcagcgccaggcggctgtcggcgtcgggcctgaagttcagcttggcgaaggtctggtcgcggcgcgcggcgctgtggtcgcggtagccgtcggtgtccatccgcgaggcatccaccaggaaaccgaccccgtcgccctcgccttccgtgtacaggtggttgcggctcaggccatcgctgccgacggtggcttccgcgccgacccgcggggcgccctggccgtcgcgggagaacatctggatcaccccgccggcgttgctgccgtagatcgtcgaggccggcccgcgcagtacctcgatgcgctcggcgacgtctag

SEQ ID NO: 8808 - DNA, 1104 bp, Pseudomonas aeruginosa
tgccgagctggccgtcggcgatctgccgacgctcgatgctatccaccgacaacggcaggtcgaaggtgtcgctggggttgtatctgccggtcaccaccatgggttcgaggctgcgtcgctcctcgccctggacggcgcaggcgatggccaggccgcagatcgccagggagccgggcaacaggtgggagacgaagctgggtcggggtcgggacggcatgcagggttccgcgggtcgcaaggtatcgaaggggctttgccaagggcgggaactcgcctccccttggcaaagccccttccgggccgaggcccggaaggccgggagccggctgtgggctcccggtgggcgggtcattgcctgggcagggcgtaggcgatgatgtagtcgcccatgcgggtaccgaaggagccgtgtccgccagcgacgatcagcacgtactggcgaccgtccttgccggtgtagctcatcggcgtggcctggccgccggccggcaggcgcgcctgccagagctgcttgccgtccttcacgtcgtaggcgcgcaggtactggtcgagcgtgccgctgaggaaggccacgccgccggcggtggtgatcgagccgcccatgctcggtacgccgacggtgaggccgatcggcaccggggtgttgtcgcggctggtgccgttcttgtgctgccagacgaccttggcggtggtcaggtcgatacccgccacgtcaccccaggacggcgcctggcacggcaggccgatgggcgacatgaacggatgcatgatcaccgcgtagggcgcgccggtgttcggctgcacgccgctggtctcgccctcgcgcttgcttccgctgggcaccttgtcgcgcggcaccatctgcgagacgaaggccatgtagttggggctggtgaagaggatctggcgcaccgggtcgaccgacaccccgccccagttgaacactccgacgttgcccggatagatcaggctgccctggctccgacggcggggtgtactggccctcgtagcgcagcgagcggaactggatgcggcagagcatctggtcgaacgggctgctgccccacatgtcgcgctcggtcagcggcgggcgcagcaggttga

SEQ ID NO: 8809 - DNA, 330 bp, Pseudomonas aeruginosa
actggctgcccaccgcggcggtgccggccaggaccaccgccacgcccagcgccgcggtgcccagcggcgccggaccgtcggccagcagcgggcggcggaaccagggtagccagagcagcaggccgaagacgaaccacagagccaggcgcggcaccagttgccaccagtccaggccgacttcccacagcgcccagacggtgctggcgaacagcaccagagcgtacaggcctagcgccgcacgcttgcccagcagcagcaacagtccgctcagggccaggccgatgccggccagcaggtagtacagcgagccgcccaggctcgccagcttga

SEQ ID NO: 8810 - DNA, 654 bp, Pseudomonas aeruginosa
gcgtccgccagcgccgcgcagagcgccggcagcaccgtcgcctcgcggctcaggccgagggcgccggtggccgcccggcgtacctccgggtcgacatcggcgctggccagcctggccagttcggccagggccggctggtggcggagccagccgagcaccgccaccgcctcgcggcgcaccgccgcctgcggatcgccgagggcggccagggccggcgcggcgctctcctccaggcgcagttcgcgcaacgcacgcaatacgctggcgcggacgaaggcatcggcatgcccgagccacggcagcaggcgccgcccggcggccggttccttgagttcgccaaggctctgcgcggcggcatcggccaccgccggcaccggatcggccagggccgcacagagcgcatcgaccactgcgtcttcctcccaggcctccagcaggcgcgcggcctcgccgcgcacgccggggtcgggatcgccgcgcagggccgcaatcagcaacggcagcgcctccggcagctccaggtcggccagttcgatcagcgccaggcggcgtacgccggggtcggcgtcctccaggcgcggcgacagttcgaggatttcgggcagggtggcgtttttacaggtcatatggcgatccgcagtcggtccggggtga

SEQ ID NO: 8811 - DNA, 2844 bp, Pseudomonas aeruginosa
ccagcacccgggcgatctccacgcgctgctgcatacccccggacagttggccgggccagcgcccggcgaagtccgccagccccaccagtccgagcatctccatggcgcgccggttgcgctcggcgcgggccaggccctgcatcttcaggccgaaggcgacgttgtcgcggacccgccgccaggggaacagggtgtgctgctggaataccatgccacgctgcggcgaaggtccttccacgctccggccgtcgaccctcacgctgccggcgcttggccgcaggtggccggccagggcgccgagcagggtcgacttgccgcatcccgaaggcccgagcaggcagacgaactcgcccggccgcgcctccaggctcagatcgcggaccgcctcgaaggcttcgctcccctgccccaggcggatgctcaggtcgcggatctggatgcgccccaggctgttgccggccgtcgtcatcggaccttgcctcccgccgcgtaccagggcgtcagcgacgcgccgacgcgcttcaccaacccactgctgcccatgccgaagaggccgatgagcagcatgccgaccaccacctcgtcgtagttctggatgttgtaggaagcccaggtgtagtaacccagtccccattgcccggagatcatctcggcggtcaccaggcagaaccaggaggtgcccatgccgatcgccaggccggtgaagatgcccggtccggcgccgggcagcagcacctcgcgcagcagtgcccggcgccccgcccccaggctgcgcgccgaagccagcaggcgcggatcgagcgcctccacgccatgcacggtattgagcaggatcgggaacagcgcgccggtgaaggtaatgaagatcatcgaggcctccgacgaagggaacatcaggatcgccaggggaatccaggccaccgccgggatcggccgcagcacttccagcggcggcagcagcaaggcctcggcccaggccgagcggccgatcgccaggccgagggcgatgcccagcgcggcggccagcagatagccggcgaagacccgcgccagactggcgccaaggtgcgccaggagcacgctggactgggccaggttgcaggccgccagcaacaccgcaccgggcgtcggcacgttggcgaaggtcaccaggcccagattcagttgcagaccggcggcgagctgccagaacgccaggcaggccgccagcgaagcggcgcgggtggcccagcgccagggtcgggagatcggaagcgaactcatgggcggactccgaagacgcccgcctcagcggagcgccagcgcctgctggctggcggcggcaaagtcgcgtacctcgccgccatggcggcgggcatagtcctgggcctgctcgcggagcaggaaggcgttgaggcgaccctcgccgtcgcggacgaaccacgcctggttggccagcagcttgatcccgctgtcacgatcctgggcgtagatcgcacgaatcgccttgccctgcgccttcagctcggcaagatcggccagggccgactccggcgaagcgtaatggcgcaccctggcctcgcccttcacccagatctgcgctacccgttcgaactcctcgatcggccggccgctgcgcgcgtcgctggcgcgcagcggcgacggtgcgtagtctgccagcgccgcctggtagtccagcccggcctgacggtaggcctcgcggatgtagcggtcgtcgacgaaacgctcgacgtccagcccacggtcggccttcttcagcagcttcagggtgtcgatggaggtcgccagcgcctggcggtattcgggtttccaggcctggtcgcgggtctgcaggccgagcggaccgtggaacaggtaattgacctcggcctcgatgccggtgaccttctcgatcagctcgctgtatttctccggttcggcggccagcagtcgattggcttcgatgctcgcccgcaggtaggccaccaccacctccggatagcgctcggcgtaggcggcgtccaccagcgcgccatggaaggtcggcgcgttggcctgggaaccgtcgtagatcttgcgggcgaagccgcgattggggaacagctcggcgaagggtacgaagtcggcatgggcggcaatcttgttcgcctgcaaggccgaaccggcgatttccggcggctgggcgatgatggtcacgtcgcgctgcgggtcccagccttgcgccgccaccgcgcgcagcagcatgccatgggcagtggaggcgaacggtacggagatggtctggcctttcagttcggccagcgactgcaccggcgagccgctcggtaccacgatgccgttgccgctgccacgggtgctgccggacagcacgctgatgaacaggctgcgcttgccggcggcggcgaaggccacgccgttgaaggtgccgggaaagtcggccatggcgccgaagtcgagcttgccggcgaccatctcgttggtcagcggtgcgccactggtgaagttcttccactccacccggtagtccgcatccttgtagcggccgtcgcgcggcaggtatttctccagcaggcccagctcgcggatcagcagcccgccggcggcgcagttgatggtggtgtcctgagtgccgatggccacgcggatggtttccgcctgggcacccagggaagtcagggccagcgccaggctggccaggattgcacgcagtcgcatggggattcccctcgaatcatggtcatgggaatcgtctccgccacccggacggtggtgggaaacgaggggtgtttcagagtggcgtccgggagtggccggatggcgggttctgcctcgcttgccgggagcgggcgtcagcgcagcaggtag

SEQ ID NO: 8812 - DNA, 1875 bp, Pseudomonas aeruginosa
gccatggcacgcggtcctcgtggttcgatctggcccgctttcgtggcggcgggctcggtgtctagcggtactacgccggggcgtggggccctaggcggcgtcgttcctcagccgcaggcgctggtaggcctgctgttcgccctcgtcgatggcgaacaggtaggtttcgaccggtttcctgaagctggccatgcgtccctgctcgtccttcttcaggtgcgcgtggcagaaccaggcagcgtcgtcgcgccgcggatagtccacccggtggtggtacaggccccagcggctctcggtgcggaacagcgaggcgcgcgcgggcatctccgcgcaatcgcggataacgctgacttccagggcgcgcatcagctcgtgggggttgtccgccttgatccgctccaggtcctcggcgatggcctggatgcgttgcaggcccaattccatcttgcgggtcaccttgggcggttgcaggtagtcgttgaccagccggcgcagcttgtactccacctgcgccgccggcaggccatgctcgcgcagcagcggcgcctcgatccgcgcacgctcgcgctcgacctgggcgcggtcgaccgcgctgaaggcgcgcccggcgacgtattcggcggcgttgcgcccggcgaaccagccataggtgaaggcgccgagcatgtagttgtgcggcaccgcggccatgtcgccggcagcgtagaggcccttcacgctggtctcggccttctcgttgacccacacgccggaggccgagtggccggagcagaagccgatctcggaaatgtgcatctcgaccatctgctggcggtagtcggtgccgcgcccggcgtggaactgcccgcgactggggcgttcgttgccatggaggatgtcctcgatggtctggatggtttcctccgccaggtggtcgagcttgaggaacaccgggccattgccgccttcgagttcctggtggaactcccacatcatctgcccgctccagtagtcgcattcgatgaagcgctcacccctggcgttggcggtatagccacccagcgggccggtgacgtaggcacaggccgggccgttgtagtccttgatcagcgggttgatctggaagcattccaggttggccagctcggcgccggcatgataggccatggcgtagccgtcgccggcgttggtcgggttctcgtaggtacccatcaggtagcccgaggacggcaggcccaggcggcccgccgcgccgcagcaaaggatcaccgccttggcgcggatcacatggaagtcgccgctgcggcagtcgaaaccgagtacgccgttcaccgcgccctcggcatcggtgagcaggcgggtgcagaccaggcggttggcgatggggatccgcgcacgcttgagctggcggtagagcaccttcttgatgtcgtgcccttccggcatcggcagcacataggcgcccatgtggtggaccttcttcaccgcatagtcgccggtctcgtccttttcgaacctgacgccccagcgatccagctgccgcagggtctcgaagctgtggctggcataggcgtagaccgccgcctggttgacgatgccgtcgttggccacggtgatttcccgggtgtactgctcggccgtggcgtggccggggacgatggcgttgttcaacccgtccatgcccatgctgatggcgccgctgcgcttgacgttggccttgtccaccagcagcacgcgcagttcgcggtcgtgctccttggccttgatcgccgccatcggcccggcggtgccgccgccgatcaccacgatgtcgtattcctgctccagggtgttcatgcccgctctcccttctgccgatcgatgcgcaggcgatactggaaagcgtcgccgcggtag

SEQ ID NO: 8813 - DNA, 1728 bp, Pseudomonas aeruginosa
acgccgtcgaggatgcgcccgcgcagcagctccttgagctggctgtacagcggcacgggagaaagcgggagcagtttgcccatggtcggattcgcttgtcggagtggctcggacacttgttataacaagttatgctgtgatggtaaacgccatgaacgatcaagcggaaataccgaaaacgcatatggatatggcgccacccgtgcgtggctctcgccggccaaaggaccggcccgcagcgcggaccggcccgccccctcagcgcagcggccgccagagggtgaaggctaccggcggcgtccagccgctgttggaggtgtgcgcctgcaggcagagatagcgcagcccctcgtaggtcaccccatcgtcgacccgataggcctggttctcccgccattgcgggaattgcggatccaccgccccgccgctggtgctgacctccaggccttcgctgggcagcgactggttgccctgggtatcggtggcggtgacgaaatagctgtagcgggtgtccgccgtcaggccgctgtcggtggaacccagcgcagcgctctggccaaccatggcgccgtcgcgatagaggctgtagtaatcgatcggacgctgcccgctggaggcgttccaggccagcaccaggctggtctcgccgcgctccagcagacgcaggccctgcggcgccgccgggcgctggtcgccgccctcgccgtcatggatgaggctggcgtagcgcttgcggaactcccagttgtagcgctcgccgcgcttgttcaggccatcgtcccagttcaccgaccaggtcatcaggcccttgatcgcgtgaccggcggcttccaggcggcgaaacgcgttgctcaccgcggcgggatcgatcacgtagccggtagccgccgcatcgacgttgctcggcaggccgatggccaggcgctgcgccgggatccgcacgaagtcgcggctgccggtggccaggctctcggtgaggtagtagaggaagtcttctttcatcgcgtcgttgttctgcgcgatccaggcgcccttgccgccgttcgcctcctggacccacaggccgtcgccgccctggttgtagtactgcggcgcgatgaagtcgtagacgccttccagggcctgcagataaggcacgtacttgccgttcttgtgcagatagggaaactccggggccatgctgacgatgaagtgcttgccctgcccggcgtagtgctcgcgcaccagcttgagggccgccggcagcacccgctggttgtcggccaggtcgatggcgctctgctcgaggtcgatgtccaggccgtcgaaaccgtaggtttccaccagacggacgatctcggcggccagcgcctgctcctgcccggcgtgcaactcgatgtgcgcgtcggcgccccccagcgaaatcagcaccgcgcggccctgggcgttgagcacgccgacctggcggcgaaactccgcgtcggacaggttgtatggctggaaggtcgggatgccgcgccctttcatgaaggccacggcgaccacgttgtactcgctcggcacgtcttccagcgcgatgttggcgaacgagccctgctggtagccgtcggcggcgccggccggccagttgtgccagaagcccatgagaatcttcttgccggcgatgctcggcatggccgccgcggcatcttcgcgggcctggtgcaactgggaaaagtcgatcctgatcatttaccgctcctcggatga

SEQ ID NO: 8814 - DNA, 1011 bp, Pseudomonas aeruginosa
gaaacgcatccggaggggctgtccgacgaaccgcgccgtggccgccgcgaacgcttagaaaaaacaggcgcgagcgtctaccacggggcattccggcgtttgtcgcgatcagggcgggggcatggttgcagagacggcggaaggcttcacctaccacaattggcagagccgcggcggcgatgctccgcgccgggttcaaccggcttcgctgagttcggcgaccaccactccgggaaggtctttcagcagtgccggggacagcagcagcttggtctcgcggaccccggcgcccatcaccaccaacggccgttcgaagaccgccgcgtcgaccagcagcggcatgccttcgggcaagccgaacgcggtgatgccgccgaactgcatgccggtcagctcggtggcgacctcgcgggcggcgaaggacagccggcgggccccgagcagcgccttgaccgcgccgttcacgtcgagccgccgcgagcccaggttgaccaccgcggcatagccttcggcgccgtcgcgcttgtagcgcaggaccagggtgttggcgcagtcctccaggccaaagccgtagcgtgcgctgaacgccgcggtgtcggaatgctcgtcggcgacgcggaacaccaccagctcggcggaaggcaggccgcgcgcgacctgctccggcagatggcggtggtagtcggccggggcgacggcgtcaagccggtggcgttgggtgtattcgcgcacaaccatgggcaacctcgaatgaagacggacggcaccggcccctgccgccaggcgggcggcaggggccggcggttcaggttgccaggttcgccggcacgccgccaggcacatcgggcgccaggcgctgccgcaggatcgcgcaaacctcctccgccgccgtcaccaccaggccgtggccgccggccagggtctccagctcgtagcggctggcgtgccgccgccagccgtcgatggccaccctggagacgcccgggtcctgctcgccgaggatcgcggtga

SEQ ID NO: 8815 - DNA, 930 bp, Pseudomonas aeruginosa
agcggcacaacgctcggccatgcgccgccagcaacaacgaacgcaagggcaagccgctgcgttcggccagggcgcgcaagcgcgacaggctgtcggccggcacgtccacgcggaccgccgccatgcgccggggtccctcctccgccagtccgggcaacggccggtagcgggcgccggccaggtagtcgagccagaacagcgccgaggcggcgttggcctcggcctcacgctccagcgccacgtagtcgcggaagcctactgcgggcgcttccgcttcccgcgcgacgacaccggcgagaaggtcggcgtagaccgccagcagctcgtccaccaggctttgcaggctccagccgtccagcacgctatggtgttcggcgacgcccagggcgaagcgccgctcgtccagcgccagcgcggcgaggcgcaccagcggtgggcggctccagtcgaacggggtggcctgctcttcctcgatccaggcacgcaggcgcaggcgccgtgtttccccgtcgaggccacacaggtcgtgcaccggcacctcggcggcgaccgcagcggccgggtggacccattgcaggggaacctggccaccgtgcagatcgaagccggtacgcaggatcgcgtggcggccgatcaggatcgcccaggcgcgcgccagcaactcgccgtccaggcgtccatgcacctcgtgcaggacgacgttgtgcaacagccgtggatcgccgctggcctcgctttgcaggagcatgccctgttgcaggctggtcatcggataggcgtcgtcgagcccctccggcaggcgcttgcgttccgccgccgacaacagggcgaacggctccagcgtctgcggcgccgagctcgcggccgcatccgccggactcgccggagcggccagcaggcgcgccagttcgcggatgctctggtggttga

SEQ ID NO: 8816 - DNA, 720 bp, Pseudomonas aeruginosa
cgccgatcgccgggcgtttcagcacgctcttccagatctccagcagggccgcctcggtggcattggccggcgcttccagggtctgcgcggccgcctcggcggccagcgccgccaacagcgcgcgacggtcgagcttgccttcggcggtcagcggcaggcgttcgacccgggcgatccggctcggcagcatgtaggccggcaggcgcgcctcgaggaagccacgcagggcctgctcgctcagctcgccgccgagggccgcggcggggcgcggcgcgagcgcgcgccagtcgatgcgctcagccagcgactcggcatagcccgggcgcaccgcgtagcagttgtaacggtcggtaccctccagcagcgcgtcctgacggatgctcacctcgaagccatggcggcgcaaaaggtcgctcaaggcatcggcgcggccggcggtggcaccgtcgcgcttgtcatggacctccaggacgatctgccggaccttggccagcgccgcatcgtcgagaccgagcagcacatccatttccgcgcgctgcacgtcgatcttcagcaggtcgatacgctccaggcccagttcgccgatcacctggtcgaggcggcgcaggcggcagcggtgggcttcggcgcgcaggcggtcgtcgaggatttcgtcgatgttgtccagcagcaggttggccccgccctcctcgccctggttgctcaggtagcgtcggatga

SEQ ID NO: 8817 - DNA, 1083 bp, Pseudomonas aeruginosa
cggcaatccagctcggccaccccggcgccatccagttcgcccgccagccaggcgaagcccaactcggcgagcggccagtcgggggcaaagggatcgcgcagggccgctgcctcctcctgggcgaggatcgccgcctggagggcgtcgagccgctcgccgacgctgcccgcgcggacattctccaggcacagcggcgcgaccccggcgaacggtccggccagctcggcgaactcgttgaacaggcgccccgagaccagtcgcgccatttccagagggagtccctcgtcgccctggaactgcccggcgacctgggtccaggccagcagggcggccgcctccggcaagccgttggcggccaggcgttcgagcagcgcgcgcggcagcaggcgccgcgcccgtccaatcgccttcgcccaggtcgtccgccagcgccagcggactttccgccgcaacggccgcctgctctcgccagtaaccgctggcgctttcgccgtcttcgccggccagcgcctcgttggcccactcggagaaatgctggaacagcagcgcctcgtctccctcgtccgcgctcgcctggccggccggccccaggccgcggcgcagcagcgccaccaggctggccgcatcgacgacgaacgccggcgccgccagcaacagcccctggagcgtctctccggcggcgtccagcagcaggccgagcgccagtaccggctggccttccccgcccaggggcgaagcggcgagacgcgcgctttcgcgcgcgaagcgtccggcccagtcgccatctcccggcaggcgctcgaccagcagatcggccgcgcgcccatccagtacctgcaccggcaggctcatgcccggcatcgtccggtaggccacgcgcagttgcgcctcgccgtccagcgcccggcgcagccgctccagcgtcgccacggtatcggccggggcgtgcaggcgcacgccgacaaccgtattttccggccgctcggcatggcggcgccaggcgcgggtctgcaagggagacagcgggaatccttcgagcgcttcgctcgcggccggttgcacagcggattgcaggtcttctga

SEQ ID NO: 8818 - DNA, 2019 bp, Pseudomonas aeruginosa
acgaggcgctcatgcggtacctccgagcgccaggcgcgaaggtgtcggcgggacatcggcgggcgccaggctggaatacggcgtggacatgatggtgaggatccgtcgcggcccgcggaacggctcgcggccgtgctgggcgagcatgttgtcgaggatcagcacgtcgcccacgcgccagtcgaagcgccgcgtctcgcggtctatggcgctgcggatggtcgccagggtctgcgcctcgatcgggctgccatcgccgtagtaggtctggtacggcaggtcttcctcggcgacgctgcgcagcagcgcatcgcgcaggcccggctcgagactggtggcatggaagaacatgccgtggttgaaccacaggcgctcgccggtatacgggtggcgttggaacgccgcgcgcctctgccaggtgcgcaggtgctcgtcgccgatccaggcatgggcgatccggtgctcagcgcagaacgcctcgacctcggctcggctgtcggtctggaacgcttcgcgccaggacaggccgaggccggcgcggtagttgcgcacgtagaggatgcccaggcgcccgaagcgttccagcaattcgtccggcaggtggcggagcaccagccggttggccgccaccggggtggcgccgccctcgagcggcgcgacctggcaatggaacatgatgtacagcggccagtcggcggtataggactgctcgttatgcaggaagatcggctggtccaccggatgctcggtggaggtgtagacctcgccgctgacctggctacgcggcgaggaacgctccttgtagtcgagcagttgcggggcgaaggcagcggcggctgcgcggaagcgctctgccgagtcgacctcgaagcctctcagcaacaggccgccagccaggttcaggtcgtcgtgcagggactggccctgctcgcgaatccagtcggccagggacaggccgggagcctgtgcctcgatcagcagcggcaggccgtcgcgctccgccgccgggcgccgcaccagcgcctcgctgctgcgcgggctgagattgcgcggccgggcgaagccgcgaccggtgagactgggagctgttcgttccatcgctgttctccgtgggaggctcggggtcgtcaggaagcgttgcagccctccggcgacatgcgtttcgaaataggttcgccggcattcgccagcaggcgccgctcccaggcctggtgcaggcgctcgatgcggtgcaggtcgaagatcgcgctggccccggtccagacggccagccaaccctgcggctggtcttccagccacagcgtcaggtccaggcgcgcgccaggcaccgggatgaagtcggcttcgacgcgcaccccggcatccaccgccggggccgcccgaccgttgtgcgcgccgcaggcgatgcggatcggcaggccgctggcgccgcgctggcgcagggcctgggtcacgcattcgaggggcacgtcctggtgttcgagcagttccagcagatcatggccgacctggcgcaggcgccactccacggactgctccggacgcaggccgaccgccagcggcaggaggttgacgaagcagccgaccagcccctgcatttccaggcgcgaacgcccggccagggccacgccgacgagcaggtcgtcgacgcccagttcggcgccgagcacttcggcgaaggcctgtagcgcagcactgaacgggcttaccgaggtgcgttcggccagcgcccggcaggcggcatggacggcggcggaaaccggcagggcgaggcgttggccggcgcgcccgccgctctcctccgggcgcgccggcgcggcgccgggagccttcgccagcggcaacaaacgctcagcccagcgctcggcgacacggtccaggcgtcccgaggccaacgccgcgcgctcgcgggcggcaacctgttccggcgtgctggcgagcacgcccaggcgaccgccatcgagcagcgtcttcagttccgcggcaaagaccgccagcgacacatcgtcgaaggcgtag

SEQ ID NO: 8819 - DNA, 630 bp, Pseudomonas aeruginosa
gccgggtccagcgggacgtatcaaccgccggcgcggagcacgccaagcaggccgaccagcaggccgctgtcgcgccgcatgcagaccccgacccgctgctccggagccaccccggcggcgcgcaggcgcacggcgagcgcggcgctttcgcgctccagctcggcatatctgaggctacggtcggcggcgtgcacggcgatgcgctgcggtgtgcgccgcgcctgggcctcgaacagatggtggagtacgccgcgcgacggggcggcctggggctcgctgcgcatggcctgcatacggcgctcttcgtcggcgtccatccagggcagccggccgacgcatgcctgggcgtcgaccatgccgcgcgccatgcgcgcgagatggccggcgatacgccgcaattcgtcgtactggggatcgcgcagagccaggccgacgctgccgtccgccgccagcaccagggccagccagccggggctgctcgccgttggccgcgccgccagcacctggaccgcgcagcacccggccagggcggcgcgctcctggccgtcggcggatagctgccgccgggcgtcatcgagttcttccgccagccgcgcgctacgttcggcggacgactccatcgcccggtag

SEQ ID NO: 8820 - DNA, 1287 bp, Pseudomonas aeruginosa
cccttgaacagcaccagcagggagatccccgccttggccggcagttcgccgctggccaggccctcgccgagggccctggccgtctgcaggaagcctggcagcagcaggtcgttgccctggacccgcgccgccagctcccaggccagcgccagcagcgccaggatcagccccttgcgcagccagccctgttgccagagacgctggctcaggggcaggcgccgctccagggagacctccagcaggggttcgagctggacttcgtattcttcgcgaacgcgcgtgactcgactcatcgatcgattcctctgctcaatgggccagccggatatcggcgaagtcgagggtcgcggccgccgtcggttcgccgccctcgtcgaacagcaagcggtggatgcgtcgcgccgcggcttgcagcggctcgccgccaaggctgtgcagcccgaacgggtggccgtgcacttcggcccggacccgccccgggtgcggcgagagcagcaggatgcggttgcccaccaccaacgcctcctcgatggagtgggtgacgaacagcagggtgaaacgcacctcttcccacaggcgcagcagttcttcctgcatctttcgccgggtcagcgcgtccagcgcggcgaacggctcgtccatcagcaggatcttcggctgcatcgccagcgcccgggcgatcgccacccgcgccttcatgcccccggacagcgtgtgcgggtaggcctcggcgaagcccgccaggccgaccttctcgaggcattcgtcggcgcgtcgctcggcctcgtcgcgcgtcacctggccggacacccgcaaggggaacagcacgttctgccgtacggtcttccatggcggcaactggtcgaactcctggaacaccacgatacggtcggggccgggcgccctgaccgcctgtccctgaaggcggatctcgccctcgctgggcgtgatgaagccggccaccgccttgagcagggtcgacttgccgcaaccggacgggccgagcaggacgaagcgatcggccgggtcgacttcgaagctgacccgctgggtggcccgcaccacgcgcgagcgggtgcggtattcgaggctgactccgtccaccgccagcagggcgtcggcggggagcgtggaaggttggcgggaggcggcgttcatcggcgtctcaactcccctgcaacggcgcgccgtcctggaagaaatagtcctgccaggaggccggcttgttgcggatcgcaccgacccggtagagaaactccgccagcggataggtgttcttcggcgtga

SEQ ID NO: 8821 - DNA, 471 bp, Pseudomonas aeruginosa
tcttcagcagcgcggctcggtcgatcttcgccccggtcacccggatataggtatcggcggcggccgccttgtcgttctgggcgaaggccgccgcttccttcagcgcctcgacgaaggcccggtaggtcttcgggttgtcctggcggaacttctccgtggcgaacagcacggtcggcgaattcggccccagcagctcgtagctgtcgagcaccacgtggaccttcgggttggccagcgcctggtcctggaacggcgggttggagaaatgcccggtcagctcggtgccgccggccaccagcgcggcggtggcgtccggatgcggcagcgccacggtgtacttgtcgaggcggtcgaactgcttgtcgccccactgcttcgccgcggcgtactggaggaagcgcgactgcaccgaaacccccaccgccggcacggcgatgcgatccccggcgccgaagtcggcgatgctcctga

SEQ ID NO: 8822 - DNA, 747 bp, Pseudomonas aeruginosa
cgaagccctggcgtacctggtgatgacctacccggagcgcctggactgacccccggccttgctgccatggacgaagaaaggcccgcccggtcatcccgggcgggccttttccatccggcgacggatcagcaggtgcagcacatcatcggcatgccgttgcaactcatcatcatcggcatgccgcactccatcatcttcgccatcagcatgcagcagttcttgaacatctccatgtccatgccctgcatcggcatcatcctgcagtgcatggcgtcgccctgcatggagcactccatcatgcacttcatcggagccatgcccatcatcggcatgcccatccccatgcccatcgtcggcatcatcgccatgcaggcctgggacatgcccatcatcgccaggttgccgcactgcattatcatgggcatgccgcagttcatcatcatcgccatcatctcggcgctgttgcggaactggcccatgtccatgcccatcgccggcatcatcttgcacagcatgccgtcgtccatcgtttcgcactgcatggtcgccatcatcatcggcatgcccatcatgggcatcatcggcatggcggcattcatgttcatcggcatctgcatggcattcatcatggcggtaactcctgtaggcgaagcgggggtaggtgcgaatggggccgattctaggcagcgccgacgcaccggcaagatgccggtgcaacagccgagccgggcgctgcatggtggctag

SEQ ID NO: 8823 - DNA, 1110 bp, Pseudomonas aeruginosa
ataaacgttctaagacccgcagcctttttccccttgccgggcgcagccccgtctattgcgccgctttccggtgctcggacgatgccctgcggaagtcgcgcgggccgacgcggaaagcgtgcgcggcattgccccagaccagcacggcggccaagccgatcagcggtagcagggtccagggcagcatctcgctgccccagcgctgcaacaccatgccacccaacgctccgccgccggcgatggccaggttccaggccaccacgatcatcgactgggccaggtcggcgccctccccggcggcgtccgccgaggcggtctgcagcagcgtcgccgcgccaccgaacgtcagcccccagagggccaggccggcgaacgccagccagctccagcgagcgcccaggcacagcgccagcgccgccacggcgaacagcgccaggctggccaggaccatccgccgcaggtgccggtcgaccagcacgccgaccagccagattcccgccaccgcggcgctgccgaataccagcagggccaggtccaccgaggcgcccaggccgaccttggcgaggaacggcgcgatataggtgtagaggatgttgtgcgccagcacccaggcgacgatcaccagcaataccggacgcacgcccggcgtgcgcagcaccccgagcaggcgcaggcgccgcccggccggctggccagggaagtccggcacgctgcgcagcacccagccgaccagcagcagcgcggtcagcgacaacaggccgaaggcccagcgccagccgagcaggccgcccagccaggtgcccagcggaacgccgagcgacagcgccagcggcgcaccgagcatggccaccgccagcgcccgcccctgctgctccggcggcaccaggcgccgcgcgtagccggccagcaggccccaggcgaggccggcggcgacgccgctgccgaagcgcgccagcagggtcaggcggtaatccgaggaaacggcggttaggctgttgcagacgaagaagatcagcagcgccagcagcagcacccggcgccgccgccagccctgggtcaggctcgccgccggcagcgcggccagtagcgaacccaaggcgtagacgctga

SEQ ID NO: 8824 - DNA, 1359 bp, Pseudomonas aeruginosa
gaatggcgacgaagccggacatcgccatcgccagcagcgcactcagcggcagccgcggcgccacggccgacgcagcggccccggcgttctccggaaatgcttcgcggcgtcccatcagcgcagctccgcggaacggtagacggcgtcgcgcaggtcgttgacgaagcgtcccgacatgccctcgaacagggtgttggtaagcgccaccaccgacagttcgcgggcccggtcgacgaaccaggaatgcccgtaggcgccgccccagcgccaggtgccgggagcctccggcgattgcgcgatagccgggtcgcgcagcacggagaaacccaggccgaagccgaaaccgggattggccggcagttccaggccgggtacctggtcgcggcccatctcctccgccaggccaggcgtcagcaacggcgcgccgccctggcgaaggatttccaaaaggcgcagcacgtcgccggcgctgccgatcatccccgccccgccggacgcataggcagacggttcgaaggcccgactcggctcgaagcgaatgccgacgctgtcctcgaacggcgccacggtctcccgcccggccattcggcgcgggcgtggccggtcgctgacgtagaccgccgccagtcggcacgcgtcggcgcagaggaagccgctgtcgcgcatgccggctggaatcccgacccgctgccgcagcgcttccgccagcggccgcccgtcgacccgctccaccagcgcgccgagcacgtcggtggccagcgaatagccccaggcgcggccgggttcgtagagcaagggcacggaggccaggcgacggagattctcggccaggtcgaaacccggcaggtccatgccatcggaaatcccggcgcgggcataggggccgtctgcgtcggcttcgaggaagcgatagccgaggccggcgctgtggctcagcaactgccgcggcgtgatgcgcgcctcgcggccgtcggccaggcgcggacggaacgccggcaaccagtcggcgatcggctcatggagggccagccggccctcgtccaccaggctcagggccgcgacgctgacgatcggcttgctcaccgaggccaggcggaacaggctgtcctcgcccattatccggccggatttgcggtcggccaggccggcagcccgtcgatagagccactgcccccggtgtgccaccagcaccaccgcccccaccaggcgctggtcggcgaatgccgcctcgatcacctgatcgacattttccgccaggccgcagcctggctctcgttcgaaactggacatgcgggactctccgcagatgaaggatgcggacaggataagagcgctgcaaaagcggaaaaagacggatag

SEQ ID NO: 8825 - DNA, 906 bp, Pseudomonas aeruginosa
tcggagccttgcatggacagcctcagcggtttcaccgtcttcgtccgcgtcgccgagacccgcagcatcgtcggcgccgcccggaccctcggcgtcagcgcctcggcggtgggcaagcgggtcgcccgcctggaagagaaactcggcgtgcgcctgttccaccgcagcacccgcagcatcaccctgaccgccgaaggcagcctgttcctcgagcgcagccggcgcatcctggccgagatcgaagccaccgagctggagctgtcgcaaagccgcgagaccccgcgcgggcgcctacgggtcagcctgccgctggtcagcgggctggtcctgccgacgctcgccgatttcatgcaggcctatccggacatcgagctagacctcgacttcagcgatcgcgtggtggatgtcgtcgacgaaggcttcgacgtggtcctgcgcaccggccagccggtggattcgcggctgtccatgcgcgaactgggtgagttccagctgaagctggtcggctcgccggcctacttcgcacgccacggcacgccgcgctgcccggaagacctgctgcggcacacctgcctgcactaccgcttccccaataccggccgcctcgaggaatggccgctgcgccgcgcggacggcgaagccccgccgcagatcccggtgtcgatggtctgcaacaacatcgagacccgcgtctgcttcgccctgcgcgaccagggcatcgcctgcctgccggacttctcgatccgcgaggcgctgcgcgaagggcgcctggtcagcgtcctcgacaccttctgcgagcgccgcgcgcggttcttcctgctctggccgtccggccgccaggtctcgcccaagctgcgcgccttcatcgacttcgtcgcgccacgggtgatcgccacgctgggctga

SEQ ID NO: 8826 - DNA, 618 bp, Pseudomonas aeruginosa
cgctgtctcacgcttgaggtgttccatgcatccacccctccaagccctggtcatcatgggtgtcgccggttgcggcaagtccagcgtcagccaggccctttgccagcgcagcggcgcccacggcatcgaaggcgacagcttccatcccgccgccaacatccgcaagatgagcgccggcattcccctcaccgacgacgaccgcgccggctggctggacaccctcgccgagcagctgcgccaggcggtggccgccggcaagctgccggtactgacctgttccgccctcaagcgcgcctaccgcgaccggttgcgccgcgcggtgcccggcctcggcatcgtctacctggaactgaccccggcggtcgccgccgagcgcgtcgcccagcgccccggccacttcatgccggcgaccctgatcgacagccagttcgccgccctcgagccgccgctcgacgaacccctgaccctgcgcctggacgccaccctgccggtggaatgcctggcgcaggccgcccacgcctggtggctggagcacaccgccgcctgaattctttcgcttgtccgacaaagatagcgctaccccgaaaaagcgcttcaatgaaacagcaactccggtag

SEQ ID NO: 8827 - DNA, 1929 bp, Pseudomonas aeruginosa
ccgaaccaatgcaacgccccgaccacgaagcctcgcgctggccgcgcgacttcgatatccgccagcgctatgccgagcagcaggaactgcttgagccaccgccggcgcggccccgcgaagagcctaccgccgacgcctgaagccagccggcgccatgcctttgctcccgccccccacgaagcgggagcaaaggctgatttccggcaagggcgcgacggttttcctgctgaaacgatttaccttcgatccggaccgcgctacaacagtcccacgcctttcatccacgtcattcgaggacccgccatgaccgccccgctccacctcgattcgctgtttcccagcctcgacgccattcccgagcagtaccgccccgacgcccccatcgagcagcgcgactacctggtcgacggccaactgcgatattgggacggcccgctggcgccggtacgcagcccggtattcctcgccgaggccgacggcgagcgccaggtgatcctcggcagcaccccgctgctcgacgccgacgccgcgctcgccgcgctcgacgccgcggtgcgggcctacgaccacggccagggcctgtggccgaacctgcgggtggccgagcgcatccagcacgtcgaacgcttcctggcgcggatgcgcgagcaacgcgaggcggtggtcaagctgctgatgtgggaaatcggcaagaacctcaaggactccgagaaagagttcgaccgcacctgcgactacatcgtcgataccatcgaagcgctgaaggaactcgaccgccgctccagccgtttcgaactggaacagggcaccctcggccagatccgccgggttccgctgggcgtggcgctgtgcatggggccgtacaactacccgctgaacgaaaccttcaccaccctgatcccggcgctgatcatgggcaatacggtggtgttcaagccggccaagttcggcgtgctgctgatccgcccgttgctggaagccttccgcgacagcttcccgccaggagtgatcaacgtcatctacgggcgcggccgggaaaccgtgtcggcgctgatggccagcggcaaggtcgacgtgttcgccttcatcggcacccattccggcgccagcgacctgaagaagctgcacccccgcccgcaccgcctgcgcgccgccctcggcctggacgcgaagaacccgggtatcgtcctgccgcaggtcgacctggacaacgcggtgaacgaggcggtcaccggcgcgctgtccttcaacggccagcgctgcaccgcgctgaagatcctgttcgtccacgaaagcgtgctgcgaccgttcctcgacaagttcagcgcgcgcctggccagcctcaagccgggcatgccgtgggaaccgggagtggcgctgacgccgctgccggagccgggcaaggtcgactacctcgaaggcctgctgaacgacgccctggccaagggcgcacgagtggtcaatgcgggcggcggcgagcatcggcaaagtttcttctaccccgctctgctgagtccggtgagcccggacatgcgcctctaccacgaggagcagttcggtccgctggtgccggtggtgccctatcgcgagctggacgaggtgatcgactacgtcctgcgctccgactacggccagcagttgagcctgttcggcaacgacccggcgcagatcggccggctggtcgacgccttcgccaaccaggtcggccggatcaacgtcaacgcccagtgccagcgcggcccggacagctacccgttcaacggccggaagaattcggcggaaggcaccatgtcggtccatgacgcgctgcgggtgttctccatccgcaccctggtggcgacccgcgacaccgaggcgaacaagaccctggtcagcgagatcatccgcaaccgcgcgtcgaacttcctcaccaccgactacatcttctga

SEQ ID NO: 8828 - DNA, 702 bp, Pseudomonas aeruginosa
agcgcctgtccctctcccgccgggagagggacctgccgccacctcccccactgtccgccaggcagcagccgcgcaacaggctgccgccccggcaacacctcctgctcgcgcgaacccgcgcaaccagtggcctgcgcgggtcggcacaggctgtgcaacggcccggactccagggtagccgtcgaccggacggccccgctgcctaccaggagtccgcatgaacgcccgcgtccatcccgaagccaccgccaccagtctctccgaaggcgccgactacgaactgctcgcccagcgtttccgaccgatcttcgcgcgcatcgccgaaggcgccgtcgagcgcgaacggcaacgcgaactgccccacgaggcgatcgcctggctcaagcaggccggcttcggcgccgtgcgcgtgccgcgcgagcacggcggcgccggcgcctcgctgccgcagttggttcagttgctgatcgaactggccgaggccgactccaacatcacccaggccctgcgcggccacttcgccttcgtcgaggaccgtctcaatgccgagcccggccctggccgcgaccgttggctgcggcgcttcgtcgagggcgacctggtcggctgcgcctggaccgaggtcggttcggtacggctgggcgaagtgctcacccgcgtctcgcgcaaggacgacggtcgctgggtggtgaacggcagtaa

SEQ ID NO: 8829 - DNA, 2040 bp, Pseudomonas aeruginosa
gtactacagcaccggcagcctcttctccgactggatcgatctgtatgcccagcgcgacgacaccggcgccgatgtgatcgcggcgatccgcaccgaccagcccggcgtgcgccagagcgacgactgggacggcttcggccagcgcaccaccggcagcggcacgtcgctgttcgaggatgccgaggtggaggaagagaacctcatcgacttcgccagccgcttcaagtaccagaccgcgttctaccagttggtcctgctcgcggtgctggccggcaccggccgcgccgccttgcgcgacgtcgccgccgaggtgcgcgggcggacccgtatctacagccacggcaatgccccgcgagtcagccaggatccccaggtgcagcaggtggtcgggcgcatcgccgcgcgcgtctacgccgccgaggcggccaccctgcgcgccgccgaagcggcccagcgcgcctacctggcgcgcttcgtaggcgacccgcaggcggagaaggaggccaatatcgccgccgagatcgaatcggccaaggcccaggcgatcgtcgccgaactggtgttgcaggccaccagcgagctgttcgacgccagcggcgcttccgccgtcggccgcggcaagcagctcgaccgccactggcgcaatgcgcgcaccgccgcctcgcacaatcccctgatctacaagcaacggatcgtcggcgactgggagatcaacggcagcgagccgccctacgtctggcagatcggcagcggtccggccacggcgtcccgctgaacctcgcccatcccatcgcaaggagttgccatgagcgcactggaaaagaacgccgccgatccctatcggcaaccgctgccacggaccccggcccggcgcatcgccgacgacgccgaggcgatccgcgtcgcccgcgaactggccgggctgttcgccgaggaagcctcgctgcgcgaccgccagcgccggctgccggtggccgaactggaagccttctcgcagagcggcctatggggcatcagcgtaccgcgcgcctacggcggcgccgaggtcggctaccggaccctggccgaagtactgaagaccatcgccgcggtagacccgtccctggcgcagttgccgcagaaccacctggcggtgctcgaccatttgcgcctggacggcagcgaggagcagaaacgcttcttctacggcctggtgctagacggcgtgcgcttcggcaacgccttctccgaacgccacagccgtaccgtcgccgaattccagacacgagtgctggcggatggcgacgggttccgcatcgacggccgcaagttctattcgagcggcgccctgctcgcccactgggtaccggccgtcggcctcgacgccgagcagcgcgcgcacctggcgttcatcccgcgcgacgcgccggggctgacggtgatcgacgactggtccggcttcagccggcgcaccccgccagcggcaccgtcatcctggacaacgtgcgggtgccggccgagcacgtcatcccggtgcaccgcgccttcgaccgccccaccgccgccggcgccgtatcgcagttcatccaggccgccatcgacgccggcatcgcccgtggcatcctcgccgagaccgtgcagcaggtgcgccgccacgcgcggccatggatagacgccaaccagcagcatgcctgggaagacccctacaccatccagcaggtcggcgacctgcgcatccgcgtgcgcgccgcggaagccgtgctcgacctggcggccgacgccatcgaagcggcgctcgccgcccccgacgaggagagcgtggccgccgcctcgatcgcggtggccgaggccaaggtgctcaccaccgaagccgccctgctcgccgccaaccggctgttcgaactggccggcacgcgctcgaccctggaggaactcaatctcgaccgccactggcgcaacgcccgcacccacaccctgcatgacccggtgcgctggaaataccatgccatcggcaactaccagttgaatggggtgaagccaccgcggcacgcctggctctag

SEQ ID NO: 8830 - DNA, 279 bp, Pseudomonas aeruginosa
gccaggttgaagccatccacgtcggtgtcctccacccactcctgcaacaggtcggcgacggtcgccgggctgccgacgaacagcggtccgaagccgccgataccgacccagtcggccagctcgcggaccgtccaggtgcgcgtcggatcggcgctggaaaacgcttccaccgccgattggatcgcattggtgtggatgtgccgcagcacctggtccggccgatactggccgaagtcgatcccggtccagccggagatcagcgccagggccccttcgtag

SEQ ID NO: 8831 - DNA, 408 bp, Pseudomonas aeruginosa
tctcctcgctgcgctggaagccctcggcgaggccgaacgcctgcaacccgccgacctctgccagggcctggcggacgaagcggtcgtccaccaggtcactggccacctggcgcggatcgaggctggcgaggaaggcattattgccttcgatcagggtgtccttcagccgccgcaccagttcctcggtatagctcggatagggatagggctggaagtcgatgcgtcgctcctgccagtcggcgtggcggatcgcgccgctggcgagataggcctgctgctcctcggcgcccggcgccagcacccggccgaggacctccggtgcgtgcggcgtgtagcggttggctccggccttggacagcaactgtgcggcctcggcgcggtgctcgcgagtccatagctgggccttga

SEQ ID NO: 8832 - DNA, 363 bp, Pseudomonas aeruginosa
cgggcacgggcgtgctccaggccgaccgcggcgatcgcctggtcgacgcgggcctggcgggtggccgcgtcgaggtgcggctggcgggcgaaatcgaggccgaaggcgacgttcttctccaggttcagccagggcagcaggctggggtcctggaacgccaccgcgacgcccggatgcggtccgcgcaggggctcgccgagtacccgcacgctgccggcggccggctcctgcaggccggccagcacgcgcagcaggctggacttgccgacgccgctgggaccgaggatcgagaccacctcgccggcgcccaggcgcaattcgaaatcgccgagcaccgcctgccagccggcaccgcgcggatag

SEQ ID NO: 8833 - DNA, 771 bp, Pseudomonas aeruginosa
cgatcgggacgaacgccgactcgcgccagcggcgggcgaaaccggcgccgtgctcgctcaggtatgccttgccgccgctggcctgcaactccagttgcacggcattggcggcggcttcggcgagcccgatgcggatgcggaacaggcgtgccggctggctggcgaactcgccgctggccagtccggcgtgcagcgccgccacgtgtccgtcgagggtttcgcgctgtgccgccagctcgccatccaggagcgaacggctgccgcccaggtgccgctgcacttcgtccagtgcgcggcgcgccaggccgatggccatgccgcattgcaggccgaggaaggccgggcgcacccgtggcaggaactgccgggcgtcgtcgtgcaacagccagtcgcgcccgaccgccaccgcgcgcagatcgagggcggcggtgttgctgcattgcaggccgagcaggcgcaggtccgccgagcgctgcaagccggcgagtccttcgggaatcgccaggacgaagggcttgccgccctccccgtgttcgatcgccgccgccaccacgaaatcgccgctgcgcaggttggtcacccacggcaggcgaccgtccaggcgccagccggcctcctccgcgtgcgccaccacctgcagcgcctcgatcccggagaggaacttcatcgcgttggacagcccagtggcgccggccaggcggccggccagcaggtcgccgagcaggcgttggcgcagttcctggttgggactctgcaacaggtactcgatga

SEQ ID NO: 8834 - DNA, 510 bp, Pseudomonas aeruginosa
aggcgcgctggccccagaagacgaacgccgcggtcagcgagcgcgccgccactgcggccacccgctccaccgcgtcggcgagcgtgccgccggcgccgccgaggcgttcctccaccgccacgccgagcacgccggcggcggccaggcgcggcagcagcgcggcgggatcggcgtcgccgcggtcgagggcgtcggcctggcggtcgagccagtcgctcagggtcgggtcaagcatggtcgtcactccttgcgccggcgcggcatgccgcccggcaagcgcaggctcaggcctgcgggttggtccagcgatattgctccagctcggcattgagcggcgtgcgggcgaacacgttggcgaagttgcagagcgtcgccaggctcaccccgaggatcacttccagggcctgggcctggtcgaaaccggcggcgcggaaggcttcgaactgctcgtcggtgaccgcaccgcggctggcgatcaccgcgcgggtgaagtcggccagggcttcgtag

SEQ ID NO: 8835 - DNA, 1008 bp, Pseudomonas aeruginosa
gtctttcccttagatgaattcgtccaacccccttgtcgattggttattagacagcctcgaagtcgacaccagcctgttccatgtcggtcgctactgcggcggctggcatgcctccacccacggtctggcgcgtgccagcttccacctggtggtgcagggacactgctgggcgcacgtcgccggaagcgcccggggctggcgactggacagcggcgacgcgctgttcttcctgcgcgacgtcgagttccgcctgtccagcgaggccaccgccgaggcagcgcgctgccagccgcgtggcgaaatgcaggcgctggagtggaacgcggcggacggtgccggcctggtctgcgggttcttccacttccattcgggattgtccgggctgatcgtcgacgccctgcccgactggctgatcctgcgcgccggcgatccggcgctggacgcggcgcgacgcctgttcgccctgatcgtcgacgagtgccgccgccagccggcgccgtcgccggttctgctggagcgcctcagccacctgctgttcctctacgtgttgcgccagcaggtgctcgacaacccgaccctcggcggcctggtggcactggcacgccagccgcagttcgccggcctgctggaagcgctgatcgaggcacccgaacagccctggagcctggaacagatggccgtacgcaccggactgtcgcgctcggccttcttcaagcgcttcaacgaactcagcggtcagtcgccggggcaggtcctgctggccctgcgcatgcaccgcgcctgcgccctgctgcgcgccgacgccagcgtcgccgaggtcgcggcggcggtcggctaccagtccaccgccgccttcacccgtgccttccacaaggccaccggacagcagccgggggcctatcgcaaggccagccgctgatcaccagagaccgatcggtaccaggcgcccgccttccggctcgccgtagcggaacgcctggccgcgcaggtcgatctccgcgttgctga

SEQ ID NO: 8836 - DNA, 534 bp, Pseudomonas aeruginosa
tccgccgcttcagcccgcgcagccagtcgaacagcatcccggcatgggcctcgcgcaccgccgcatgcgccgggtcggcgccgaggtcgcgcaattcgccggggtcgctggcaaggtcgaacagttgggcgcggaagccgtcgtaggcgatgtacttccagcgctcgctgcgcaccatgtacatgcggcaggcatcgatgggtcggcccaggcgctcccgcgccggcgcctggaaggcgtagtcgtactcggcgatggcgtagcggcgccagtccgccggcggcgcgccatggacgaagggcagcagcgaacggccctcgatgcgatggctggcgggctcgacggcgaaggcttcgaggatgctcggcagtacgtcgatggactgcaccagcgcctcctccacccggccgcgggtggcgtccgcctcggggcgcggatcgcggatcagcaacggcacgcccaccgccgactcgaggaggaactccttctcgcccaggccgtggtcgccgaggaaatcgccatggtcactggtga

SEQ ID NO: 8837 - DNA, 585 bp, Pseudomonas aeruginosa
ccatacggaattagcagtcaccccttcatccaggacccacacatgaatcgccgacccgcgtaccgctccatcccgtcgtcccgcagcgcaccgttccgccgtcgcctgctgcccctgtcgatctgcctggcctgcgccggaggggcgcaactggccggcgccgacgacacccccgcgggcaccgaagatgcgcgccaggcgcagccggccaccaccctgcagaccgtcacggtgacctcgcggcgacgggtggaaaactcccaggatgtgcccaccgcgatgagcgtgctcggcggcgaaaccctggagagccagcgcatctaccgggtgcaggacctgcagcaactggtgccgagcaccaacgtcgcctacgtccacgcgcgccagtccagcgtgtcgatccgcggcctcggcaacaacccggccaggggacggcctggaaggcagcgtcgggctgtacctcgacaacgtctacctcggccgccccggcatggcctcgttcgaccttctcgacatcgagcagctggaaggtcttgcgcggcccgcagggcaccctgttcggcaagaacaccacggccggggtga

SEQ ID NO: 8838 - DNA, 411 bp, Pseudomonas aeruginosa
accgctacgaacagcgcgccgccgcggccggcgcgacgctggtggatggccatcggcgcaaggtcaacttcgactcggaccagcaggtcacggtgttccagggcggaacctcggtggaagccaactggaagctggccaacgacttcaccctcacttccatcagcgcctaccgctggtgggatttcacgccgcgcaacgacgacggcctggacgtaccggcggcctataacgccggagtctcggtgcgcgacaagcagtggtcgcaggaaatccgcctggcttcgcccagcggcggtttcttcgactacgtgctcggcgcctactacttcggccaggacctcgacaacaagtccttcaccgactacgggcccagggcagacatgtggaacggaacccccgccggcgccctga

SEQ ID NO: 8839 - DNA, 1038 bp, Pseudomonas aeruginosa
agccacggcccgctacccgcccctgcggccacccggcgccacgcatgggagcgaggctcgcgggtggtcccctgcacagccccgccgcttcgggctaggatgtgccttcgttcccccggtcggcccgcgcccatgcccagagccagcaaagtcaccgatccctcctacgagctgatggacgatcacgaaggccattcgctgatctaccgccagcacggcttccccagcccgctggtgcgctggcacttccacaaggaatacgagctgcacctgatcgtcgccagctccggcaaggtattcatcggcgactacatcggcaacttcgcccccgacaccctgttcctcaccggtcccaacctgccgcacaactggatcagccaggttgagcccgacgaggtggtggcccggcgcgacatgctggtgaacttcaccgacgaggtgctggaggacggcagcggcgtattctccgagctgaaccgcctggccccgctgctggcgcgggcgcgctacggcatcgagttccgcgacccggcgctgatcggcgaaagccggcgactgttgcaacgcatcgccgacagcggcggcatgacccgcctgggatacttttttatcctcatggaacagctcgccgaatgcgaggactaccagttgctctctaccgtcacttcctcgcaactggccgacgagcacaacgtcgaacggatcaaccgggcggtggactacatcttccagcactacgcccaggacctcacccaggagcaggtcgccgcccacctgggcatgacccccacctacttctcgcgcttcttcaagcaggccgccgggcgcggcttcgtcgagttcgtcaaccgcctgcgcatcagcaagtcctgcgagctgctggcccgcagcgagctgccggtgaccgaggtgtgcttcgagtcgggcttcagcaacctgtccaatttcaaccggcgcttccagcagctcaagggcatgacgcccaccggctaccggcgcctggtgacccagcggctgaccgagcagaacctgctctga

SEQ ID NO: 8840 - DNA, 1437 bp, Pseudomonas aeruginosa
tcggcagcgagcgacacaaaaacaataatgtcttccgcgccgcccgccggcccggaagaggagttcaccgatgaacgactcgatcaaggcctgcctggccgccgcctgccttgccctgcccctgctggcccagggcgccgagaccctgaccatcgccacggtcaacaacaacgacatgatccgcatgcaacgcctgtccaaggtgttcgaggaaagccacccggacatcgcgctgaaatgggtggtgctcgaagagaacgtcctgcgccagcgcctgaccaccgacatcgccacccagggcggacagctcgacctgctcaccatcggcatgtacgaagccgcgctgtggggcgccaagggctggctggagccgatgagcgggctgcccgccgactacgccctggacgacctgttgccctcggtgcgcgacggtctctccgtcaagggcacgctgtacgccctgccgttctacgccgaagcctcgatcacctactaccgcaaggacctgttccagcaggccgggctgcggatgcccgagcaaccgacctggacccagctcggcgaattcgccgccaggctcaaccgcccggaccagggccagtacggcatctgcctgcgcggcaaggccggctggggcgagaacatggcgttgatcggcaccctggccaacgccttcggcgcacgctggttcgacgagcgatggcagcccgaattcagcggcggcgaatggaagaaggctctcgacttctatgtctccaccctcaagcggtacggcccgcccggcgcctccagcaacggattcaacgagaacctggcgctgttcaacagcggcaagtgcgcgatctgggtggacgccagcgtcgccggttcgttcgtcaccgacaagagccagagcaaggtcgccgacgccaccggcttcgccttcgccccccgggaagtcaccgacaagggcgcctcctggctgtattcctgggccctggcgattcccgccagctcgcgcgccaaggacgtggcgaaggccttcgccacctgggccacctcgcaggcgtacggcaagctggtggcggacagggaaggcgtggccaacgtgccgcccggcacccgcgcctcgacctacagcgaggcctacctggccgccgcgccgttcgcgcgggtcaccctggaatcgctgaagcgcgtcgatcccaaccatccgacgctgaagccggtgccctatgtcggcatccagttggtcaccatccccgagttccaggccatcggcacccaggtcggcaagctgttctccgccgccctcaccgggcagatgagcagcgaccaggcgctcgccgccgcgcagcagagcaccgcccgcgagatgaagcgcgccggctatccgaagtagtccgccgccgggcgcagccgcgcccggcgcggcgctgctcgagcgcttgtccttga

SEQ ID NO: 8841 - DNA, 969 bp, Pseudomonas aeruginosa
agatccagacggagtcgccatgaacacctcggccctcgataccccgctcccggcccgtcccgcccgccgccgtctccagcgccgccggcgcggccctggctggctcctggtcagcccctcggtggcgctgctgctgttgtggatgatcgtgcccctgggcatgaccctgtatttctcgctgatccgctacaacctgctgtatcccggcgagaatgccttcgtcggcctggagaacttcaccttcttcgtcaccgacgccggcttcctgcccggcgcgctgaacaccctgctgctggtgggcagcgtgctggcgatcagcgtggcgttcggcgtgctcatcgccgcgctgctggaggccggcgaattcttcggccgcggcgcggtgcgggtgttgctgatctcgccgttcttcatcatgccgacggtgagcgcgctgctctggaagaacctgatcttccacccggtctcgggcatcctcgccgccgtctggcgcctgttcggcgccgagccggtggattggctggcgcactatccgctgctgtcgatcatcctcatcgtctcctggcaatggctgcccttcgccatcctgatcctgatgaccgccatgcagtccctcgaccaggagcagaaggaggctgcccgcctcgacggcgccggtccgctggcgatcttctggcacctgaccctgccgcacctggcgcggcccatcgcggtggtgctgatgatcgagacgatcttcctgctctcggtgttcgccgagatcttcaccaccaccagcggcggccccggctacgaatcgaccaacctcgcctacctgatctacaaccaggcgctgctgcagttcgatgtcggcatggcctcggccgggggcctgatcgcggtgctgatcgccaatatcgccgccatcgtgctggtgcggatgatcggcaagaaccttaccgagcgcagctgaggaacccgccatgctga

SEQ ID NO: 8842 - DNA, 291 bp, Pseudomonas aeruginosa
cggtgcgcaggaacctctccttcgccctcgacctggccggcgtcgacaagcgcgaggtcgccgccaaggtcgacgccgccgcacgcatcctcgaactgcaagcgctgctggagcgcaagccgcgccagctctccggcggccaacggcagcgggtggcgatcggccgggcgatcgtgcgcaacccgaagatattcctcttcgacgaaccgctgtccaacctcgacgccgccctgcgcgtgcagatgcgcctggaactggcgcggctgcaccaggaactggcggcgaccatga

SEQ ID NO: 8843 - DNA, 1746 bp, Pseudomonas aeruginosa
acatcgcccgcccgggccatgccttccagagcctgctgcgggtcgccgccgacgtcagcgagcgcctgggcagcgacagcttctgccatgtccgcgccgactcgggggaaatgctcaccctgcgcgtgcgcggcgatttcgcaccggactacggcgcccccctggagctgggcttcgatccggagcactgccacctgttcgacagcaacggccaggccctcgacaaacgactgcaacaggcggcctgaagccgccagcgggaacccaccgatgaaactcaaccggcagcacctccccctgctggcgaccgctgtcgcccgcccgtcctacgaccccgcgcaactgcgccagggcatcgtccacatcggcgtcggcggcttccaccgcgcgcaccaggcggcctacaccgacgccctgatgaaccgcggcgaagccctcgactgggcgatctgcggcgccggcctgcgcagcgacgaccgcgccatgcacgacgccctggccgcccaggactacctctacaccctctacgagctgggcgaccaaccggacaccgaggtccgcgtgatcggcgccatcagcggcatgctgctcgccgaggacggcgccgaggcgctgctggaaaaacttgccgagccggccatccgcatcgtctcgctgaccatcaccgaaggcggctactgcatcgacgatggcagcggcgagttcctcgccgagttgccgctggtgcgccacgacctggccaacccgcggaccccgcgcggggtcttcggctttctctgcgaggctctgcggcggcgccgcgacacaggcgtgccggcgttcaccgtgatgtcctgcgacaacctcccgcataacggcgaggtggcgcgcaaggcgctgctggccttcgccgaacggctcgacccggggctggcgcgctggatcgcgacgcacgtcagctttcccaacgccatggtcgaccgcatcaccccgatgaccagccccgcccaccgccgccaactggcccaacggcacgacgtggaagacgcctggccggtggtctgcgaacccttcgtgcaatgggtgctggaagatcgtttcagcgctgggcgcccggcctgggaaaaggtcggcgtgcagttcaccgacgacgtcacgccctacgaggagatgaagatcggcctgctcaacggcagccacctggcgctcacctacctgggcttcctgcgcggctaccgcttcgtccacgagaccctcggcgacccgctgctgcgccgctacgtgcgggccttcatggaccgcgacgtggccccgctgctggcaccggtaccggggatcgacctggaacgctacaaggacagcctggtcgagcgcttcgccaaccgcgccatcgcagaccaactggaacgggtctgctcggacggctcgtcgaagtttcccaagttcatcgtccccaccgccaatcggctgatcgccgccggccggccgctggaacgggtggccctggtggtggcggcctgggcgctgtacctgggcggggtcgacgagcatggcgaacgctacccgattcccgatccgcgcgccgccgaatgccaggcgctggttgccgaacgccgcggcctgggccggcgcctgctcggcgtggagaccgtgttcggcccggcgatcccggcctcggcggccttcgtcgaggccttcgagcggctctacgacagcctgcgccgacacggcgtcagcgaaaccctgcgccaggtactcggcgaatga

SEQ ID NO: 8844 - DNA, 657 bp, Pseudomonas aeruginosa
cgccggagggccgcatgcacggattgttcctcggcatcgattgcggcacccagggtagcaaggcgctgctgctcgacgccggcagcggccgcacgctgggcctgggcagcgccgcgcagcgcccgccggaaggccgtgacggacgccgcgagcaggatccggcggactggctggaagccatggccagcgcggtacgcatggccctggaagaagccgcggtggacggccgcgaggtccgcgccctggcggtttccgcccagcagcatgggctgctcctgctcgacgccgagggccgggcgctgcgcccggccaagctctggtgcgacaccgagagcgcggcggaaaaccgcgagctgctggaagccctcggcggcccggccggctcgctggaacgcctgggactggtgctcgcgccgggctacacgctgtccaagctgctctggagcaggcgccgctttcccgagctgttcgcccgcgtcgcgcacatcctcctgccccacgactacctcaaccactggctcaccggccgcgtctgcagcgaagcgggcgacgcctccggcagcggctacttcgacgtgcgccggcgcacctgggccagcgacgtgctggagctggtcgagccgggcggacgcctggcggcggcgctgccggagctga

SEQ ID NO: 8845 - DNA, 1443 bp, Pseudomonas aeruginosa
gccgcgccaatctttgccgggcggtgctcgaaggcaccgccttcggcctgcgctacggcctcgacctgctgcgcgccagcggcctgccgggcgaggaaatccgcctggtcggcggcgcggcgaagaacccgctgtggcggcggacgctcgccgacctgctcggcctgccgctggtctgtccgcggcagaccgaggccgccgcccttggcgcggcgctccaggcggcctggagcctgggccgcgaaagcggcgccggtgaaagcctggaagccctgtgccggcgctgcgtggcgctcgacgagtcgacccgcacccagccccaggcgcgacaacaggcggcctacgaacaggcctaccggcgttacctggagcacctgcctccgcgataatggtcgctttccttcctcttctggcgttttggagatctgcatgtacctggtgtgtggcgaggcccttttcgatgtcttcagcctggaaagcgctgcgcgcagcaacgagctgggcttcaccgcgatcgccggcggctcgccgttcaacgtcgccgtcggcctgcgccggctgggcgtggaggcggcgctgttcggcgggctgtccagcgactacctgggcacgcggctgcgccgggtgctcgaagaagaaggcgtggactgcggcttcctggtgcccagcgacgccccgaccaccctggcgatggtcggcctggacgccagcggctcggcgcaataccagttccgcggcgacggctgcgccgaccgccaggtgcgcctggaacacctgccgacgctggatgggcggatacgcggtttgcacgtcggatcctataccctggtggtgacaccggtggccgacaccctgctggcgctggtccggcgcgagagcggccggcgcctggtcagcctggatcccaacgtgcgcctcgacccgcagccggacatcgacctctggcggcgccgggtcgaggccttcgccagtcatgcgcacctgatcaaggccagcgaggaagacctggcccttgttttaccccggccgcgcccccggcgaggtggcccgcggctggctgaacccgcgctgccggctggtcttcgtcacccacggcggggccggcgccagcgtgcactgcacccacggcagctggagtcgcccggcggataccgccctgccactgcgcgatacggtcggcgccggcgataccttccaggcggcgaccctcgcctacctccgccgcctcgacgccgacagcccggccgggctagccgcgctgtcgcgggaagcgatcgacgcgatgctcgccttcgccatccgcgcggcggcggtcacctgctcgcgggtggggccggacctgccgttcgcccacgagctttgaggccggccgtgcggagggtcaggccgagggctgccgcccggtctagcgccccggccgcgccagccactcccggcccttga

SEQ ID NO: 8846 - DNA, 480 bp, Pseudomonas aeruginosa
gcagccaggcgaagcggctggccgcggtgggctccagcgggaaggtcggcagcagcttgccggcatagccgaactccgccagcaccacccggccgcgctcgacggtcagcggacaaccgccgtagccgtcgtagcgcagcggcaggccacggccgctgcgcaggccgagaaggttctcggccaccaccacgatctgcttgcgcgccgccgccgcggtcttcgcgttggcggtgccgcagacatcgccgagggcgaagatctcgccatggcggacatgttgcagggtcgccgggtcgacttcgcaccagccggccgcgtcgcccaggccgctggcggcgacaaaggtcggcggcagctgcggcggcaccacgtgcagcaggtcgaagtccttttccgccagattggtgttgccgtcggcgtccttcacctcgaaccaggccttgcgcgccgcgccgtcgaccttcaccaggttggaattga

SEQ ID NO: 8847 - DNA, 1263 bp, Pseudomonas aeruginosa
acggcgcccgtccggcgcgtcactcatggatctgaggagcgcccgatgagcctcgcacacgctacgcgcgacaatcccacggccgctgcccatcgcatcggcagcgacgacgaagccctggaaacggcccgcgagctggccgccctgttcgcccgcgaaagcatccagcgcgaccgcgagcggcgcctgccgctggaagaactggaactgttctcccgctccggcctgtggggcatcgcggtgccccgcgaatacggcggggccggcgtctcgcgggtgaccctggcgaaggtggtggcgatcgtcagcgccgccgacagttccctggggcagattccgcagaaccatttctacgccctcgaagtgctgcgggtgaacggctcgccggcgcagaaaggtcgcctgttcggcgccgccctggccggcgagcgtttcggcaacgccctggccgagatcggcacgcgtaccgccagcgagcgccgtacccgcctgcgcgccgacggcgacggctaccgcctggacgggcgcaagttctactgcaccggcgcactctacgcgcagcgggtgccgaccctggcggtggacgacgagggccgccagcaactggccttcgtcccgcgcgacagcgccgggctggaaatcgtcgacgactggtccggcttcggtcaacgcaccaccggcagcggttcggcgctgttcgaccgggtagcggtggccgccgaggacgtggtctcgttccaggacgccttcgagcgcccgaccaccgtcggcccgctggcacagatcctccacgcggcgatcgacgccgggatcgcccgcggcgccttcgaggacaccctgcgtttcgtccgcgagcgcgcccggccctgggtcgactccggcgtcgacaaggccagcgacgacccactgaccatccatgagatcggccgcctggcgatccgcctgcacgccgccgaagcgctgctggagcgtgccgggcgggtgctcgaccgggccaccgccgagccggacgcggaaagcgtggcggccgcctcgatcgccgtcgccgaagcccgcgcgctgaccaccgaggtcgccctgctggccggcagcaagctgatcgagcttggcggcagccgcgcctgtctcgccgaactcggtctcgaccgccactggcgcaacgcccgcgtacacaccctgcacgacccggtgcgctggaagtaccacgcggtcggcgactactacctcaacggccgcctgccgccacgccgcggcacgctctga

SEQ ID NO: 8848 - DNA, 474 bp, Pseudomonas aeruginosa
gcgacgggcggatcggctggaacatcgtcaccggctacctggaaagcgcggccaaggccatgggccagtccgcgcagatcgagcacgaccgccgctacgaccgcgccgacgagtacctggaggtcctctacaagctctgggagggcagctgggaagacgacgcggtgctcgccgaccgccagcgacgggtctacgcgcggccggagaagatccacaagatccgccaccatggcgagttctaccaggtcgagggctaccacctcgccgagccctctccacagcgcaccccggtgctgttccaggccggctcctcggagcgtggcctggccttcgccgcgcgccacgccgaatgcgtgttcgtctccggacagacccgcgaggccacccgccagttggtgcagcgcatccgcgcggcggtggtcggcgccggccgtcgcgccgaggacatcaggatcttcatgggcatcaacgtga

SEQ ID NO: 8849 - DNA, 1029 bp, Pseudomonas aeruginosa
cccgcaccgtggagccggagagctacgccgacttcatcgacctggtggtgcccgagttgcaggcacgcggcagctacaagaccgcctatgcccccggcaccctgcgggagaagctcttcggcggcggccgcgcgcgcctgcaggcggaacacgccggcgccgccttccgccagcccccggccgcgcgccagcgccaggcctgaccccactttccctttcgttcaggagcccaccatgctgaacaccttgaaaaccctgagcctggccgtcctcctcggcagcggcccggcccaggccgccgacgccccgctgaagatcggcaccaccgccgccttcgccccgccgctggaagtcgccgtgagcgaagccggcaagcagggactgaaggtcgaactggtcgagttcagcgactggaacgcccccaacatcaccctcgcccagggcgacatcgacgccaactacttccagcacgtgcccttcctggaaaacgccaaccgcgaaggcggcttccagttgaagccgttcgcgccagggatcatcaacaacgtcgggctctattcgaagcgctacgccagcctcgcagagttgccggaaggcgccagcgtggccatcgccaacgacccgatcaatggcggccgcggcctgcaactgctacagaaggccggcctgctgaagctcagggacggcgtcggctacaaggcgaccctcgacgatatcgtcgacaacccgaaggacatccgcatcaccgagctggaggcggtacaactggcgcgcgccctcgacgatttcgacctggcccagggctacccgcactacctgcgcctggccgggaccatcgacccgacccgggcactgctgttcgacgggatcgacaaccgggaatacgtgatccagttcgtcacccgcggcaactaccaggaccgcgacggccgcctggcgcgcttcgtcgacatctaccagcattcaccggtggtccgcgccgcgctggacaaggcccatggcacgctgtaccagccgggctgggagtga

SEQ ID NO: 8850 - DNA, 297 bp, Pseudomonas aeruginosa
tgtcggccaagaccgtgtggcagaacatcgccctgccgctgcgggtggccggggtgccccgggcacggatcgaggagcgggtcgccgggctgctgcaactggtcggcctggaggaaaaacgcgacgcctatccggcgcagctctccggcgggcagaaacagcgcgtcggcatcgcccgcgcgctggtgcaccagccgcagatactgctctgcgacgaagccacctcggcgctggacccggagagcacccaggcgatcctcgcgctgctgcgcgacatcaaccgccggctgggcctga

SEQ ID NO: 8851 - DNA, 450 bp, Pseudomonas aeruginosa
tcacccacgagatggcggtcatccgcgagatctgcgaccgcgtggtggtcctcgaatgcggccgcatcgtcgaacagggcgaagtctgggaagtcttcggcgatccgcgccatgcccgtcacccgaagcctgttcggcagcctgcgcgccgccctcccggccgacctccaggcgcgcctgcgccaggctcccggcgccggcgacccggtgctgctcgatctccagtacaccggcgccagccgacgggtgccggacctgctggccatcgccagggccatcggccagcgcgtcgacctgctccacggcggcatagagcgtatccagggccgcgccctggggcgcctgctgctacaggtcggcgcgccgcccggcgagcttcccggcgtgctggccaaggccgcgctggtggcggacaaggtggaggtgctcggccatgtcgcccatgcttga

SEQ ID NO: 8852 - DNA, 1965 bp, Pseudomonas aeruginosa
acggctctggcaaggtttcctcgatacgctgctgatgatcggcgcgtcctccgccatcgtcctgctggtgggtatcccgctggccctggtgctggtcaccaccgggccgggcgggatcttcgaggcgcgcctgctcaatcgcatcctgggcggtctggtcaacgtgctgcgctcggtacccttcctgatcctgatggtggcgctgattccctttacccggatgatcgtcggcaccagctatggagtctgggccgcggtggtgccgctgaccatcgccgccacgccgttcttcgcgcggatcgccgaggtcagcctgcgcgaagtcgaccacggcctggtggaggcggcccaggcgatgggctgcgaacgccgccacatcatctgcaacgtactgttgccggaggcgcgaccgggcatcgtcggcggcttcaccatcaccctggtgaccatgatcaattcctcggccttggccggcgcgatcggtgccggcggcctcggcgacctggcctaccgctacggctaccagcgcttcgacacccaggtgatgctcaccgtgatcatcgtccttgtgctgctggtcacgttgatccaattcggcggcgaccgcctggcccgcctgctgaacaaacgcctgtagaatccgccctcccggcctgggagggctggcgctttgccgagggcgacaggaaccagcgtcgccgcgacagcgcatctttccccgcgccggacagacctgtatctgtcgtcctgcggtcatccggcgacgccagactggtcggcaatcccgtgaaaaagaaagaaggaaaggcgcctcatgcggcaaagattctggcaaggaacattcaagaccctgggcctcctcggcctgacggcggggctcgccgcccaggccgcggagccgtccggcaaggccctcagcgccgccgccggcgtgccctggccggcggtcatcgcccaccgcggcgcctcgtacgacgcccccgaggaaaccgccgcggcctacctggtggcccgcgacctcggcgccgactacctggaagccgacgtgcagcgcagccgcgacggcgtactggtcgccctccacgacgacaccctggagcgcaccaccgacgtcgccgaggtcttcccgggacgcgccaaggacccggtgagcagcttcactctcgccgaactcaagcgcctggacgccggctcctggttcaatcgcgccttccccgagcgcgcccggcccggcttcgtcggcctgcgcatcctcaccctcgacgagatgctcgacatcgccgagggcggcgccaacaagccgggcctgtacctggagaccaaggtaccggcgcaattccccggcatcgaagacgacctgcgcaagctgctggaacgccgcggctggctgcaaccccgcgagcgcgccgccgccgggcatgtcgacgtggcccacggcaatggccgggtgatcctgcagaccttcgagaagagcagcctggaactgctgcaagaaagcatgccgcaagtgccgaagattctcctgctgtggctcggcgacggttacctggaagcccgttcgccagtgaccttcaaggaatccggggaaaccgacaaggcggccttctatgccaggcaggaagtgaagtccgaagccgagttcggcgcctggctggactgggccaaggcccacggcgcgctgggcaccgggccctcggcgaccctcagcgaacgcggcgaacagagctacgccgacctggtgaaaccctggatgaaccgcatgacccacgcgcgcgggttgttcatccatgcctactcggtggactcggcggaagacttcaaggccctaggcgcggccggcgtcgacggtttcttcaccaaccgcacctcggaactgctgaagttccagggccgcccggcggcgcaagacatggacgcgctgctgcgccggcacggctactgagcctcggcctggccggcggatga

SEQ ID NO: 8853 - DNA, 1329 bp, Pseudomonas aeruginosa
gcgcgggcggccatccgcagttcccgcttcggcggcgcggcgctagccggcgctgtcgctgccgaagcgtgccagctgcatctcgcgcagccggctgagggtgcgacggaaggcgaaggccaggtagccctcggtataaagtgcctccaacggcaccctggcctccaggtagagcggcaccttgcggtcgtagcattcgtccaccagggcgatgaagcgccgcacgccgtcgtcgtgcaccgacaactgcggcaattcgcgatcccccgcctccaccagttgcgcgccgtcctcggtgccacgggctatgcggccttcgcgctggctggcgctcaggcacggcaggtcgtccatcaggatcgcccggtagcggtcgcaaaggccgatgaagtccagcgccgacagcggcgcctcgcagagctgcgcatagctgcaccagagcaccgattcgctgtgccggtgcaccgccagcgggcggtgccccagttcgatgggctgcgtggatgccgcttcgccggcactcaggcgcgcgaagagttcggcgaaaccgctcgcctgccccgcctccaccacccagtagcgttgctcggcccggccgggatgcaggcggtggtcctggccgccatccaccgcgaccaccgccatgtgccgctggatcgcctcgatcgccgggaggaagcgttcgcggttgaaaccgtcggcgtacaactgctccggtggctggttggaagtgaccaccagcaccacgccctcctcgaacatgatgcgcagcaggctgccgagcaggatggcatcgccgatatcgctgacgaacagctcgtcgaagcacagcacccgcacatcccgcgccaactcgcgggccagggcgcgcaacgggtcggctgtaccggtcagttcgaactggcgctggtgcacccattgcatgaagtggtggaagtgctggcgccgcgcgggcacgcgcaggcactggtagaagtgatccatcagccaggtcttgccgcgtcctaccggtccccacaggtagacgccctggatcgcgccgtggcggtgagcttcatgcagggcctggaaacaacgctccagcgcctcggcggcgcgccgctgcgcctcgtcgggagcgaaaccgcgctgttccacggcctggcgatagacggcgagcggcgacatggccggcagatcgggagaggtatcgggcatcgggcagttccacctggcgcagagcgcggagccagacgctccgcaaagcgccgagtctactgcgcccggctgggtttgggcgaatgccgcagcgccggcacggcggatagtcgcgggaggttggccgaataa

SEQ ID NO: 8854 - DNA, 897 bp, Pseudomonas aeruginosa
ccgcttgcgcttacccgccgcgatcccgagcgcctgaactcagatcgacaaccgcaccgcccgctcgccatcgatccgctggccaccgcgcttgttcaccaccagttcgccgatggcgatcagccgcgtgcgcgtgacgttgcggctgagtcccagcaggttggcggtatgcacctggttgccgtggcagaaacggtacgccgcgcgcagcagggcatcttcgacccgcccatggaggttctcgccctgctcttcgaacagacgctggaaagcctgctgcaacaagtgctcggcggcgccgctcgccgggcccccgcgcgccagctcctcgccacgctccaggcgcaggttggacaggtgcaggtcatccgcgcggatcagcccgtcgcggcagatcagcaaggtatggtggatgacgttctccagctcgcggatgttccccggccaggaataggcacgcaacttctgcgccgcctccgggctcaactggctctggccgtagcccaggcgacggctgtattcggcgatgaagtggcgggtcagcggcaggatgtcgccgggtcgctcgcgcaacggcgacagttcgagactgacgacattgagccggtagtacaggtcctcgcggaagtgcccggcattgatcgcccgctccagttgcacgttggtcgccgccagcacgcgcacgtcgatggggatgctcttgcgcgaccccaggcgcaccacctcgcgctcctgcaacacgcgcagcaacttgacctggatcggcatcggcaggtcgccgatctcgtcgaggaacagggtgccgccgttggcctcctcgaaccagccggccttggccgccagggcgccggtgaaggcacccttctcgtggccgaacagctcggcttccaccagtga

SEQ ID NO: 8855 - DNA, 564 bp, Pseudomonas aeruginosa
gggtcggcattggcctcggcgacctcggagcggaaccacggtcgcgcttcgcgcagggtgtactggcgagcctcctcgaaggcgccttcggcgatgccgaggaacacctcggtgaagatcaactgggcgatcagcggccgcaggcaggcgaacggcgtgctcagcggcccgggatcgagcagcaactcgctctcctccacccgcacccgctcgaagatcgcgctgccgctgtcggtctgccgctggcccatgttgtcccaatcctggcccaggctgataccgctgcgcgcggtggggatggcggcaatcagcagcgccccgccctcgccgtccagtgccgaggcgatgagcatctccgaatcgcgggcgccggagcagaagctcttcttcccggagaactcgcgccagccgtcgaagcgccgggccacggtacggttgtccagcgggttcagcgcgttgccccagaaccagcggttgcgcgcggtcagctcgaaccacggctgccattgctcgggccgcgagaacaggcgcacggtggccagcatcaggtgctggaagccatag

SEQ ID NO: 8856 - DNA, 588 bp, Pseudomonas aeruginosa
agctgtcgatgccgagctcggcgtattccccgatgcgctccgccacctgccgcggatcgccgaccagcgcggtgccggcgccgccgcgcaccaggccgaccccggcccagaggttcggctggatctccaggcgatcgcggcggccgccgtgcagcgcggccatgcgtcgctggccttcggagtcgaaacgggcgaaggactgctgcgcggcggcgatggtctcgtcggagatgtgttcgatcagcctgtccgcggcgcgccaggcttcttcggcggtttcgcggacgatcacatgcaggcggatgccgaacttcaccgtacgcccatggcgagccgctcgctggcgcacgtcggcgattttcgccgccaccgccggcaacggctcgccccaggtcaggtagacgtccacctgttcgccggccagttcgtgggcggcctccgaggaaccgccgaagtacagcggcggatacggccgttgcagcggcggatagagcgccttggcgttctccacgtggatgtgcttgccgtggaagtccaccgcctcgccctgcaggacgcgccgccagacccgaaggaactcgtcggtga

SEQ ID NO: 8857 - DNA, 1209 bp, Pseudomonas aeruginosa
aacagccgccgtccgggttcttgccggttttgtgggggaattgtgaaagactgtaaagcgccacgctcacttgcccaccagcgagaccacgttgtgccgtggcgaggtttccagctcgccgatcttctccaggcgggcgcgcacgatgttgcggctgatccccagcaggcgtccggtctgcaactggttgccgtggcagaagcgataggcggcacggaacacggtttcctcgatgtgctcgtagagatcctcgcggttttcctcgaacagcgcctgcagcgccgcctccaacgccgagccggcggcgctttcgggagcgcggcgcaagccgttcggctcctggcgcgcacgcatgtcgatgaggtgcaggtcggccggctggatcagacggttgcggcagaccagcagcgcgtggtggatggcgttctccagctcgcggatattgcccgcccaggaatgcccgagcagcttgcgctcggcttccgggctcaggctcgcgctggtgtagccgaggcgccggcagtgctcgacgatgaagtactcggccagcggcaggatatcgccgcggcgctcgcgcaacggcggcagttggatggtcgccacgtgcaggcggtagaacaggtcctcgcggaagtgtccggcgaccaccgcgtcagccaggtcgacgttggtcgccgccaccagccgcacgtcgatggggatcggccggcgcgaaccgagccgcaccacctcgcgttcctgcagcacgcgcagcagcttgacctggatgctcggcggcaggtcgccgatctcgtcgaggaacagggtgccgccgttggccgcctcgaaccagccggccttgctctgcaacgcaccggtaaaggcgcccttctcgtggccgaacagctcgctctccaccaggctctcggcgaaagcaccgcagttgaccgcgacgaacgggccgccgttgcgtccgctgagggcgtggatatggcgcgccaccagctccttgccggtgccggtctcgccgatgaccagcgcgttggcctcgctgggcgccaggcgctcgatgcgctccagcagctcgcgggaacgggggtcgttgaacaccagcacggtggcgcgcaccgatttggtcagctcgcgggcgtggggatgggtgatgacggacatgctgggttccgagccggggaatgtgcgcccatcttgccccaggaacccatagattaa

SEQ ID NO: 8858 - DNA, 3051 bp, Pseudomonas aeruginosa
tctcggcgaaggcgccctgccccatcagcggcaggcgcgtgtgcagcagctcggcatagcggcgcaacagccagtcgatgggcggcacccgccacgactggtcgccgtcctgggcttgcggatgcacctcctcggggtagcgctcgcagagttccgccagcagcaccagcgcgcgctgcaatccgcccagcccgccgcgttgcagccaggcctcgccgagccaggcggcgagcatcagatccttgctgcgccgctgcaacagatcgctggccaactgctccaccgcggcccagtcggcgcgcttggcctccgcctgccagacgccggtcggcaggctgctgtcatcctcccggcgcaactcgcgcaggcggtcgtagtccgggtcgtagcgcaggctggggccgcacggctgtccggggtcgatcggttcgagcagcacttccagggacagggcgttgccggaaagaggcagggtcatggggtacctcccgtgctggcgacggtggccggcaacagcgtcgcgaacggcgattgcggcgcgcgcaccggcagcggctggatggacagcggggtcttgccgcccaggctcatcaacgacaggcggaggaacatccgcgcctcgttttccgggctgtagggcgcatacaccggcagttgcaggaccagcggaaactccgtgtagtcgacgttcggcgggcgctgccgggagaagtgcgcgcgcatcatgcgcaacagcgcccaggagccctggtagctccagccggcctcgaggtcggccaccgccaggctggcctggcgcgggtcgtctgccggacgctgcgagccgttcttcgcccagcgcagcatgattttcagcggatcgccgacattccaggtcaggcccttgtcctgcgcgccggggaaacggctttcctggtcgcccgagtacaggctccaggcgatcacctggtcggcgccgcgttccaggctgcggtcgctgcgccagtcgatgtccagggcgacgccgagcaggcccgacttgtcgcgctcgaacagcgggccgagccagcgctgcgcctgctccaggcggcggacgaagtcctcggcggccggcaggtccggcgagcgaacctgggccagcccttcgcgcacctgcggcaagcgcgtctccatcagtttcagcaggtgccgcacccgccccggctcggcatcggccgcttccaggctgtaggcgaacgggaagcgtccggcgaggtactggttgaagtagtcggcgaggtccttccaggcctgcgccgcctgctgctgttgcaacgactggcagcgcccgagcgcgccctggcgcaggtccaccaggcgcgtcgccaggtcgctgcggctggacggcaggagcacgccgttgagaatgtcggcgcaactgccgatgtccatctggttgaaatcgttacccaccagcttcgccaactgcgccgcggtgctcgccgggttgtcggccttgaatttctgcagttcggcgttgagcgcgctgaagcgcacgaacgcgttgtagtcggcggtggccaggctggattgctgcgcctgcaaccactccagcgccggggcgtggcgttcggcgacggccgccatggcattgaactggctgttcaggctttgcttcagctcggcactgtcctgggcgcggaacatctgcaggccgaaattcggcgcgcccgaccagcggctgaaatcgaccggctcgcgcagcaccgcctgctcgtcgatgtcgcgcagggcctggccgatatcggccacggccagcgcgttgaggctgagcagcaggcgcgcgccggcctgcaggtcctgcaactccagcagcgccgcctgcaacacctggacctgcttgacctgcacgtcgaaacgcgaggcattgcgactggccaggctacgactgcgcggcccgaggctttgccacatggcctcggtcgccgcgctggcggcggcgtgcaggaccgaatagcgatagcgcgggttgagcgatggcagggtgctctcgtagtagccggtgaagtcgttgaagaagctcaacgcctgagtcacgccgatatcgtcgatgctcagcaaggagtggtccgccagtgtcttgtccgccagggccacggagacgaagtccttggtcttcaggtcatcgatggcgcgtttcagaccgagcaggtcatcggccagcttgagcgtcgccccctgtttcaccagcaggccgtcgccggcagcctccggaggcgcgatccattcgctgcgaaactgctgctgcaactgcacggtgaggttctgcagttcctccacgcggtttcccagcaagctgctttgctgggcgctcttgagcaggttctggtagccagggacgagatcctggccgacgccattgccccagatcaggttgatgcggttgacctgttgctgcaggtggttgatcaattcgccgatccccagcaactgggccgccgtggcgtctcgttcctggccgagctgcgcgagttcctgggtcagggcattgccggtgcgttccaggctgtcggtgaggaagtaggcgttcagccagcgtgccatcaggtcatggaagttatccgccgccgtggcggcgacccggcccaggtcgagggcggcgagatcggccggacgctcggcgaacagcatgcggttgtaataggccaggcgcgccaggctgccggcgttgtagctgctgcccaaggcatcgttactcagttgcagaaggtcgtcgagcggcgtcctgcggttgtcgatggcctgggcgaacaagcgattgtggcgctccagcgtagtggcgcgggcgaccaggtccttcgccgccaggtagtccttccactggctggggtcgtcgccctccttcaggccgggttggccatcgctgcggatcgcccgcaggtcgctcgcctcgccttccagcaggctgcgcagcggtcgcaccagcaggcactcggaaacgcggcgatacgcgttgtcgatacgtgcatccagggaggaaaaccaggaactgggaaacgccagcgaagtgaagcgccagcgcggcgcctgtga

SEQ ID NO: 8859 - DNA, 1566 bp, Pseudomonas aeruginosa
caccagttgccaccaggcctggacgttctgccggacctgggcggcgcgccgagtgtcgtcgtcgagcggctggtagcgctcactggcgccatgcagcagttgcgacagttcaccggcgtcgcgcagcgcgtcgcgccagacccaggtcatcaggccgccccagagcaggcacaggcacaacgcggcgaggccgatcccgcgctgccagcgctggcgcagctggaggatgcgcggcaccgcctgggccaggccttcctcggcaaggatccgccgtgcccacagttggctggcgaagctgctgcgccgacgcggcgcgtcgaccgccggcaggacatcgtcggctgccgcgcccgccgcctcgctgccgctcaggtagagaccgcgaaagcgcggcgcctcgcccctggcgttgccctggaagaccggttcgagcagcgcctgcaacgaaccgcggaggctttccaggcgtggcggcaggcaatacagctcattgtccacctggccgcgcaaggtaccgagttcgacgatcgactcggtcagggtggcggtgatttcctccagcgcctgctcgcaccagcgcgactgccaggccgcttcggcggcgaacggcgaggaccagccgagggcgcgctcgcgcgcctcctcgggcagcgccgcgagaagttcctggaaacccggcaggtcttccaggccagtgatcaccacgtaaaccggcaggctcaggccaaggcgctgggtcagttccacgtagcgacggcgcgcggcgaggccgaggttggccgcctgctcgccatcctgcaaccgcgccagcggaatgttccagaccaccccgtccagcgcgcgcctgccgcgcaggcgcaggaacagacgcaacaggcgcagccaggcgccgctttgccggcgcaggccctcgtcgggcaggaacaccgactcgggcaccagcaggatcgccccctcgccgtccgaccaccagcggccgaaccaggccggacgcgccaccggcagcaggcgccaggtggcgcacaactgctcgccctcggtctcgttgccgagcatcagcagccagggcgattcgtagcggccctgccagccctgctcgcgctccatctgccggaccgccgcgtagaagctgcggatctccgtaccaccgcgggttcgccaccaccagcccagcgcccccagcagcagcgccagcagcaccaggaggagaaccagcatgaacagggtcgcgccgctcatggcgcctgctccgcatcggccaggtgggtcaccgccgccatttcgtgctggatgtcgcgccagaacaggtgtccgataccgctcatcaacagcaccagcccgagcaccgccaggcccaggcggaagccgtccggcagcgctgcgcgcaccggcagacgccgtggcggcgcagcggcgggctgctcaaggcgacggccgaggtcggcggcgtccgcctcgcgctgccaggcgaaggcgaacaacgcctgccgccacttctcgtgcagcgcctcgccgcgcggcccgcgcaggcgaccgcggaagccgaggatcaggcattgcaggtag

SEQ ID NO: 8860 - DNA, 732 bp, Pseudomonas aeruginosa
ccggcgcgacgatgcgcagcggctggccggcatcgaaccagtcgccggcaccctgcacgacgaacaaacgggtgtcgtcgccaacgctgtaggccacctgttcctggcgattcatcggctgccgcggcagcccgctcatgcgttgccgggcgagcaacggcaggtgcgggtcggaggcgacgatggcgcgctccagccagtcagccgccgcctgttcgccggcgccggcgggcatccgcaggccgaccaccaggcgctgacgcggcgccggatcgggcaggcgcacggaaaatacctgttcctcctgctcgaacggcaggcagcggtagcccgcgcggatcgactcgatggcccgctccagccagtccagcagcggctcgtagccacgccgcaggtcgaggaagtcgagcgcttcgaaggccggcacgccggccagcggatcgagcgccgcccaggcaccggccaggcccagcaggctgccgtgcagggccagcggcgaggccgtacggcttgccagcaggccttcgacctccggcaggcgggtccagagcgcggcaagctggcgacggatttccaccgcgtcgtcctggttgcccgcctgctgcgccaggcgcaggcgcccgccgaggaacagcgccttctcccgggcccgcgcgcaaagcgactgcacgcgtctgcccaggggcgactccggcaggatcagtggcgtcggcgggacgtagggcaggctga

SEQ ID NO: 8861 - DNA, 819 bp, Pseudomonas aeruginosa
tcagggcatccccccgatgcattgctcccccaccattgcatcggagtcagccgccatggccgagagtacgcagcacaagctggaccgggtgcgcccgccgcgcgtgcagatcacctacgacgtcgagatcggcaacgccatcgagaagaaggagctgcccctggtggtcggcatcctcgccgacctctccggcaagccggataccccgccggcgaagctggtcgaacggcgtttcgtcgacatcgaccgcgacaacttcaacgagatcctctcctccatctctccccgcgccaccctgcaggtcgacaacaccatcagcggcgacgacagcaagctgaacgtcgagctgcgcttcaaccacatcgaggacttcgacccggtcaacctggtgaagcaggtggtcccgttgcgtcgcctgttcgaagcgcgccagcgcctgcgcgacctgctgaccaagctcgacggcaacgacgacctcgaccagttgctgcaggacgtggtggccaacaccgaaggcctgcaggaaatcaaagcggcccgcccggaagccgaagcggccccggccggcgacagcgaacccccggccgaccagccggcctgaccctcttcccggagaagccgccatgcccaagtcatccgccgccgaacaatccggcgagagttcgacccagaccctgtccctgctcgacgagatcatcgcaaagggccgcatggcccacgacgacagccagcaggactatgcccgcgacatgctcgcggaattcgccacccaggtcctcgacgagggcatggccgtcgacaaggacaccgtggcgatga

SEQ ID NO: 8862 - DNA, 579 bp, Pseudomonas aeruginosa
cggcgtgagctcgcccccgccggcaccgccggcggggcgcccttcccgttccagacagcccctctccaggagtcagatgcgatggatgcgatcattctcgatttcggcagcgacatcaaaggcgacagcctgctcgtcggctacgaaaacaagatcgaaatcatgtcctacagccacaacgtggcgatgcaggtcaccaacgacgtcagcaactcggaacgcacctccggcaaaccccacgtcggcgaattcaccctcaccaagttcatcgacacctcgaccccgaccctcaacgagtattgctgcgccggcaagccgatcgccgaggcgaccatcaccatcggccgcaacgccgccgagggcaacgggcagatcatgcccttcatcgtctacaccctgaacaacgtggtgctctccaacgtcagcgtcagcggcggcgccggcggcaagccggtggaaaccctgtcgctgaacttcaccaagatcaagtgggagctgaccgcgcagaaggacgacggcaccaaggaaggcacggctgcctcgacctgggacctggccgccaaccagttggtcaagtga

SEQ ID NO: 8863 - DNA, 438 bp, Pseudomonas aeruginosa
ccgagcgccgacatgtccggagccctgccgccactgttcgagcgcctcagcgccgaggccgacgaacgtccagcgttcgacgaccgggcgctggccgagtcggtccgcggcgagctgctgcgcctgctcaatacacggcgtccggcgaatgcgcgcagcggcatcctcgcctatgggctcgccgactggaccgccgtgcaacgcctgcgcgccgaagaccggcgccagctggcgcgcgaggtgcgggtggcggtcgagcatttcgagccgcgcctgcaactggccgaggtcgaggtcgaacctgacccgggcaatccgcagcgcctgcgtatccagctcggcggcagcctgcgcagcgggtcgcgcctgacgcctgcgctgttcgtcatcgaacagggcaacgatggcctcgaggtgcgccatgagcgattcgattga

SEQ ID NO: 8864 - DNA, 1020 bp, Pseudomonas aeruginosa
tgccgacctgctcgactactaccagcgcgagctgacctggctacggcacgccggcggcgccttcgccgagcgctatccgaaggtcgcccggcgcctgcaactggcccccggcgaatgccccgacccgcacgtcgagcgtctgctggaaggcttctcgctgctcaccgcgcgcctgcaacggcgcctcgacgacgactacgcggagttcagcgacgccctcctcgaacagctctacccgctggcgctgcgcccgctgccgtcctgcgcgatcgtccagttcgaaccggacccgacccagggcaacctcgccgagggctaccggctgccgcgcgacaccgcgctgttcgtcaccacccgcggcggcgacagcgtgcatttccgcagcagcgccgaggcgaccctgtggccgctggcgatcgacgaagcgaccctgctcggcggcgaggaggcgcaagccctgaccggagtcggcgccgcccgctcggcgttgcgcctgagcctgcgctgcctgggcgagtaccgctgggaggagctgtcgatcgagcgcctgcgcatccacctggcggcttcgccgatgggctgcgcgatcctctacgacctgctcgccgcgcataccgtgcaggtcatggcgggggcgcccggcacgccgccggcggcgctctgcggaatgccggcgatcgtcggcttcgccgccgacgaggcgctgctgccggaggaagacggcggacatccgggcctgcgcctgctcgccgagtacttcgcctttcccgacaagttccacttcttcgacttgccgctgtccggcgcgctcgccgacggacaggcgctctacctgtacctggtcttcgatcgcgcaccgacggcacgcctgcatttgcaggcggaagacttccagctcggctgcgcgccggcgatcaacctctttccgcagacctcggagccgctgcgcccggacggcacccgcagcgagtaccgcctggtcgccgacagtcaccgcgagaacagcgtggaaatccatag

SEQ ID NO: 8865 - DNA, 1221 bp, Pseudomonas aeruginosa
  unsure (517): Identity of nucleotide at the above locations are unknown.
catccgcgccgtgcgctcggttgccgggagcaccgtgcagccagtcccggcgtactatggctgccgccacgacagccacctcggcacgctctactggcacgcccggcgcatcgccgggctgaccccgaaccggctgggcagcgatctgctgctgagcgtggtggataccggcttcgacccgttgcgcgagaccccggccttcagcctgaccgccgagctgctatgcaccaatcgctatctggccgagcgcctgggtgccggcaccgcgctgggcttcgaacggcccgggccggtcgccgccgcacgcctgcgcaacgcgcccagcgcgcagagccagccgcgcctggacggccaatcgcgctggagactggtctcgcagctgaccctcaaccacctctcgctggtggaaggcccgcgcgccctcgaagccctgcgggaaatcctcgccctgcacaacctgcgcgacgacgccagcgcccgccggcagatagaaggtctgcggcaactcgactgccancgggtggtggcgcacgtcggcgaggatgcctggcgcggctggcgcaatggcctggaaatccgcctgcgactcgatccgcagcacttcgtcggcgccagcggcgtgctgttctccgccgtgctggcgcagttcttctcgctgtatgccaccgccaaccgcttcgtgcgcacggtcctggtggaagccgacaaggaggtgaagacatggcaaccccaggccggctcgccgctctccctctgagtcagcggctgcgccgcacgccgcagcgcttcgaactgttgcaggcgctgctgctgctcgaacgcgagcgtccccaggcgttgccgctgggcaccggcaacgcgccgcgggcggaggccctgcgcctgcgcgggccgctgctgccgctgttcgcctcgagcgaggtggaaagcctgctcgacgacccgcagcaaccggtgctgtccaccccggtgttcggcctcggcggccccgacggcccgttgccctatgcctaccaggaatggctgcaacaacgcgcccggcagaaggaccatgcccccgccgagttcctcgacctgttccagcaccgcctgctcagcctgctctaccgggtgctgcgccaagcatccgcttggcgctcggtttccccggtgccggcggcgaccccggtgcaggccgcagctacgtgccctcaacggcctgttgccaaaagccctgcatga

SEQ ID NO: 8866 - DNA, 522 bp, Pseudomonas aeruginosa
gcgcctggcgctgccggacagcgcggtgctggcacgcaccgcgctgttcgccggcgggcgtcgctccctggccggcttcgccgggcctggtgcgccagcacttcggcgtggaggcacggctggacgcataccagggcgcctggaaggaaatccccacggccagccgcagcccgggtgcaacgcggcgggcgcaacctgcgcctgggtcgcgatgccatagccggcacgcgcacctgggacgaacacgccggcatcgccttcagcctcggtccgctggatgcccgcgaggccgcccgcttcttccccgacggcgacgcccatggccagttggccagcctcgccgcgctgtacttcggccccgacctggattgtcgcctgagcctgctggtgagcggcggcgcgccgctgcgcctggagcgcggtacaccgcccaggctgagctggaacaccggcctgcggcgcatcgaagacggccagcggcagcgcatcgatctcgacctgcggcagccggaggtagcttga

SEQ ID NO: 8867 - DNA, 1410 bp, Pseudomonas aeruginosa
aatggaactcgccgccctgatcggccgcctcaacccggattgtcgccgcgccctggagcgcgccgcgcaacgctgcctgcaacgcacccatcattacgtagagatcgagcacctgctgctggagctgctggacatcgacggcggcgacttcgcctgcctgctgccgcgcttcggcctggagcgcgacgccctggtcgccgagatcaacctgtcgctggagctgttcaaggccggcaatacccgcactccggcgctgtccgcgcacaccatcggcctgctcgaagacgccgtggtgcacgccagtgtgctcggccaggcgcagatccgttccggcctgctgctgctcgccttgctcgaccgcgaggagcgccgcgccctgttgctgaacagcgcgtcgtcgctgctgcggattccccacgaggccttgcaggccaacctgctggagtggatccaggcctcccgcgaacagccgcccgcgccgaaccgtccggcggcaggcggcgacaagccggaaagcgccccggacccgctgctcgaccagtacacccaggacctcaccgccgaggcccgcgccgggcgcatcgaccccatcgtcgggcgcgacggggaaatccgccagtgcgtcgacatcctcctgcgccggcggcagaacaacccgatcctggtcggcgcgccgggcgtcggcaagaccgcggtggtcgagggcctggccctgcgcatcgccgccggcgaagtgccgccgtcgttgcaggaggtgatcctgcgggtgctcgacctcggcctgttgcaggccggcgccagcatgaagggcgagttcgagcagcgcctcaagggggtgatcgacgccgtgcgcaacagcgcgcagccgatcatcctgttcatcgacgaggcgcacacgctgatcggcgccggcggcgcggaaggcggcagcgacgccgccaacctgctcaagccggccctggcgcgcggcgaactgcgcaccctggcggccaccacctggctggaatacaagaaatacttcgagaaggacccggcgctgacccggcgcttccagctggtccaggtcgaggagccggacgaggccaccgccgtggagatgctgcgcggggtcgccggcaagctggaactgcatcacggcgtgcagatcatggacgcggccatcgtcgatgcggtgaagctgtcgcatcgctacatctccggccgccagttgccggacaaggcgatcagcgtgctcgacaccgcctgcgcgcgggtcgccctcggccagcacgacgtgccgccgccgctggaaagcctgcgccatcgcgagcaggcgctggaagaggaattgcagcggctgcgccgggaacaggccaccggcctcgaccacagcgcgcgtatcaccgccctggaaagcgagtcgggcgataa

SEQ ID NO: 8868 - DNA, 525 bp, Pseudomonas aeruginosa
ccgccggaccatccgcgagctggagacccgctgggacgaggaacgcgaagcggtgcgcgaactgctcgacacccgccgcgaactgctggccctcagcgaaagcgccgacgcggccaagcccgacgaggaactggacggtcgcatcgaccacctggccgccgaactggcgcgcctggcggccggcctcgaagccatccgccaggacgacccgctggttcccgagcaggtggactcgcgtaccgtggccgcggtgatcgccggctggaccggcatcccggtgggcaagatgctcgccgacgaagcccacgccatccgttccctggcgcaacgaatgggccagggggtgatgggccaggaggccgccctgggcgccatcgccccagggcatccaggcctatcgcgccggactcagcgacccggccaagccggtcggcgtattcctcctgccaggccccaccggcgtgggcaagaccgagaccgcctacgccctggccgacgccctttacggcggcgaacgcaacctga

SEQ ID NO: 8869 - DNA, 207 bp, Pseudomonas aeruginosa
tcagcatcaacctctccgagtaccaggaggcccacaccgtcagccagctcaagggcgccccgcccggctacgtcggctacggcagcggtggcgtgctcaccgaagcggtgcgccgcaagccctattcggtggtgctgctggacgagatcgagaaagcccatccggacgtgctggaagccttctacaacgtgttcgacaagggcgtga

SEQ ID NO: 8870 - DNA, 552 bp, Pseudomonas aeruginosa
agaacagcggacgaattcatgaactggaacgatctttgcggaataaacacggtagccggaaaagccatagacatcccgaccctggtcggtcccggcgtcgatcacgaccgacgtggaaggaccggaatgcccaacggcgcgacgctgaccgccatgatgaacgctgccgacgccctacgtctgaccgaggccccgaggaccaggcgcggtggtgtgtccgacggtatttccttccacatcgcccaatacgtgcccggtggcgcgtctctgaccatcaccagccagttcgtcggtcagaaagccggctccgccgtgtgctacgagaacacactgttcaacgatgccctggtcggtcgcatcaacgccatcgttggcaacatcatcgtgcgccagagcgtcgcaccctgtacgcgctgccgcgccggctaccgccagctcgcccagaacggaccacgtactatcgtcgtctccagcgatgacggctacgacggcgcccccgacaacaccatcttcctcttcgcacccaccgggctggtgttctaccgacgctga

SEQ ID NO: 8871 - DNA, 501 bp, Pseudomonas aeruginosa
cgctggccagcaacaaccgggtgttccagaacctggccaccagcgacatcgtcacccaggtcttcgaccagcacggcttcagcgactaccagttgcagctcagcggcagctaccagccccgcgaatactgcgtgcagtatggcgagagcgacctcgccttcgtctcgcggctgctggaggaagacggcatcttctggttcttcacccatgccgccggcaagcacaccctggtgctggccgacagcaacgacgccttcccgccgattcccaacggcccgcaagtggcctacctgggccaaggaatcggcgtgcgcgagttgcagggcgtgcgttcggcgcagtacagcctccaggcggtatccgggacctacagcgccaccgactacgagttcaccaccccgggcacctcgctgtactcccaggccgaggcggtttccggcgccgccggcgtctaccagcaccccggcggctacaccgccaaggcccagggcgacagcctga

SEQ ID NO: 8872 - DNA, 558 bp, Pseudomonas aeruginosa
aggtcaactgaggagaagcgcatggcggcatccggcaagctcgacctggttcgaggcgacagccatctcgccggcaacctgctcgacggcagcctggaaggtccgttgcgcatcgacgagcacgacaggccgcaggccagcctcggctaccgacagggccagttgcacggcgccagcaccctgctccatcccaacggcaaggtctccgcgcaactcgccttcgtcgacggcaagctgcacgggccggccagtttccatgccgcggaaggctggttgcagcgcaaggcgcactaccgcaacggactgctccacggcgaagcgctcaactatttcgccaacggccaggtggccgagcgcgagcattaccgcgacggcgtgcgcgacggggtctaccagcgcttccatggcaatggccaactggccttcgacggacgctacctgaacggccagctactggacggcgcccagccgttcgccgacgacggccggccgctggacagcgagggcaagcccatggcgcgctggcgctggtggtggaccaggctggcggagccctag

SEQ ID NO: 8873 - DNA, 2001 bp, Pseudomonas aeruginosa
ctatcccctgttccgcgatggcctgagacgggtcgtccgccgctacctcccgcaagccgccgtaagcgaagcgggcagcttcgacgaggtgctgcgcctggcctcgagcgtctcgccggaacctcccgccctcttcgtcctcgacctgctgcttcccggcttcgccgcctcccagtccatcgagcgcttgcgtcgcgcctatcggcacagcgcaatcgtcatcgtctcgatgctcgacgacccgcgtctggtggacgaggtgctggccgccggcgccgacggctacctcggcaaatccctggaggccggggagatcggcacggcgttgcagacgctcggcagcggcgaaccggtggtgcgcctgcgcggcgggtcgagcgccggcagtcggcaacgcgccctcctggacgccctgaccccacggcagcaagcggtactgcggctgatcgccgatggcctgtcgaacaaggaaatcggccgcgcgctgtcgatctctccgttcaccgtgcgcgtgcacgtttcctcgctgctgcgcgccctggaagtgaacacgcggacggccgccgcggcgctggcggtgaaggccggcttctaggcaggttccacgcggccgtacccggagttcccgcgcaagcatccgagaatgccgaaacgagaagtctgccgcgattttccgcgaagtctcctcgcggcgctgaagcccgtcgcggcggaccagtcccatccatgaggggcgcgcctgcgcgccggcctcaccgggagcggcgacgctcgttttcagcagaggaacggcatatgatcgacagggtgaagccgctgatggcggcatgggttctggtcttcgcatcttcttcgttcgccagcgaaacggcgggaaaattgccacgaaagccagctctagggccggaaaccgcgggggcgaccctggtcattcccggcgagaccgacaggctcgcttcgctctacgcccgcgcacggggcgaaggcggcaaggtggtgctctgggccggcggcgacgcgccgaaccagatggactggttgaagacggccttcgagagccgctttcccggcgtgatcctggacgtcacggtggacctttccaagttccacgacctgcgcatcgaccaggaactcgccgccggcaccctgacgccggacgtggcgatgctgcaaaccaccttcgatttcgacaaatggaaggcccgcgacgtgctgctgcgctacaagccggtcggcttcgcccggcagaagaaaggctacgccgatcccgacggcgcctatgtcacggcctacaacaacgccttcgtgccgacctacgcttccgtccggctgccagcggagcgctatccgacgcgcttcgccgattacctgaagccggccttcaagggcaagctggtgctgacctatccccatgacgacgatgcggtgctgtacgtctacgacaagctggaacggcgctacggcagcggtttcctgcgcgccctggcggcgcagaagccgaacttcctgcgcggcacggcggcgccggcggcctcggtgggcaccgactccatcggttcgctgggcaacctgaccggctatgcgaccgacagcgatacgccggccggctacttcatcccgaccgacgagccgttcatcgtctggaaccagcgcgcggcgatcttcaaggccgcccgtcatccggccacggccaagctgctgctgtcctacctgggctcggccgagttccagtccagctacggcggctggcgcgcccgcgccgacgtcggcgaagcgcctgggctgccgccactggagtcgctgaagaacgtcgacgtgcacgatttcacccgctggatggccgatcgccaacgggtggccagcctgcgcaggcacatggcgcaaatcttcggcccggtacgcggcgagtctccgttgcgcgacccggcgctgatgagcctgctggggctgacggcgaacgacatcgtcgccctgcccgaaccggacctgccgatctactga

SEQ ID NO: 8874 - DNA, 765 bp, Pseudomonas aeruginosa
cctgctgaacacccgcatccagcgcatcatccacgccccggccgcgcaacaggcctgccaggcctgcatttcccgattgcccggcgaagacgagggcgactgggcccacctgctggaaagcttcgaccgttccaaccagtggctgctcgacccgcagcgcgacggcagcatcgtcctgcgctggagttccgccgcctgatcctgtttgccgcgcggccgtcgagccgcgcggcttgcgctcttcccttcccttccattcgctgttcgcggctatcgcggatagcttcccggcaacaggatgtcccggccgacctcgcggatgtcggtatggccgcagaaggccatggtcaggtccagctcgcgggctatgatctccagcgcccgcgtcactccggcctgccccagcgcgcccagcccgtagagatagggacggccgatcatggtcccgcgcgcaccgagggcgatggccttgagcacgtcctgcccggaacggatgccgctgtcgagccagacctcgatgcgctcgcccaccgcctcgacgatcgccggcagcgcgctgatggtcgagggcgcgccgtccagttggcgtccgccatggttgctgacgaccagcgcatcggcgccggagtcggcggccaaccgcgcatcctcggcatcgagaatgcccttgagcaccagcttgccgccccagcgccgcttgatccattcgacgtcgccccagttcagccgcgggtcgaactggcgggcggtccactcggacagtga

SEQ ID NO: 8875 - DNA, 720 bp, Pseudomonas aeruginosa
gcccatgtcgtcgacgcccttgacgtgcccgacgatgttgccgaaaccgcgacgccgggtgccgagcatgcccagcgcccagcgcggcttggtggcgatgttcagcaggttggccagggtcggccgcggcggcgccgagagaccgttcttcaggtccttgtggcgctggccgatgatctgcaggtcgagggtcagcaccagcgcgtcgcagccggcggccttggcacggtcgatcaggcgttcgatgaaatcgcggtcgcgcatcacgtagagctggaaccagaacggctggccgacttccgtggcgatgtcctccagggaacagatgctcatggtcgacagggtgtagcgcacgccgaactcggcggcggcgcgggcggcgaggatctcgccgtcggcatgctgcatgccggccagcccggtgggcgcgatggccaccggcatggccatctcctggccgagcatgcgggtgcgcagcgagcggttctcgatattccgcgcgacccgctggcgcagcttgatcgcggcgaagtcgtcctggttggcgcggtaggtgccttcgctccaggaaccggagtcggcgtagtcgtagaacatccgcggcacgcgcttgcgcgccaggcggcgcaggtcttcgatatcggtgatgacgctcatgcagtccactccttcgggggtggctggatggtagagcgcgacgtaccgccgcaggcggaataa

SEQ ID NO: 8876 - DNA, 1464 bp, Pseudomonas aeruginosa
tcaaccgctacctcgacgctccgctggtcctgggcgacaggagcgctgcgaaactgcgcattggcgggatctacagcacccgcgacatccgcagcctggtcgacgccctgccgaaagtcctgcccgtggacctggaacatcgcgaggacggcagcatccgcatcagcagccgttacgcccagctctgaacccaggttaaatttagccgccctggcctcgtatatctggcagtgcccagcctgccgatccagcggcggcggtctctccacgcaccggccggattcccgaatgagacgaacccgtagtactcgtcgcgcactgctcgtcgcagtctgcctcagccccctgatcgccctggccgcctggcaggcctatccgttccgcagcaacagcttcgataccgtgagcgtcagccgcggcagcatcgagagcagcgtctcggcgctcggcaccctgcaaccgcggcgctacgtcgacgtcggcgcccaggcctccgggcagatccgcaagttgcacgtcgaggccggggacgatgtgacggaaggccagttgctggtcgagatcgacccctccacccagcaggccaaggtcgatgccggccgctattcgatcgagatgctcaaggcccagctggccgagcaacgtgcccaatacaccctcgcccgccagcagtaccagcgccagcagcggctggccgccggcggcgcgacgcgtaccgaggacgtgcagagcgcccaggcgcagatgctcgccacccaggcacggatcgagatgtaccaggcgcagatccgccaggcccaggcctcgttgcgcagcgacgaagccgagctcggctatacccgcatctacgcgccgatgtccggcacggtggtggcggtcgatgcgcgcgaaggccagaccctcaatgcccagcagcagaccccgttgatcctgcggatcgccaaattgtcgccgatgaccgtctgggcccaggtttcggaagccgacatcggccgggtcaagcccggcatgccggcctacttcacgaccctcagcggcgaaggccggcgctggaccggcaaggtccggcagatcctcccggtgccgcccaagccgctggaccagagcaaccagggcggcggcagccccaccagcggcagcggcgggcagagcggcagcggccgggtggtgctgtataccgtgctggtcgacgtggacaacggcgaccaccaactgatggcggaaatgaccgcccaggtgttcttcgtcgccgccaccgcggaaaacatcctcaccgcgccggtcgccgccattcacgacgacggcaagggcggccaggtcgcctgggtggtcggcagcaatggcaagccgcagagccgccagatcaggaccggcatcagcgaccgcctgcgggtacaggtgcttgccggcctggaggaaggcgaccgcctgttgatggccgctcccgacggcagcgacagctga

SEQ ID NO: 8877 - DNA, 1038 bp, Pseudomonas aeruginosa
ccgtgcgcgaacgcacccgcgagatcggcatccgcatggccactggcgcccgccagggcgatatcctccgccagttcctcaccgaggcggcgatgctctcggtggtcggcggcctggccgggatcgccctggccctgtgcatcggcggcgtgctgctgctcggccaggtcgcggtggccttttccctgtcggccatcgtcggcgccttcagttgcgcgctggtcaccggcctggtgttcggcttcatgccggcgcgcaaggccgcccagctggacccggtggccgccctggccagccaatgacggatatgtccatgaagaatctctccctgatttccgcctgcctgctgctcggcgcctgcggcagcacgccggcgcccctcgacagcggcctggccgcgcccagccagtggcgctacctggcggccgggcgcagcgatgccagcgacatccgccagtggtggaaggccttcggcgcgccggaactggacagcctgctgcaacgcgccctgctgaacagccaggacctcggcgcggcggtggcccgcgtacgccaggcccaggcctcggcggtgatcgccggcgcgccgttgctgccggagctgaatgcgacgctcggcgccagccggcagaaactcctgcgcgactcgggctacagcggtaccgacgcgacctccgacaacgatgccgtcgactccttctccgccggcctcagcgccagctacgaagtggacttctggggcggtcgccgggctgcctaccgcagtgccctggaaagcctcaaggccagcgagtacgaccgcgcaacggtagagctgaccctgctctccggcgtcgccaacagctacctgcaggtattggcgctgcgcgaacagcagcgcatcgccaggctcaacctggacaacgccgagcacgtcctgcgcctggtggagacccgccatgccgcgggctcggccaccgccctggaggtcgcccagcagagcagcctggtcgccagccagcgcaagcagctgccgctgctcgagcagcaggcccatga

SEQ ID NO: 8878 - DNA, 753 bp, Pseudomonas aeruginosa
ggcgctgattaccctggccaccctgatcggcgagccggtgcaggcgctacaggtggccgagcggcctttcgacagcctgcgctggccggagaccggagcgggcctgccgagcgaactgctcagccgccgtcccgatatcgccaacgccgaagcgcaactggccgcggcccaggccgacgtgcaggtggcgcgcgcggcgctgttccccaagctgaccctgagcgcctcgctgtcgtccggcgccaaccgcgccgccgacactttccgcaacccctattacaacctgggcgccaacctgctcgccccgatcttcaaccacggccgcctgcgcgccgagcgcgaccgcagcctggcgcgccaggaagaactgctggaaacctaccgcaaggcgatcctcaccgcctttgccgacaccgaacgctcgctgaacagcatcgacggcctcgaccgccagctgcactggcagcagcaggagctggagcaggcgcagcgcgccttcgatctctccgacagccgctaccaggccggcgcggaaaccctgctgacggtcctcgaaacgcaacgcacgctgtacgcggcgcaggatgccgccgtgcaactgcgactggcccgcctgcaggcctcggtcggcctgtacaaggccctcggcggcggctggcagagcgaccgccagggtctcgcgcggaaagactgaggcccgcgttgcgcgggcctcctccatccttactcgctctttcgccgttcagcgcctga

SEQ ID NO: 8879 - DNA, 1404 bp, Pseudomonas aeruginosa
gtccgcttcggcagacgctcatccgcgctttcgatctcgaacctgactgggacggcaatgactagaacacgcacacgcaaggccctctacctcggcttgccgatcttcctcatcctcgtcggcggcggcctgctggcctggaagaccttcggcccgagcgaagcgggctacccgcgcaaggtcatgaagcacgccgaggagttgcatgagcgcatcctctccttcgatagccggatcaccatcccgccggacttcggcaccgaaggcaacgagttcgacaaggacggaccgaaccagctcgacctggtcaaggcgggccgcgggcgcctgtccggcgctgccctggcgatcttcggctggccggagatgtggaacggcccgaacgcgccgcacaagccgacccccggtttcgtcgacgaagcccgccaccagcaggaaattcgttacaagattctcaccggcatggtccgcgactttcccaaccaggtcggcatcgcctactcccccgaggacttccgccgcctggccatggaaggcaagttcgccatcgtcatgagcatgctcaacgcctacccgctgggcgacgacctgtcccaactggacaaatgggccgcccgcggcgtgcgcatgttcggcttcaattatgtcggcaacaacgattggtccgactcttcccgtcccttgccgttcttcaacgacacggcggatgccctgggcggcctctccccgctaggcaagcaggcggtcgaacggctcaacgatctcggggtgatcatcgacgtctcgcagatgtcgaccaaggccctggaacaggtcgccgccctcagccgcgcgcccatcgtcgcctcgcactccgcgccgcgcgccctggtggacatcaagcgcaacctcagcgaccacgagatgcaactgatcaaggacagcggcggcgtgatccaggtggtcggcttccccgcctacctgcgtccgctgagcaaaccgaccctggacaagctcaacgccctgcgcgcgcgcttcgacctgccgcccctggaaggcctggactatgcgctgatgccgggcgatccgatcatcaccatctggccggaacaacgcttcggtgaatacgccagcgccctctacggcatcctggaggaggagcccaaggccggcctcaaggaactggtggacgccatcgactacacggtgaagaaggtcggcatcgaccacgtgggcatcagctcggacttcaacgacggtggcggcgtggacggctggaaggatgtcagcgaaatccgcaacgtcactgccgaactgatcacccgcggttattccgatgccgacatcgccaagctctggggaggcaacttcctgcgcgcctggggcgaagtgcaaaaacgcgccaagccgacagccaccccctga

SEQ ID NO: 8880 - DNA, 1233 bp, Pseudomonas aeruginosa
atggaaagcgctgcgccagcaattcgatctcgacccgcagtatctgcacttcgccaacttcctcctcacctcccaccctcggccggtgcgggaggccatcgagcgcctgcgggtccgcttcgaccgcaacccgggcgaagcggtggactggcatcgcgaggaaatctggaaatacgaggacgaggctcgcgcctgggcaggtcgctacttcgccgtgcaacctggccaggtggcgctcaccggcagcaccaccgacggcctggcggcgatctacggcggcctgctggtgcagccgggcaaggagatcctgacctcctcccacgagcactactccacctacaccaccctggaataccggcacaagcgcatgggtacccaggtccgcgagttcccgctgttcaaggacccgcaccgggtttccgccgacgagatcctgtccagcatcgccgctcagatccgcccgcagacccgggtgctgggcatgacctgggtgcagtcgggcagcggcgtgaagctgccgatccgcgagatcggcaagctggtgcgcgaactcaaccagaagcgcgacgagcaggaccggatcatctacgtggtcgacggcgtgcatggtttcggcgtggaagacgtcagcttcgccgacttcgactgcgactacttcatcgccggcacccacaagtggctgttcggcccgcgtggcaccggggtcatcatcgcccgctcggaacagctccaggagcacctggtgccgagcatcccgaccttctcccgcgccgacaacttcggcaccctgatgacccctggcggctaccacgccttcgaacatcgcctggccctgggcacggccttcgagctgcacctgcagttgggcaaggccgaggtccaggcgcgtatccaccagctcaacgcctacctcaagcagcgcctgggcgagcatcccaaggtccgcctggtcacgccgaccagccccgagctgtcttcgggcttcaccttcttccgcgtcgaaggccgcgattgcgaggcggtcgccaaacacctgatggcgcaccgggtaatcagcgacgccgtggatcgcgatgtcggcccggtggtgcgcctggcgccgagcctgctgaacgacgaggcggagatcgaccgggtgctggaaatcctcgccccgcaactcgcctgacccctttcgccactcaacgagaaccgccatgcacgcattatcgcccctggccctggccgcactga

SEQ ID NO: 8881 - DNA, 468 bp, Pseudomonas aeruginosa
agaactacgccgcctggctgtcgaagaagaccggcaagcactaccgcatgctcagcgaggccgagcgcgagtacggcgcccgcgccggcagcgccggccccttccccttcccgttcgacgaaggcaaggaatacagcatcgccaagcacgccaacacctacggcgccagcgatggctacaacttcacctcgccggtgggcagcttcccgcccaacgccttcggcgtctacgacatgcacggcaacgtctacgagtgggtcgccgactgctggcacgaccactacaacggcgcgccgagcgacggcagcgcgtggatggaggacaagtgcgagctggtgcagatccgcggcaacgactggggcgagccgccgatcttctcgcgctcgggcaaccgcaacaatgcggcccccagcgaccgcggcgactggatcggcttccgcgtggcgcgcgaactctgattcagaatga

SEQ ID NO: 8882 - DNA, 1668 bp, Pseudomonas aeruginosa
tacatccgggaagcaactatgaccaatcccaagcgcggcgccattcgcgaactgctcgccctgctcaggccctttcgagcgatcgtggccgtctccatagcactgggcatggccggcggccttgccatcaccctgctgctggccagcatcaacaacgccttgcactcggaaaacggcctcggccaaggcgtactgctgtcgttcggcggactctgcctgctggcattggtcagttcgatcgtctccgacatcggtaccagctacgtcggccaacacatcatcgcgaagctgcgcaaggaactcggcgagaaagtcctctcggcgcccatcgagcagatcgagcgctaccggacccaccgtctcattccggtactgacacacgacattgacaccatcagcgacttctccttttccttcaccccactggccatagccctgaccatcactttcggctgcctgggttacctcgcctacctatcggtcccgatgttcctgctgacagtcgtcgccatcgtcatcggcacggcagcccagtacctggcgcgctcccgcggtttcaaagggttctatgccgcccgcgatctcgaagacgaattgcagaagcactacaccgccatcgcttcgggcgcgaaggaactgcgcatccaccgcccccgtcgctatcgcatgcacaccggccgcatcagcgaaaccgcgaacaacatccgcgacctccacatcagctccatcaatatattcatcctggccaagaccttcggctcgatgctgttcttcgtggtgatcggtctggcgcttacgctccaggcctactggccttcgtccaatccggccgccatcactggcttcgtgatggtcctgctgtacatgaagggaccactcgaacaggtggtgaccatccttcccatcgtcagccgcgcccaggtcgccttccagcgggtcgccgaactttccgagcgtttttcctctcccgaaccccatcttctgctcagcgaacaggaggccccggacaagaccgtcgacagcctggagctgcgcgacgttcgctacagcccccccgccgtcgaaggcagcgaaccgttccatctgggccctatcaatctgcgtatcgcccaaggtgacatcgtcttcatcgtcggcgagaacggctgcggcaagacgaccctgatcaagctgctgctcggcctctatcgcccgcagtccggcgagatccttctcaacggagaaccggtcagcgcggagacccgcgacgattaccgccagctcttcagcaccatcttcgccgactactacctcttcgacgacctggtccagggcaagcaggcttcgttgcagaacgcgacccaatatctgcaacgcctggaaatcgcccacaaggtcagcgtcatggacggcaacttcagcaccaccgatctctccaccgggcagcgcaagcgccttgcgctgatcaatgcctggctcgaagagcgaccggtcctggtcttcgacgaatgggccgcagaccaggacccggctttccgcagggtcttctacaccgaactgttgccggacctgaaacgccagggcaagaccatcatcgtgatcagccacgatgatcgctatttcgaaatggcggaccagttgataaggctctcggcaggcaaggtcgtcaaggaaaccgagacggcgtga

SEQ ID NO: 8883 - DNA, 2463 bp, Pseudomonas aeruginosa
gaagagcaatcacccatgccagcaccacacggtctcagtcctctgagtaaggcgtttttgatgcgccgtgccttccaacgcaggattcttccccactcgctcgccatggccctgagcctgccgctggcgggatatgtccaggcgcaggaagtcgagttcgacatccctccccaggcgctgggcagcgcactccaggagttcggccgccaggcggatatccaggtgctgtatcgcccggaagaggtccggaacaagcgtagcagtgcgatcaagggcaagctggagccgaaccaggcgattaccgagctgcttcgtggcaccggcgcatcggtggacttccagggcaatgcgataaccatcagcgtcgccgaggcggcggacagcagcgtcgatctcggcgccaccatgatcacctccaaccagttgggcaccatcaccgaggacagcggctcctatacgccaggcactatcgccacggcgacccgcctggtcctgactccgcgcgagacgccccagtcgatcaccgtggtcacccgccagaacatggacgacttcggcctcaacaacatcgacgacgtcatgcgccatacgccgggcatcaccgtctcggcctacgacactgaccgcaacaactactatgcccgcggcttctcgatcaacaacttccagtacgacgggattccctcgacggcccgcaacgtcggctactccgcgggcaatacgctcagtgacatggccatctacgaccgggtggaagtactcaagggggcgaccggcctgctcaccggtgcggggtccctcggcgccacgatcaacctgatccgcaagaaacctacccatgaattcaagggccatgtcgaactgggcgcgggcagttgggacaattaccgctccgaactggacgtcagcggcccgctgaccgagtccggcaacgtccgcggccgggcggtagccgcctaccaggataagcactcgttcatggatcactacgagcgcaaaaccagcgtctattacggcatcctcgagttcgatctgaatcccgacaccatgcttaccgtcggcgccgactatcaggacaacgatcccaagggatcgggctggtcgggcagcttcccgctcttcgacagccagggcaaccgcaacgacgtctcccgctccttcaacaacggagccaagtggagcagttgggagcagtacacccgcaccgtcttcgccaacctcgagcacaatttcgccaacggctgggtcggcaaggtgcagctcgatcacaagatcaacggctaccacgcgcccctcggcgcgatcatgggcgactggccggcaccggacaacagcgccaagatcgttgcgcagaagtacaccggcgaaaccaagagcaactcgctggatatctatctcaccggccccttccagttcctcggtcgcgagcacgagctggtggtcggcacctcggcttccttctcccactgggagggcaagagctactggaacctgcgcaactacgacaacaccaccgacgacttcatcaactgggacggcgatataggcaagcccgactggggtaccccctcccagtacatcgatgacaagacccgccagttgggcagctacatgaccgcccgcttcaatgtgaccgatgacctgaacctgttcctaggtggacgcgtggtcgactaccgggtaaccggcctgaatccgaccattcgcgagtccggacgcttcattccctacgtcggcgcggtctacgacctgaacgatacctactccgtctacgccagctataccgacatcttcatgccgcaggacagttggtatcgcgacagcagcaacaagctgctcgaacccgacgaaggccagaactacgagatcggcatcaagggtgaatatctcgacggacgactcaataccagtctcgcctacttcgagattcatgaggaaaaccgcgcggaggaagacgccctctacaacagcaaaccgaccaaccccgccatcacctacgcctacaagggcatcaaggccaagaccaagggctacgaggcggaaatctcgggtgaactggcgccaggctggcaggttcaggctggctatacccacaagatcattcgcgacgacagtggcaagaaggtttccacctgggagcctcaggaccagttgagcctctacaccagctacaagttcaagggcgccctggacaagctcacggtcggcggcggcacccgctggcagggcaagagctggcagatggtctacaacaatccccgcagccgctgggaaaagttctcccaggaagactactggctggtggacctgatggcccgctaccagatcaccgacaagctgtcggccagcgtcaacgtcaacaacgtcttcgacaagacctactacaccaacatcggtttctacacctcggcatcctatggcgatccacggaacctgatgttcagcactcgctgggacttctga

SEQ ID NO: 8884 - DNA, 522 bp, Pseudomonas aeruginosa
ccgtcagcggcatccgctccagcagcatcaggtgcgccggcaccatgtagtccggcaggtgccgcttcagcgactcccgcagcgactcccgcagacgctcggcatcctccgccgagtccgccaccacgtatcccaccagttgcgtgccgccgaccccgtcatgggccagcaccacggcatcacgtaccccggccagaccggcgagcgccgcttcgatctcacccagttcgatacggaagccgcgaaccttcacctggtggtcgatacgcccgatgtactcgatattgccatccgcctggaaccgtgccaggtcgccggtacggtacagccgctcgccggcaccgccggggaacgggttcggcacgaagcgggtggcactcaacccgggccgcctcaggtagccgcgcgccagaccggcgcgaccgatgtacagctcgcccaccgcgccgcgcggcaccgggttcaggtcacggtcgaggatgtaccaggacaggtccgggatggtcccgccgatcggactga

SEQ ID NO: 8885 - DNA, 504 bp, Pseudomonas aeruginosa
aactactggcgccttcacgctgggccaaggctctcacggcctcgaccagttcccgtggtagctcgaaacccaactgcgcgccacgatggctctgccgggccggacgcggccgatcgaacggcaactccagcaccggctgctcgccgcccagcaggccggtccagtacgccaactggcgctccttttcccccgcctccatccagctgcgctgccacagggcgtagtccgcgtactggatcggcagggctggcaacaccacgtcgagcccttggctataggcggcatagagctggaccagttcctcgaccatcacctgcatcgaccaaccgtcggacacgatgtggtgctggaccagcaccagtacatggtcgtcttcggccagttgcaacaggttcacccgcagcagcggcccccgttccaggtcgaatggctgcacaacgatggcctgtatccgttcgatcaggccttcttcaccgaactgttcccgctcgatggaaacgctaa

SEQ ID NO: 8886 - DNA, 522 bp, Pseudomonas aeruginosa
ccgtcagcggcatccgctccagcagcatcaggtgcgccggcaccatgtagtccggcaggtgccgcttcagcgactcccgcagcgactcccgcagacgctcggcatcctccgccgagtccgccaccacgtatcccaccagttgcgtgccgccgaccccgtcatgggccagcaccacggcatcgcgtaccccggccagaccggcgagcgccgcttcgatctcacccagttcgatacggaagccgcgaaccttcacctggtggtcgatacgcccgatgtactcgatattgccatccgcctggaaccgtgccaggtcgccggtacggtacagccgctcgccggcaccgccggggaacgggttcggcacgaagcgggtggcactcaacccgggccgcctcaggtagccgcgcgccagaccggcgcgaccgatgtacagctcgcccaccgcgccgcgcggcaccgggttcaggtcacggtcgaggatgtaccaggacaggtccgggatggtcccgccgatcggactga

SEQ ID NO: 8887 - DNA, 681 bp, Pseudomonas aeruginosa
actgggcaccacgatggctttgccgaaccgggcgcggccggtcgaacggcaactccagcaccggctgctcgccgcccagcaggccggtccagtacgccaactggcgctccttttctcctgcctccatccagctgcgctgccacagggcgtagtccgcgtactggatcggcaaagccggcagcgctacctcgagccctcgactataggcggcatagagctggaccagttcctcgaccatcacctgcatcgaccaaccgtcggacacgatgtgatgctggaccagcaccagcacatggtcgtcctcggccagccgcaacaggctcacccgcagcagcggcccacgctccaggtcgaacggccgcgcgatcgtcgtctcgacctgccgagcgagggcgccctcctcgagcggccccaacgcgacgatatccaacggcaatgccatggatgcggcgatctcctggcgcgcctcgtcgccgtcgaggcgaaaacgggtgcgtagggtctcgtgccgcgcaaccaggctgtcgaagctgcgttgcagggcatccaggtccagccgcccacgtagacgcaagacactcgggatatggtaggccgcgctttccggctccagttgccagagaaaccactgtcgctcctgggcataggagagccgcaggggctcgccgtcctggcgcttga

SEQ ID NO: 8888 - DNA, 1857 bp, Pseudomonas aeruginosa
  unsure (814): Identity of nucleotide at the above locations are unknown.
gcggccaatgacctgggtggccagcaacgagtggccgccaagctcgaagaagttgtcgtcgagcccgacctgttgcaattgcaggacctccgcccagatccccgcgacctgttgctccagatcgcttcgcggcgccacgtagacctgctgcaacaggctcgcatccggctgcggcaggcccttgcggtccagcttgccgttcggcgtcagcggcatccgcgccaggaacaacaggtgcgatggcaccatgtattccggcaggcgctcgcgcagcgccgtcttcaactgcgcccggcactccgcctgcgcttccggcgaatccgcgaccgccggcgcctgcgccaccacgtagcccaccaactgctggcccaccgcacccggctgggccaccaccaccgcctcgcgcaccgccggatgctcgcgcaggcgcgcctcgatctctcccagttcgatgcggaagcctcggatcttcacctggtggtccacccgtccgaggtagtccaccaccccatccgcacgcccacgggtcaggtcgccgctgcggtacagccggctgcccggcgcgccaaaggggtccggcacgaaacgctcggcggtcagcgccggacgctccaggtagccgcgcgccaccccttccccgcccaggtacagttcgcccgccacgcctaccggcagcaggttcaactgcccgtcgaggatgtagccgctacggttgcccagcagcgtaccgatcggcatgtatgccgcgccgcaggcatcgcccgcccgtgctttccacagcagcggcgtcaccaccgtctcggtcgggccgtanccgttgaacaggtacttcggcttcagcgcccgccacgccaggtcatagctggcctgcgccaccgcgtcgccgccgaagcaatacacccgtaccggcggcggattgccgtcgcgctcggcatgctcggccagttgctgcaggtacaccggcgggaacacccccaccgttaccccgtggcgatgcatctcggcgtaggtccgttccggcagccacaggctgtcgtcgcggatcagcacccgcgcgccgttgatcaacgggtgcatccagccttcgtgggaaccgtcgaaggcgaacgacatgaagtgcagctcgcagtcctccggggtcatctcgtagcgctcgccggtggccacgatatgggcgatcaacggaccgtgggacaccgccacgcccttgggcatgccggtggagccggaggtgtagatcacataggccaggttgtcgccgtgcagcgccacctctggatcatgagcggggaagccggcccactcctcctcgcgatccacggacaggcaggacaacccctcggggatcggcagacgctccagcaggtggctatgggtcagcagcaggtgcgcgcgactgtcctgcatcatgtacagcaggcgctcgcgcgggtattcgatatccagcggcacgtaggcgccgccggccttcagcaccgccaggaacgccaccatgatctccgcgctgcgctgcatggcgatcgccacccgcacttcggggccgacgcctcgggcgatcaacgcatgggccaggcggttggcccggctatccagctcggcgtaggtgagtttttcctcgtcgaagatcaccgccaccgcatccggcgccatacgcgcccgctcggccactcgctggtgtaccagcggcgttgccggatagcccgaatcgctgcggttccagagctgcccgatgacttcgcgctcctcgcggtcgagcatgtccagctctcccaggcgagcgtcaggcatcgccaggatcgcatccagcaggttctgccaatgccgtaccaggcgctctgcggtcgaagcatcgaatag

SEQ ID NO: 8889 - DNA, 192 bp, Pseudomonas aeruginosa
gtcgaagggcctggccatctccgcttcgactgccgccctgagcgacgcgtcatcgacattcgccaggctatgccgggaaacctgcaactgcccatcggcatccaccacctgaacggtacgcaggccttcctggcggaagcgggtacgcaacgactcgtgacgctgtgcgaggcgctcgaaactgcgctgtag

SEQ ID NO: 8890 - DNA, 2022 bp, Pseudomonas aeruginosa
cgcctggccgataggactggcattgcccacccgggcgttctcggcggaacaatcgaagacgctggacaccaccgtggcctcggtcggtccataggtattgagcaacctcacccggcccatgccggcttgccgccagagcttcggcccctccagtggcatggcttcgccaccgatgtggatctgccgcagggcaccgtaggaacgccgtggctcggccagggcatcgagcaggaacaggttccagtacgccgtgggcaggtcggcaagggtcacgccctgctcgactatctgccgatacagctcaccggtatcccagaggtcgccgccacgcaggaccacgcaggcaccacgggtcagcgccggatagagctgttcgacgaagccgtcgaagctcagggtggcgaactgcaatatccgatcctccggggtgagcgcggaataaccactggcgatacgcgagaactgcgcaagcgccgcatggctgatggccacgcccttgggttttccggtggagccggaggtgtagatcacataggccaggttctccggccgcaggttcaccaccggatcatccgtagacaccgatgcgtcccgttccaggcggtcgatggagagcacctccagcccttcgtgcaaaggcagcccgggcagcaaatgctcctggctgagcaacaggccgacggcgctgtcctcgagcatgtgacgcaaacggtcctgcggataggtcgggtccagcggcacataggcaccaccggccttgaggatcgccagcagaccgaccaccatgtccagcgagcgctcgacggcgattcccaccagcacatcgggaccgacgccacgcgctatcaggcagtgagccagacgattggcgcgggcgttgagctcggcgtagctcaacgcctgcccctccagcgccagtgcttgcgcctgcggacgcagacgggcctgctcctggatctgcaactggaccaggggcggcaacccaccctcgtcggcgttctctgcccaggcccgcaacaggcaatcgcgctcctcgtccagcaacagcggcaactcggcgaccggccggcccggttcggccacgatgccgcgcaggagattctgccagtgccgagccaggcgctcgacggtcgaggcctcgaacagatccgtggcatagccgaacgatgcccagataccgtcctcggcctcgtgcacgtccagcgtcaggtcgaaggccacggagctgctccgccactccatccgctccagcgacaggcctggcagttgcacgccctggttggccgaacgagagtcggcctggtgattgaacatgacctggaacaacgggttgtggccgaggctgcgctccggctgcaaagcctccaccagttgctcgaacggcaggtcctggtgcgcctgtgcctccagcgcgcgctggcgggcctgggccagcaactcgtcgaaacccatccggccattgatgtcggccttgagcacctgggtgttgacgaagaaaccgatcagccgctcggtttcaacccggttacggttggcgatcggcacgccgacacggatatccgcctgtccgctatagcgatgcaacagcgcctggaaggaagccagcaacagcatgaacatggtcacacccttgcgctgaaccagctgtttcaaggcaagggccaggtgtggctccagctccaggtccaattgcgctccacgatagctgcgcagcggctgccgcgggtgatcgaggggcaactcgatcaccggctgctcgccgcccagcaggccggtccagtacgccaactggcgctccttttcccccgcctccatccagctgcgctgccacagggcgtagtccgcgtactggatcggcagggccggcaaccccacgtcgagcccttggctataggcggcatagagctggaccagttcctcgaccatcaattgcatcgaccaaccgtcggagacgatatggtgctggaccatgaccagcacatgctcgtcggcgtccacctccagcaaagtcacccgcagtaa

SEQ ID NO: 8891 - DNA, 2025 bp, Pseudomonas aeruginosa
ttcgctcatgaattcacgaaggtcatcgaaatcggtgtcattgctggaagtctgcgccgcggcaagctcggcataggcttgcagcgactcggtctggaacaacgccgccagcggcagctccacgccgacctcgctctgcatccgggcagtcacctggatcgccagcaacgagtggccgccaagctcgaagaagttgtcgtcgagcccgacctgttgcaattgcaggacctccgcccagatccccgcgacctgttgctccagatcgcttcgcggcgccacgtagacctgctgcaacaggctcgcatccggctgcggcaggcccttgcggtccagcttgccgttcggcgtcagcggcatccgcgccaggaacaacaggtgcgatggcaccatgtattccggcaggcgctcgcgcagcgccgtcttcaactgcgcccggcactccgcctgcgcttccggcgaatccgcgaccgccggctcctgcgccaccacgtagcccaccaactgctggcccaccgcgcccggctgggccaccaccaccgcctcgcgcaccgccggatgctcgcgcaggcgcgcctcgatctctcccagttcgatgcggaagcctcggatcttcacctggtgatccacccgtccgaggtaatccaccaccccatccgcacgcccacgggtcaggtcgccgctgcggtacagccggctgcccggcgcaccaaagggatccggcacgaaacgctcggcggtcagcgccggacgctccaggtagccacgcgccaccccttccccgcccaggtacagttcgcccgccacgcctaccggcagcaggttcaactgcccgtcgaggatgtagccgctacggttgcccagcagcgtaccgatcggcatgtagcccgcgccgcaggcatcgcccgcccgtgctttccacagcagcggcgtcaccaccgtctcggtcgggccgtagccgttgaacaggtacttcggcttcagcgcccgccacgccaggtcatagctggcctgcgccaccgcgtcgccgccgaagcaatagacccgtaccggcggcggattgccgtcgcgcgcggcatgctcggccagttgctgcaggtacaccggcgggaacacccccaccgttaccccgtggcgatgcatctcggtgtaggtccgttccggcagccacaggctgtcgtcgcggatcagcacccgcgcgccgttgatcaacgggtgcatccagccttcgtgggaaccgtcgaaggcgaacgacatgaagtgcagctcgcagtcctccggggtcatctcgtagcgctcgccggtagccacgatatgggcgatcagcggaccgtgggacaccgccacgcccttgggcatgccggtggagccggaggtgtagatcacataggccaggttgtcgccgtgcagcgccacctctggatcatgggcggggaagccggcccactcctcctcgcgatccacggacaggcaggacaacccctcggggatcggcagacgctccagcaggtggctatgggtcagcagcaggtgcgcgcgactgtcctgcatcatgtacagcaggcgctcgcgcgggtattcgatgtccagcggcacgtaggcgccgccggccttcagtaccgccaggaacgccaccatgatctccgcgctgcgctgcatggcgatcgccacccgcacctcggggccgacgcctcgggcgatcaacgcatgggccaggcggttggcccggctatccagctcggcgtaggtgagcttttcctcgtcgaagatcaccgccaccgcatccggcgccatacgcgcccgctcggccactcgctggtgtaccagcggcgttgccggatagcccgaatcgctgcggttccagatagcgccgatagcgctaagctccgccttctcgagcatctgcagatcgaccagacgtcgctgcggatgttcggcgaatgcctccagcagagtcgtcaggtggcgacccaggcgctcgatcgtagcggccgggaacagtccgcgatcgtagctgaattgcagtga

SEQ ID NO: 8892 - DNA, 3315 bp, Pseudomonas aeruginosa
ctggttccagtgctggcgattgggaatcggctgttcgaagaacaaccgctggaacggcaacaacaccgtctcgccgctcacaggcccctgctccatttgcaccgcagcccctacgcgggcgactcgcgccagcccctgtacggtctgttgttggaacaggtccttcggagtgaactggatgcccgccgcacggcatcgactcaccacctggatcgaaacgatggaatcgccacccagggcaaagaagttgtcggtggcgcccacctcctccagcttcagcacgtccgcccagacggccgcgatacgtcgctccatttcattctgcggcgcaacatgcgtctgccccgcagcagcttgcggtcgcggcaacgccttgcgatccagcttgccgttcggactcagcggcatccgctccagcgccagccactgcgccggcaccatgtattccggcaggctcgccgccaggtgcgcggtcagggcttcgcgccagtcgccgctctcgctctccagcaccacgtagccgaccaactgcctgccgtccaccgccagcaccgccgcctcgcgcacccacggatgctccagcaggcgcgcctcgatctcgcccagctcgatgcgcaggccgcgcagcttcacctggtggtcgatccgcccggcgtactcgatcaccccgtcggcgcggtagcgcgccaggtcgccggtgcggtacatccgctccccagccacgaacgggctggcgacgaaacgctcggcagtcagccccggacgctggtggtagccacgggccaggccccgaccggccaggtacagctcgccgagcacgcccaccggtaccggctccaggttgccatcgaggatgtagcaggccaggttggcgatcggccggccgatcggcaccgcgtccttgccctcctccatgcaggtccagtgggtgacgtcgatggccgcctcggtcgggccatagaggttatagaggccggcctgcggcagcttggcgaacacctgctgctgggcgtccgccggcagcgcctcgccgctgcaaacgatgcgtttcaggctggtgcaggaggcgacgtcttcgtcctgcaggaaggcctgcagcatcgacggcacgaagtgcagcgtgtcgaccccctcgcgattgatcagctccaccagcttcgccggatcgcgatggtcgcccggcgcggcaaccaccaaacgtgccccgctcatcagcggccagaagaactcccagaccgacacgtcgaagctgaacggggtcttctgcaacaccgtgtcgccgacgcccaggccgtaggcctgctgcatccagcacaagcggttgctcagcgccgaatggcggttgccggcgcccttgggcttgccggtggagccggaggtgtagatgacataggcgaggttctcgccatcgagatgaatatccgggttcgcctcactgtaatcctcgaaccagggcgcaccgcgatccaggtcgatccgctgcacgccttgcgccagcggcagcttcaggtgcgactggctgagcagcagttgcacgccgctgtcctccagcatgtaggcctggcgctcctcgggatactccgggtccaccggcacgtaggcgccgccggccttgaggatcgccatcagggccacgaccatctcgatggaacgttccatggccacgcccaccaggcggtccgcaccgaccccgcgctcgatcagggcatgcgccaggcggttggcccggcggttcagctcggcgtagtccaggcgctcctcgccgaaggccagcgccggcgccgtcggtgtgcgctcgacctgctcctcgaacaaccggtgcacgccgcgttgcagcgggtactcggccgcagtggcgttccagccttccagcaactgatagcgctcctcggcatcgagcatcggcagcgagtcgacgctggcctgcgggttttccagcatgccgcgcagcaggttctgccaatgccgcgccatgcgctcgacggtccgcgcctcgaacaggtcggtcgcgtaggtcagcgcggcgtacaggcgaccgcccttctcgtaggtatccaggctcaggtcgaactgggtggtacggctcttccagtcgagctggccgaagctcaggccggccacgctgtccagcgcctcgatgtcggccaccagcggctggtggttgtacatcacctggaacagcgggctgtggctcaggctgcgctcgaccttgaacgcctcgaccaggcgttcgaacggcagatcctgatgggcctgggcgccaagcacggtgtccttgagcccggccagcagggtcgccaccgacgtgcggccgtcgaataccgagcgcagcacctgggtgttgacgaacaggccgatcagcccttccacctcggcgcggttgcggttggcgatggggacgccgacccgcaggtcggtctgcccgctatagcgttgcaggaggatattgaagccgccgagcaacagcatgaacagggtcagcccctggcgtcgggcggtgccgcgcagggcctcggccagggccggctcgatgctgaactcgtaacggctgccacggtagctgggaaccgccggacgcgggtggtcggtcggcaactccaggaccggatgccgctcgccgagcttgccgcgccagtactccagctggcgctcctgctcaccggcctccagccagctgcgctgccacagggcgtaatcggcgtactggatcggcaaggccggcaggccgggctccgcgccagtcgcataggcactgtagaaacgactgaattcttcgatcagcacgttcatcgaccagccgtcggacacgatgtgatgcagggtcaacagcagcacatgccgctcctcgcccaggcggatcaggcggacccgcagcaacggcccctcgcacaggtcgaacggctgcaacgactcgcgctgcgcctcctcgcgcaggcgggcttcctgctcggcctcaggcaggccgctgcaatcctcgaaggcaacctccagcgggcgttgcaggggcgcctgcgccaggctgtcgtcggcgccgcgcgggaacaccgtacgcagggtttcatgacgctgcaccaggctggcgaaggcgcgctccagcgcctggcgatccagcggtccgttcaggcgcaccgcgctgggcaggttgtaggcgccactctgtggctccaggtgccagaggaaccacatgcgctgctgggcgtaggacaggcggtcgcgctcggccgaagacacgccggccggaaacgggaacagcgagaaatcgattccctcccctcgcagggtttcgaggaagacccgacgcttctcaacgggtag

SEQ ID NO: 8893 - DNA, 306 bp, Pseudomonas aeruginosa
acctttatacggggcaagatcgaaaccacccgcctgctcagcgaccgtacccccctgcagttcgtcaccgaatccatgcgccccctgcacaccggcgatttcggcggtatctgggtcaagctgatctggttcgtcttcggcctgctgctgagcatgatggtgctcagcggcctgctgatctggagcaagcgcaccgcacaggccaccgccgcgctggtcaagcgcggcaagcgcccggcgcgccagccgaaaccggccaagccggcgccggtaatggccaaccagaccgcggagggacagccatga

SEQ ID NO: 8894 - DNA, 903 bp, Pseudomonas aeruginosa
acaaacgaggtaagcaatgagcatccacacccgcccctggcgcctgcccctggccgccctgttgctcggcctgagcggcgcggccctggcgcacaacccgatctgcgaatgcgaggaagtgcaggccggcgagatccgctgcaagggcggcttctccgacggcagcggcgcccccggcgtaaccctcgacgtgatcggctacgacgagcagatcctggttcccggcaagctcggcgccgactcgaccctgaccttcaagcgtcccgacggcgagttctacgtgctgttcgacgccggccccggccacgtggtggaaatcgaccacgccgacatcgccgcgccatgagcgtcgaaaccgtccgcccggccggcgccggccacgagaccctctacgtactgctcggcagtgtgctgatcctggccctcgccgccacggtggtcgggctgcgccagcagtcccatgaagcgcaagccctggacgcccaccaggtggacgcccggctcgacctgaatgccgccgaacagggcatctacgccgacctgcaggtcgccgccgaagacatccaggcgcgcctggacgacggcgaagccgcgccctccgtcgacgaactggccgccgagggcttcccgcccttcgtcgccgacatcgccgcgagcagtcgcggcgagcaccgctggagccacggcgaaaccgccgggcgtccgagctacctgggcgtcagcggcaaacccgaggtggccggctcgttcctcctgctgctcggccccgccgaagtctggctgaagcccgccgcggccgctgccggcgccgtaccgggcgacgcccgagccctggccgacgccggctggcgccaggtggtcagccgcttcgacgccggcgtgacccgtcagcaccgccattga

SEQ ID NO: 8895 - DNA, 1533 bp, Pseudomonas aeruginosa
cgtgcacgcgctggtcggaccgaacggcggcggcaagagttcgctggtcaagaccctgctcgggcagatgccgcatcgcggcgagctgcgcctggagtggcccggcgcgcccggctgcatcggctacgtgccgcaggcgctggagttcgaccgcggcctgccgctcaccgtcgacgatttcatggccgccatgtgccagcgccgtccggctttcctcggcctgtcgcgcagccggcgcccggcgatcgacgcggccctggaacgggtcggcatgctggccaagcgcggtcggcgcatgggcgccctctccggcggcgagcgccagcgcgtgctgctggcccagggcctggtaccgccgccgcaactgctggtgctggacgaaccgatgtcggccctcgacgagggcggcatccaggtcttcgagcggctgctgctggactggcgccaggccggcgtcaccgtgctctggatcgagcacgacctggaggccgtcggccgcctcgccgaccgggtcagcggtctcaaccgccacctgctgttcgacggtccggcggccagcagcctgaccccggaacgcctgctcacgctgttctccacccagccccggaagaacgcggaggccagccgatgaacgacgcctacgaacaactgcgccaggccgtccaggcctgggccgccgccggctaccttccggagaccctggcctacggcttcgtcgtcaacgcgctcctcgccggcctgctgatcggcccggtgctcggcggcctcggcaccctggtggtggtcaagcgcttcgccttcttctccgaggcggtcggccacgccgcgctcaccggcgtggccatcggcatcctcctcggcgagccctacaccgggccctacggcagcctgttcggctactgcctgctgttcggcgtcctgctcaactacctgcgcaaccgcaccggcctggccccggacaccctgatcggggtgttcctctcggtgtccctggcgctcggcgccagcctgttgctggtgctggcgggcaagatcaacgtgcatatcctcgagaacgtgctgttcggctcggtgctgaccgtgaacggccatgacctcgcggtgctggcggcggtcgccgtgctggtgccgtgcctggccctgccgctgtacaaccgcatcatgctggccagcttcaacccgcaactggcggcggtgcgcggggtcgcggtgaagagcctggactacctgttcgtggccctggtgaccctggtcaccgtcgccgcggtgaaagtgatcggcgcgatcctggtcggagccctgctggtgatcccggcggcggcggcgcgcctggtcagccagtcgctgaaagggttcttctggctggcggtgctgatcgccaccgtcagcacgctggccggtatcctgttgccgatcatgttcgacctgccgattccctccggcgccgcgatcatcctggtcgccggcctggccttcggtctcgccgccatcgctcgcggctgcctgccgcacctgaaaggaacccccggatga

SEQ ID NO: 8896 - DNA, 543 bp, Pseudomonas aeruginosa
tcagcggcggcaggaagcgcaccacgctgccgtggcggccgcccagttcgaggatcaggccgcgcctcaggcactcgcgctggacccgcgaggccagggcgccgtcggtcggcggatgaccgagggcatccgcctcgccctgcgggtcgacgatctcgaccccgagcatcagcccccgaccgcggatatcgcccagttgcggatagtcgcgctggaggatgcgcaggtgctcggccaggcgctcgcccatggccgccgcgtgggccgccaggtcgtgttccttcaggtagcgcatcaccgccgaaccggcggccatggccatctggttgccacggaaggtgccggcgtgggcgccgggctgccatttgtccagccattcgcggtagaccaccaccgccagcggcaggctgccgccgatggccttggacagcaccaccacgtcggggacgatgccggcgtgctcgaaggcgaacatcctgccggtacgggcgaagccgctctggatctcgtcgacgatcagcgccaccccggcctgctcggtga

SEQ ID NO: 8897 - DNA, 366 bp, Pseudomonas aeruginosa
gcaccgcgcccagcggcttcttcggtccgagattgcccatcagccccagcgcgccctggctcatgccgtggtagccgccctggaacgacaggatggtgctgcgcccggtggcggtgcgtaccagtttcagcgcggcttccaccgcgtcggtgccggtcgggccgcagaactggatcttcgcctcggcggccagcgccggcggcagcaggccgaacaggtcctggacgaactggtccttcaccggggtggtcaggtcgagggtgtgcagcggcagctcgtcggccagaacctggcggatcgcctcgatcaccaccggatggttgtgccccagcgccagggtgccggcgccggccaggcaatcgatga

SEQ ID NO: 8898 - DNA, 609 bp, Pseudomonas aeruginosa
tcgaaccgctttaccccgcgccatgctcgcggcctgggtcctgctcctgctggcggcctgcagccagggcccggcgcctaccccgcccgcgtcctggggttggcaggacgccagcggcgaacgcgcgatcgcccccgacgaagcctatcccgagctgttccaggcggtgcaggaaagccggctgttcagcgaccagaagcacttcgtcgatgcgctcccgctgcgcgagcctgcacggatccgcgccgactacctgcgcgagagggagcggcccggcttcgacctgcgcgccttcgtcggccgcaacttcgaggagtccggcagcgtcgagaccgccccgccggaagcgggtgccgatctcgccagccacatcagcgacctgtggccggcgttgacccgccactacgagcaggtgccggcccacagcagcctgctgccgctgccgaaaccctacgtggtccccggcggacgcttccgcgaggtgtactactgggactcctacttcaccatgctcggccttgcggagagcgggcagcaccaacgggtgcgcgacatgctcgacaacttcgcctacctgatcgatacctacgggcacattcccaacggtaa

SEQ ID NO: 8899 - DNA, 981 bp, Pseudomonas aeruginosa
cacaccgcgccaggagtccttcctggaggatcgggcgaccgccgcgcgcgccccgcagcgccccgcgggcgaggtctatcgcgacctgcgggccggcgcggaaagcggctgggacttctcctcccgctggctggacgacggccgcgaactggccagcatccgcaccaccgccatcgtcccggtggacctcaacgccctgctctaccatctcgaacgaaccatcgccaaggcctgcgccagcagcgcgctgaaggcctgcgagcaaggctacggagcccgcgcggagaagcgacgacaggccatcgaaggccacctctggcacccggcgggctactacgccgactacgactggcaacgccggcggcccatcgagcggatcaacgccgccagcctcttcccgctattcaccgggctggcctccgccgaacgcgccggtcgtaccgccgacagcgtcgccgcccaactgctgcgcccgggcggactggccaccaccacccgtgccagcggccagcaatgggacgagccgaacggctgggcacccttgcagtgggtcgccgtacagggcctgcgcgcctacggccgggacgccctggcggaagacatcggccggcgattcctcgcccaggtgcagcaggtctacgaccgcgaaggaaaactggtggagaaatacgacatcagcggcaaccagggcggcggcggcggtggcgagtacccgttgcaggacggcttcggctggtccaacggcgtgaccctgcaactgctccgactctacagcccgggcgccggtcgctgagcctcagcccggctccgggtactggcgctgcgcggcgtcggcgaagcctgcggcgagaaagtcgatcagcgcgcggaccgaaggcaacagcccgcgccgcgaggggaacattgccaccaccatgccttccaccggcgtccactccggcagcacccgcaccagccggcgctcggccaggtcgcgactga

SEQ ID NO: 8900 - DNA, 846 bp, Pseudomonas aeruginosa
  unsure (289): Identity of nucleotide at the above locations are unknown.
gcagccgcgaggaaatcgaccaggccatcgaggacttcgagaacgggcgcttcatccgcgcccactgaagtccgcccccctacgacatggcccgcgcaggaagcgcgggcccggccgggctttgcccgaaattcacggacgaccaccctgcaagaggaaatggaaatgagcgctcccgccaacttcaacggccagaccccgaagatcgatccggccaacgccgccatgttgctgatcgaccaccagagcggcctgttccagacggtcaaggacatgccgatgaccgaantgcgcgccaacgccaccaccctggccaaggtcgccaccctggcgaagatcccggtgatcaccaccgcctcggtaccgcagggccccaacggcccgctgatcccggagatccacgaggccgcgccgcacgcccagtacgtcgcgcgcaagggtgagatcaatgcctgggacaacccggaattcgtcgccgcggtgaaggccaccggcaagaagcaactgatcatcgccggcaccatcaccagcgtgtgcatggccttccccagcatcgccgcggtacacgacggctaccaggtgttcgcggtgatcgacgcctccggcacctactccaagatggcccaggaaatcaccctggcacgggtggtccaggccggcgtggtgccgatggacaccgccgcggtctgctcggaaatccagcgtacctggaaccgcgacgacgccgtgcagttcgccgaagcctacagcgcggtattcccgcactaccaactgctgatcgagagctacgccaaggcccaggccgtggtcaacaaccacgagcaactggattcgcagcgcaagtga

SEQ ID NO: 8901 - DNA, 1500 bp, Pseudomonas aeruginosa
tccatgggaaggaaggggctgcacgccccttcttttgccgagcaggagcctggtggacagcaacgactacggaccggacccatgcctgattcctccatgaagcgcggggctacgctctgccttgcccttgccataggtccgggctcgctcctggccgacgactccctgggccatcgcgacaacatcagcaccggcctgaaccagcggcagaaagccgaaatgaaggtgccgccgggcttcgtcgaaggctcgacgctgaacggtttcatccgcaactactatttcgcccgcgacaaccacgacaccccgtcccgccgcgaccagcgcgaatgggcccagggcctgatgctgtcgttccgctccggctataccgacacgccgataggcatcggcctggatgcgcacgccttctacggcctgcgcctggacggcggtggcggcagcggcggtgccggcgtgctgccgctggactccgccggtcgccccgccgacagcttctcggcggccggcgcggccctcaagctgcgcggcctggacagcctgctgaagatcggcgaccagttgctggagaacccggtgatcgccagcggcgtcagtcgcatggtgccgcagagctaccgtggcgtgaccctgaagaactaccatttccgcgcgctcgaactggacgccggcttcgtcgaagccacccgcctgcgcaaccagagcggccacagtcatctcaccagcggctacggcaacggcaccaagggcggtatcgccgccgatcgcgaaagcccgcacatcgcctggctgggcgccagctacagcgcccccggcggcagccaggcgacgctctacagcggccgcctggcggatatctggaaccagcactacctcggcctcagccagccgtggcggctttccagccaattgaccctgacgccctggctgcattactacaagacccgcgaccagggccgcagccagctcggccggatcgacaacgacctctacaacgccgggctgaccctggccggcggcggccagtcgctgagcctcagcctgcaaaaggtcgatggcgacaccccgttcgacttcatcgcgcagaacgaccggaccttcctctacgaaagcaacgccatgcagtacgccgacttcaacggccccggcgagcgctcgtggaagatccagtaccaggccagcctggccttcctcgccgccccggactggcagttcggcgccgcctacggccgtggccaggccgacctgacccgggtcgacccggacagcgcgggctacggctacctctacaaccccaatggcaagaacgcccagcactgggaacgcgacctgtcgctgcgctacgccttccccgccggcccggccaagggcctcagcgtgaccctgcgctgggccacccaccgccccggcgaaggctacaccgcccccggcaacacccgcggcaactccagctccgacgaataccgggtggtggtcgactacccgatcaggttgctctga

SEQ ID NO: 8902 - DNA, 954 bp, Pseudomonas aeruginosa
acccacggaaccagaaaaaagagaaactccctcatgcgtgcagccctgctacccaccttcggcgccctctccgccgcactctgcctggaggcccgcgccgacgccgtcgcgctgccgccgctggcgctcggcaacgccagcttcatggacggcgtcagccgtcccggcatgctcttcgaactgcccctgcaatacgttcgggcaaacaacgccagcgacgccggcgggcattcggttcccggtcggcaacgggttcgtggcaccatgctgttgccgcacttcgcctacctcagccagaacaccctgctcggcgcccactacggcgccgaagtgctgctgccgctggtacgcctggacctcgatatcgacggcggcccggacggccggcgcacccgccagggcgacctgatcgtcagtccgctgatgctgcaatgggggcccgctacgctgttcggccgcccctactggcagcgcctgaacttcgtcttctccctgcccaccggcgactacgacaaggacgccgcgatcaacaccggcagcaacacctggatcttcaacccgcactacgccttcacctgggaactgggcgagcgcctggaactcagcggccgcctgcactacgcctggatcagccgcaacgacgacccctcgccgcgcctgggcgcaaacgacgtacagccgggacaggcgctgcacgcgaacttctcgatctcctacgcgctggacccgcactggcggatcggcctggccggctaccagttgaaacagatcagcgccgaccgcatcgacgaccaccggcaggccgactcgcgcgagcaggtcttcggcataggcccgggggtgatgtacagccagggcaggcaaacgctgttcgccaacctctacgccgaaagcggcgcgcgcaaccgcagcgaaggcaaccaactgaccctgcgctacctgctggcgttctga

SEQ ID NO: 8903 - DNA, 981 bp, Pseudomonas aeruginosa
aagagtatggagcaggcgccctcccccgggagcggcgcctgcgccacaatggtgtcccctcttcgcacgtccggcgcgaaaaggcccgacacaaggattacggatgctcccagtcaagaacctcttcgtgctctacaccggcggcaccatcggcatgctgcagacccctcagggactggctccggccggtggcttctaagcgcgcatgcgcgaccacctgcaaagcctcggcgacgccccggacctgcgctggcgcttcgccgaactgcaaccgccgctggacagcgccaacatgacccagggcaactggctggcgatgcgcgacgccatcgtcgccgcgctcgacgccggccacgacggcgtgctgctcctgcacggcaccgacaccctggcctacagcgccgcggcgctgtccttcctgctcctcgacctgccgatcccggtgctgctgaccggctccatgctgccggccggcgcgccgggcagcgatgcctgggacaacctggtcggcgccctgcgcgtcctccaggagggccacgcgcgcggcgtacaggtctatttcaacgatgccctgctgcacggcgcgcgggtcagcaagctgcgcagcgacgcgttcgacgccttcgccgaactgccgcgaccgcgccacgccgagcatgcgccggcgcccgcggcgctcggctaccgccagccgcgccgggaagtgaacctcgccgtgctgccgctctatccagggctgcgcgccgcgcacctgcgcgggctgctcgacagcggcgtggaagcgctgctgctggaatgctatggcagcggcaccggccccgtccgacgacgaggagctgctggcgctgctgcgcgaagcccacgcccgcggcgtgctgctcgccgcggtcagccagtgcgcctacggccaggtcgagttcggcgtttacgccgccggcagccgcctgcgcgacgccggcctgctctcggctggcggaatga

SEQ ID NO: 8904 - DNA, 1311 bp, Pseudomonas aeruginosa
cccgcgaggcggccctgggcaagcttttcggcctgctcggcgccggcctcggacgcgacgaagcgcaacgctggttcgccctcgacctgtgcggcgagaacgccgactgaccgccctgcggccgcccgccggcggccgcttccttcagccctccccgcgatacgcgacaacgccggcggcccgcccgtgcccggcgcccatcgtcaagcttcagcgaacagtgtttccggccttccccggtttatcccccggcggcgagtccacaggatgtcgccttccgctgccggccccgccggcatccgcccacaaggaggaaacacctgcatgtacgccatcgccgaagacacccttcccgcacgcgtattgaaagaactgttgctctatcgccgccgttaccccgagcatcgccagagcgccagcgaagcggacgagatccgccgcatcgaacaggtccagttgccgcgcatcgccgccttcatcgaagccggcgagcccatcgaattcgtcctgccggcgtttccggccaagtcgccgaaccccggcaaggtcctcgacagccgtccggacatggccgagcgcctgtcgctgtcgttcctcaaccacctgtgccagcgcatccagctgttctatgcaccgggcgcgaagatcaccgtctgctccgatggccgggtgttcggcgacctggtgaggatcggcgatgcgcacatcagcgcctaccaggatgccttgcgcctgatgatcgaggagatcggcgccacccatatcggcgtgttcaacctggaggacgtacgcgccttcgaggcccagcgcgacaaccacgagcagctccgccagttgctgatcgacggctacgccgagccgctggaaagcatccgcgagaccctgctggccagcgaagaaggcctgctgctgtaccgcgccatcacccgtttcctctacgaggacggcctgacccccgactaccagggctcgaagactgccctgcaacgcgacgccaaggagcgcgcctacggggtgatccagcgcagctgggcctggggcgcgctgctggccgaccagttcccccgcgcgatccgcctgtccatccatccgcagccggcggacagtctgaagttcggcatccacatgatgccgacccgcgacgactggctgacgccctggcacggcgtggcggtgaacaccgaggaccgcttcgtgctgatgaagcgcagcgaggtgctggaactcggcggcgagctggtgcagatcaacggccagcccagtcactaccgcctgccggccagggccgcccggcgcgccgccgtggcctga

SEQ ID NO: 8905 - DNA, 846 bp, Pseudomonas aeruginosa
tctgggacgccaccggcagcgagttcggcgcgcgccacgcggtctatgagagccattattccggcaatgccgagcagatccgcctcgactcgctggcctgggccagccgtcgcgggcacctggcctactgcgaggcgatggtccagcgctgcatggccgactacgacatccacggctggctgcgggggccctggcagcatgactgagcgtaaacgctggctggccggctgcctctcggccctgctttccctgccgctggccgccgccgtgccgggcccggacgcgcccgccgacctggcgcgcggcaaggcgatggcgcagaagatgtgctcgcgctgccacgacgacgacggcaacggcgggccacgaccgaaccgcagctacccgaagctcgccgggctcgaccgggaatacctgtacaagcagatctacgacctcaagacccagcgccggcgcaacccggccaccaacggtcgcggcgaggagctgagcgcggcggacgtggtcaacgtctccgcctggttcgccgcccagcgcatgagcgccggcgagcagaccctggccgacccgaggcaacgcgaacgcggccgccagctcttcgagggcggcctggcgcagcgcggcgtaccgccctgcgtcacctgccacgggcccgccgcccagggcctggcggcgctgaaggcaccgcgcctggccgggcaatgggcggaatacctggcaacccagttgcacggcttccgcgacggcaagcgcggcaacagcgcgaccatgcgcgcggtcgccggcggcctggaggatagcgacatccaggcgctcgccggctacctgggcagcctggggccgtaa

SEQ ID NO: 8906 - DNA, 969 bp, Pseudomonas aeruginosa
aatgaaaccggtttcagaggatcgccaatgtcccttcaccccgtctccatcagtctttccagctatggcgcggacctcgttcgcagtcgcggccaggccagcttcctgcccttgctggcgatggccggcgcgcagcgcgtggaactgcgcgaggaactcttcgccggcccgccggataccgaggcgctgaccgccgccatccagttgcaggggctggagtgcgtgttctcctcacccctcgagctgtggcgcgaagacggccagttgaaccccgagctggagccgaccctgcgccgcgccgaagcttgcggagccggatggctcaaggtctcgctcggccttctgccggaacagcccgatctcgccgccctcggccggcgcctggcgcgccacggcttgcaactgctggtggagaacgaccagacgccccagggcggccggatcgaggtgctggaacgcttcttccgcctcgccgaacgccagcagctggacctggcgatgaccttcgacatcggcaactggcgctggcaggagcaggcggccgacgaagccgccctgcgccttggccgctatgtcggctacgtgcactgcaaggcggtgatccgcaaccgcgacggcaagctggtcgcggtgccgccgtcggccgccgacctgcagtactggcagcgcctgctgcagcatttcccggaaggcgtggcgcgggccatcgaatacccgctgcagggcgacgacctgctcagtctcagccgccggcacatcgccgccctcgcccgccgtcggccagccccaggaggaacgccagcatggctgacttcgagatcctctgcttcggcgagaccatggccatgttcgtcgccgaacagcccggcgaactggaccgggtcgagcagttcggcaagcgcatcgccggcgccgacagcaacgtcgccatcggcctcgcccgcctcggcttcacggtggcctggctga

SEQ ID NO: 8907 - DNA, 1044 bp, Pseudomonas aeruginosa
tcgccgagatcaacgccctcgccgcgcatgcccactgggtcctgccgggcctggaggaaggccgcctgctcagcggctggcaggaacccgcggatatcgccgcgttctacctggacatgggcgtcgacgcggtggcgatcaagctcggcccgagcggcgcctactatcgcgatgcccacggcgaagggctggtccccggcgtgccggtggcgaccgtggtggacaccgtgggcgccggcgacggcttcgcggtcggggtggtcagcgcgctgctggaaggcctgccgctgcccgacgcggtggcgcgcggcaactggatcggcagccgcgcggtacaggtccgcggcgacatggaggggctgccgaaacgcagccaactgctcgaccgcgagcgccgcaagagcgcctgaacccgccgcccacgcggcacctgttgcgacaagaacaagacaagctcaggagatacccgaccatgaccatgcctcgcctcgccagcagccgctggtggtacatcatgccgatcgttttcgtcacctacagcctggcctacctggaccgcgccaactacggcttcgccgccgcctccgggatggccgacgacctgcggatcacccccgggctgtcctcgctgctgggcgcgctgttcttcctcggttacttcttcttccaggtgccgggggcgatctacgcggaaaagcgcagcgtcaagaagctgatcttcgtcagcctgatcctctggggcgggctggccaccctgaccgggatggtcgccaacgtctacctgctgatcggcatccgcttcctcctcggcgtggtcgaggcggcggtgatgccggcgatgctggtctacctctgccactggttcacccgcgccgagcgctcgcgggcgaataccttcctgatcctcggcaacccggtgaccatcctctggatgtcggtggtctccggctacctggtggagcatttcagctggcgctggatgttcatcatcgaaggcctgccggcggtgatctgggccttcatctggtggcgcctggtggatga

SEQ ID NO: 8908 - DNA, 603 bp, Pseudomonas aeruginosa
cccgaagccccacgtcgaagaacgctacgcagcgagctaccgccccctcgacgcgctgctcgaggaatccgacttcgtctgcctgaccctgccgctgaccgccgccaccgaaggcctgatcggtgccgcgcagttcgcccggatgcgcccgcaggcgatcttcatcaacatctcccgtggccgggtggtcgacgaggcggccctgatcgaggccctggcccagcggcggatccgcgccgccggcctcgacgtgttcgagcgcgagccgctgtctcccgactcgccgctgctgcgcctgccgaacgtggtggccaccccgcacatcggctcggccaccgaggaaacccgcgaagccatggcccgctgcgcggtggacaacctgctggccgccctcgccggcgagcggccgctgaacctggtcaatccttcggcctgggcgcgacggcgaggcgcctgaaggccgcgccgggccgacgcccggcgcgccgttctgcttcacttgccggtattggcccgcctgaatccttgctgaaacgttttttcaacgtgacacatgaacttataattagcctgctaatcattatcagaaagacgaaaccgtga

SEQ ID NO: 8909 - DNA, 735 bp, Pseudomonas aeruginosa
tccagagaggaccccaccatgcccgatgacaaggccgtcaacggccgccgcgacttcctgcgcaagaccctgaccgtgatcccggcggtgaccctggccggctatggcgtcggccatgccatgcagacgcccgccgccgagcaggacaaaccccgcgaacgctaccagcctcgcttcttcaccaacaccgaatgggctttcgtcaacgccgcggtggcgcgactgatccccagcgacgacaacggccccggcgccatcgaggccggggtgccggagttcatcgaccgacagatggaaaccccctacgggcacggcgcactctggtacatgcaggggccgttcgtcaccgacgccgcgccggagttcggccatcagttgaagctggtgccacgcgacatctaccgggtcggcatcgccgccctggaacgctggagcaaggccaaccagggcaagccgttcgccgatctggagccgtcggcgcaggacgacatcctgcaacgcctggaagccggccagatcgacctgcaggacctgccggccaagctgctcttcggccagttgctgcagaacacccgcgaaggcttcttctccgatccgcagcacggcggcaatcgcggcctggtgggctggaagctggtcggtttccccggcgcccgcgccgacttcatggactgggccgaccgtggcgagaagtatcccttcccgccggtggcgatttccggcgagaggggctga

SEQ ID NO: 8910 - DNA, 2256 bp, Pseudomonas aeruginosa
  unsure (1015): Identity of nucleotide at the above locations are unknown.
cgatggcaggcaggccaccggcgtgacctacgtcgacgcccaggggcgcgagatcgtgcagccggcgaagctggtgatcatcagtgccttccagttccacaacgtgcgcctgctgctgctctccggcatcggcaagccctacgacccgcgcaccggcgagggcgtggtggggaagaacttcgcctaccagaacatggccaccatcaaggcgtttttcgacaaggacgtgcataccaacccctttgtcggcaccggcggcggcggcgtggcggtggacgacttcaacgccgacaacttcgaccacggaccgctgggcttcgtcggcggctcgccgatgtgggtcaaccaggccggctccaagccgatcggcggcctcgccgtgccgcccggcacgccgagctggggcagcggctggaaacaggcggtcaaggacgcctacacgcacaccgtgtcgatggacgcccacggcagcaacatgacctaccgcgacaaatagtccgacatcgacccgacctacaaggacgcttacggccagccactgttgcgcatgaccttcgactggaaggacaacgagatccgcatgagccgctacgtcaccgagcacatgcgcaagatcgccgaagcgatgaacccgaaggccatctcggtgagcgtcaagaacttcggcgaccacttcaatacacgggtctaccagaccacccacctgctcggcggggcgatcatgggcagcgatccgaagaccagcgtgctcaaccgctacctgcagagctgggacgtgcacaacgtcttcgtcatgggcgcctcggccttcccccagggcaccggctacaaccccactgggctggtggcggcgctggcctactggtcggccaaggcgatccgcgagcaatacctgaagaaccccggtccgctggtgcaggcatgaggagcgcaacgatgaaaccgacagctttcctcgccttctccgccttcgcgtgcggcatcgcccaggccgccgcagcgccggacccggccntggtcaggcagggtgaatacctggcccgcgccggcgattgcgtggcctgccacaccgccagggacggcaagccgttcgccgggggcctgccgatggaaacgccgatcggcgcggtgtactcgaccaacatcaccccggaccgcaagaccggcatcggcgactacagcttcgaggacttcgaccgtgccgtgcgccacggcgtggccaggtccggcgacacgctttacccggcgatgccctacccgtcctacgcgcgagtcagcgaagcggacatgcgcgccctctacgcctacttcatgcatggcgtggagccggtggagcagcccaacaaggccagcgacatcccttggccgctgtcgatgcgctggccgctggcattctggcgctggaccttcgctcccgaggtgaaggacttccaggccgccgccgggctggacccggtgctggcgcgcggcgcctacctggtcgaaggccttggccactgtggcgcctgccataccccgcgtgggctgggcatgcaggagaaggccctggcggcgagcgatggcgcggcctacctgtccggcagcgcgccgctggagaactggatcgccaacagcctgcgcggcgaccaccggaccggactgggcagctggagcgaagccgacctggtcagcttcctgcgtaccggccgcagcgagcgcagcgcggtgttcggcggcatgtccgacgtggtggtgcacagcatgcagtacatgaccgacgccgacctcaccgccatcgcccgctacctcaagtcgctgccgccggcggaccccgccgaccagccgcacgtctacgacgagagcgtagcccaggcactgttccacggcgacgacagcaagaccggcgcggcgctctacgtcgacaactgcggggcctgccaccgcaccgacggcaagggctatgcgcgggtcttcccggccctggccggcaacccggtagtgaccggcagcgacccgacctccctggtgcacatcgtgctcaagggcggcaccctgccggccacccaccaggcaccgtcgagcttcaccatgccgccgttcggctggcggatgaacgaccaggagatcgccgacgtggtcaacttcatccgcaccagctggggcaaccaggcgccaagcgtcagcgtcgacgaggtcaggcgcctgcgcaaggacaccggcgcggcggcggtgggcgacattccgccgccgggaccggccgcggcggatcgcggctga

SEQ ID NO: 8911 - DNA, 1071 bp, Pseudomonas aeruginosa
caggtaggcagggatcgccgccaggccgaggccggcgcgggccatctcggcgaccgccagcacgccgttgcagcggtaggccggcagcaccccaggatagtgtcgacgacgccagaccacgctcgggtggtcgggaagaaaatcgtccggggcgatccagtgcagcatggcgggctccgtcgcgtcgcggccctccaggtagcgttcgctggcgcagagcacgtagcgcacctcgccgaggttgcgcccgaccaagtgttccggcggcgtgcgggtcatgcgcagggcgatgtcggcgtcgcgccggctgaggttggcaaagtcgttggaggtcgccagctccagttgcagggccggatagccaggcatgaagcgcgccagcgccggcagcagcaggccatgcaggacggcgtcggagcaggtcatgcgcacggtaccgctgagcacctcgcgctccagttcgaggccgatgcgcgccgcctccagcgcctgctccgccagttccgcctgctgcgccagacggcgggcggtctggttcgccaggtagccgctgcggctcttgtcgaacaatgccttgccgaggttcttctccagccggcggatggcccggaagaccgtcgacacatcgaccctgagcaactctgcggcccgcgccaggctgccgccgcgaaccagggcgaggaccagggcaagatcggcatggtccaggcgatattgcagcggtgcattcatcttttgcattggcgccgatatcgagtgcggaaacgcaactatagagtgagcgccagggcccgccaaccggcgtggcgaaactggagcgaaaacggatgtccacccctcccgcggcgccgctgcgcattgccctggtcggcgaccacgacccgcacatcaccgcccaccgggcgattcccctggccctgcgcctggccggcgaggcactcggcctggagatcgcattcgactggctggccagcgaccgcctgcccgccgagccggcgctggagcgctatgacgggttctggtgcgtgccgggcagcccctatcgcgacgccgacgcggtgctgcgcctga

SEQ ID NO: 8912 - DNA, 465 bp, Pseudomonas aeruginosa
tcttcagctcccatcgcagcgccgtcgacgacggctacgccgaagcggccgagcgcatgctggaactggccagccgccagccgggctatctcggcgtggagtcggtccgcggcgccgacggtttcggcatcaccgtctcctactgggacaacgaggcggcgatccgtgcctggagccgccacgcggagcaccgcgacgcccaggcgcgcggccggcgcgactggtacgccggtttcagcgcgcggatcgcccgggtcgaacgcgaatacgccttcccggctcagccggacaccgcgcagtctccggcctcgtcctgagccagcacccggaagcaggccagggccagcagccaggccagccagccggcgccgaccgcgacgaggaaaccgctggcggcgccgtagccctccaccacccaaccggccagcgccgagcccaaggccatgccgatgcccagcccggtga

SEQ ID NO: 8913 - DNA, 354 bp, Pseudomonas aeruginosa
tgtagcacacctcgtccatcaccgattcgaaggaaaacgccgtgtgcagcttcggcgagccccggtacagctcggtccagcgcgcccgtaccatggccggcatgctcggcatcgccccggcgagcaaggcgaacaggtagagccaggcattcggcgctcgatagtgcgtacacagcaacagcgcgctcatcgccagggcgctggccagcgcggccgggagcagcacccggccctggccgaagcggtccaccaggcgcgatacctgcggcgcgagcaaggcattgcagaacacgaaggtggccgccacggtaccggccagccagtagtcggcatgcacctgggaaagcatggtga

SEQ ID NO: 8914 - DNA, 618 bp, Pseudomonas aeruginosa
agccccttcgccacccggagacctcgcatggcccgcaagcctcgcgccgagatgatcgaggaaacccgcgccaagctgatcgacgccgcgcgccgagcgttcgccgacaacggctacgccggcgcctcgatggacgaactgaccgccagcgccggcctcacccgcggcgcgctgtatcaccacttcggcgacaagaaaggcctgctggccgcggtggtgcagcagatcgacgacgagatgaatcttcgcctcggcgccatcctggctgccggcgaggacctctggagcggcttccgtgcctacaaccgggcctacctggaaatggccctggaagcggaaatccagcgcatcgtcctgcgcgatgccccggccatcctcggcagccccagcagcgaggccagccaactgcgctgcctaagctcgatgaccgggcaactgcgcgaactgatggacagcgggcgcgtccgccgcaccgacgccgaggccctggcctggctgctcaacggcgcgctggtggacgccgccctgcgtatcgccaacgccgaacacccgccggagagcctggccagggcctgccaggccctggacgtgctgctcgacggcctgctcatggagtga

SEQ ID NO: 8915 - DNA, 525 bp, Pseudomonas aeruginosa
aaagccaatggactaccgcatcagaaccagccgcgacgaggacgccgcgctgctcccggccatcgagcgctcagccggggaaagcttccgcctgctgcccgagctggcctggatcgccgacgccggggtcgccggggtggacttccatcgccgcctgatcgagcgcggcagccactggctggcggaagacgccgatggccagccggtcggtttcctcgccgccgaacgctgcgccgacgagttgcacatcgccgagttgtccatcgcccaggcccaccagcaacagggcctgggccgccgcctgctggagcgcgcggtgacctacgcccacgccagccactgccgggcgctgaccctgacgaccttctgcgacgtgccctggaacgcgccgttctacgcacgcctgggcttccagcggctgacctggcaggaagccggcgagcgcttgcgcgcgatcctcggccacgagcaggagatcggcttcggcccgccgacagccgctgcgcgatgcgcctggtgctctag

SEQ ID NO: 8916 - DNA, 1830 bp, Pseudomonas aeruginosa
acggcggcaaagggcttgaccggcgggtggcgggtgacggtacagttgccaactgcaacaggatgtttcagcactgccccggacgggcttccgctctccctcttccccagtgtgcccttgcatgagcagtcaacgccgaaactaccgcttcatccttgtcgtcaccctgttcgtcctcgcctccctggccgtctccggacggttggtctatctccaggtccacgaccacgaattcctcgccgaccagggcgaccttcgctcgatccgcgacctgccgatcccggtcacccgcggcatgatcaccgaccgcaacggcgagccgctggcggtatccaccgaagtcgcgtcgatctggtgcaaccccagggaaatggccgcccacctcgacgaggtgccgcgcctggccggcgccctgcaccgccccgcggcgccgctgctggcccagctccaggccaacccgaacaagcgcttcctctacctcgagcgcggcctgtcgccgatcgaggccagcgaggtgatggccctgggcataacgggggtacaccagatcaaggaatacaagcgtttctaccccagttccgagctgaccgcgcagttgatcggcctggtcaacatcgacggccgcggccaggaaggcaccgaactgggcttcaacgactggctgagcggcaaggacggggtacgcgaggtggcgatcaacccgcgcggctcgctggtcaacagcatcaaggtgctgaagacgcccaaggccagccaggacgtggccctgagcatcgacctgcgactacagttcatcgcctacaaggcgctggaaaaggccgtgctcaagttcggcgcgcactccggctcggcggtcctggtgaacccgaagagcgggcagatcctggcgatggccaacttcccctcctacaacccgaacaaccgcgccagcttcgccccggccttcatgcgcaaccgcaccctcaccgataccttcgagccgggctcggtgatcaagccgttcagcatgtcggcggcgctggcctccggcaagttcgacgagaacagtcaagtcagcgtggcaccgggctggatgaccatcgacgggcacaccatccacgacgtcgcccggcgcgacgtactgaccatgaccggagtgctgatcaactcctcgaacatcggcatgagcaaggtcgccctgcagatcggacccaagccgatcctcgaacagctcggccgggtcggtttcggcgcgccgctgtcgctgggcttccccggcgagaacccgggctacctgccgttccacgagaaatggtcgaacatcgccaccgccagcatgtcgttcggctacagcctggcggtgaacaccgccgagctggcccaggcctactcggtgttcgccaacgacggcaagctggtgccgctcagcctgctccgcgacaacccgcagaaccaggtgcgccaggcgatggacccgcagatcgcacggcgcatccgggcgatgctgcaaaccgtggtggaagacccgaagggcgtggtccgcgcccgcgtgccgggctaccacgtggcgggcaagagcggcaccgcgcgcaaggcctcgggccggggctacgcggacaagtcctaccgttcgctgttcgtcggcatggcgccggcgtccgacccgcaactggtgctggcggtgatgatcgattcgccgaccaggatcggctacttcggcggcctggtctcggcgcccaccttcagcgacatcatggccggatcgctacgcgccctggcgatcccgccggacaacctgcaggacagcccggccgtcgccgaccgccagcaccacggctgaccgctgcctag

SEQ ID NO: 8917 - DNA, 1392 bp, Pseudomonas aeruginosa
ccctgcgggccaacggcgactggctgcaagccgacgcagcgcgcctgcgcgacatggacggccgcccgcagcgcgcctccgcctgctgccaatagcgcgagccgccccatgctgatcgccttcgccatcttcctgttcaccctggtcctggtcatctggcagcccaggggcctcggcatcggctggagcgccagcatcggtgccctgctcgccctggcgctgggcagcgtcgcgccgggcgacatcccgaccgtctggaacatcgtctggaatgccaccgccaccttcatcgcggtgatcgtcatcagcctgctgctggacgaggccggcttcttcgaatgggccgcgctgcacgtcgcgcgctgggctggcggcgacggccggcgcctgttcgccttctgcgtgctgctcggcgcggcggtctcggcgctgttcgccaacgacggcgcggcgctgatcctcacgcccatcgtgatgtcgatgctgctggccctgcgcttcagcccggcggcgaccctggccttcgtcatggcggcgggcttcatcgccgacagcgccagcctgccgctggtggtctcgaacctggtgaacatcgtctcggccgactacttcgggctcggcttcggcgagtacgccgcggtcatgctgccggtaaacctggtgagcgtcgcgacctccctgctggtgctgttcctctatttccgccgcgacctgccgccggtttatgcgctggagcaattgaagccgccgcgggcggcgatccgcgaccgcgcgaccttcatcgtcggcggctggatgctgctggtcctgctcgccgggctgttcgccctggagccgctgggcgtccccgtcagcgcggtggccgcgacctgtgcggcgctgctgctggcggtggccgggcgcgggcgggtgatctcgacccggcgggtgctgcgcgaagcgccctggcagatcgtggtcttctcgctgggcatgtacctggtggtctacggcctgaagaacgccggtctcacagacctcctggcgcagctcctgaaccgcctggccgagcacggcgtatgggcggccgcgctgggtaccggactgctttccgccgccctctcgtcggtaatgaacaacatgcccagcgtgctgctcggcgccctgtcgatccaggccagcgacaccgccggcgcggtgcgcgaagcgatgatctacgccaacgtcatcggctgcgacctgggtccgaagatcacccctatcggcagcctggcgacgctgctctggctgcacgtgctggcgcgcaaaggcatgcgcatcacctggggctactacttcagggtcggcgccctgctgaccctgccggtcctgctggcgaccctttcggccctggccctgcgcctggccatctga

SEQ ID NO: 8918 - DNA, 729 bp, Pseudomonas aeruginosa
gctggagcgcatcggctcgctctgaccggaggaagcatgtccgaacaactacccaacctcgatcccgcgctgctcggcgacccgccccccgtctccgggcacaggccgcgcatcctcctgctctacggctcgacccgcgagcgctccttcagccgcctgctggtgctggaggccgcacgcctgctcgaacgcttcggtgccgaaacgcggattttcgacccatccgggctgccattgcccgacgatgcaccggtggagcatcccaaggtccgcgagttgcgggacctggtgcagtggtcggaaggccaggtctggtgctcgcccgagcgccacggtgcgctgtccgcggtattcaaggcgcagatcgactggattcccctggcactcggggcggtgcgcccgacccagggcaagaccctggcggtgatgcaggtctgcggcggctcgcagtcgttcaacgtggtcaaccagttgcgcgtgctgggtcgctggatgcgcatgttcaccatccccaaccagtcctcggttcccaaggcctacctggagttcgacgaagcgggccggatgaagccatcgccctactacgaccgggtggtcgacgtgatggaggagttgttcaagttcaccctgctcctgcgcgagcgcacggacttcctggtggaccgctattcggagcgcaaggaaagcgccgagcagctttccgcgcgggtcgaccagcgttcgctctga

SEQ ID NO: 8919 - DNA, 1410 bp, Pseudomonas aeruginosa
ttcccctggcgctctacgcctggtccgccgtgcaggccttccgggtcgactcgaccctgcgcgacgaacagttcatgcgcgactggagcgcctcggtgcgcaacgacccggacgccgccggtgccattccccgtcacctgttccgtccggcctatggcgtcgaaggtcatcttcaccagttcgccgaagacgccgaggccatccgccgcgaccatccttggctggctctgcgcggctggctggccgctatcggcaagctctgcgcgctggcgtcggcgctggtcgcggccgccttgctggcgagactggaatacgacgggcgccgctcgatgcgctcgcaagcctacctgctcggccacctcgcgccggcctggcggcgcctcggtcgactggtcccgctgcacgctggcctgctggtcgccgccctggccagccagttgctctacgaagcgctgtggagctacagccactggcacagccacggcttcgtcgccctggctcttctcgctgccgctgtggctgctgttcctcggcggcctgctcatgctgcggcgcctgcgcggcgaactgctgccgctggaggaaccggtgctccacctgctcggccgcgaactcgaccgggtcgccgcgcccggcctctggcaatggctgggacagatcgccgaccgcgccggagcgccgctaccggaccatgtcgtcaccggcatcgagcactgctacttcgtcacccaggccaaggtcctgctggcgccccgcggcattccgctggaggggcgtaccctgtacatcccgctgacctatgcctcggtcatgagcgaggccgaaagcgccgcgatcatcggccacgaactgggccacttcgccgccggcgacaccgcccacggtgcctccctgtcgctcctgcagcggcaggtgcgcctgcgcatcgaacgcatcgccgcacccgaggatgggcgtgtcggcctgctcggcaagccgggcctgtgggccgcgctgtacttcctcgatcgcttcgagcgcgcctacctgcactggaatcgccgccaggaactggccgccgacaaggtcggggcgcgggtagccggcgcgcgggtcttcgccatcgcgctgctacgcacctgcgcccttgcaggactgatcgaacgcctgctggccagcccgcagacgcgcaacctggtgcatgcgctgaccgaccatctgcgcgggaactccctggaactggacgaacacgacagcgctcgccgcctggaacaccccttcgacagtcacccgccgacctaccagcggatcgcggacctttccctggcgctcgacgacgatctgctgcgacaggcaaggcgcatcgtcagcgccgacgacacgcagtggctcaaccgcctgctcgatgcaggccacggggaaagccggtga

SEQ ID NO: 8920 - DNA, 1236 bp, Pseudomonas aeruginosa
  unsure (559),(686): Identity of nucleotide at the above locations are unknown.
tcctcgaactgcacggcaaggcgctaccggcaccatccacgcgcccgctcgatccgttcgccgcgcgtgccgtcagcgaatgccgggacggcccacgggttcgcctgctgtcccccggctggcgcctcaacggtcgcaacctgtcgctactggaagccgcggaggtcatcgacctctacctggacatcgcccgcgcccaggcccggttccgccaactgggcgagatcccgcccagtgcttcctcttcactcccaactccaaggatatttccatgagcaaccaggaaccccgggacctcgtctccaacctcgccgaaaccctcggtgccgaacacgaagagctgaaccaggcgaagaccgccgaggtcatcgcccacctggagcgggtgatcgccaacgtaccgccggccaccgagttcaccaatacccgcaagtacgtggtgctgggtccgctgctgagcatcgtgcccttcatcatgaccggcatgtggttctcccagggcaagccgggggtcggcgtcgtcggcttgctgctcggcctgttcgggctgttcctcggntaccagcatcgcaactccggcaagacccccttcatgcgcctgacccgtacccagctctgggccgacagcctgtcggctccggtcgagctggccgacgtcatcgatttcagcgtcaaggccgacatgntgcaaaccacccagaccctccacctgcggcccgaaacgccgctgccgacccatcgcgccgtacgccaggtgttcgcctcccaggccatggccttcaaaggcaaggacccgcgcatcaccatcatgtcggccggcctgcagagcgatggcaagaagctggactgcgacgacatggcggcgatcctcgacgcctacatccaggccgcccacgcccagcgctacctgcaacaactgcgcagccagggctgagtgaagggcacggtccatccgcgaaggctgctgctttgcctggtgctggttccagcgctgctggcggggctcggcgcctggcagtcctggcgcgccgagcagcaggccgagcgactgggcgccgcgcagcagcgggtcgagcgcgcgctcgccgaagcgcgggcgctgccgccgagggccagcgtccgggtggacggccgggcctatgtgcgcgacctggccctggcgcggctcgacgagcgactcgccgacacacgaagcgcacagcgcctgaatcgcttcgccgccgtcctcgccgatag

SEQ ID NO: 8921 - DNA, 1221 bp, Pseudomonas aeruginosa
  unsure (458): Identity of nucleotide at the above locations are unknown.
cggagcctgcctggcggcgctggtcgccgtattgggagccgtctccctggccggcatcgccggcgccgcacgcagcgcactgcgctcgcgtcgctgcctgctcctgtggttcgagctgggccgacgcctgctgccctgcctgctcctcgcccagatcggcctgctcgccctggccctggcctgtgccggaacgttcgagatcctcgggctgtggcgggtcggccaggttccggtcagcgaaggacgcacccaactgagcgtggcgctgatccttctcggcctgctggcgtcggcgtggcaaatgctggcgaagatcacccgcttgcgcctgcgcccggcgccggccctggatgtcatcggccgccggctgggcgaagaggatgcaccggaactctggacgctactgcgcgagctggcggcgcgcctcgacacgccagccccgcagcacctgttggtangtctcggccagggcttctacgtgaccgccaaccgcgtctgcctgcaaccttccggcgagcatctggaaggacgcagcctatacctctcgctaccgttgctgggcctgctggaccgcgccgaactgagtgcagtgatcgctcacgaactggcccacttcgccggccgcgacgcccattacagcctgcacttcctgccgatctaccagggcgccgcgagccaactggccgccatcgaggagcaggaagccaacgtcttcgaacgtgcggcactggaaccggcgcgactgttggccgggtacttcctcgaacgtttcggcctcgccgtgaaccactggagccgcctgcgcgaattcgccgccgaccgccgcgccgcacaactggccggtgcgccggcgatggcctcggccatgctgcgcagcgcggcggccggcgcgccgatacgggcgttcctcgaacactgcctgctcgctccggcgcgcgcgccggacaacctggtggacgccatccacgtctacctgggccagtccggcctggaagcaccggcccccggggcggagggactccaggtccatccgcaggatacccaccctccgctgggcctgcgctgcacggcgctgggagagagcttcgaacgcacctgggccgggaccgccggccgggccgttccgacacgaccgccgagccaggcgctgggcgtctggttcggcgcccccctggcgttgagccgagcgctcagcgccgacctgctcggcaagacctgtga

SEQ ID NO: 8922 - DNA, 453 bp, Pseudomonas aeruginosa
tctaccggtacatcctcgccggccatcgccagcgcgccctgcaacatcatcgcgcacccgggagcgacggcagcggggcctgaagcgagcaacgctcaggctgcgcgctggcgttgccagtccaccgcggctttcaggcgcgccaccaccttgcgcacgaagagcgggtcgtccgccacgcagagctccgcgctgacccactccggccagccggtcccctggcgctcgcgagcccccagcaggcgctcgacttcgtcgcgcacggcgcgctccaggcgttcgctggcacgattgcgggacaggtggaggcgcaggcaggcctgtttctcgcgctccagggcgcggcgtcgggacagcggcagttcggcaaggttgtggctcatgatcggtgctccttgtcgcgcaagcaggcgatttccgattactgtacattcatacagtaatcggaattga

SEQ ID NO: 8923 - DNA, 1482 bp, Pseudomonas aeruginosa
atcaggctgccctggctccgacggcggggtgtactggccctcgtagcgcagcgagcggaactggatgcggcagagcatctggtcgaacgggctgctgccccacatgtcgcgctcggtcagcggcgggcgcagcaggttgaggtcggaacgcgcctgggtcggcgcggtatggtcgccctccaccgcgccctgcggcgccggcacttcgcggatcggcacgatcggcgtgccgtcgcggcggtccagcacgtacaggctgccctgcttggtcggcgcgatcagcgccggcttgacgccatcggcggtcttcaggtcgagcagggtcggctggctgccgacgtccatgtcccacaggtcgtggtgggtgaactggtagttccagcgcagcttgccggtgttcaggtcgagggccaccaggccggcgctgaacttctcggcgccaggggtgcggttgccgccccactggtcgggcatctggttgcccagcggcaggtagacctggccgagcttctcgtcgacgctggccagcgaccacatgttcggcgagttgcgggtatagaacttgccgggagccaggggctcggtctcgtccgggttgccgctgtcccagttccacaccagcttgccgtcgtgcacgtcgaaggcgcggatcaccccggacggctcgttggtcgactcgttgtcggtgacgtggccgccgatgatcaccagattgcgggtgaccgccgccggcgatgtggagtagtagccgcccggggtgaacggaccgatgccggccgtcaggtcgaccgcgcccttgaccccgaagtcctcgcagaccttgccgttgtcggcgttgatcgcgatcaggcgggcgtcggcggtgggcaggaacaggcgccgcggacaactggcggcgaccgccttgccggccttggagagcgcggccggcggcgcgccgacgtcgctcctggcgtactgctcttcgtcgtagtaggagacgccacggcaagtcatgtgggcgaagcccttgaagcctaccgggctctggatctgcggatcgaagcgccagatttctgcgccggtgtccgggtcgagggccagcaccttgctgtgcgcggtgcaggcgtagagcatgccgttgaccttcagcggggtgttctcgttggtcagttcgagcggatcgtcggcggtcggcaggtcgccggtacggatgcgccaggcttcctcgagctggccgacgttggccggggtgatctgcttcaacggcgagtagcggtcgccgaactcggtgcgcccgtaggcctgccagtcgccgtccggcatcgccggggcggtgctggtcatgccgctgtcgcggtcgatgcgaccgacgatctgccccggattggtgaactggctgcccaccgcggcggtgccggccaggaccaccgccacgcccagcgccgcggtgcccagcggcgccggaccgtcggccagcagcgggcggcggaaccagggtag

SEQ ID NO: 8924 - DNA, 1656 bp, Pseudomonas aeruginosa
cgccgcacgcttgcccagcagcagcaacagtccgctcagggccaggccgatgccggccagcaggtagtacagcgagccgcccaggctcgccagcttgatgccgccggccagcagcgccaggccggacagcaggatcaacaggccgagcaggctcggcagcaggcgcgatcgactgcggttaccttcgctcatcgtccggtactcccttcggggttgatgacaggcattgcttactctcctattacgttctgcacgccgggctgttcagcccgccgcgccgcgttgggctgcgctgaagaaatggccgctggccatgaccgaatcgcggttgtccgaagcaacagcctagaacaccgtctggatcttgatccccgccaccagcgcgttgtcgacctcgtcgaccccgcccggctgcttgatgtactgcaggttcggccgcaccgtcagccagtcggtcacatgcaccccgtagtacagctcggcgttgtactcggtgtcctgcagcggctggtacagcgggttgtcgtagtcgtcgatgccgttcacctggttcaccaggcgctggcgcttcttcacatcgtcgttgacatggatgcgcgcgatgcccaggccgatgtcgtccttcggccgcgcgtcgaacggccccttgtagaccatcccgagctgctggtagttgtccaccacgttggtcgccttgtcgtggaccgtcaggttggcgaacaggctcaacccgcgcgaggcatcgccgttgtgcgaagtgacctgctgctgcgccaccacccaccagccatgcttgctgccgcgcgacttgaagtcgttgccggtcagcccctgcggctggccgtcgacgtcgtcgtagacgtcatcggccttcgccgtgctgtagtagtagcccagccggtactcgcccggcagttgctcggcgccgaccttcggctgccagatcagctccaccggcagcaacgcgcccttggtcccgctgccgctcatcttgaagccgttgccggtctccaggttcgacgggttctgctcgtaggcgccgacctgcacgtaccagtccggcgcgaagttgtacttcacccgcaacgcccactggctgaccggccagttgtaccagatgctccccgcccagttgcccacctgcgagccgcagaaggccaggttctggaaatcgcaggggaagctgttgaagtcctcgccctcgccgaaacggccgaatttcacgtccagcgcgccgtcgaagtactgctgcttgagccacagctgggtcagccgccaggtctgcccgcggccccagacctcctgcaccgagctgatgtgcccggcacgcgggtcgccgatgcggtcgttggaaaggttcttgccgttgcgctcggtgacggtgaactggaactcggtagccttccagccgaggatcttctccaggtccatgtgcacgcccagggcgaactggtcggtgtagcgcccggtcttgtcgtcgtcatagccgccgtcgaggttggccgccgcctcgccgacgtactccagcttgaagtcgtagcccttctccagcagctcggtgcgcttgccgccccagtcgccgagcatccatttcgagttcggcgagaacgcctcggcggcgtgcaccgcgttgcacagcagggaggcggacaatag

SEQ ID NO: 8925 - DNA, 870 bp, Pseudomonas aeruginosa
ccctgcaggcggatatcgcgcaggcgcacgccctgctccgccgcgacgatccgtccgcgcaggcgctgcgcccggcattgcgcacagggacaggcggcgcgcaggcgagcatggtcgatccggctgaccgcgccgtccgcccattcgagcatcagccagccgtccctggcggaattgcgcaggcgcagcggcggctgggtcatgccggcacccgcagttgcgccagggcgatacgcaccgccttgcgcacctcgggatcgccgtcgccttcggcgacccgcaaggcctgggccgaggccgggtccgccagttcgccgagggccagggcggcctccttgcgcaggttgccgatgggatggccgagcaatgcttccagcgcctcccgcgccggccggtggcgcaagcgcccgagcgcccgcgcggcgcgcaggcggacctgccagtagtcgtccgccagggccttcagcagcggctcgccggcctcctcccggcccagcttgccaagggtcgtcgccgcctcttcgcgaacctgccattgagcgtccgccagcgccgcgcagagcgccggcagcaccgtcgcctcgcggctcaggccgagggcgccggtggccgcccggcgtacctccgggtcgacatcggcgctggccagcctggccagttcggccagggccggctggtggcggagccagccgagcaccgccaccgcctcgcggcgcaccgccgcctgcggatcgccgagggcggccagggccggcgcggcgctctcctccaggcgcagttcgcgcaacgcacgcaatacgctggcgcggacgaaggcatcggcatgcccgagccacggcagcaggcgccgcccggcggccggttccttga

SEQ ID NO: 8926 - DNA, 1266 bp, Pseudomonas aeruginosa
gttcgccaaggctctgcgcggcggcatcggccaccgccggcaccggatcggccagggccgcacagagcgcatcgaccactgcgtcttcctcccaggcctccagcaggcgcgcggcctcgccgcgcacgccggggtcgggatcgccgcgcagggccgcaatcagcaacggcagcgcctccggcagctccaggtcggccagttcgatcagcgccaggcggcgtacgccggggtcggcgtcctccaggcgcggcgacagttcgaggatttcgggcagggtggcgtttttacaggtcatatggcgatccgcagtcggtccggggtgatgcccggcggcaagccgagcggggtcaggcgcggcaactggcggccgtcgtcgtggtcgagcagttccaggcagtggcgtttcaggcgcacgaagtcggcgctggtcaccagccgggtgtcgcgagggcgcgggaagtccagcgccaggtcggcgatgatccgtcccggacgggggctcatcaccagcaccctgtccgccaggtacagggcctcgtcgatgtcgtgggtgacgaacagcaccgtggtgcggacccgcgcccatacgtccagcagcaaggtctgcatcttcagccgggtctgcgcgtcgagggcgccgaagggctcgtccatcagcagcaggcgcggccggttgaccagcacccgggcgatctccacgcgctgctgcatacccccggacagttggccgggccagcgcccggcgaagtccgccagccccaccagtccgagcatctccatggcgcgccggttgcgctcggcgcgggccaggccctgcatcttcaggccgaaggcgacgttgtcgcggacccgccgccaggggaacagggtgtgctgctggaataccatgccacgctgcggcgaaggtccttccacgctccggccgtcgaccctcacgctgccggcgcttggccgcaggtggccggccagggcgccgagcagggtcgacttgccgcatcccgaaggcccgagcaggcagacgaactcgcccggccgcgcctccaggctcagatcgcggaccgcctcgaaggcttcgctcccctgccccaggcggatgctcaggtcgcggatctggatgcgccccaggctgttgccggccgtcgtcatcggaccttgcctcccgccgcgtaccagggcgtcagcgacgcgccgacgcgcttcaccaacccactgctgcccatgccgaagaggccgatgagcagcatgccgaccaccacctcgtcgtag

SEQ ID NO: 8927 - DNA, 411 bp, Pseudomonas aeruginosa
cccagtccccattgcccggagatcatctcggcggtcaccaggcagaaccaggaggtgcccatgccgatcgccaggccggtgaagatgcccggtccggcgccgggcagcagcacctcgcgcagcagtgcccggcgccccgcccccaggctgcgcgccgaagccagcaggcgcggatcgagcgcctccacgccatgcacggtattgagcaggatcgggaacagcgcgccggtgaaggtaatgaagatcatcgaggcctccgacgaagggaacatcaggatcgccaggggaatccaggccaccgccgggatcggccgcagcacttccagcggcggcagcagcaaggcctcggcccaggccgagcggccgatcgccaggccgagggcgatgcccagcgcggcggccagcagatag

SEQ ID NO: 8928 - DNA, 447 bp, Pseudomonas aeruginosa
aaaaaacaggcgcgagcgtctaccacggggcattccggcgtttgtcgcgatcagggcgggggcatggttgcagagacggcggaaggcttcacctaccacaattggcagagccgcggcggcgatgctccgcgccgggttcaaccggcttcgctgagttcggcgaccaccactccgggaaggtctttcagcagtgccggggacagcagcagcttggtctcgcggaccccggcgcccatcaccaccaacggccgttcgaagaccgccgcgtcgaccagcagcggcatgccttcgggcaagccgaacgcggtgatgccgccgaactgcatgccggtcagctcggtggcgacctcgcgggcggcgaaggacagccggcgggccccgagcagcgccttgaccgcgccgttcacgtcgagccgccgcgagcccaggttgaccaccgcggcatag

SEQ ID NO: 8929 - DNA, 4212 bp, Pseudomonas aeruginosa
agacggacggcaccggcccctgccgccaggcgggcggcaggggccggcggttcaggttgccaggttcgccggcacgccgccaggcacatcgggcgccaggcgctgccgcaggatcgcgcaaacctcctccgccgccgtcaccaccaggccgtggccgccggccagggtctccagctcgtagcggctggcgtgccgccgccagccgtcgatggccaccctggagacgcccgggtcctgctcgccgaggatcgcggtgatcggtatggccagcggctcgcgcgggcggtagcgatagtcggcggccaggcgcgaatcggcgcgcagggtggccaggctgatctcgcgcagctccgggtcgtcgagcacttccagcggcagcacgtcgtactcgcgcagggttcgcagcaactcggcgtcgcccatcgcatggaagcgcgggtattccaggtccggccccggagcgcggctgctgatcacgaacaactgcctggcgcgcaggccgtgcaggctttccaggcgtgccgccagttcgtaggcgagcatgccgccgaggctggcgccgatcagggcgaacggacggtcgagcaatggcaggagcgcgtcgtcgatggcacagagcatggcctctacatcggtgacgaatggctcgtcctggcgttcctggcgccccggatactggatcgccagcagctccacgtccgccggcaggcgcgcgtcccaaccacggaaagtgccggcgttgccgcccgcgggcggcagcgcgatcaggcgcaggcgcggctgcgcgctcccgctgcgctgcaaccacagggcccgggcgcgctcggtggcgggcggcaacggcggcgcgtcggcggcatggcagcggcgcaccacttcgcgggcatccggatcgccctgcaacagccccaggctcagttgcctgccggtcagccggcgcaattcggcgatcgcctgcacgcccagcagcgaatgcccgccggcactggcgaagccctggtcggccgccagcggccggccgagcacccgggacaacaccttgagcacccgccgcagctccacgctgtcctcggcctgggccgccgcgggcggctgcaccgggtctccgagcagcgccagcaacgcctcgcggtaggcgccggccagtgcctcggcgcgctcggcggggaaacgtccggcggcatactggaagcccacctcgaggcgctcgccggccacctcgaagtccaccgccagcggcacgtcgacgtccaccaccacctggtcgaggatgccgccgtgccttactcccgccgccggcgcggcgtcgtcctggtggaagtcgacgaagttgaacaggctgtccaggcgcaactcgcggttgcgcctgcgaatcgccgccagcggatggcgccgatgttccaggctcgcgcgctcgtagtcgaatgcgcgacgggcgctgtcgagcagatcgacggaagccgacagccggcacggcagggtgttcaggaacaggccgagcaggcggtccgctcccggctcctcggggcgcccgtggctgacgaagccggtgactacttcatcggcatcgctgaagcggcacaacgctcggccatgcgccgccagcaacaacgaacgcaagggcaagccgctgcgttcggccagggcgcgcaagcgcgacaggctgtcggccggcacgtccacgcggaccgccgccatgcgccggggtccctcctccgccagtccgggcaacggccggtagcgggcgccggccaggtagtcgagccagaacagcgccgaggcggcgttggcctcggcctcacgctccagcgccacgtagtcgcggaagcctactgcgggcgcttccgcttcccgcgcgacgacaccggcgagaaggtcggcgtagaccgccagcagctcgtccaccaggctttgcaggctccagccgtccagcacgctatggtgttcggcgacgcccagggcgaagcgccgctcgtccagcgccagcgcggcgaggcgcaccagcggtgggcggctccagtcgaacggggtggcctgctcttcctcgatccaggcacgcaggcgcaggcgccgtgtttccccgtcgaggccacacaggtcgtgcaccggcacctcggcggcgaccgcagcggccgggtggacccattgcaggggaacctggccaccgtgcagatcgaagccggtacgcaggatcgcgtggcggccgatcaggatcgcccaggcgcgcgccagcaactcgccgtccaggcgtccatgcacctcgtgcaggacgacgttgtgcaacagccgtggatcgccgctggcctcgctttgcaggagcatgccctgttgcaggctggtcatcggataggcgtcgtcgagcccctccggcaggcgcttgcgttccgccgccgacaacagggcgaacggctccagcgtctgcggcgccgagctcgcggccgcatccgccggactcgccggagcggccagcaggcgcgccagttcgcggatgctctggtggttgaacacgtcgcgcagggtaaaggaaagccccgcctcgcgcgccatgacctgcatctggatcaggcggatggagtcgccgccgacctggaagaaattgtcgctgacgccgatcgccgggcgtttcagcacgctcttccagatctccagcagggccgcctcggtggcattggccggcgcttccagggtctgcgcggccgcctcggcggccagcgccgccaacagcgcgcgacggtcgagcttgccttcggcggtcagcggcaggcgttcgacccgggcgatccggctcggcagcatgtaggccggcaggcgcgcctcgaggaagccacgcagggcctgctcgctcagctcgccgccgagggccgcggcggggcgcggcgcgagcgcgcgccagtcgatgcgctcagccagcgactcggcatagcccgggcgcaccgcgtagcagttgtaacggtcggtaccctccagcagcgcgtcctgacggatgctcacctcgaagccatggcggcgcaaaaggtcgctcaaggcatcggcgcggccggcggtggcaccgtcgcgcttgtcatggacctccaggacgatctgccggaccttggccagcgccgcatcgtcgagaccgagcagcacatccatttccgcgcgctgcacgtcgatcttcagcaggtcgatacgctccaggcccagttcgccgatcacctggtcgaggcggcgcaggcggcagcggtgggcttcggcgcgcaggcggtcgtcgaggatttcgtcgatgttgtccagcagcaggttggccccgccctcctcgccctggttgctcaggtagcgtcggatgacgtcgcgttcgccgctggcgtcggcgtactcggcgatcccggagaaggtcgagtagcccggatagtaggtgaaggtttcttcgcgctcggcgtcggacaggccgatgccgaatacctcgacctgcggtgcgtagcgtccgaggttggcctccaggcgccggcggatcggtgccagcggctcgaaggcgaccactcgcgcgcgcggcgcgcggctggcgatgtacagcgagaacaggccgatgttggcaccgacgtcgaggaccaccgcgtccggcggcaggacgatgccgtcgcggctgtagacctcgtcgacgaagatttcctggtagacgtactcggtttcgttgaggttcagtccggcgacccggtgcccgctgggcaggtcgacttccagccaggactcgtccgcggtctccccggcggcggtgacgaaggcgacgatccggcgatccgcgcccggctcggccgcatcggcctcgtcggtgagtaccgccgcctcgcccaccgctgggtgttccagcagcgcgctgcggatctcgcccagttcgatgcggtagccgttgatcttcacctgttcgtcgatccgcccgaggaactccaggcaaccgtcggcgcgccagcgcaccaggtcgccgctgcggtacaggcggccgctgcccggccagccctcgtcgaggaagcgcccggcccgcctcgccggcgtcgccggcatagccgcgcgccaccccggcgccgccgatccacagttcgccgctggcgccacgggtcttgcgacgaccgaggccatcgaccacatgcagatcgacgttggccagggcgcggccgatggtcggccgcgcatgctcggcgacccgcgccaggctggcgttcaccgtggcttcggtag

SEQ ID NO: 8930 - DNA, 729 bp, Pseudomonas aeruginosa
ccggggtgtacaccgccgccgcgcgcatcaccccgagcagggcgacgatcgcctcgcggttgcgcccggtcatcaccgccaccgcctggccgggccgcacgccggcagccagcagcgcttcggcgaccgcttcgctgcgcgcgcacagcgtggcgaaatccaggctgccgtgggcatccagcaacgccggcgcctgcggctgcagggcggcccgcagatcgaacgcggccaccagggattccaccggcgcgggctccacgcgctcgccctgccaggcctggtagcgctcgcgctcggccgcgccgatcaacggcagcccggccaatggcagttgcctgtcggcggcgatgctttccaggcattcgacccaggcgtcgagcaagcgcccggccagcgttccgtcatggtcgcggcggacccgcaggctggccagccggccttcgccgtggggcagcacctgcaactcgaggaacccgcccagcggcggctgacggcaatccagctcggccaccccggcgccatccagttcgcccgccagccaggcgaagcccaactcggcgagcggccagtcgggggcaaagggatcgcgcagggccgctgcctcctcctgggcgaggatcgccgcctggagggcgtcgagccgctcgccgacgctgcccgcgcggacattctccaggcacagcggcgcgaccccggcgaacggtccggccagctcggcgaactcgttga

SEQ ID NO: 8931 - DNA, 1509 bp, Pseudomonas aeruginosa
gccacgcgcagttgcgcctcgccgtccagcgcccggcgcagccgctccagcgtcgccacggtatcggccggggcgtgcaggcgcacgccgacaaccgtattttccggccgctcggcatggcggcgccaggcgcgggtctgcaagggagacagcgggaatccttcgagcgcttcgctcgcggccggttgcacagcggattgcaggtcttctgacgcactcatggctatccctcgcacgggttcagggttggtggacatgcaggtcggtcatcgccaccagcaccttgcgctcgccggtgtacggctcgcggccgtggacgctgatgaagttgtcgagcatcaggacatcgccgcgctcccaggcgaacgcgcgggtttcctcgcggtaggcggcgcggatggtgtccagcacctccgcctcgatcgggctgccgtcgccgtagtaggcgttgcgcggcaggccctgttcgccgacctcgtcgagcaaggcccgggccagggccggcggcatgttggagacatggaacatgtgcgcgtggttgaaccacagcgtctcgccgctgagcgggtggcgcaccatcgcctggcgtacctggcgggtattcaggcgctggtcgtcgagccaggtccattgggtaccggtctgccggcagtaggcctcgacctcggcgcgactgtcggtctggaagccttcctgccaggtcaggtcgatctccggcccgtagttgcgcacgtagcacaccccatggcggaggaagcgctgcctgatcgcctcgggtatccgagcgctgacccggcgctcgtcggccaggggcgtgcggccctgggtggcgggcggtgtctggcagtagaagtggatatagctcggccagttgtgcgagtaggacatctcgtggtgcggcggaatccagccgtccggcgagaactcggtggaggtgaacacccggtgcgccacttcctggcgtgccgccgcgcgctccaggtagtcgagcatgttcggcgaaaagctttgtaccgcctgggagaagccctccgctccgtctaccgcgaagccacgaaacaggatgccgccatgccgcagcaggctgtcgcgcagccctgcgccggcggcggcgatccattgccgcaggtccatgcccggctggcgcgcgcggacgatgcgcaggtagtcgttggccgggtcgagcaggctttcctccaccaggtcgccggccgagagctgccgggggcgcaggcgcggcgcgctgaacgaggcgctcatgcggtacctccgagcgccaggcgcgaaggtgtcggcgggacatcggcgggcgccaggctggaatacggcgtggacatgatggtgaggatccgtcgcggcccgcggaacggctcgcggccgtgctgggcgagcatgttgtcgaggatcagcacgtcgcccacgcgccagtcgaagcgccgcgtctcgcggtctatggcgctgcggatggtcgccagggtctgcgcctcgatcgggctgccatcgccgtag

SEQ ID NO: 8932 - DNA, 678 bp, Pseudomonas aeruginosa
cgaccagcagcaggcgtgccggcgcctcgtgggcgaggtcgaagactcgcgcgccctcacggcgcacgccatcctccagcaaccgctcggcgtggacggcgtcgctcgccagcaggcgttgcaggggcaccgcatgcgccgccagcgcatgcggctgcggcccgtcgacgcccgtttcgacacgccggcgcagcgccacatgccgttccagcaactggcgcaaggcctgttcgatggcgtcggccgtggcgccgactatgcgcaggtgggccagcaggttgtaggaggtgtcctccggcgccagttgctgggccacccacaggcgccgttcggcgaggctcagcccggcggcgccggcgctcggctccggctcgtcgccctcgggcgcggcctggcgcagcagttccagcagggcctcgggggtcgccgggccaccggcgaacgcctgcaacggtacgcgtcgggacagtcgctggcgcagcgtcgcgagcaggtgcaccgcccgcagggaatcgccgccggcggcgtagaagccctgtccggcgcgcggcggcgcaccaagctgcgcctgccaggcctggtgtagcgcctgctccagcggatcgctgggcagcgcctgcggctcggcgccgctcgcctggggacgcggcagggccttgcggtcgatcttgccgttga

SEQ ID NO: 8933 - DNA, 501 bp, Pseudomonas aeruginosa
ggctacggtcggcggcgtgcacggcgatgcgctgcggtgtgcgccgcgcctgggcctcgaacagatggtggagtacgccgcgcgacggggcggcctggggctcgctgcgcatggcctgcatacggcgctcttcgtcggcgtccatccagggcagccggccgacgcatgcctgggcgtcgaccatgccgcgcgccatgcgcgcgagatggccggcgatacgccgcaattcgtcgtactggggatcgcgcagagccaggccgacgctgccgtccgccgccagcaccagggccagccagccggggctgctcgccgttggccgcgccgccagcacctggaccgcgcagcacccggccagggcggcgcgctcctggccgtcggcggatagctgccgccgggcgtcatcgagttcttccgccagccgcgcgctacgttcggcggacgactccatcgcccggtaggcggaacgcagcagcgcgggcgcctgccgcccgcgaaccgtga

SEQ ID NO: 8934 - DNA, 447 bp, Pseudomonas aeruginosa
ggcgctcgatgctgccgaacaccaggttctccaccagcaggccgatcagcaccaccacggccaggccggcgaataccttgtcggtgtacagctcgttgcggttctggaaaatgtaccagccgagcccgcccttgccgctgctcgcgccgaacaccagttccgcggcgatcagcgtgcgccaggcgaaggcccagccgatcttcagcccggcgagaatcgacggcagcgccgccggcaccaggatcaggaggacgaagcgcaggccacgcaggccgtagttgcgccctgccatacgcagggtctccgagacaccgaggaaaccggcataggtgttcagcgccagcgcccagagcaccgaatgcaccagcacgaagatcaggctgttctggcccaggccgaaccagagcagcgccagcggcagcagcgcgatcgccggcagcgggttga

SEQ ID NO: 8935 - DNA, 441 bp, Pseudomonas aeruginosa
ctcgactcatcgatcgattcctctgctcaatgggccagccggatatcggcgaagtcgagggtcgcggccgccgtcggttcgccgccctcgtcgaacagcaagcggtggatgcgtcgcgccgcggcttgcagcggctcgccgccaaggctgtgcagcccgaacgggtggccgtgcacttcggcccggacccgccccgggtgcggcgagagcagcaggatgcggttgcccaccaccaacgcctcctcgatggagtgggtgacgaacagcagggtgaaacgcacctcttcccacaggcgcagcagttcttcctgcatctttcgccgggtcagcgcgtccagcgcggcgaacggctcgtccatcagcaggatcttcggctgcatcgccagcgcccgggcgatcgccacccgcgccttcatgcccccggacagcgtgtgcgggtag

SEQ ID NO: 8936 - DNA, 1344 bp, Pseudomonas aeruginosa
aggcggatctcgccctcgctgggcgtgatgaagccggccaccgccttgagcagggtcgacttgccgcaaccggacgggccgagcaggacgaagcgatcggccgggtcgacttcgaagctgacccgctgggtggcccgcaccacgcgcgagcgggtgcggtattcgaggctgactccgtccaccgccagcagggcgtcggcggggagcgtggaaggttggcgggaggcggcgttcatcggcgtctcaactcccctgcaacggcgcgccgtcctggaagaaatagtcctgccaggaggccggcttgttgcggatcgcaccgacccggtagagaaactccgccagcggataggtgttcttcggcgtgacgctgaactccacctgcggattggcgatgatcttcagcagcgcggctcggtcgatcttcgccccggtcacccggatataggtatcggcggcggccgccttgtcgttctgggcgaaggccgccgcttccttcagcgcctcgacgaaggcccggtaggtcttcgggttgtcctggcggaacttctccgtggcgaacagcacggtcggcgaattcggccccagcagctcgtagctgtcgagcaccacgtggaccttcgggttggccagcgcctggtcctggaacggcgggttggagaaatgcccggtcagctcggtgccgccggccaccagcgcggcggtggcgtccggatgcggcagcgccacggtgtacttgtcgaggcggtcgaactgcttgtcgccccactgcttcgccgcggcgtactggaggaagcgcgactgcaccgaaacccccaccgccggcacggcgatgcgatccccggcgccgaagtcggcgatgctcctgacccgcgggtcgttgctcagcaggtagtaggggaagttgcccagcgaagccaccgccttgacgttctggcgcccgcgggtacggtcccagatggtcagcagcggaccgacgccggcaccggcgatatcgatcgccccggacagcagcgcatcgttgaccgccgcgccgccggacagttgggtccagtcgaccttgatttgcaggccctcggcctggccgtgcttttcgatcaggcgctggtcgcggaccacgttgagcagcaggtagacgatgccgaactgctcggcgatgcggatctcgccctcggcctgcgccggccggctggccagcaccgtggtggcgaagctcaggcccaggccgagcgcggcgaccaggcgggtgaaaacggggaatgcggttcatggaaacgctcctggcgaaaagggggaagcgcgtgccgtcgtcagaacggcgcgtcgccctggatggtggtgcggtag

SEQ ID NO: 8937 - DNA, 294 bp, Pseudomonas aeruginosa
atatgctgctccgtacggttcggcgttccttgtaagcacaaaagtgaattaataaataaaaacttagtatttatggctctaagcggcgaagggatagtctggctgccatcgaacccgccgcccgaggaatgcctcatggaccgcaccgacaacgtcatcgatttcgcccgctaccgctcgcgccgccaggcacgccgcctgggcgaaatgatgtgggcggtgtacgcctggcgggccggctacgtcgtgccgcaaccgccagccaggcacgacgagcgcagccgccgggcctga

SEQ ID NO: 8938 - DNA, 636 bp, Pseudomonas aeruginosa
ccgatgaacctgcccgccagcgatggcgttgcccacctggaactggccgccggcgtgcataccgaacccgatgatctgattggccagcgcgtcgcccacaacctgctgcgcctgcgcggcaagcgcaatctctcgctggacgccctggcgcggatttccggtgtcagccgggcgatgctggcgcagatcgagtccgggcgcagcgtgccgtcgatcaaggtgctgtgcaagatcgcccagggtctcaaggtgtcgctggcagccttcctcgacgatcgcgccttcgccggtgtcgcggtgctgccggcgcaacagagcaagcgcctggtcagcgccgacggcgctttcaccagccgcgcgctgttccctttcgatgtggcgcgccaggtggagttctacgaactgcgcctgcgcggcttcggccaggaagacgccgaagcccacgcccccggcacccaggagaacctggtggtggcgcagggggtactggaagtgcgggtcaacgaggagcgcttcctgctcgccaccggcgactcgatcctgttctacgccgaccagccgcacagctaccgcaaccccgccgatagcgaagccctggcgtacctggtgatgacctacccggagcgcctggactga

SEQ ID NO: 8939 - DNA, 414 bp, Pseudomonas aeruginosa
acatctccatgtccatgccctgcatcggcatcatcctgcagtgcatggcgtcgccctgcatggagcactccatcatgcacttcatcggagccatgcccatcatcggcatgcccatccccatgcccatcgtcggcatcatcgccatgcaggcctgggacatgcccatcatcgccaggttgccgcactgcattatcatgggcatgccgcagttcatcatcatcgccatcatctcggcgctgttgcggaactggcccatgtccatgcccatcgccggcatcatcttgcacagcatgccgtcgtccatcgtttcgcactgcatggtcgccatcatcatcggcatgcccatcatgggcatcatcggcatggcggcattcatgttcatcggcatctgcatggcattcatcatggcggtaa

SEQ ID NO: 8940 - DNA, 822 bp, Pseudomonas aeruginosa
cagggtccagggcagcatctcgctgccccagcgctgcaacaccatgccacccaacgctccgccgccggcgatggccaggttccaggccaccacgatcatcgactgggccaggtcggcgccctccccggcggcgtccgccgaggcggtctgcagcagcgtcgccgcgccaccgaacgtcagcccccagagggccaggccggcgaacgccagccagctccagcgagcgcccaggcacagcgccagcgccgccacggcgaacagcgccaggctggccaggaccatccgccgcaggtgccggtcgaccagcacgccgaccagccagattcccgccaccgcggcgctgccgaataccagcagggccaggtccaccgaggcgcccaggccgaccttggcgaggaacggcgcgatataggtgtagaggatgttgtgcgccagcacccaggcgacgatcaccagcaataccggacgcacgcccggcgtgcgcagcaccccgagcaggcgcaggcgccgcccggccggctggccagggaagtccggcacgctgcgcagcacccagccgaccagcagcagcgcggtcagcgacaacaggccgaaggcccagcgccagccgagcaggccgcccagccaggtgcccagcggaacgccgagcgacagcgccagcggcgcaccgagcatggccaccgccagcgcccgcccctgctgctccggcggcaccaggcgccgcgcgtagccggccagcaggccccaggcgaggccggcggcgacgccgctgccgaagcgcgccagcagggtcaggcggtaatccgaggaaacggcggttag

SEQ ID NO: 8941 - DNA, 1818 bp, Pseudomonas aeruginosa
tcgccacgctgggctgaagcgcgcctggcagggccggtcaagccggcggcagacaggaacaagaccgcggcggccacggagcgtctaataggtacatccaccccttgccaggccgcatccatgatcaacatcgagacgccgacctactacacggcgaccaagaagtacgaattgtccttcccctccctggaaaccgacctggacgccgacgtggtggtgatcggcggcggcttctccgggatcaacaccgcgcttgagctggccgagcacggcatcaccgacatcgtcgtgctggaggcccgccacctcggcttcggcggtaccgggcgcaacggcgggcagatcatggccggcatcggccacgacctggagaagatccgcaaggacgtcggcgaggacggcctgcgggcgatcttcgagatcagcgacctcggcgccgacatcatcaagggccgtatcgagaagtacgccatcgacgccgacttctgccacggctacggctacatgggcttcaacgcacgccaggcgaagaccctgctggcctgggaaaaggaattccggtcgctcggctcgccccatgagatccgttacctgcacggtgccgaggtgcgtcagatcatcggctcggacgcctacggcagcgccctgctgcacatgggcggcggccatgtgcactcgctcaacctgctgctcggcgaagccaaggcgctggccggcctcggcgcacggatattcgaatacagcccggcgctggaggtgcaatacggcgagcgcatccgcgtgcgcacggccaagggctcggtcaccgcgaacaagatgctcttgggcatgcgacagcttcctcaaccggctcgaacccgagctgcaccgcaccaccatcaatacctacgcgttccagatgatgaccgagccgctgccggacgaactgatccagcggatcagcccgatccgcggcgcctacagcgacatccgcccggtcatcgactactaccgggtgaccaacgagaaccgcctgctgttcggcgccgccacacccttcgtcgaacgcatccccggcgacctcaaggcctggaaccgcaagctgatgctgaagattttcccctacctggagcacgtccgcatcgacctcgcctggggtgggccgatggcttgcagcgccaacctgttcccgcagatcggcagcctctcggggcggcccaacgcgttcttcgtccagggttattccgggttcggcgtgacccccagccacatcgtctgcaaggtcctcgccgaaggcatgagcgaaggctcggcgcgctacgacctgctcagctcggtgcgccgcatcccgatccacggcaaggaccacttccgcccgctgctgctcagcgcgggcaagacctggcaccagctctccggctactggaacggccggcgctgaaacctaccgatcactctacaaggagcattcccatggccattaccgccatccgccacggcatcaccctcgacgaactggacgcctggggcagcgtcgccgacctcggctcggagatcctcgaaggcgaggtgaaagccttcggcaagatgaccgcaggagcccccaccgacccggtcagcgccgcctacttcggcaccaccgccggcaagttccgcatgacctatccgttcagcgaacaggccacggtggtcagcggcgaggtccgcctcaccgacgagtccaccggccagagcacgctatacaaggccggcgacagctggttcgtcagccagggcaccccggtgctctgggaggttgccgacggcggcttcgtcaagcattactacgcggtggcttga

SEQ ID NO: 8942 - DNA, 645 bp, Pseudomonas aeruginosa
ggcggcctgtccgccactgcccgcgcgggattcgacagaccacaacgacaagaaggcggagccaggctcgcgcgattttttccaggtcgcaaagatagcgctgtctcacgcttgaggtgttccatgcatccacccctccaagccctggtcatcatgggtgtcgccggttgcggcaagtccagcgtcagccaggccctttgccagcgcagcggcgcccacggcatcgaaggcgacagcttccatcccgccgccaacatccgcaagatgagcgccggcattcccctcaccgacgacgaccgcgccggctggctggacaccctcgccgagcagctgcgccaggcggtggccgccggcaagctgccggtactgacctgttccgccctcaagcgcgcctaccgcgaccggttgcgccgcgcggtgcccggcctcggcatcgtctacctggaactgaccccggcggtcgccgccgagcgcgtcgcccagcgccccggccacttcatgccggcgaccctgatcgacagccagttcgccgccctcgagccgccgctcgacgaacccctgaccctgcgcctggacgccaccctgccggtggaatgcctggcgcaggccgcccacgcctggtggctggagcacaccgccgcctga

SEQ ID NO: 8943 - DNA, 1395 bp, Pseudomonas aeruginosa
aacagcaactccggtagaacaacgacaaaaggagagccctccatgttcggcatgtcacacgatgcctacctgctcctcgacgccctggtgaccatcatcggcctgatcgtgctgatcacccgcttcaaggtgcatcccttcatcgccctgatcatcgccgccggcttcctcggcctgacctcggggatgccggtggagaagatcgtcaaatcctttcaggacggcttcggcggcgtgctcggcttcgtcggcgtgatcctcgccctgggcaccatgctcggcaagctgatggccgattccggcggcgccgaccagatcgcccgcaccctgatccgcgccttcggcaaggagcgggtgcactggtcgatgatgctcgccgcgttcctggtgggcatcccgctgttcttcgagatcggcttcatcctgctgatcccgctggtattcatcgtcgcccggcgcagcggcgtgtccctgatcaagatcggcatcccgttgctcgccggcctttccgcggtgcacggtctggtgccgccgcatcccggcccgctgctggcgatcggcgtgttcggcgccgacatcggcaagaccatcctctacggcctgatcgtcgccctgcccaccgccgccatcgccggcccgctgttcggcgcgctggtctcgcgctacatacccggcacgccatcggcggaactggtcgagcagatcgcccacgagcccgagacccaggacctgcccagcttcggcgtgaccctggcgaccgtgctgctgccggtgttcctgatgctgctgaagaccttcgccgacgtcgccttccccgatggccacgcgttccgcgcctggatggacatgatcggccatccgatcagcgccctgctcctggccctgctggtggcgctctataccttcgggtacgcccgtgggtttgaactggagaagatcctcaggctgctggaccagagcctggcaccggccgccgccatcgtgatgatcatcggcgccggcggcggcttcaagcagatgctggtggccagcggggtcggcgacgtcatcggccatctcgcggtgaacgcgcagatctcgccgatcctgctggcctggctggtggccgcggtgatccgcatcgccaccggctcggccaccgtcgccaccatcaccggggccggcatcgtggtgccggtgatcgacctgattcccggcgtcaaccgcgagttgctggtgctcgccaccggcgccggctcgctgatcctctcccatgtcaacgacgccgggttctggctggtcaagcagtacttcaacatgagcgtcagcgagactttcaagacctggaccgcgatggagaccatcctctccgtggtcggcctggtcttcatcctgttgctgtcgctggtgctctga

SEQ ID NO: 8944 - DNA, 465 bp, Pseudomonas aeruginosa
gcctgttcggcaacgacccggcgcagatcggccggctggtcgacgccttcgccaaccaggtcggccggatcaacgtcaacgcccagtgccagcgcggcccggacagctacccgttcaacggccggaagaattcggcggaaggcaccatgtcggtccatgacgcgctgcgggtgttctccatccgcaccctggtggcgacccgcgacaccgaggcgaacaagaccctggtcagcgagatcatccgcaaccgcgcgtcgaacttcctcaccaccgactacatcttctgaagcgcctgtccctctcccgccgggagagggacctgccgccacctcccccactgtccgccaggcagcagccgcgcaacaggctgccgccccggcaacacctcctgctcgcgcgaacccgcgcaaccagtggcctgcgcgggtcggcacaggctgtgcaacggcccggactccagggtag

SEQ ID NO: 8945 - DNA, 1299 bp, Pseudomonas aeruginosa
ccgtcgaccggacggccccgctgcctaccaggagtccgcatgaacgcccgcgtccatcccgaagccaccgccaccagtctctccgaaggcgccgactacgaactgctcgcccagcgtttccgaccgatcttcgcgcgcatcgccgaaggcgccgtcgagcgcgaacggcaacgcgaactgccccacgaggcgatcgcctggctcaagcaggccggcttcggcgccgtgcgcgtgccgcgcgagcacggcggcgccggcgcctcgctgccgcagttggttcagttgctgatcgaactggccgaggccgactccaacatcacccaggccctgcgcggccacttcgccttcgtcgaggaccgtctcaatgccgagcccggccctggccgcgaccgttggctgcggcgcttcgtcgagggcgacctggtcggctgcgcctggaccgaggtcggttcggtacggctgggcgaagtgctcacccgcgtctcgcgcaaggacgacggtcgctgggtggtgaacggcagtaagtactacagcaccggcagcctcttctccgactggatcgatctgtatgcccagcgcgacgacaccggcgccgatgtgatcgcggcgatccgcaccgaccagcccggcgtgcgccagagcgacgactgggacggcttcggccagcgcaccaccggcagcggcacgtcgctgttcgaggatgccgaggtggaggaagagaacctcatcgacttcgccagccgcttcaagtaccagaccgcgttctaccagttggtcctgctcgcggtgctggccggcaccggccgcgccgccttgcgcgacgtcgccgccgaggtgcgcgggcggacccgtatctacagccacggcaatgccccgcgagtcagccaggatccccaggtgcagcaggtggtcgggcgcatcgccgcgcgcgtctacgccgccgaggcggccaccctgcgcgccgccgaagcggcccagcgcgcctacctggcgcgcttcgtaggcgacccgcaggcggagaaggaggccaatatcgccgccgagatcgaatcggccaaggcccaggcgatcgtcgccgaactggtgttgcaggccaccagcgagctgttcgacgccagcggcgcttccgccgtcggccgcggcaagcagctcgaccgccactggcgcaatgcgcgcaccgccgcctcgcacaatcccctgatctacaagcaacggatcgtcggcgactgggagatcaacggcagcgagccgccctacgtctggcagatcggcagcggtccggccacggcgtcccgctga

SEQ ID NO: 8946 - DNA, 876 bp, Pseudomonas aeruginosa
acctcgcccatcccatcgcaaggagttgccatgagcgcactggaaaagaacgccgccgatccctatcggcaaccgctgccacggaccccggcccggcgcatcgccgacgacgccgaggcgatccgcgtcgcccgcgaactggccgggctgttcgccgaggaagcctcgctgcgcgaccgccagcgccggctgccggtggccgaactggaagccttctcgcagagcggcctatggggcatcagcgtaccgcgcgcctacggcggcgccgaggtcggctaccggaccctggccgaagtactgaagaccatcgccgcggtagacccgtccctggcgcagttgccgcagaaccacctggcggtgctcgaccatttgcgcctggacggcagcgaggagcagaaacgcttcttctacggcctggtgctagacggcgtgcgcttcggcaacgccttctccgaacgccacagccgtaccgtcgccgaattccagacacgagtgctggcggatggcgacgggttccgcatcgacggccgcaagttctattcgagcggcgccctgctcgcccactgggtaccggccgtcggcctcgacgccgagcagcgcgcgcacctggcgttcatcccgcgcgacgcgccggggctgacggtgatcgacgactggtccggcttcagccggcgcaccccgccagcggcaccgtcatcctggacaacgtgcgggtgccggccgagcacgtcatcccggtgcaccgcgccttcgaccgccccaccgccgccggcgccgtatcgcagttcatccaggccgccatcgacgccggcatcgcccgtggcatcctcgccgagaccgtgcagcaggtgcgccgccacgcgcggccatggatag

SEQ ID NO: 8947 - DNA, 471 bp, Pseudomonas aeruginosa
cgccaagcatctcgcagggcaccaggacgatccagaggatgccgatggccaggcgcacgccggtcagcacatggccgaggatgcccggcaggatcacccggcgcagggtttcccagggcgtggcggcgaggctgcggctcagttgcagccagcgcgggtcgagctggcgcacgccggcggcggtattcagcaggatcggccagagcgcggcgaaggccagcaggaaatagatcggctggtcgcccacgcccatcagcatcaccgcgatgggcatccacgacagcggcgagatcatccgcaggaactgaaacgccggagtggtcgccgcttccaggttgcgcgaggcgcccaccagcagccccagcggcactcccaccagcagcgccaggaacaagcccagcaggacccgtttcaggctcaccagcacgtgctcgtagagttcgcggcgttccagcagttcacccaggctga

SEQ ID NO: 8948 - DNA, 1746 bp, Pseudomonas aeruginosa
tcaggaccacggcggtgccgcgctcgtggatcgcccgcagcagcagctgctgcatgtcggcgcgggtcacttcgtccagcgcgccgaaaggttcgtcgagcagcagcaccttcggctgccgcgccaggcagcgggccagcgcggtgcgctgggccatgccgccggagagttgcgccgggtagcgggcacgggcgtgctccaggccgaccgcggcgatcgcctggtcgacgcgggcctggcgggtggccgcgtcgaggtgcggctggcgggcgaaatcgaggccgaaggcgacgttcttctccaggttcagccagggcagcaggctggggtcctggaacgccaccgcgacgcccggatgcggtccgcgcaggggctcgccgagtacccgcacgctgccggcggccggctcctgcaggccggccagcacgcgcagcaggctggacttgccgacgccgctgggaccgaggatcgagaccacctcgccggcgcccaggcgcaattcgaaatcgccgagcaccgcctgccagccggcaccgcgcggatagccgagggcgatcccgcgagcgtcgaggagcgcctcgctcatgccttggcctcggcctggcgttgcagttcggcgcgcagttgcaccaggctcggcgtaacgatcgggacgaacgccgactcgcgccagcggcgggcgaaaccggcgccgtgctcgctcaggtatgccttgccgccgctggcctgcaactccagttgcacggcattggcggcggcttcggcgagcccgatgcggatgcggaacaggcgtgccggctggctggcgaactcgccgctggccagtccggcgtgcagcgccgccacgtgtccgtcgagggtttcgcgctgtgccgccagctcgccatccaggagcgaacggctgccgcccaggtgccgctgcacttcgtccagtgcgcggcgcgccaggccgatggccatgccgcattgcaggccgaggaaggccgggcgcacccgtggcaggaactgccgggcgtcgtcgtgcaacagccagtcgcgcccgaccgccaccgcgcgcagatcgagggcggcggtgttgctgcattgcaggccgagcaggcgcaggtccgccgagcgctgcaagccggcgagtccttcgggaatcgccaggacgaagggcttgccgccctccccgtgttcgatcgccgccgccaccacgaaatcgccgctgcgcaggttggtcacccacggcaggcgaccgtccaggcgccagccggcctcctccgcgtgcgccaccacctgcagcgcctcgatcccggagaggaacttcatcgcgttggacagcccagtggcgccggccaggcggccggccagcaggtcgccgagcaggcgttggcgcagttcctggttgggactctgcaacaggtactcgatgaaggcgcgctggccccagaagacgaacgccgcggtcagcgagcgcgccgccactgcggccacccgctccaccgcgtcggcgagcgtgccgccggcgccgccgaggcgttcctccaccgccacgccgagcacgccggcggcggccaggcgcggcagcagcgcggcgggatcggcgtcgccgcggtcgagggcgtcggcctggcggtcgagccagtcgctcagggtcgggtcaagcatggtcgtcactccttgcgccggcgcggcatgccgcccggcaagcgcaggctcaggcctgcgggttggtccagcgatattgctccagctcggcattga

SEQ ID NO: 8949 - DNA, 906 bp, Pseudomonas aeruginosa
atgaattcgtccaacccccttgtcgattggttattagacagcctcgaagtcgacaccagcctgttccatgtcggtcgctactgcggcggctggcatgcctccacccacggtctggcgcgtgccagcttccacctggtggtgcagggacactgctgggcgcacgtcgccggaagcgcccggggctggcgactggacagcggcgacgcgctgttcttcctgcgcgacgtcgagttccgcctgtccagcgaggccaccgccgaggcagcgcgctgccagccgcgtggcgaaatgcaggcgctggagtggaacgcggcggacggtgccggcctggtctgcgggttcttccacttccattcgggattgtccgggctgatcgtcgacgccctgcccgactggctgatcctgcgcgccggcgatccggcgctggacgcggcgcgacgcctgttcgccctgatcgtcgacgagtgccgccgccagccggcgccgtcgccggttctgctggagcgcctcagccacctgctgttcctctacgtgttgcgccagcaggtgctcgacaacccgaccctcggcggcctggtggcactggcacgccagccgcagttcgccggcctgctggaagcgctgatcgaggcacccgaacagccctggagcctggaacagatggccgtacgcaccggactgtcgcgctcggccttcttcaagcgcttcaacgaactcagcggtcagtcgccggggcaggtcctgctggccctgcgcatgcaccgcgcctgcgccctgctgcgcgccgacgccagcgtcgccgaggtcgcggcggcggtcggctaccagtccaccgccgccttcacccgtgccttccacaaggccaccggacagcagccgggggcctatcgcaaggccagccgctga

SEQ ID NO: 8950 - DNA, 993 bp, Pseudomonas aeruginosa
ttggcatgcgtgcgacgcaattcaggtggcgtcgtcgacccgcttcagttcgtcgatcatcgcctccgccagcggcgacaggctgtagccggcgcggctgacgatgccgtagcgggtatgcagttcgtcgaggtcgtcgggcagctcgcgcacccgcagcggacgcaggcctccctgtcccggcggcgccaggtcgccgaggccgctgctgatgccgatggcatccgaggcgagaaccacgccgagcaggctatggccgttctcgcactcgatggccgggcggaagtcgggacgcccgctgaggtccaccagcaccttgcggatgttcggcgggctgatgttggtcgccagcgggaagctcaacagctcctcggcggaaacgctctcgcgagcggccagcggatgcccctcgcggcagcagaaatgccagcgccggggacgcaggcgcgaggtccggtattgcgggtcggcctcgaaatgccgggtgtcggcgacgaagaactcgaactcctcggcctgcaggcggcggttcagcgcctgccagtgttcgacctggaaactcacccgcgccttcggataacgcacgttgaagcgccctaccgcacgcggcaccagccaggtggcgggagccggtccggcgccgaagcgcagttcgccggcctccaggccgttgaacagggcgatctcgttggccaggttgtgcgcgccgctgaccagccggcgcgcatgttcgaggacgatcaggccctgcttggtcggacgcaggtccttggccgcgcggtccaccaggcggcagccagcgctgtgttcgagcgcctggatgctgcggctgaaggccgattgcgaaaggttaaccgccagcgccgcggcgacgaagctgcggtgctcgtgaagggcgatgaagtggcggagctggcggagatcgatatgcattttctacatggaaaatatcgggcgaatgcaattgccggggacggcgtgggctttttataa

SEQ ID NO: 8951 - DNA, 1239 bp, Pseudomonas aeruginosa
cgccggagtctcggtgcgcgacaagcagtggtcgcaggaaatccgcctggcttcgcccagcggcggtttcttcgactacgtgctcggcgcctactacttcggccaggacctcgacaacaagtccttcaccgactacgggcccagggcagacatgtggaacggaacccccgccggcgccctgagcgacgtcagcacccgcggtcgcgggcacatcgacaccgacagctacgcgctgttcgcccagggcacctggcacctaaccgagcgcctggacctaaccgccggcgtgcgcggcacctacgaggaaaagtccgcctgggtcgaacgctacgccccgctcggcggcgccgcggtgagcggcgcggcggcggccgcgcgcaacggcagggtcggcgcctacgacagcggcgacatcggcctgcacagcgtcagtccgtccgctctgctcagcctcagctaccgcttcagcgaccaggttctgggctacgcctcgctgtcccacggcgagaaatccggcggcgtcaacctgaccgtggccagcgctcccagcgccggtgccgactcgctgctgattggcaccgagcgcgccaacgatgccgagctggggttgaagaccaccctcctcgacaaccgcctgatcctcaacggcaacctgttctggaccgtggtccacggctaccaggccaatgcctacgacgaggccaaccgcacccagtacctgaccaatgccggcgatgtgcgctcgcgcggcctggagttcgaagcgacggccctgccgatccgcggcctgaccctgaatttcaatgcgtcctacaacgacgttcgctacctgtcctacaagaacgccccgtgcgcccccgaggtggccttccaggccggcgccccggcgtcctgcgacctcagcgggcaccaggtggtcggtgcctcgaagtacatcgccaacttcaatggcgagtatcgctggaagctcgacgatggcctgtagccctacctcaccgccagctacgcgttccgctccagggcggtgggcaccatcgacgactccgcatacggacagatccccagctacgccctggtcaacgcctccgccgggctgcgcggcgactacggggaccgccagtgggacctgtccctgtggctgaagaacgctttcgacaagacctactcgccagcccctggaaattccgccgacggggggtaccccggcgtgctcgggacgccgcgcaccctgggcgttaa

SEQ ID NO: 8952 - DNA, 1353 bp, Pseudomonas aeruginosa
tgtcttccgcgccgcccgccggcccggaagaggagttcaccgatgaacgactcgatcaaggcctgcctggccgccgcctgccttgccctgcccctgctggcccagggcgccgagaccctgaccatcgccacggtcaacaacaacgacatgatccgcatgcaacgcctgtccaaggtgttcgaggaaagccacccggacatcgcgctgaaatgggtggtgctcgaagagaacgtcctgcgccagcgcctgaccaccgacatcgccacccagggcggacagctcgacctgctcaccatcggcatgtacgaagccgcgctgtggggcgccaagggctggctggagccgatgagcgggctgcccgccgactacgccctggacgacctgttgccctcggtgcgcgacggtctctccgtcaagggcacgctgtacgccctgccgttctacgccgaagcctcgatcacctactaccgcaaggacctgttccagcaggccgggctgcggatgcccgagcaaccgacctggacccagctcggcgaattcgccgccaggctcaaccgcccggaccagggccagtacggcatctgcctgcgcggcaaggccggctggggcgagaacatggcgttgatcggcaccctggccaacgccttcggcgcacgctggttcgacgagcgatggcagcccgaattcagcggcggcgaatggaagaaggctctcgacttctatgtctccaccctcaagcggtacggcccgcccggcgcctccagcaacggattcaacgagaacctggcgctgttcaacagcggcaagtgcgcgatctgggtggacgccagcgtcgccggttcgttcgtcaccgacaagagccagagcaaggtcgccgacgccaccggcttcgccttcgccccccgggaagtcaccgacaagggcgcctcctggctgtattcctgggccctggcgattcccgccagctcgcgcgccaaggacgtggcgaaggccttcgccacctgggccacctcgcaggcgtacggcaagctggtggcggacagggaaggcgtggccaacgtgccgcccggcacccgcgcctcgacctacagcgaggcctacctggccgccgcgccgttcgcgcgggtcaccctggaatcgctgaagcgcgtcgatcccaaccatccgacgctgaagccggtgccctatgtcggcatccagttggtcaccatccccgagttccaggccatcggcacccaggtcggcaagctgttctccgccgccctcaccgggcagatgagcagcgaccaggcgctcgccgccgcgcagcagagcaccgcccgcgagatgaagcgcgccggctatccgaagtag

SEQ ID NO: 8953 - DNA, 1008 bp, Pseudomonas aeruginosa
tccgccgccgggcgcagccgcgcccggcgcggcgctgctcgagcgcttgtccttgaagatccagacggagtcgccatgaacacctcggccctcgataccccgctcccggcccgtcccgcccgccgccgtctccagcgccgccggcgcggccctggctggctcctggtcagcccctcggtggcgctgctgctgttgtggatgatcgtgcccctgggcatgaccctgtatttctcgctgatccgctacaacctgctgtatcccggcgagaatgccttcgtcggcctggagaacttcaccttcttcgtcaccgacgccggcttcctgcccggcgcgctgaacaccctgctgctggtgggcagcgtgctggcgatcagcgtggcgttcggcgtgctcatcgccgcgctgctggaggccggcgaattcttcggccgcggcgcggtgcgggtgttgctgatctcgccgttcttcatcatgccgacggtgagcgcgctgctctggaagaacctgatcttccacccggtctcgggcatcctcgccgccgtctggcgcctgttcggcgccgagccggtggattggctggcgcactatccgctgctgtcgatcatcctcatcgtctcctggcaatggctgcccttcgccatcctgatcctgatgaccgccatgcagtccctcgaccaggagcagaaggaggctgcccgcctcgacggcgccggtccgctggcgatcttctggcacctgaccctgccgcacctggcgcggcccatcgcggtggtgctgatgatcgagacgatcttcctgctctcggtgttcgccgagatcttcaccaccaccagcggcggccccggctacgaatcgaccaacctcgcctacctgatctacaaccaggcgctgctgcagttcgatgtcggcatggcctcggccgggggcctgatcgcggtgctgatcgccaatatcgccgccatcgtgctggtgcggatgatcggcaagaaccttaccgagcgcagctga

SEQ ID NO: 8954 - DNA, 1131 bp, Pseudomonas aeruginosa
tctcaagatccgcaacctgcagaaaggcttcgacggccaggccatcatcaagggcatcgacctcgacgtccgcgaccgcgagttcgtagtcttcgtcggcccctccggctgcggcaagtcgaccctgctgcgcctgatcgccggcctcgaagaggccagcggcggcagcatcgccctcgacggcacggacatcaccgacaccccgccggcgaaacgcgacctggcgatggtcttccagacctacgcgctgtacccgcacatgacggtgcgcaggaacctctccttcgccctcgacctggccggcgtcgacaagcgcgaggtcgccgccaaggtcgacgccgccgcacgcatcctcgaactgcaagcgctgctggagcgcaagccgcgccagctctccggcggccaacggcagcgggtggcgatcggccgggcgatcgtgcgcaacccgaagatattcctcttcgacgaaccgctgtccaacctcgacgccgccctgcgcgtgcagatgcgcctggaactggcgcggctgcaccaggaactggcggcgaccatgatctacgtgacccacgaccaggtcgaggcgatgaccctggcggacaaggtcgtggtgctcaacggcgggcgcgtcgagcaggtcggctcgccgctggagctttaccaccatccggccaacctgttcgtcgccggcttcctcggcacgccgaagatgggcttcctgcgcggccatctcagccgcaaccagggcgagcgctgcgaggtcgccctcgaatgcggcgcgcgcgtcggcctgccgctatgcgccggcgagctggccaccggcagcccggtgaccctcggcatccgcccggaacacctgaacatcgcccgcccgggccatgccttccagagcctgctgcgggtcgccgccgacgtcagcgagcgcctgggcagcgacagcttctgccatgtccgcgccgactcgggggaaatgctcaccctgcgcgtgcgcggcgatttcgcaccggactacggcgcccccctggagctgggcttcgatccggagcactgccacctgttcgacagcaacggccaggccctcgacaaacgactgcaacaggcggcctgaagccgccagcgggaacccaccgatga

SEQ ID NO: 8955 - DNA, 1236 bp, Pseudomonas aeruginosa
cggacgccgcgagcaggatccggcggactggctggaagccatggccagcgcggtacgcatggccctggaagaagccgcggtggacggccgcgaggtccgcgccctggcggtttccgcccagcagcatgggctgctcctgctcgacgccgagggccgggcgctgcgcccggccaagctctggtgcgacaccgagagcgcggcggaaaaccgcgagctgctggaagccctcggcggcccggccggctcgctggaacgcctgggactggtgctcgcgccgggctacacgctgtccaagctgctctggagcaggcgccgctttcccgagctgttcgcccgcgtcgcgcacatcctcctgccccacgactacctcaaccactggctcaccggccgcgtctgcagcgaagcgggcgacgcctccggcagcggctacttcgacgtgcgccggcgcacctgggccagcgacgtgctggagctggtcgagccgggcggacgcctggcggcggcgctgccggagctgatcgagcccggcgcctgcatcggcaacctgcgccccgaagcggccgccgccctcggcctggctccccacacgcgggtcgcctgcggcggcggcgacaacatgctcgccgccatcggcaccggcaacatccgccccggcctgctcaccgccagcctgggcacctccggcaccctgagcgcctatgccgagcggccgctggtcagtccgcacggcgagctggcgaccttctgcgcctcgtccggcggttggctgccgctggcctgcacgatgaacctcaccggcgcctgcggcctggtacaggacctgctgcacctcgacctcgacgaattctcccggctggccgcccaggcgccggtcggcgccgagggtctgctgatgctgccgttcttcgacggcgagcgggttccggcgctaccgcacgccagcgccagcctgcatggcatgaccgcggccaacctgagccgcgccaatctttgccgggcggtgctcgaaggcaccgccttcggcctgcgctacggcctcgacctgctgcgcgccagcggcctgccgggcgaggaaatccgcctggtcggcggcgcggcgaagaacccgctgtggcggcggacgctcgccgacctgctcggcctgccgctggtctgtccgcggcagaccgaggccgccgcccttggcgcggcgctccaggcggcctggagcctgggccgcgaaagcggcgccggtga

SEQ ID NO: 8956 - DNA, 378 bp, Pseudomonas aeruginosa
tcaaggccagcgaggaagacctggcccttgttttaccccggccgcgcccccggcgaggtggcccgcggctggctgaacccgcgctgccggctggtcttcgtcacccacggcggggccggcgccagcgtgcactgcacccacggcagctggagtcgcccggcggataccgccctgccactgcgcgatacggtcggcgccggcgataccttccaggcggcgaccctcgcctacctccgccgcctcgacgccgacagcccggccgggctagccgcgctgtcgcgggaagcgatcgacgcgatgctcgccttcgccatccgcgcggcggcggtcacctgctcgcgggtggggccggacctgccgttcgcccacgagctttga

SEQ ID NO: 8957 - DNA, 1260 bp, Pseudomonas aeruginosa
ggccggccgtgcggagggtcaggccgagggctgccgcccggtctagcgccccggccgcgccagccactcccggcccttgagcatggcgttccagtacacccagggcagtacgtggcgcttgagcagccaggcgaagcggctggccgcggtgggctccagcgggaaggtcggcagcagcttgccggcatagccgaactccgccagcaccacccggccgcgctcgacggtcagcggacaaccgccgtagccgtcgtagcgcagcggcaggccacggccgctgcgcaggccgagaaggttctcggccaccaccacgatctgcttgcgcgccgccgccgcggtcttcgcgttggcggtgccgcagacatcgccgagggcgaagatctcgccatggcggacatgttgcagggtcgccgggtcgacttcgcaccagccggccgcgtcgcccaggccgctggcggcgacaaaggtcggcggcagctgcggcggcaccacgtgcagcaggtcgaagtccttttccgccagattggtgttgccgtcggcgtccttcacctcgaaccaggccttgcgcgccgcgccgtcgaccttcaccaggttggaattgaacgccagctcggccgaatacttgcgcacgtactccatcagcggcggaacgaaatcggcgacaccgaacaacgccgcgccggccaggtcgaactcgacctcgatgtcctgcagcacgccctcccgcagccagtggtcgcaggacaggtacatggccttctgcggcgccccggcgcacttgatcggcatcgccggctgggtgaacagcgccttgccgccgcgcaggccgcgcaccagctcccaggtgtagggcgccaggtcgtagcggtagttggaggtgacgccgttgcgccccagggtctcctccaggccctcgatgcgctcccaggccaggcgcaggccggggcagacgatcaggttgcggtattccaggctgtcgccgccctccagcaacagtcggcgcgcctcggggtcgacccgctcgacgcgggtgcgcaaccactccacgccgggcgggaccagcccggccatcggccgcgcggtgtcgccctgtgcgtaggcgccgccaccgaccagggtccagcccggttggtagtagtgggtgtccgccggctcgatcaggctgatacgcaaccccggcgaacgtttcagcaggctggcgatcacgccgatgccggccgcgccgccgccgatcacggcgatgtcggtggtgagttctga

SEQ ID NO: 8958 - DNA, 837 bp, Pseudomonas aeruginosa
ccaggcgccccggctactcccggcacgcctcatcgagaacgacgcccaggcgttgcaggccgcccacgaggtagccggactggcccgtcgcgaagcggcgctacgcgaccgcgaacgacgcctgccctggcaggaactggaactcttcacccgcctcggcctgggcggcatcggcattccccgcgcccatggcggcgcgcaggtttcccatgtgaccctggccgaggtgttccgtgtcatctgtgccgccgacccggccctcggacagattccgcagaaccagttcggcctgctcagcgtgatcgacaacgtcgccagcccggcgcagaaacgcaagctgttccgtggcatcctcgacggccgccggctggccaacgccggcccggagcgcaatacccgccacaccctggagctgaaggcgcgggtccgtcgcgacggcgacggctaccgggtcagcggcgagaagttctactccaccggagccttgttcgcccactgggtggcggtcaaggccatcgacgaggaagagcgcgcggtgatgctcttcgtcgagcgcggcgctcccggcctgcgcatcgtcgacgactggtccggcttcggccagcgcaccaccgccagcggcacggtactgctggacgaggttccggtagccggcgacatgctgatccacaacggcctgctggccgagatcccgagcctccagggcgccgtctcgcaactgatccaggccgccatcgacgccggcatcgcccaggcggcgctggacgacgcccaggctttcgtccgcgaacgcagccggccctggatcgacgcccaggtcgaacgcgccagcgatga

SEQ ID NO: 8959 - DNA, 378 bp, Pseudomonas aeruginosa
gctctacagcatcgccgaggtcggccgcctgcaaatcgagctgcacgctgccaacgccctgctggagaaggccggccaggtcctcgacgaagtggccgcgcggccggtggacgccgagtcggcggcacgcgcctcgatcgccgtggccgaggccaaggtgctgagcaccgagatcagcctggccgccagcgagaagctcttcgaactggccggcagccgtgccacgctcgccgagttcaacctcgaccggcactggcgcaacgcccgcacccataccctgcacgacccggtgcgctggaaagtccacgcggtcggcgactactacctgaacggcgcccgtccggcgcgtcactcatggatctgaggagcgcccgatga

SEQ ID NO: 8960 - DNA, 333 bp, Pseudomonas aeruginosa
acggctcgccggcgcagaaaggtcgcctgttcggcgccgccctggccggcgagcgtttcggcaacgccctggccgagatcggcacgcgtaccgccagcgagcgccgtacccgcctgcgcgccgacggcgacggctaccgcctggacgggcgcaagttctactgcaccggcgcactctacgcgcagcgggtgccgaccctggcggtggacgacgagggccgccagcaactggccttcgtcccgcgcgacagcgccgggctggaaatcgtcgacgactggtccggcttcggtcaacgcaccaccggcagcggttcggcgctgttcgaccgggtag

SEQ ID NO: 8961 - DNA, 1608 bp, Pseudomonas aeruginosa
tcgagcttggcggcagccgcgcctgtctcgccgaactcggtctcgaccgccactggcgcaacgcccgcgtacacaccctgcacgacccggtgcgctggaagtaccacgcggtcggcgactactacctcaacggccgcctgccgccacgccgcggcacgctctgaacgccgaagggaccgccatgagcaagaagcagattctcctaaacgccttcagcatgaattgcgtcggccatatcaaccacggcctctggacccacccacgcgaccgctccagcgactaccgcaaactgcgccactggaccgagctggcccggctgctggagcgcggcctgttcgacggcctgttcatcgccgatatcctcggcgtctacgacgtctaccagggcggcatcgaggtgaccgcccgcgaagccgtccagttgccggtgaacgacccgctgatgctggtctcggccatggccggggtcaccgagcacctgggtttcggcgtcaccgccaacctcacctacgaggcgccctacccgttcgcccggcggctctcgaccctcgaccatttgagcgacgggcggatcggctggaacatcgtcaccggctacctggaaagcgcggccaaggccatgggccagtccgcgcagatcgagcacgaccgccgctacgaccgcgccgacgagtacctggaggtcctctacaagctctgggagggcagctgggaagacgacgcggtgctcgccgaccgccagcgacgggtctacgcgcggccggagaagatccacaagatccgccaccatggcgagttctaccaggtcgagggctaccacctcgccgagccctctccacagcgcaccccggtgctgttccaggccggctcctcggagcgtggcctggccttcgccgcgcgccacgccgaatgcgtgttcgtctccggacagacccgcgaggccacccgccagttggtgcagcgcatccgcgcggcggtggtcggcgccggccgtcgcgccgaggacatcaggatcttcatgggcatcaacgtgatcgtcgcagccaccgcggccgaggcccgcgacaagcatgccgagtaccgccgctacgccagccccgaggccggcctggcgcacttcgccagctccagcggcatcgacctgtcgcgctacggactcgacgagccgatccgctacgagaagaacaacgccatcgagtcggtggtgaagaacctcaccgtggcgcgcaccgactccaccgtgcgcaagctcctcgaccagttggccctgggcggccgctacgtgaccctggtaggcgacccgcgccaggtcgccgacgacctcgaaggctggatcgccgataccggcctggacggcttcaatctgacccgcaccgtggagccggagagctacgccgacttcatcgacctggtggtgcccgagttgcaggcacgcggcagctacaagaccgcctatgcccccggcaccctgcgggagaagctcttcggcggcggccgcgcgcgcctgcaggcggaacacgccggcgccgccttccgccagcccccggccgcgcgccagcgccaggcctgaccccactttccctttcgttcaggagcccaccatgctga

SEQ ID NO: 8962 - DNA, 1110 bp, Pseudomonas aeruginosa
tccagttcgtcacccgcggcaactaccaggaccgcgacggccgcctggcgcgcttcgtcgacatctaccagcattcaccggtggtccgcgccgcgctggacaaggcccatggcacgctgtaccagccgggctgggagtgacggccatgaccgttcccccgagcctgctgcccctcgaaccgttcccgacggcgcccgacacgcgcgcctccacgccgcacatccgtctccaaggcctgggcaagcgctaccccggtggagtccaggccctgcgggagatcgacctggaaatccgccgcggcgaagtgttcggcatcatcggccgcagcggcgccggaaagtcctcgctgatccgcaccctcaatcgcctggagcgtcccagcgaggggcaggtgctgatcgacgacgaagacatcggcggctacgacggccagcgcctggtcgccctgcgccgacgcatcggcatgatcttccagcacttcaacctgatgtcggccaagaccgtgtggcagaacatcgccctgccgctgcgggtggccggggtgccccgggcacggatcgaggagcgggtcgccgggctgctgcaactggtcggcctggaggaaaaacgcgacgcctatccggcgcagctctccggcgggcagaaacagcgcgtcggcatcgcccgcgcgctggtgcaccagccgcagatactgctctgcgacgaagccacctcggcgctggacccggagagcacccaggcgatcctcgcgctgctgcgcgacatcaaccgccggctgggcctgaccatcgtcctgatcacccacgagatggcggtcatccgcgagatctgcgaccgcgtggtggtcctcgaatgcggccgcatcgtcgaacagggcgaagtctgggaagtcttcggcgatccgcgccatgcccgtcacccgaagcctgttcggcagcctgcgcgccgccctcccggccgacctccaggcgcgcctgcgccaggctcccggcgccggcgacccggtgctgctcgatctccagtacaccggcgccagccgacgggtgccggacctgctggccatcgccagggccatcggccagcgcgtcgacctgctccacggcggcatag

SEQ ID NO: 8963 - DNA, 774 bp, Pseudomonas aeruginosa
agcgtatccagggccgcgccctggggcgcctgctgctacaggtcggcgcgccgcccggcgagcttcccggcgtgctggccaaggccgcgctggtggcggacaaggtggaggtgctcggccatgtcgcccatgcttgaacggctctggcaaggtttcctcgatacgctgctgatgatcggcgcgtcctccgccatcgtcctgctggtgggtatcccgctggccctggtgctggtcaccaccgggccgggcgggatcttcgaggcgcgcctgctcaatcgcatcctgggcggtctggtcaacgtgctgcgctcggtacccttcctgatcctgatggtggcgctgattccctttacccggatgatcgtcggcaccagctatggagtctgggccgcggtggtgccgctgaccatcgccgccacgccgttcttcgcgcggatcgccgaggtcagcctgcgcgaagtcgaccacggcctggtggaggcggcccaggcgatgggctgcgaacgccgccacatcatctgcaacgtactgttgccggaggcgcgaccgggcatcgtcggcggcttcaccatcaccctggtgaccatgatcaattcctcggccttggccggcgcgatcggtgccggcggcctcggcgacctggcctaccgctacggctaccagcgcttcgacacccaggtgatgctcaccgtgatcatcgtccttgtgctgctggtcacgttgatccaattcggcggcgaccgcctggcccgcctgctgaacaaacgcctgtag

SEQ ID NO: 8964 - DNA, 1152 bp, Pseudomonas aeruginosa
aaaagaaagaaggaaaggcgcctcatgcggcaaagattctggcaaggaacattcaagaccctgggcctcctcggcctgacggcggggctcgccgcccaggccgcggagccgtccggcaaggccctcagcgccgccgccggcgtgccctggccggcggtcatcgcccaccgcggcgcctcgtacgacgcccccgaggaaaccgccgcggcctacctggtggcccgcgacctcggcgccgactacctggaagccgacgtgcagcgcagccgcgacggcgtactggtcgccctccacgacgacaccctggagcgcaccaccgacgtcgccgaggtcttcccgggacgcgccaaggacccggtgagcagcttcactctcgccgaactcaagcgcctggacgccggctcctggttcaatcgcgccttccccgagcgcgcccggcccggcttcgtcggcctgcgcatcctcaccctcgacgagatgctcgacatcgccgagggcggcgccaacaagccgggcctgtacctggagaccaaggtaccggcgcaattccccggcatcgaagacgacctgcgcaagctgctggaacgccgcggctggctgcaaccccgcgagcgcgccgccgccgggcatgtcgacgtggcccacggcaatggccgggtgatcctgcagaccttcgagaagagcagcctggaactgctgcaagaaagcatgccgcaagtgccgaagattctcctgctgtggctcggcgacggttacctggaagcccgttcgccagtgaccttcaaggaatccggggaaaccgacaaggcggccttctatgccaggcaggaagtgaagtccgaagccgagttcggcgcctggctggactgggccaaggcccacggcgcgctgggcaccgggccctcggcgaccctcagcgaacgcggcgaacagagctacgccgacctggtgaaaccctggatgaaccgcatgacccacgcgcgcgggttgttcatccatgcctactcggtggactcggcggaagacttcaaggccctaggcgcggccggcgtcgacggtttcttcaccaaccgcacctcggaactgctgaagttccagggccgcccggcggcgcaagacatggacgcgctgctgcgccggcacggctactga

SEQ ID NO: 8965 - DNA, 393 bp, Pseudomonas aeruginosa
cgttgctcggcccggccgggatgcaggcggtggtcctggccgccatccaccgcgaccaccgccatgtgccgctggatcgcctcgatcgccgggaggaagcgttcgcggttgaaaccgtcggcgtacaactgctccggtggctggttggaagtgaccaccagcaccacgccctcctcgaacatgatgcgcagcaggctgccgagcaggatggcatcgccgatatcgctgacgaacagctcgtcgaagcacagcacccgcacatcccgcgccaactcgcgggccagggcgcgcaacgggtcggctgtaccggtcagttcgaactggcgctggtgcacccattgcatgaagtggtggaagtgctggcgccgcgcgggcacgcgcaggcactggtag

SEQ ID NO: 8966 - DNA, 714 bp, Pseudomonas aeruginosa
tacaggtcctcgcggaagtgcccggcattgatcgcccgctccagttgcacgttggtcgccgccagcacgcgcacgtcgatggggatgctcttgcgcgaccccaggcgcaccacctcgcgctcctgcaacacgcgcagcaacttgacctggatcggcatcggcaggtcgccgatctcgtcgaggaacagggtgccgccgttggcctcctcgaaccagccggccttggccgccagggcgccggtgaaggcacccttctcgtggccgaacagctcggcttccaccagtgactcggagaaggccccgcagttgaccgccacgaacgggccgttgcgccgcgcgctgaggttgtggatatgccgcgccaccagttccttgccggtgccggtctcgccgatcaccagcacgctggcctcgctcggcgccacctggcgcaggtgttcgagcagggcctgggacttcggatcctcgaagacctgggcggtggcgcggatcgaggtcgccaggttcggcgaacgtggcagcgtcagcagccggtcgggagtacgggtagaagcgttcatgagtagaaggtcggttgcggcggtgactggttcagcgcccagtcgcccagctcgcggatcttgtagtccagcgggtcgtgcagggtctgggtgcgcaggttgcgccagtagcggtccaggcgcagggcggcgtgagtggagcgggcgccggtga

SEQ ID NO: 8967 - DNA, 1434 bp, Pseudomonas aeruginosa
tcagcgacaacaggccgctgcggcgcaacgcgtcgcgctcggccttcggggtaccgccggcgacgtcgcgctcggcggcgttctcggcgaaatcggcggccaggcgccgggcgatctgcaacggcgtttgcgcctcggggcgggtcttcgcattcacagggggtttctcctcgggggcccggctgctcaagcgccggcgcgagccggcagcacgtcgttggcgatcatttcgccgaacggcccggtcaggttggtcagcccacggccggccaggctggcgtagggttcgggcagcagcgggaagaccagttcggcgaagcggtaggcctcttccaggtgcggatagccggagaagatgaagctgtcgatgccgagctcggcgtattccccgatgcgctccgccacctgccgcggatcgccgaccagcgcggtgccggcgccgccgcgcaccaggccgaccccggcccagaggttcggctggatctccaggcgatcgcggcggccgccgtgcagcgcggccatgcgtcgctggccttcggagtcgaaacgggcgaaggactgctgcgcggcggcgatggtctcgtcggagatgtgttcgatcagcctgtccgcggcgcgccaggcttcttcggcggtttcgcggacgatcacatgcaggcggatgccgaacttcaccgtacgcccatggcgagccgctcgctggcgcacgtcggcgattttcgccgccaccgccggcaacggctcgccccaggtcaggtagacgtccacctgttcgccggccagttcgtgggcggcctccgaggaaccgccgaagtacagcggcggatacggccgttgcagcggcggatagagcgccttggcgttctccacgtggatgtgcttgccgtggaagtccaccgcctcgccctgcaggacgcgccgccagacccgaaggaactcgtcggtgacctcgtagcgctcggcgtggccgagatggatgccgtcgccgcggttctcgtcgggatcgccgccggtgaccacgttgatcagcaggcgcccgccggacaggcggtcgagggtcgccgccatccgcgccgagacggtcggcgaaacgattcccggacggcatcgccaccaggaagcgcaggcgctcggtcagcggcgccagcgccgaggccaccacccaggagtcctcgcaggagcgtccggtggggatcagcacgccgtgatagccaaggctgtcggccgcctgtgccacctgcttcaggtaaggcagcgagaccggccgcgcgccctggctggtgccgaggaagtggccatcgccgtgggtcgggaggaaccagaacacgttcatcggcgcacctcaggcgatcttcaacagttcggagcgtccgccgaacagcggcgcggcgcgctcggcggcgaggcggatgcgcgccttcagcggctcgctga

SEQ ID NO: 8968 - DNA, 588 bp, Pseudomonas aeruginosa
aacaggtcctcgcggaagtgtccggcgaccaccgcgtcagccaggtcgacgttggtcgccgccaccagccgcacgtcgatggggatcggccggcgcgaaccgagccgcaccacctcgcgttcctgcagcacgcgcagcagcttgacctggatgctcggcggcaggtcgccgatctcgtcgaggaacagggtgccgccgttggccgcctcgaaccagccggccttgctctgcaacgcaccggtaaaggcgcccttctcgtggccgaacagctcgctctccaccaggctctcggcgaaagcaccgcagttgaccgcgacgaacgggccgccgttgcgtccgctgagggcgtggatatggcgcgccaccagctccttgccggtgccggtctcgccgatgaccagcgcgttggcctcgctgggcgccaggcgctcgatgcgctccagcagctcgcgggaacgggggtcgttgaacaccagcacggtggcgcgcaccgatttggtcagctcgcgggcgtggggatgggtgatgacggacatgctgggttccgagccggggaatgtgcgcccatcttgccccaggaacccatag

SEQ ID NO: 8969 - DNA, 1269 bp, Pseudomonas aeruginosa
ccccgctcattagggcagtacgccaagcagcgaccagactcggcgcgcctccgagtccgcattgatcagctccgccagcaactcgctcagcggcttgttgccccactccaccgcgcgcttgatcaggtagggaaccgggctgtgcggctcggtgcgcgccaggtagtcagcgatcagcagcagttgccgataggcgtcctcgcgactggtcggcgcgccagccggcccgctcggcgcgctcgccgggacgctttcctcgccgtccgcgtcgccttcggcggcgtccgcctccgcgaccggtggctgttcttcgggcagcggcgcttgcgggtgcatggcgatgaactccttgagcaaggccagccattgcgcgatgacctcgcgcagcggctggcaactgggggcgagttcgcccaggcagcggtcgcaccactgttccaggcgttgcagttgctgctggcaggcgagcaggctggcctgcttgcgctgccattgcaccaagggctccgcgcgcaacgcttcgtcgagcttcttctgctgaagttgcgccgcttccagcgccgccttggcgctcttgctgtcgccgctggcgacctgctggcgctgcaacctctgccaggcatagagggtgatctcggcgaaggcgccctgccccatcagcggcaggcgcgtgtgcagcagctcggcatagcggcgcaacagccagtcgatgggcggcacccgccacgactggtcgccgtcctgggcttgcggatgcacctcctcggggtagcgctcgcagagttccgccagcagcaccagcgcgcgctgcaatccgcccagcccgccgcgttgcagccaggcctcgccgagccaggcggcgagcatcagatccttgctgcgccgctgcaacagatcgctggccaactgctccaccgcggcccagtcggcgcgcttggcctccgcctgccagacgccggtcggcaggctgctgtcatcctcccggcgcaactcgcgcaggcggtcgtagtccgggtcgtagcgcaggctggggccgcacggctgtccggggtcgatcggttcgagcagcacttccagggacagggcgttgccggaaagaggcagggtcatggggtacctcccgtgctggcgacggtggccggcaacagcgtcgcgaacggcgattgcggcgcgcgcaccggcagcggctggatggacagcggggtcttgccgcccaggctcatcaacgacaggcggaggaacatccgcgcctcgttttccgggctgtag

SEQ ID NO: 8970 - DNA, 492 bp, Pseudomonas aeruginosa
aagctgcggatctccgtaccaccgcgggttcgccaccaccagcccagcgcccccagcagcagcgccagcagcaccaggaggagaaccagcatgaacagggtcgcgccgctcatggcgcctgctccgcatcggccaggtgggtcaccgccgccatttcgtgctggatgtcgcgccagaacaggtgtccgataccgctcatcaacagcaccagcccgagcaccgccaggcccaggcggaagccgtccggcagcgctgcgcgcaccggcagacgccgtggcggcgcagcggcgggctgctcaaggcgacggccgaggtcggcggcgtccgcctcgcgctgccaggcgaaggcgaacaacgcctgccgccacttctcgtgcagcgcctcgccgcgcggcccgcgcaggcgaccgcggaagccgaggatcaggcattgcaggtagacgttggccaggtcgcgactggccggggcgcgttcgtcgagcaggcgcttga

SEQ ID NO: 8971 - DNA, 1464 bp, Pseudomonas aeruginosa
gcggctgctcctggtacgcctgggaaaaaggccctgcactcccttcgggcattggcggctccttcctgtctaggtgttgtcgctgccgtcggcgacgaacagcacgatctgccagggactgctggcgaccccgctgaccggcgcgacgatgcgcagcggctggccggcatcgaaccagtcgccggcaccctgcacgacgaacaaacgggtgtcgtcgccaacgctgtaggccacctgttcctggcgattcatcggctgccgcggcagcccgctcatgcgttgccgggcgagcaacggcaggtgcgggtcggaggcgacgatggcgcgctccagccagtcagccgccgcctgttcgccggcgccggcgggcatccgcaggccgaccaccaggcgctgacgcggcgccggatcgggcaggcgcacggaaaatacctgttcctcctgctcgaacggcaggcagcggtagcccgcgcggatcgactcgatggcccgctccagccagtccagcagcggctcgtagccacgccgcaggtcgaggaagtcgagcgcttcgaaggccggcacgccggccagcggatcgagcgccgcccaggcaccggccaggcccagcaggctgccgtgcagggccagcggcgaggccgtacggcttgccagcaggccttcgacctccggcaggcgggtccagagcgcggcaagctggcgacggatttccaccgcgtcgtcctggttgcccgcctgctgcgccaggcgcaggcgcccgccgaggaacagcgccttctcccgggcccgcgcgcaaagcgactgcacgcgtctgcccaggggcgactccggcaggatcagtggcgtcggcgggacgtagggcaggctgacgtaggcgccgccctccttcgccacgcgcagcaacggcaggcacacggagtcggccttgccgtcgtcgccgaccagccgcagcgacgctcgccagacggtgatcggctcggggtgctcgccgctggccaggtccggcagcggcgcgccgacccgcgattgcagacggcccttcagcggcagcaactgacccgcccgccacagcggactgaccgccaggtggacgttcagcagcggcccttcggcggccgccagcgctgtctccagatcgaactccagcggcgcgtcgacaccagcctgcacgctcaccggcaggccgtcgggcaggatcgcttcgaggtgcaggacccgcacttggccggcgcacaacgcagaggggtccagttccagggcggtcactccccagaaccaagggttgcaggcctgtccgatgcgcgccgccagcgcctcggcacgcaatccctgcaactggaaatgctggggaagcagttgcatcccttcgtgccagcacaccgcgtcaggcagaacactcatacgactccccttcgacgtcctacgttgtcgtgcacgacggtcgctcgcctgcccctccgctaa

SEQ ID NO: 8972 - DNA, 717 bp, Pseudomonas aeruginosa
acctgttctagcgtcttttgtagttcgtcgccagtgacggaccagagggatcgccaaggacaggttctgcgccgttttccctgtcatgcctgtgatccagcaagggactgcgatgatcagggcatccccccgatgcattgctcccccaccattgcatcggagtcagccgccatggccgagagtacgcagcacaagctggaccgggtgcgcccgccgcgcgtgcagatcacctacgacgtcgagatcggcaacgccatcgagaagaaggagctgcccctggtggtcggcatcctcgccgacctctccggcaagccggataccccgccggcgaagctggtcgaacggcgtttcgtcgacatcgaccgcgacaacttcaacgagatcctctcctccatctctccccgcgccaccctgcaggtcgacaacaccatcagcggcgacgacagcaagctgaacgtcgagctgcgcttcaaccacatcgaggacttcgacccggtcaacctggtgaagcaggtggtcccgttgcgtcgcctgttcgaagcgcgccagcgcctgcgcgacctgctgaccaagctcgacggcaacgacgacctcgaccagttgctgcaggacgtggtggccaacaccgaaggcctgcaggaaatcaaagcggcccgcccggaagccgaagcggccccggccggcgacagcgaacccccggccgaccagccggcctga

SEQ ID NO: 8973 - DNA, 1899 bp, Pseudomonas aeruginosa
ccctcttcccggagaagccgccatgcccaagtcatccgccgccgaacaatccggcgagagttcgacccagaccctgtccctgctcgacgagatcatcgcaaagggccgcatggcccacgacgacagccagcaggactatgcccgcgacatgctcgcggaattcgccacccaggtcctcgacgagggcatggccgtcgacaaggacaccgtggcgatgatcaacgaccgcatcagccagatcgatgcgctgatcagcgaccagctcaaccagatcatccaccaccccgagttgcagaagctggaagcctcctggcgcggcctgcaccaactggtgagcaacaccgagaccagcgcgcggctcaagctgcgcctgctgaacgtcggcaagaacgaactgcagaacgacctggagaaggcggtcgagttcgaccagagcgcactgttcaagaagatctacgaagaggaatacggcaccttcggcggacaccccttcagcctgctgatcggcgacttcaccttcggtcgccatccgcaggacatcggcctgctggagaagctgtcgaacgtcgccgcggctgcccacgcgccgttcatcgccgccgccagcccacgcctgttcgacatgaacagcttcaccgaactggccgtaccgcgcgacctgaccaagatcttcgagagcctggagctgatcaagtggcgcgccttccgcgagagcgaggattcgcgctacgtgtccctggtgctgccgaacttcctcctgcgcctgccctacggcccggagacgcgcccggtggaaggcatgaactatgtcgaggacgtcaacggcaccgaccactccaagtacctctggggcaacgccgcctgggtcctggcgcagcgcatcaccgaggccttcgccaagtacggctggtgcgcggcgatccgcggcgcggaaggcggcggcgcggtcgagggcctgccagcgcacacgttccgcaccagctccggcgacctgtcgctgaaatgcccgaccgaagtggcgatcaccgaccgccgcgagaaggaactcaacgatctcggcttcatttccctgtgccacaagaagaacagcgacgtggcggtgttcttcggcggccagaccaccaacaaggccaggctctacaacaccaacgaggccaacgccaacgcgcgcctgtcggcgatgctgccgtacgtgctggcggcatcgcgcttcgcccactacctgaaggtgatcatgcgcgacaaggtcggcagcttcatgacccgcgacaacgtgcagacctacctgaacaactggatcgccgactacgtgctgatcaacgacaacgcaccgcaggaaatcaaggcgcagtacccgctgcgcgaggcgcgggtggatgtcagcgaggtggccggcaaaccgggggcctaccgcgccacggtgttcctccggccgcacttccagctcgaggaactcagcgcgtcgatccgcctggtcgccaacctgccgccgccggtagcggcgtgagctcgcccccgccggcaccgccggcggggcgcccttcccgttccagacagcccctctccaggagtcagatgcgatggatgcgatcattctcgatttcggcagcgacatcaaaggcgacagcctgctcgtcggctacgaaaacaagatcgaaatcatgtcctacagccacaacgtggcgatgcaggtcaccaacgacgtcagcaactcggaacgcacctccggcaaaccccacgtcggcgaattcaccctcaccaagttcatcgacacctcgaccccgaccctcaacgagtattgctgcgccggcaagccgatcgccgaggcgaccatcaccatcggccgcaacgccgccgagggcaacgggcagatcatgcccttcatcgtctacaccctga

SEQ ID NO: 8974 - DNA, 1845 bp, Pseudomonas aeruginosa
  unsure (1605): Identity of nucleotide at the above locations are unknown.
cgcctgcgctgttcgtcatcgaacagggcaacgatggcctcgaggtgcgccatgagcgattcgattgatgccgacctgctcgactactaccagcgcgagctgacctggctacggcacgccggcggcgccttcgccgagcgctatccgaaggtcgcccggcgcctgcaactggcccccggcgaatgccccgacccgcacgtcgagcgtctgctggaaggcttctcgctgctcaccgcgcgcctgcaacggcgcctcgacgacgactacgcggagttcagcgacgccctcctcgaacagctctacccgctggcgctgcgcccgctgccgtcctgcgcgatcgtccagttcgaaccggacccgacccagggcaacctcgccgagggctaccggctgccgcgcgacaccgcgctgttcgtcaccacccgcggcggcgacagcgtgcatttccgcagcagcgccgaggcgaccctgtggccgctggcgatcgacgaagcgaccctgctcggcggcgaggaggcgcaagccctgaccggagtcggcgccgcccgctcggcgttgcgcctgagcctgcgctgcctgggcgagtaccgctgggaggagctgtcgatcgagcgcctgcgcatccacctggcggcttcgccgatgggctgcgcgatcctctacgacctgctcgccgcgcataccgtgcaggtcatggcgggggcgcccggcacgccgccggcggcgctctgcggaatgccggcgatcgtcggcttcgccgccgacgaggcgctgctgccggaggaagacggcggacatccgggcctgcgcctgctcgccgagtacttcgcctttcccgacaagttccacttcttcgacttgccgctgtccggcgcgctcgccgacggacaggcgctctacctgtacctggtcttcgatcgcgcaccgacggcacgcctgcatttgcaggcggaagacttccagctcggctgcgcgccggcgatcaacctctttccgcagacctcggagccgctgcgcccggacggcacccgcagcgagtaccgcctggtcgccgacagtcaccgcgagaacagcgtggaaatccatagcatccgcgccgtgcgctcggttgccgggagcaccgtgcagccagtcccggcgtactatggctgccgccacgacagccacctcggcacgctctactggcacgcccggcgcatcgccgggctgaccccgaaccggctgggcagcgatctgctgctgagcgtggtggataccggcttcgacccgttgcgcgagaccccggccttcagcctgaccgccgagctgctatgcaccaatcgctatctggccgagcgcctgggtgccggcaccgcgctgggcttcgaacggcccgggccggtcgccgccgcacgcctgcgcaacgcgcccagcgcgcagagccagccgcgcctggacggccaatcgcgctggagactggtctcgcagctgaccctcaaccacctctcgctggtggaaggcccgcgcgccctcgaagccctgcgggaaatcctcgccctgcacaacctgcgcgacgacgccagcgcccgccggcagatagaaggtctgcggcaactcgactgccancgggtggtggcgcacgtcggcgaggatgcctggcgcggctggcgcaatggcctggaaatccgcctgcgactcgatccgcagcacttcgtcggcgccagcggcgtgctgttctccgccgtgctggcgcagttcttctcgctgtatgccaccgccaaccgcttcgtgcgcacggtcctggtggaagccgacaaggaggtgaagacatggcaaccccaggccggctcgccgctctccctctga

SEQ ID NO: 8975 - DNA, 684 bp, Pseudomonas aeruginosa
gtcagcggctgcgccgcacgccgcagcgcttcgaactgttgcaggcgctgctgctgctcgaacgcgagcgtccccaggcgttgccgctgggcaccggcaacgcgccgcgggcggaggccctgcgcctgcgcgggccgctgctgccgctgttcgcctcgagcgaggtggaaagcctgctcgacgacccgcagcaaccggtgctgtccaccccggtgttcggcctcggcggccccgacggcccgttgccctatgcctaccaggaatggctgcaacaacgcgcccggcagaaggaccatgcccccgccgagttcctcgacctgttccagcaccgcctgctcagcctgctctaccgggtgctgcgccaagcatccgcttggcgctcggtttccccggtgccggcggcgaccccggtgcaggccgcagctacgtgccctcaacggcctgttgccaaaagccctgcatgagcgcctggcgctgccggacagcgcggtgctggcacgcaccgcgctgttcgccggcgggcgtcgctccctggccggcttcgccgggcctggtgcgccagcacttcggcgtggaggcacggctggacgcataccagggcgcctggaaggaaatccccacggccagccgcagcccgggtgcaacgcggcgggcgcaacctgcgcctgggtcgcgatgccatag

SEQ ID NO: 8976 - DNA, 2634 bp, Pseudomonas aeruginosa
cttgaaatggaactcgccgccctgatcggccgcctcaacccggattgtcgccgcgccctggagcgcgccgcgcaacgctgcctgcaacgcacccatcattacgtagagatcgagcacctgctgctggagctgctggacatcgacggcggcgacttcgcctgcctgctgccgcgcttcggcctggagcgcgacgccctggtcgccgagatcaacctgtcgctggagctgttcaaggccggcaatacccgcactccggcgctgtccgcgcacaccatcggcctgctcgaagacgccgtggtgcacgccagtgtgctcggccaggcgcagatccgttccggcctgctgctgctcgccttgctcgaccgcgaggagcgccgcgccctgttgctgaacagcgcgtcgtcgctgctgcggattccccacgaggccttgcaggccaacctgctggagtggatccaggcctcccgcgaacagccgcccgcgccgaaccgtccggcggcaggcggcgacaagccggaaagcgccccggacccgctgctcgaccagtacacccaggacctcaccgccgaggcccgcgccgggcgcatcgaccccatcgtcgggcgcgacggggaaatccgccagtgcgtcgacatcctcctgcgccggcggcagaacaacccgatcctggtcggcgcgccgggcgtcggcaagaccgcggtggtcgagggcctggccctgcgcatcgccgccggcgaagtgccgccgtcgttgcaggaggtgatcctgcgggtgctcgacctcggcctgttgcaggccggcgccagcatgaagggcgagttcgagcagcgcctcaagggggtgatcgacgccgtgcgcaacagcgcgcagccgatcatcctgttcatcgacgaggcgcacacgctgatcggcgccggcggcgcggaaggcggcagcgacgccgccaacctgctcaagccggccctggcgcgcggcgaactgcgcaccctggcggccaccacctggctggaatacaagaaatacttcgagaaggacccggcgctgacccggcgcttccagctggtccaggtcgaggagccggacgaggccaccgccgtggagatgctgcgcggggtcgccggcaagctggaactgcatcacggcgtgcagatcatggacgcggccatcgtcgatgcggtgaagctgtcgcatcgctacatctccggccgccagttgccggacaaggcgatcagcgtgctcgacaccgcctgcgcgcgggtcgccctcggccagcacgacgtgccgccgccgctggaaagcctgcgccatcgcgagcaggcgctggaagaggaattgcagcggctgcgccgggaacaggccaccggcctcgaccacagcgcgcgtatcaccgccctggaaagcgagtcgggcgataaccgccggaccatccgcgagctggagacccgctgggacgaggaacgcgaagcggtgcgcgaactgctcgacacccgccgcgaactgctggccctcagcgaaagcgccgacgcggccaagcccgacgaggaactggacggtcgcatcgaccacctggccgccgaactggcgcgcctggcggccggcctcgaagccatccgccaggacgacccgctggttcccgagcaggtggactcgcgtaccgtggccgcggtgatcgccggctggaccggcatcccggtgggcaagatgctcgccgacgaagcccacgccatccgttccctggcgcaacgaatgggccagggggtgatgggccaggaggccgccctgggcgccatcgccccagggcatccaggcctatcgcgccggactcagcgacccggccaagccggtcggcgtattcctcctgccaggccccaccggcgtgggcaagaccgagaccgcctacgccctggccgacgccctttacggcggcgaacgcaacctgatcagcatcaacctctccgagtaccaggaggcccacaccgtcagccagctcaagggcgccccgcccggctacgtcggctacggcagcggtggcgtgctcaccgaagcggtgcgccgcaagccctattcggtggtgctgctggacgagatcgagaaagcccatccggacgtgctggaagccttctacaacgtgttcgacaagggcgtgatggaagacggcaccggcctggtggtggacttcaggaacaccgtgatcctcgccaccagcaacgtcggcgccgaactgctgctggacagcccggccgaacaggtcgccaccccggccttcgacgagcgcctgcgcaaagtcctgctgcaaaccttccgcccggcgttcctcgcgcgcatgaccgtggtgccttaccggccgctggaggaagccaccctggaaggcatcgtcgtggccaagctggaaaaactgcgggaacgctacaaggccgctaccggcaaacagttcgacttcgacccggccatcgtcaaggccgtgctcgccaagtgcagcgcggcgggcgcgcgggatatcgagaacgtgctgatggcgcaggtgacggggaagttggcggagtgggtactcgaatgagcgtcccgaggcatcgcggcatccgcccgtttccgatggagaacgtatcggctagagaacagcggacgaattcatga

SEQ ID NO: 8977 - DNA, 882 bp, Pseudomonas aeruginosa
ccatcaccagccagttcgtcggtcagaaagccggctccgccgtgtgctacgagaacacactgttcaacgatgccctggtcggtcgcatcaacgccatcgttggcaacatcatcgtgcgccagagcgtcgcaccctgtacgcgctgccgcgccggctaccgccagctcgcccagaacggaccacgtactatcgtcgtctccagcgatgacggctacgacggcgcccccgacaacaccatcttcctcttcgcacccaccgggctggtgttctaccgacgctgaacgcccgccgaactgccccaccttcgaggactgccgtcatgccccgaaccatcgaatactggcgccccacgaacggcctgtatcatgcgaccccacccggaatcgccgtgctgacccaggacagcgattgggaggtgctcaacgaagccaccggcttctacgaggaaagcccgtatccctccgccttcaagggacaggtgtatcgcgcgctgaactacataaacgctacgccgacgggcgcatcgctgctctggaacctctacacgacgaacaatttcgtcgacatcaccccctcgtcgctgggcaacaatgtccagtccaccaatcagcccatggcgctcaatcaggtcgccagagaaatcatcgtaggaaccggtcccggcccccagacccagatcgcgctcaatcagacaggcatcgctccgcaggcgcagacccagtggctgacctatgtcatcaacagttcgccgcattgggccctggacggcgtgccgggcaacggtggtggcctttacggctatctagagcgcgcccgccagtatgccaaccgctggatgctgctgttcgaccaccgctacttccgctggagcgacagcaatga

SEQ ID NO: 8978 - DNA, 1527 bp, Pseudomonas aeruginosa
cgacgattcgctgaatatcgactgggtgctgatctcggtcgcccacgacgccagccacgcgcactaccgcaaccgcttcgaggcgatccccaaggccaccgcctaccgccccgcgcgggtcacgcccaagccgcgcatgcacacccagaccgccctggtggtgggcaaggccggcgaggagatctggaccgaccagtacggccggatcaagatccagttcccctgggaccgcgacggcaagaacgacgagacctcctcctgctgggtgcgcgtggtgctgccctggagcggcaagggcttcggcatgcagttcgtgccgcgcatcggccaggaagtgatcgtcaccttcatcgacggcgacccggaccgcccgctggtcaccggctgcgtctacaacggcgacaacgccctaccctacgcgctgccggacaaccagacgcagtccgggatcaagaccaactcgtcgaagggcggtggcggcttcaacgagctgcgcttcgaggacaagaaggacgccgaggaagtcttcctccaggcgcagaaggacctcaacgtcaacgtgctcaacgacagcaccgccagcatcggccacgacgagaccctgacggtgcagaacgcccgcacccgcacggtgaaggaaggcgacgagaccgtcaccctggagaaaggcaagcgcacggtgaccatccagaccggcagcgacagcctggatgtgaaggacacgcgcacggtgacggtgggcgccgaccagacccacagcaccggcggcaactacagccacaaggtcagcggcaacttcgagctgacggtggacggcaacctgaccatcaaggtcagcggcaccctcgccctgcagagcggcggcagcctgaccctgaagagcgacgccgacctcgccgcccaggccggcacctcgctgaccagcaaggccgggacgtcgctgaccaaccaggccggcacctccctcaccaacaaggccggcaccagcctgaccaacgatgccggcgtcagcctgaccaacaaggccggcgccgaacagacggtggacggcggcggcatgctgaccctcaagggcggcctggtaaaggtcaactgaggagaagcgcatggcggcatccggcaagctcgacctggttcgaggcgacagccatctcgccggcaacctgctcgacggcagcctggaaggtccgttgcgcatcgacgagcacgacaggccgcaggccagcctcggctaccgacagggccagttgcacggcgccagcaccctgctccatcccaacggcaaggtctccgcgcaactcgccttcgtcgacggcaagctgcacgggccggccagtttccatgccgcggaaggctggttgcagcgcaaggcgcactaccgcaacggactgctccacggcgaagcgctcaactatttcgccaacggccaggtggccgagcgcgagcattaccgcgacggcgtgcgcgacggggtctaccagcgcttccatggcaatggccaactggccttcgacggacgctacctga

SEQ ID NO: 8979 - DNA, 786 bp, Pseudomonas aeruginosa
tgcggggcggagctccgcgacagggatcgacgaaaaaggattttcggcggatcgaacggtgcccgcagcgccctcgccggccggcccgcggccggtcgatgcaggggttgccgtaccctggccgcccccatggacgggacgacaatgcctagcacaagaagcctccccgcacgggtcatcgtcgccgatgactatcccctgttccgcgatggcctgagacgggtcgtccgccgctacctcccgcaagccgccgtaagcgaagcgggcagcttcgacgaggtgctgcgcctggcctcgagcgtctcgccggaacctcccgccctcttcgtcctcgacctgctgcttcccggcttcgccgcctcccagtccatcgagcgcttgcgtcgcgcctatcggcacagcgcaatcgtcatcgtctcgatgctcgacgacccgcgtctggtggacgaggtgctggccgccggcgccgacggctacctcggcaaatccctggaggccggggagatcggcacggcgttgcagacgctcggcagcggcgaaccggtggtgcgcctgcgcggcgggtcgagcgccggcagtcggcaacgcgccctcctggacgccctgaccccacggcagcaagcggtactgcggctgatcgccgatggcctgtcgaacaaggaaatcggccgcgcgctgtcgatctctccgttcaccgtgcgcgtgcacgtttcctcgctgctgcgcgccctggaagtgaacacgcggacggccgccgcggcgctggcggtgaaggccggcttctag

SEQ ID NO: 8980 - DNA, 1530 bp, Pseudomonas aeruginosa
tgctcggcgccaccgagcgatgcagccaagcctgccggaaccccgtcgggcgccgaccacggcctggcaggcgctccaccggatactgtgtgggaaattgggggaaatgcagatggtccccccgggttccactggcacccgcaagtggcgaccggggaacgccttggccaggatcgccgcttccagcacgaagtcgggcttggacttgcggccgaaaccgccgccgagcagggtcacgttgaccgtgaccttgtcgaacggcagcttcaggcgctcggcgatgcgctcgcgggtcacttgcggcgcctgggtcggggcccagacttcgcaggcgccgtccttgtaccaggcggtggagaccggcggttccatcggcgcctgggccaggtgcggcaggtagtactcggcctcgacgatatccccacccttggcgaacagcgccgcggcatcgccgctgtcgcgcaccaccttgcccggcttgcgcgcggcctcttccagttgcttgcggtaggccaccgagtcgtagccgccgttgaccccggcgtcccactcgaccgccagcgcctcgcgccccttgatcgccgcccaggtgttctgcgccaccacggcgaccccgcccagcggctggaactcggacgggatcggccggccctcgatctcgatcaccttgaccacccccggcaccttcagcgccgcggcggcgtcgtagcgcttgagcttgccgccgtagaccggcggccgggcgaccacggcgtagagcatgtcgtcgaagcgcgcgtcgaagccgaagccggcgcggccattgacgatatcggcgccgtcgatggcgcgcgccacgtccttgccgatgtagcggaactgctcgggcttcttcagcagcagcttgtcgcgcgccggcacttcgagacccgcggcggcctcggccagttcgccgaaggacagcgaacggccgctgggcgcatgcagcaccttgttctgttcggcgcggcactcgcccagcgggaccttccactggttggccgcggcctgttcgagcatctgtcgcgccgccgcaccgcagcggcgcatgggttcgaaccaatggcgcatgctgcgcgagccatcggtgtcctggttgccgtagcgcgcttcgtcgccgggcgcctggatcaccttgacccggctccagtcggcctccagctcgtcggccaccaccatcgccaggctggtgcgcacgccctggcccatttccgagcggttgcagacgatgccgaccgtgccgtcccggtcgatgctcacgtagatcttcgggttgtccacccagccgtggggcatggcgtcggcgccgaaggccttcttctcggcggccagggcgtcgcgccagccccagttggcagccaccagcagcacgccggtggcgccgacgcccttgaggaaaccgcggcggctgagattgccgatgaccagatcgtcggggtacgagcgcttcatgccttggcctcctgcaacttggcggaggcgttgtggatcgccgtcttgatccggttgtag

SEQ ID NO: 8981 - DNA, 267 bp, Pseudomonas aeruginosa
ccgagaaagcaagcggaggcacccatgaaccacactgcatcgatccccgccctgcccacggcctatgacctgctgaacacccgcatccagcgcatcatccacgccccggccgcgcaacaggcctgccaggcctgcatttcccgattgcccggcgaagacgagggcgactgggcccacctgctggaaagcttcgaccgttccaaccagtggctgctcgacccgcagcgcgacggcagcatcgtcctgcgctggagttccgccgcctga

SEQ ID NO: 8982 - DNA, 609 bp, Pseudomonas aeruginosa
ggacggccgatcatggtcccgcgcgcaccgagggcgatggccttgagcacgtcctgcccggaacggatgccgctgtcgagccagacctcgatgcgctcgcccaccgcctcgacgatcgccggcagcgcgctgatggtcgagggcgcgccgtccagttggcgtccgccatggttgctgacgaccagcgcatcggcgccggagtcggcggccaaccgcgcatcctcggcatcgagaatgcccttgagcaccagcttgccgccccagcgccgcttgatccattcgacgtcgccccagttcagccgcgggtcgaactggcgggcggtccactcggacagtgagcccatgtcgtcgacgcccttgacgtgcccgacgatgttgccgaaaccgcgacgccgggtgccgagcatgcccagcgcccagcgcggcttggtggcgatgttcagcaggttggccagggtcggccgcggcggcgccgagagaccgttcttcaggtccttgtggcgctggccgatgatctgcaggtcgagggtcagcaccagcgcgtcgcagccggcggccttggcacggtcgatcaggcgttcgatgaaatcgcggtcgcgcatcacgtag

SEQ ID NO: 8983 - DNA, 1149 bp, Pseudomonas aeruginosa
tggtgggtgggcgccgaacgcagcgggaacagcaccaccagccgcccctcggcaagccaggcgcgcgccagcgagggtcgcgcgagggccacgccctggccgttggcggcggcttccagggtcatgcccaaatcgagcaggcgcggcccggcgcagggctccggccagtccagcccggccacgcggaaccacggctgccagggctccagcggcgagcgcagcaacggcaggccagcgagcatggctggcgtccagggccgcggcaggccgagcagcagccccggcgcggccatcggtagcacgcgctcctccagcagccgctcgccggccgccacgccatggctgtcgccgcgcacctcgacatcggccagcggcaggtcctggccgtccgaaggactcgacaggagaatctccagctcgatttccggacaggcctcggcgaaggacgccaggcgcggaatcaggatctgccgggcgaaggtcggcggcgtgcgcagggtcagccgctgctggcgctggacctggcgacgatgcagcggaaccgccgcgagctgggcgaggatcggcgcgatctgttcgaggtactcgcggccgtgggaggtcagcgccagcgagcggccgtcgcgctgcaacaggctcaccccgagcatcccctcgagaccggaaacccgcttgctggcggcgctgccggtgatcgacaggagttcggcggcgcgctcgaaggtacccagccgggcagccgcttcgaacgcctgcaacgcttcgatggaaggaaaacggaaatcgtcgggattgagcatggggcagactttacccgctgcccgagatcagggataccgcgtcagagccgctgctcgttggccgcggcgcggcgctcgggcgccgcggaaccggcggcaccgccccaggaagccttgccggggctgtagacatcctgttcgtcgagggtcaccaggccgctttccaccaggcgcccgaggacctggcggatgctcaccagggacagcggcgtaccggtttcggagagacgccggtgcagggtgcggatcggcacccggccctgctcccccgaggcttcccagagcgcatcgatcactttcagccgggccaggctcatcttcaggccggcctccttcaacatctgtttga

SEQ ID NO: 8984 - DNA, 456 bp, Pseudomonas aeruginosa
acggcaaggtctgccattgctggcgggaaaacagctcggtctggtcgcggtagtgcggcgagcgcggatcgctggactgggagaaagccagcaacccgcgagccttgggcccttcctcggggaaggtcaccagctggatgtagctggtgccgccgaccacctccaggtggtcgcccttgcggacgctctggatcgcgttgtagaccccgaaatggccatcgccgccgggaatcgcgatgcgttcctggccacgggtgctcacttgcaggtcgccccagcgcgcgccgtcgggaatcccgctcttctccacctccgccgccgcgtccgccagcgcctggcgcacctgggtcgccacctgcggccggtcgagggcgatgccttgcggcgtatccaggggacgttgcgcatcgaacggttccttccacgcgccgtcgagttcggcgaagcgttgcatga

SEQ ID NO: 8985 - DNA, 1746 bp, Pseudomonas aeruginosa
ctcgccgctaccggcgtcgcgcaacgccagctcgatgccctgggcggtggcggtcgcgcgctccacggtggtcatgcaacggaaggcgtggcgcgggatgccggagactttctggcggtagaagacgccgtagatgcgctcgatcaggtcggtatccaccaccgaatagttggtgttgtggtattcgcgcagcaaacgctcgcgttcggcatgttcgcggctgtagatgagatcggtgaacttcggcgcgaacacttcgttgacgaacgggctatcgtccgccggcttgagcgccgaggcacgcaggatcatgtcggcctgcaccgacgggtagctgtcgttgaggtcgatgaaggcctccgccgcgctctgcccgccgccgataatggcgatcttcatcggcttgccactgctgcagggctgcttggccatgtgttccaggtactggctgtggtggaacacccggccgtcgcccttgagcgcacggaacacctgcgggatacgcggggtgccgccgggactgaccaccagggcgcggatggtgcgcaccagctcctcgccgtcggcgttgcgcgagatcacccgcagcgcctcgacctggccggcgctcagcatcggctcgatgcgcaggacctcttcgccgtagcggctctgctcctggaagtggctggcgacccagcgcaggtagtcgttgaactccatccggcagggatagaaggtgcccaggttgatgaagtcgaccagacgatcgtgcttgtgcaggtagttgacgaaggaatacgggctggtggggttgcgcagggacaccaggtccttgaggaaggagatctgcaactcgctctgcgacaccagggtgttgccgtgccagcggtagtcgccctgcttgtccaggaacagcacttccagggcgccctgcgcctgggcccgttcctggagggcaatcgccagggcgatattggaagggccgaagccgacaccgatgagatcgtgaaccacggcggttgcagttgcctgagtcatttccagttcctctggattggccccctttcaagcgggagcgataagtcgagagcagccctggagggccatctgttgactaggaacgaggacagggaaatgaaatttaagcgttgccgagcacgaatagcgaaatcagtcggcttcccattcgcgcatgcgcacccgacagtgcttcatcgcgttgacgatgtgcttttccaccaggctgcgggaaatattgagatgttcggcgatctgcgaatgggacaggccgtccagcttgcgcaacaggaaggaactgcggcagatggccggcaactcggccagcgcgcgctgcaggttgtccaggcgctgcccctggtcgaccaccgtctgcggcgagggactggccaggccctcctcgtcgtccaggacctccaggggttccgcccggcgcacccggctacgacggtgctcgtccaccgccaggttgagcgccgtccggtacagaaaagccttcggatgctcgatctgcgcttgactggagcgctccagaacgcgcaaatacgcgtcgtgggcgacatccgccgctgcatgtcgatccccgagcctggcactgaggaatcgcagcagctcccgataatggttttccaagacgactcctgctcgctgcctctacggcactgtccttccaagggcgggatcgcctgccggcgacattggcagtatgaaatcattaaatttataataattctcatcaagctttaa

SEQ ID NO: 8986 - DNA, 3450 bp, Pseudomonas aeruginosa
tggccgctcccgacggcagcgacagctgatggaaaacgccacgcaacccgtccccctgatcgaactgcgcgacatccgcaagcgctacggcggcaatggcactccggaagtcgaggtactcaagggcgtatcgctgtcgatccacgccggcgagttcgtcgccatcgtcggcgcctccggctccggcaagtcgaccctgatgaacatcctcggctgcctcgaccggcccagctccggcagctaccacttcgccggccacgacgtcgccgaactggacagcgacgagcaggcctggctgcgccgcgaggcattcggcttcgtgttccagggctatcacctgatcccctccgcctcggcccaggaaaacgtcgagatgccggcgatctacgccggcatcccggcgagcgagcggcacacccgagcgcgggccctgctcgaacgcctgggcctggccgagcgcaccgccaaccgtccgcaccagttgtccggcggccagcagcagcgggtgtcgatcgcccgcgcgctgatgaacggcggccatatcatcctcgccgacgaacccaccggcgccctcgacagccacagcggcgcggaagtcatggcgctgctcgacgagctggccagccagggccacgtggtgatcctgatcacccacgaccgcgacgtcgccgcccgcgccaagcgcatcatcgaggtgcgcgacggcgagatcgtcagcgacagcgccaacgacgagcgcccggcgcaaccgagcgccggcgtcgagcgccacctgcaggccgacgatctcagccagcgcctcgccgagggcagcagcgaaccctcgggggcctggcgcgccgaactgctggaggcggtgcgcgccgcctggcgggtgatgtggatcaatcggttccgcaccgcgctgaccctgctcgggatcatcatcggcgtcgcctcggtggtggtcatgctcgccgtcggcgagggcagcaagcgccaggtgatggcgcagatgggcgcgttcggctcgaacatcatctatctcagcggctactcgccgaacccgcgcgcgccgatgggcatcgtcagcagcgacgacgtcgccgccatcgccaccctgccccaggtgaagaaggtcatgccggtgaacggcggcgagctggtggtgcgctacgggaacatcgactaccacgcctacgtcggcggcaacaacaccgacttcccggaaatcctcaactggccggtggccgagggcagctacttcaccgagcgcgacgaagacgccgccaccacggtcgcggtgatcggctacaaggtgcgcaagaagctgttcggcagcgccaacccgatcggccgctacatcctcatcgagaacgtgccgttccaggtcatcggcgtgctcgccgagaaaggctccagctccggcgacaaggatgccgacaaccgcatcgccatcccctactccgctgccagcatccgcctgttcggcacgcgcaaccccgagtacgtgatcatcgccgccgccgacgcccagcgcgtgcaccaggccgaacgcgccatcgaccagttgatgctgcgcctgcaccgcggccagcgcgactacgagctgaccaacaacgcggcgatgatccaggccgaggcgaagacccagaacaccctgtcgctgatgctcggctcgatcgccgcgatctccctgctggtaggcgggatcggcgtgatgaacatcatgctcatgaccgtgcgcgaacgcacccgcgagatcggcatccgcatggccactggcgcccgccagggcgatatcctccgccagttcctcaccgaggcggcgatgctctcggtggtcggcggcctggccgggatcgccctggccctgtgcatcggcggcgtgctgctgctcggccaggtcgcggtggccttttccctgtcggccatcgtcggcgccttcagttgcgcgctggtcaccggcctggtgttcggcttcatgccggcgcgcaaggccgcccagctggacccggtggccgccctggccagccaatgacggatatgtccatgaagaatctctccctgatttccgcctgcctgctgctcggcgcctgcggcagcacgccggcgcccctcgacagcggcctggccgcgcccagccagtggcgctacctggcggccgggcgcagcgatgccagcgacatccgccagtggtggaaggccttcggcgcgccggaactggacagcctgctgcaacgcgccctgctgaacagccaggacctcggcgcggcggtggcccgcgtacgccaggcccaggcctcggcggtgatcgccggcgcgccgttgctgccggagctgaatgcgacgctcggcgccagccggcagaaactcctgcgcgactcgggctacagcggtaccgacgcgacctccgacaacgatgccgtcgactccttctccgccggcctcagcgccagctacgaagtggacttctggggcggtcgccgggctgcctaccgcagtgccctggaaagcctcaaggccagcgagtacgaccgcgcaacggtagagctgaccctgctctccggcgtcgccaacagctacctgcaggtattggcgctgcgcgaacagcagcgcatcgccaggctcaacctggacaacgccgagcacgtcctgcgcctggtggagacccgccatgccgcgggctcggccaccgccctggaggtcgcccagcagagcagcctggtcgccagccagcgcaagcagctgccgctgctcgagcagcaggcccatgaggcgctgattaccctggccaccctgatcggcgagccggtgcaggcgctacaggtggccgagcggcctttcgacagcctgcgctggccggagaccggagcgggcctgccgagcgaactgctcagccgccgtcccgatatcgccaacgccgaagcgcaactggccgcggcccaggccgacgtgcaggtggcgcgcgcggcgctgttccccaagctgaccctgagcgcctcgctgtcgtccggcgccaaccgcgccgccgacactttccgcaacccctattacaacctgggcgccaacctgctcgccccgatcttcaaccacggccgcctgcgcgccgagcgcgaccgcagcctggcgcgccaggaagaactgctggaaacctaccgcaaggcgatcctcaccgcctttgccgacaccgaacgctcgctgaacagcatcgacggcctcgaccgccagctgcactggcagcagcaggagctggagcaggcgcagcgcgccttcgatctctccgacagccgctaccaggccggcgcggaaaccctgctgacggtcctcgaaacgcaacgcacgctgtacgcggcgcaggatgccgccgtgcaactgcgactggcccgcctgcaggcctcggtcggcctgtacaaggccctcggcggcggctggcagagcgaccgccagggtctcgcgcggaaagactga

SEQ ID NO: 8987 - DNA, 1413 bp, Pseudomonas aeruginosa
tcacccgcggttattccgatgccgacatcgccaagctctggggaggcaacttcctgcgcgcctggggcgaagtgcaaaaacgcgccaagccgacagccaccccctgaccacgccgcaacggacctcccgatgaacgaccgtcgtacctttctcaagcaggccggcattctcgccgccggcctgccgctgctttccgctgcccagtcgctccgcgccgaaggcgtaccgagcgacgccggcaataaatggaaagcgctgcgccagcaattcgatctcgacccgcagtatctgcacttcgccaacttcctcctcacctcccaccctcggccggtgcgggaggccatcgagcgcctgcgggtccgcttcgaccgcaacccgggcgaagcggtggactggcatcgcgaggaaatctggaaatacgaggacgaggctcgcgcctgggcaggtcgctacttcgccgtgcaacctggccaggtggcgctcaccggcagcaccaccgacggcctggcggcgatctacggcggcctgctggtgcagccgggcaaggagatcctgacctcctcccacgagcactactccacctacaccaccctggaataccggcacaagcgcatgggtacccaggtccgcgagttcccgctgttcaaggacccgcaccgggtttccgccgacgagatcctgtccagcatcgccgctcagatccgcccgcagacccgggtgctgggcatgacctgggtgcagtcgggcagcggcgtgaagctgccgatccgcgagatcggcaagctggtgcgcgaactcaaccagaagcgcgacgagcaggaccggatcatctacgtggtcgacggcgtgcatggtttcggcgtggaagacgtcagcttcgccgacttcgactgcgactacttcatcgccggcacccacaagtggctgttcggcccgcgtggcaccggggtcatcatcgcccgctcggaacagctccaggagcacctggtgccgagcatcccgaccttctcccgcgccgacaacttcggcaccctgatgacccctggcggctaccacgccttcgaacatcgcctggccctgggcacggccttcgagctgcacctgcagttgggcaaggccgaggtccaggcgcgtatccaccagctcaacgcctacctcaagcagcgcctgggcgagcatcccaaggtccgcctggtcacgccgaccagccccgagctgtcttcgggcttcaccttcttccgcgtcgaaggccgcgattgcgaggcggtcgccaaacacctgatggcgcaccgggtaatcagcgacgccgtggatcgcgatgtcggcccggtggtgcgcctggcgccgagcctgctgaacgacgaggcggagatcgaccgggtgctggaaatcctcgccccgcaactcgcctga

SEQ ID NO: 8988 - DNA, 1053 bp, Pseudomonas aeruginosa
cccctttcgccactcaacgagaaccgccatgcacgcattatcgcccctggccctggccgcactgatcgtcgccaccgcccccgccttcgccgacgaagcgaagaaacccggcacggtgttcaaggattgcaaggactgcccggagatggtcgtactgcccgccggcagcttcaccatgggcaccccggacgacgaggtcggccgccagcccgacgagggcccgctgcacgacgtgaccttcgccaagccgttcgccatcagccgctaccaggtcaccgccggcgaactggacgcctacctgaaagccaccggcgtcaagctggccgacggcgatacccgccccggccgcgaatgcatcgccggcaagccgcgctaccagcaaggccctcgccagccggcggtgtgcgtcgactacaacgacgtgaagaactacgccgcctggctgtcgaagaagaccggcaagcactaccgcatgctcagcgaggccgagcgcgagtacggcgcccgcgccggcagcgccggccccttccccttcccgttcgacgaaggcaaggaatacagcatcgccaagcacgccaacacctacggcgccagcgatggctacaacttcacctcgccggtgggcagcttcccgcccaacgccttcggcgtctacgacatgcacggcaacgtctacgagtgggtcgccgactgctggcacgaccactacaacggcgcgccgagcgacggcagcgcgtggatggaggacaagtgcgagctggtgcagatccgcggcaacgactggggcgagccgccgatcttctcgcgctcgggcaaccgcaacaatgcggcccccagcgaccgcggcgactggatcggcttccgcgtggcgcgcgaactctgattcagaatgaagaaggccggagcgacgacaccgctccggccttttcgaacccctcgaaggaaccgggttcagagcttctcggcgagcagcgccagcccttcgtgcaaggccgggaacaggctgttgttgaagttgttccagcgcagctcgaggatggtgtcgtcgggtga

SEQ ID NO: 8989 - DNA, 510 bp, Pseudomonas aeruginosa
atcccgacaccatgcttaccgtcggcgccgactatcaggacaacgatcccaagggatcgggctggtcgggcagcttcccgctcttcgacagccagggcaaccgcaacgacgtctcccgctccttcaacaacggagccaagtggagcagttgggagcagtacacccgcaccgtcttcgccaacctcgagcacaatttcgccaacggctgggtcggcaaggtgcagctcgatcacaagatcaacggctaccacgcgcccctcggcgcgatcatgggcgactggccggcaccggacaacagcgccaagatcgttgcgcagaagtacaccggcgaaaccaagagcaactcgctggatatctatctcaccggccccttccagttcctcggtcgcgagcacgagctggtggtcggcacctcggcttccttctcccactgggagggcaagagctactggaacctgcgcaactacgacaacaccaccgacgacttcatcaactgggacggcgatatag

SEQ ID NO: 8990 - DNA, 402 bp, Pseudomonas aeruginosa
acgatacctactccgtctacgccagctataccgacatcttcatgccgcaggacagttggtatcgcgacagcagcaacaagctgctcgaacccgacgaaggccagaactacgagatcggcatcaagggtgaatatctcgacggacgactcaataccagtctcgcctacttcgagattcatgaggaaaaccgcgcggaggaagacgccctctacaacagcaaaccgaccaaccccgccatcacctacgcctacaagggcatcaaggccaagaccaagggctacgaggcggaaatctcgggtgaactggcgccaggctggcaggttcaggctggctatacccacaagatcattcgcgacgacagtggcaagaaggtttccacctgggagcctcaggaccagttga

SEQ ID NO: 8991 - DNA, 1239 bp, Pseudomonas aeruginosa
gtgaccgcccagttcgaagaagttgtcgtccaggccgacccgttccactcccaggatctccgcccagatcgctgcgatgcgctgctccagctcgctaccgggcgctcgataggcctgctgcgacaagctcgcatccggttgcggcaacgcctgccggtcgagcttgccattgaccgtcagcggcatccgctccagcagcatcaggtgcgccggcaccatgtagtccggcaggtgccgcttcagcgactcccgcagcgactcccgcagacgctcggcatcctccgccgagtccgccaccacgtatcccaccagttgcgtgccgccgaccccgtcatgggccagcaccacggcatcacgtaccccggccagaccggcgagcgccgcttcgatctcacccagttcgatacggaagccgcgaaccttcacctggtggtcgatacgcccgatgtactcgatattgccatccgcctggaaccgtgccaggtcgccggtacggtacagccgctcgccggcaccgccggggaacgggttcggcacgaagcgggtggcactcaacccgggccgcctcaggtagccgcgcgccagaccggcgcgaccgatgtacagctcgcccaccgcgccgcgcggcaccgggttcaggtcacggtcgaggatgtaccaggacaggtccgggatggtcccgccgatcggactgaccaggccacccttcaggtcggcttcgctcaccggacggtaggttacgtgtaccgtggtctcggtgatgccgtacatgttcaccagttgcggctggcgatcgccgaagcgctggaaccacggccgcaggctctgcagatccagcgcctcgccaccgaagatcacgtagcgcagcgccggctgctgcgtcgccatgtcggcggaacaggccatcgccatcagttgcttgaacgccgacggcgtctggttgagcaccgtcacgccttcgcggcacagcagacggtagaagtcttccggcgaacggctcacccattgcggcacgatcaccaggcgcccgccatagagcagcgcgccgaagatttcccagaccgagaaatcgaaggcgtaggaatggaacaacgtccacacgtcccgctcgtcgaagccgaaccaggcctcggtggcgctgaacaggcgcagcgcgttgcggtgggtgagcaacgtgcccttgggcttgccggtcgagcccgaggtatagatcacgtaggccaggttgtccgccgataa

SEQ ID NO: 8992 - DNA, 1494 bp, Pseudomonas aeruginosa
gcgcaaggcactcggaatatggtaggccgcgctttccggctccagttgccagaggaaccactgacgctcctgagcgaaggacagtgccaacggttgctgccgatcggcaagcggtatcgtcgagaccgcatccgtcgtgcgttccaatccctgggcgaacgcttccagaaccggccgctcgaacaacgccttcaggcttgcgtccaactgctgctcctggcgaacccgagaaatcacccgggtagccagcaacgaatgaccgcccagttcgaagaagttgtcgtccaggccaacccgttccactcccaggatctccgcccagatcgctgcgatgcgctgctccagctcgctaccgggcgctcgataggcctgctgcgacaagctcgcatccggttgcggcaacgcctgccggtcgagcttgccattgaccgtcagcggcatccgctccagcagcatcaggtgcgccggcaccatgtagtccggcaggtgccgcttcagcgactcccgcagcgactcccgcagacgctcggcatcctccgccgagtccgccaccacgtatcccaccagttgcgtgccgccgaccccgtcatgggccagcaccacggcatcgcgtaccccggccagaccggcgagcgccgcttcgatctcacccagttcgatacggaagccgcgaaccttcacctggtggtcgatacgcccgatgtactcgatattgccatccgcctggaaccgtgccaggtcgccggtacggtacagccgctcgccggcaccgccggggaacgggttcggcacgaagcgggtggcactcaacccgggccgcctcaggtagccgcgcgccagaccggcgcgaccgatgtacagctcgcccaccgcgccgcgcggcaccgggttcaggtcacggtcgaggatgtaccaggacaggtccgggatggtcccgccgatcggactgaccaggccaccttccaggtcggcttcgctcaccggacggtaggttacgtgtaccgtggtctcggtgatgccgtacatgttcaccagttgcggctggcgatcgccaaagcgctggaaccacggccgcaggctctgcagatccagcgcctcaccaccgaagatcacgtagcgcagcgccggctgctgcgtcgccatgtcggcggaacaggccaccgccatcagttgcttgaacgccgacggcgtctggttgagcaccgtcacgccttcgcggcacagcagacggtagaagtcttccggcgaacggctcacccattgcggcacgatcaccaggcacccgccatagagcagcgcgccgaagatttcccagaccgagaaatcgaaggcgtaggaatggaacaatgtccacacgtcccgctcgtcgaagccgaaccaggcctcggtggcgctgaacaggcgcagcgcgttgcggtgggtgagcaatgtgcccttgggcttgccggtcgagcccgaggtatagatcacgtaggccaggttgtccgccgatag

SEQ ID NO: 8993 - DNA, 378 bp, Pseudomonas aeruginosa
agctggaccagttcctcgaccatcaattgcatcgaccaaccgtcggagacgatatggtgctggaccatgaccagcacatgctcgtcggcgtccacctccagcaaagtcacccgcagtaacggtccctgttcgagatcgaagggtcgtgcgatctccgcctcgacccgctccagcaatcgctgttcgtcgagtccccgttgcacttcgacttcgagcgccagcgagacgtcggcggagacgacctgcacccattcatcacccatccgcgcgatccgcgtgcgcaggctttcgtgccgctcgacgagcgccgcgaagctgcgctgcaaggacgcaatgtccaacctgccgcgcaggcgcagggcggtaggaatgtggtag

SEQ ID NO: 8994 - DNA, 594 bp, Pseudomonas aeruginosa
tgttcgaccagggcctgcaaggccgcttcgagtgccttcgcattcagggcctcgcgcggcttcaacagcaatgactggttccagtgctggcgattgggaatcggctgttcgaagaacaaccgctggaacggcaacaacaccgtctcgccgctcacaggcccctgctccatttgcaccgcagcccctacgcgggcgactcgcgccagcccctgtacggtctgttgttggaacaggtccttcggagtgaactggatgcccgccgcacggcatcgactcaccacctggatcgaaacgatggaatcgccacccagggcaaagaagttgtcggtggcgcccacctcctccagcttcagcacgtccgcccagacggccgcgatacgtcgctccatttcattctgcggcgcaacatgcgtctgccccgcagcagcttgcggtcgcggcaacgccttgcgatccagcttgccgttcggactcagcggcatccgctccagcgccagccactgcgccggcaccatgtattccggcaggctcgccgccaggtgcgcggtcagggcttcgcgccagtcgccgctctcgctctccagcaccacgtag

SEQ ID NO: 8995 - DNA, 333 bp, Pseudomonas aeruginosa
gcaatgagcatccacacccgcccctggcgcctgcccctggccgccctgttgctcggcctgagcggcgcggccctggcgcacaacccgatctgcgaatgcgaggaagtgcaggccggcgagatccgctgcaagggcggcttctccgacggcagcggcgcccccggcgtaaccctcgacgtgatcggctacgacgagcagatcctggttcccggcaagctcggcgccgactcgaccctgaccttcaagcgtcccgacggcgagttctacgtgctgttcgacgccggccccggccacgtggtggaaatcgaccacgccgacatcgccgcgccatga

SEQ ID NO: 8996 - DNA, 273 bp, Pseudomonas aeruginosa
atgccgccgaacagggcatctacgccgacctgcaggtcgccgccgaagacatccaggcgcgcctggacgacggcgaagccgcgccctccgtcgacgaactggccgccgagggcttcccgcccttcgtcgccgacatcgccgcgagcagtcgcggcgagcaccgctggagccacggcgaaaccgccgggcgtccgagctacctgggcgtcagcggcaaacccgaggtggccggctcgttcctcctgctgctcggccccgccgaagtctggctga

SEQ ID NO: 8997 - DNA, 1758 bp, Pseudomonas aeruginosa
cccgtcagcaccgccattgatcgcacatcgactccacagaaggcgtttttccatgctgttctcccgtcgctcatcccgtccgcgcggcctcgccgccctcctcccgggccgcgccctgctggccgccctgctgctggccctgctcgccccgctgacccaggccgaagacggcaaacgcctgcgcatcggcatcaccctgcatccctactacagctacgtgagcaacatcgtcggcgacaaggccgaggtggtgccgctgatccccgccggtttcaacccgcatgcctacgagccgcgcgccgaggacatcaagcgcatcggcacgctcgacgtggtggtgctcaacggcgtcggccacgacgatttcgccgagcgcatgatcgcctccagcgaaaagcccggcatcccggtgatcgaggcgaacgccaaggtgccgctgctggccgccaccggcatggccgcgcgcggcgccggcaaggtggtcaacccgcataccttcctgtccatcagcgcctcgatcacccaggtcaacaccatcgcccgcgaactgggcaagctcgacccggccaacgccaaggcctacacccgcaacgcccgggcctacgccaagcgcctgcgggccctgcgcgccgacgccctggcgcggctgaacaaggccccggccgccgacttccgcgtcgccaccatccacggcgcctacgactacctgctgcgcgaattcggcctggaagtcaccgccgtggtcgagccggcccacggcatcgagccgagtccgagccagttgaagaagaccatcgaccagctcaaggcgctggacgtgaaggtgatcttctccgagatcgacttcccctccacctacgtcgagaccatccagcgcgagtccggggtgaagctctattcgctgtcgcacatttcctatggcgactacagcgccggcaagtacgaggaagaaatggcgcgcaacctcgacaccgtggtccgcgccatccaggagtccggcgcatgaccgtggccgaacggctttgcgccacgccttgcgggccggccatcgacttcgccgggatcgacctgagcctcggcggcagccgcatcctcgatggcgtgcgcctgcgcgtcgaggccggtagcgtgcacgcgctggtcggaccgaacggcggcggcaagagttcgctggtcaagaccctgctcgggcagatgccgcatcgcggcgagctgcgcctggagtggcccggcgcgcccggctgcatcggctacgtgccgcaggcgctggagttcgaccgcggcctgccgctcaccgtcgacgatttcatggccgccatgtgccagcgccgtccggctttcctcggcctgtcgcgcagccggcgcccggcgatcgacgcggccctggaacgggtcggcatgctggccaagcgcggtcggcgcatgggcgccctctccggcggcgagcgccagcgcgtgctgctggcccagggcctggtaccgccgccgcaactgctggtgctggacgaaccgatgtcggccctcgacgagggcggcatccaggtcttcgagcggctgctgctggactggcgccaggccggcgtcaccgtgctctggatcgagcacgacctggaggccgtcggccgcctcgccgaccgggtcagcggtctcaaccgccacctgctgttcgacggtccggcggccagcagcctgaccccggaacgcctgctcacgctgttctccacccagccccggaagaacgcggaggccagccgatga

SEQ ID NO: 8998 - DNA, 825 bp, Pseudomonas aeruginosa
agaagtgcccgccgtcgaacagttccagttcgaaaccgctgcgggtttcctcggcccaggccagcaactgttcctcgctggccttgtcctccctgccgccaagcgttcggatcggacaggccagcggcgggcgccgctggtgacgatagctgccgcagagcaggaaatcggcgcgcaggatcggcagggtcaggctcatcagctcgcggttgcccagcacctcttccggcgtaccttgcaggtcgcgcaggtcggcgatcagctcggcgtcgctcttcggttcggcgaaaccgcggtcatactcggcgcgtcgcgacggcgccgcggtgccgcaggcgaagaaccccagcggcgtcgggcaacccagctcgcgcaaggcatacagcacctcgcaggcgagcaaggcgccgaggctgtgcccgagcatcgcgtaggggccctggcggacctcgtcgtgcagctcgcgcgccagttgctgcgccaggctcgccaggtcggtctgcaacggctcggccatccgcgccccgcgccccggcaactccaccggacgcaccgccagccaggccggcagcttgcgccgccagcggctgtaggtcatggcgctggcgccggaatacggcaggcagaacagccgtacgggcgtaccgcccactcagccggccgccttgtccatgtgctggcgcaggctcagcgggcgcatgtcggtccagacttcctcgatgtaggccaggcagtccttcttcaggccgctcttgccggccgcccgccagccctggggaatctccttgtattccggccagatggaatactgctcctcatggttga

SEQ ID NO: 8999 - DNA, 1920 bp, Pseudomonas aeruginosa
ccactacctggaactggatgtcgtcacggtcgaacactgaagtcattgcttgctcctgatgggatcgaacggccgcgcgcagcacggcccttgcgttggataacgaaaagcccggcgggaaaattagccggccagcgccgcgccgagggcgcgggcgaaacgccgggccacctcgtcgatctgttcggcgccgatgatcagcggcggcaggaagcgcaccacgctgccgtggcggccgcccagttcgaggatcaggccgcgcctcaggcactcgcgctggacccgcgaggccagggcgccgtcggtcggcggatgaccgagggcatccgcctcgccctgcgggtcgacgatctcgaccccgagcatcagcccccgaccgcggatatcgcccagttgcggatagtcgcgctggaggatgcgcaggtgctcggccaggcgctcgcccatggccgccgcgtgggccgccaggtcgtgttccttcaggtagcgcatcaccgccgaaccggcggccatggccatctggttgccacggaaggtgccggcgtgggcgccgggctgccatttgtccagccattcgcggtagaccaccaccgccagcggcaggctgccgccgatggccttggacagcaccaccacgtcggggacgatgccggcgtgctcgaaggcgaacatcctgccggtacgggcgaagccgctctggatctcgtcgacgatcagcgccaccccggcctgctcggtgatccgccgcaagccgcgcagccagtcgagatcggccgggaccacgccgccctcgccctggaccacctcgacgatcaccgccgccggcaactgcacgccgccttccggatcgttcagcaggttctccaggtagtgcaggttcgccttgacccccgcctcgccgccgagaccgaacgggcaacggtaatcgtagggatacggcaggaactgcacgcccgtgctgagcaccgcgcccagcggcttcttcggtccgagattgcccatcagccccagcgcgccctggctcatgccgtggtagccgccctggaacgacaggatggtgctgcgcccggtggcggtgcgtaccagtttcagcgcggcttccaccgcgtcggtgccggtcgggccgcagaactggatcttcgcctcggcggccagcgccggcggcagcaggccgaacaggtcctggacgaactggtccttcaccggggtggtcaggtcgagggtgtgcagcggcagctcgtcggccagaacctggcggatcgcctcgatcaccaccggatggttgtgccccagcgccagggtgccggcgccggccaggcaatcgatgaaggtacgcccctcgacgtcctccaccagcagccccctggccttcttcagcgccagcggaatccgccgcggatagctgcgcgcgttggactcctggcggctttgccgttccagcaagggcgactgagagaactcgtagagcgtttcgccctccgccggggtggcgcggagcggctggtcttcgatgacgctggtggcgacgtgcatgtcttcaaccctcaaggcgtggtggtgttccactggcaaccggcgatccggccgccaggggcggcattcgcggatcggatgcacaggagacgcaggagggacgcacggatttactgcgccggaccgcagcaccgagcccggaccgccagcttcggcccggacaccgtcgagcaggccgctagtcggtgcccgcggcgctcacccgccagatcgcgttgccgacgtcgtcggcgatcagcaacgccccgtcggccgcctgcgccaaccccaccggcgcgccgaacaactgcttctcgtccgcggagacgaacccggtcaccaccggctgcggcgcaccggcgggcttgccgtcggcgaacggcacatggaccacctggaagccgctga

SEQ ID NO: 9000 - DNA, 2034 bp, Pseudomonas aeruginosa
aaggcgtccagcggtctgaagcgtagtgcggtggccattgcgaaacactcctctcgggaaacgcaggcttcccgacgtgaagggacgggcaggagattcgaaccgccgaggccctgcgcaaggcgcgggcagcggggaacggcacggcgaaacggcgactggggggctcgcgccccttctgcgacggacctgcgcgaagcgctggagttcatctgcaaggacctgtcggaagcgataggtacgctggcgatccttccgatggaacttcgtgcgccgcgactcaccgaaacaggggtagcgaccttcccggccctcccgccgggttgccgcgccgccccaggcgcaccccgccggcgaccgatccgcgcccggcgtttgccgaagaggagacagccgatgcctgatcgaaccgctttaccccgcgccatgctcgcggcctgggtcctgctcctgctggcggcctgcagccagggcccggcgcctaccccgcccgcgtcctggggttggcaggacgccagcggcgaacgcgcgatcgcccccgacgaagcctatcccgagctgttccaggcggtgcaggaaagccggctgttcagcgaccagaagcacttcgtcgatgcgctcccgctgcgcgagcctgcacggatccgcgccgactacctgcgcgagagggagcggcccggcttcgacctgcgcgccttcgtcggccgcaacttcgaggagtccggcagcgtcgagaccgccccgccggaagcgggtgccgatctcgccagccacatcagcgacctgtggccggcgttgacccgccactacgagcaggtgccggcccacagcagcctgctgccgctgccgaaaccctacgtggtccccggcggacgcttccgcgaggtgtactactgggactcctacttcaccatgctcggccttgcggagagcgggcagcaccaacgggtgcgcgacatgctcgacaacttcgcctacctgatcgatacctacgggcacattcccaacggtaaccgcagctactacctgagccgttcgcagccgccgttcttcgcctacatggtggacctccaggcaagacgcgaaggcgacgccgcctaccggcgctacctgccgcagctacagaaggaatacgcctactggatggaaggctccgccgggctgcgccccaacgaggcgcgcctgcacgtggtgaaactggccgacggcagcctgctgaaccgctactgggacaaccgtgacacaccgcgccaggagtccttcctggaggatcgggcgaccgccgcgcgcgccccgcagcgccccgcgggcgaggtctatcgcgacctgcgggccggcgcggaaagcggctgggacttctcctcccgctggctggacgacggccgcgaactggccagcatccgcaccaccgccatcgtcccggtggacctcaacgccctgctctaccatctcgaacgaaccatcgccaaggcctgcgccagcagcgcgctgaaggcctgcgagcaaggctacggagcccgcgcggagaagcgacgacaggccatcgaaggccacctctggcacccggcgggctactacgccgactacgactggcaacgccggcggcccatcgagcggatcaacgccgccagcctcttcccgctattcaccgggctggcctccgccgaacgcgccggtcgtaccgccgacagcgtcgccgcccaactgctgcgcccgggcggactggccaccaccacccgtgccagcggccagcaatgggacgagccgaacggctgggcacccttgcagtgggtcgccgtacagggcctgcgcgcctacggccgggacgccctggcggaagacatcggccggcgattcctcgcccaggtgcagcaggtctacgaccgcgaaggaaaactggtggagaaatacgacatcagcggcaaccagggcggcggcggcggtggcgagtacccgttgcaggacggcttcggctggtccaacggcgtgaccctgcaactgctccgactctacagcccgggcgccggtcgctga

SEQ ID NO: 9001 - DNA, 1185 bp, Pseudomonas aeruginosa
gcctcagcccggctccgggtactggcgctgcgcggcgtcggcgaagcctgcggcgagaaagtcgatcagcgcgcggaccgaaggcaacagcccgcgccgcgaggggaacattgccaccaccatgccttccaccggcgtccactccggcagcacccgcaccagccggcgctcggccaggtcgcgactgaccacgcagagcggcaggccgccgatcccgacgccctccagcaccgcctggcgcaaggtgccgaggtcgtcgctgagcagttgcgggcgcaggttgagggccgcgctgctgccatccgcgccgaccagccgcaggctgccgtccaggcgcgaacgctcccagccgacgtagggcatcgccgacaggtcggccggcagctccggcgggcggtagcgggccagcagctccgggctggccaccagcacctgcgggctacgtgccagcaccttcatcaccaggtcgctgtcctccagcggcgggaaacgcagcgacagcgagatgtcgtagccttcggcgatcacgtcgacccggcgattgaaggtcttcacatacagctcgacgttcggatactgcgccatgaagcgcgccagcatcggcgccagttcgaagtgcagcagcggcgtcgagcaggtcaggcggaccattccgcacggctccgagcggttctgttcgatgacgtcctcggcagcctccgcttccaccgtcatcgccacgcaatgacggtagtaggcctggccgatctcggtcacctggaattgccgcgtcgagcgctgcaccaggcgtacgcccaggcgcgcctcgagctgcgcgaccttgcggctgatggtcgacttgggaatccccaacacccgcccggcgggggcgaagccaccgtgctcgaccaccttggcatagatgaaaagcgcgttcagatcgaacaccagctcaccactcatcgttccacgtgcgagactctgagacttgatttgcggactaccggttcccactcccgggaactagcgtatcgctccatcgactcaatcgaggagcaccgacgtgaaaaaggtcctgggaatctacggcaacgccaaccgccactgggtgggcgacggattccccgttcgttcgctcttttcctacaacacactgggccagcatatcagcccgttcctcttgctggactacgccgggcctgctga

SEQ ID NO: 9002 - DNA, 618 bp, Pseudomonas aeruginosa
cacaggtggaacgctggaaatggtccagctatgggtcaacctgccctccagcgacaagatgaacccgccgcgctaccagaccctgctggatgccgacattccccgcgtcggcctgcccgacagggccggcgaactgcgggtgatcgccggacgctacggccgccaccaggggccggcgctgacccactcgccgctggcggtctgggacgtgcagctgaaggccggcaagcacctcgccctcgacctgcccaagggacatacctgcgccgtggtggtcatgcgcggcaccctcgcggtcggcgacgagatcgttcgcgaagcccaggtcgccatgctcgaccgcgacgacccgcggctggaactggaagccaacaacgacgtgcagttgctggtactcagcggcgagccgctggacgagccgatcatcggctacggccccttcgtgatgagcagccgcgaggaaatcgaccaggccatcgaggacttcgagaacgggcgcttcatccgcgcccactgaagtccgcccccctacgacatggcccgcgcaggaagcgcgggcccggccgggctttgcccgaaattcacggacgaccaccctgcaagaggaaatggaaatga

SEQ ID NO: 9003 - DNA, 279 bp, Pseudomonas aeruginosa
agaactaccatttccgcgcgctcgaactggacgccggcttcgtcgaagccacccgcctgcgcaaccagagcggccacagtcatctcaccagcggctacggcaacggcaccaagggcggtatcgccgccgatcgcgaaagcccgcacatcgcctggctgggcgccagctacagcgcccccggcggcagccaggcgacgctctacagcggccgcctggcggatatctggaaccagcactacctcggcctcagccagccgtggcggctttccagccaattga

SEQ ID NO: 9004 - DNA, 528 bp, Pseudomonas aeruginosa
ccctgcgctgggccacccaccgccccggcgaaggctacaccgcccccggcaacacccgcggcaactccagctccgacgaataccgggtggtggtcgactacccgatcaggttgctctgaacccacggaaccagaaaaaagagaaactccctcatgcgtgcagccctgctacccaccttcggcgccctctccgccgcactctgcctggaggcccgcgccgacgccgtcgcgctgccgccgctggcgctcggcaacgccagcttcatggacggcgtcagccgtcccggcatgctcttcgaactgcccctgcaatacgttcgggcaaacaacgccagcgacgccggcgggcattcggttcccggtcggcaacgggttcgtggcaccatgctgttgccgcacttcgcctacctcagccagaacaccctgctcggcgcccactacggcgccgaagtgctgctgccgctggtacgcctggacctcgatatcgacggcggcccggacggccggcgcacccgccagggcgacctga

SEQ ID NO: 9005 - DNA, 765 bp, Pseudomonas aeruginosa
ggttggcttggtgaagagcaaggtcctcgtcgccgctcgcccacgtcgcgtcgcgatcagcccgaactcgcccagcaagccacgcacctcattgcacaacgccgtgcgggcccgcaccagacgactgcgcacccgatgcaccgactgcacggcctgctgctctgcgctcttcaccgggacatagcgcatgctcggacgactggcggcttcgcagatcgcctcggcgtcgtgtgcatcgtgcttgtcccccttgacgtagggtttgacgaactgcggtgcgatcaggcgtaccgtgtggcccagctcccgcaactcgcgcgcccagtagtgcgcactgccgcaggcctccatcgccaccaggcacggcggcagttggcgaaagaaatcccgcacctgtgcccgcttgagttggcgacgacataccacatgctcgtgacgatcaacgccgtgcacctggaatacttgttttgccagatccagaccaatgcgactaaggttcatgctgactccccctccgggacttgtggctgcaccattagtctggcgcttgacgccgtaggagggaggagtccatttcattgccctacggagttggggagctgtccggcgtttccggggtgcgtagggcgaataccgccacaggcggtatccgccgataccccggataagcggcggataaccgcgagcggttattcgccctacggagctggggaggtgtcggcgtttccagggcgttatccgccgattcagaacgccagcaggtag

SEQ ID NO: 9006 - DNA, 993 bp, Pseudomonas aeruginosa
  unsure (284): Identity of nucleotide at the above locations are unknown.
ccgtcgtgtaccgcggcgatgctggggaaggccatgcacacgctggtgatggtgccggcgatgatcagttgcttcttgccggtggccttcaccgcggcgacgaattccgggttgtcccaggcattgatctcacccttgcgcgcgacgtactgggcgtgcggcgcggcctcgtggatctccgggatcagcgggccgttggggccctgcggtaccgaggcggtggtgatcaccgggatcttcgccagggtggcgaccttggccagggtggtggcgttggcgcgcanttcggtcatcggcatgtccttgaccgtctggaacaggccgctctggtggtcgatcagcaacatggcggcgttggccggatcgatcttcggggtctggccgttgaagttggcgggagcgctcatttccatttcctcttgcagggtggtcgtccgtgaatttcgggcaaagcccggccgggcccgcgcttcctgcgcgggccatgtcgtaggggggcggacttcagtgggcgcggatgaagcgcccgttctcgaagtcctcgatggcctggtcgatttcctcgcggctgctcatcacgaaggggccgtagccgatgatcggctcgtccagcggctcgccgctgagtaccagcaactgcacgtcgttgttggcttccagttccagccgcgggtcgtcgcggtcgagcatggcgacctgggcttcgcgaacgatctcgtcgccgaccgcgagggtgccgcgcatgaccaccacggcgcaggtatgtcccttgggcaggtcgagggcgaggtgcttgccggccttcagctgcacgtcccagaccgccagcggcgagtgggtcagcgccggcccctggtggcggccgtagcgtccggcgatcacccgcagttcgccggccctgtcgggcaggccgacgcggggaatgtcggcatccagcagggtctggtagcgcggcgggttcatcttgtcgctggagggcaggttgacccatag

SEQ ID NO: 9007 - DNA, 435 bp, Pseudomonas aeruginosa
ctggaccatttccagcgttccacctgtgctacggaagcgttccgagtggtactcctcgtggaggatcccggaggccgccgtcatccactgcacatcccccggcccgatgcgtccgccggcaccggtggagtcgtggtgctcgacctcgccctggtagacgatggtcaccgtctcgaagccgcgatgaggatgctggcctacgccgcggcgctgctgtgcgggggggaaatcagcaggcccggcgtagtccagcaagaggaacgggctgatatgctggcccagtgtgttgtaggaaaagagcgaacgaacggggaatccgtcgcccacccagtggcggttggcgttgccgtagattcccaggacctttttcacgtcggtgctcctcgattgagtcgatggagcgatacgctagttcccgggagtgggaaccggtag

SEQ ID NO: 9008 - DNA, 558 bp, Pseudomonas aeruginosa
cccgcaggtgctggtggccagcccggagctgctggcccgctaccgcccgccggagctgccggccgacctgtcggcgatgccctacgtcggctgggagcgttcgcgcctggacggcagcctgcggctggtcggcgcggatggcagcagcgcggccctcaacctgcgcccgcaactgctcagcgacgacctcggcaccttgcgccaggcggtgctggagggcgtcgggatcggcggcctgccgctctgcgtggtcagtcgcgacctggccgagcgccggctggtgcgggtgctgccggagtggacgccggtggaaggcatggtggtggcaatgttcccctcgcggcgcgggctgttgccttcggtccgcgcgctgatcgactttctcgccgcaggcttcgccgacgccgcgcagcgccagtacccggagccgggctgaggctcagcgaccggcgcccgggctgtagagtcggagcagttgcagggtcacgccgttggaccagccgaagccgtcctgcaacgggtactcgccaccgccgccgccgccctggttgccgctga

SEQ ID NO: 9009 - DNA, 522 bp, Pseudomonas aeruginosa
ggtccaccgggacgatggcggtggtgcggatgctggccagttcgcggccgtcgtccagccagcgggaggagaagtcccagccgctttccgcgccggcccgcaggtcgcgatagacctcgcccgcggggcgctgcggggcgcgcgcggcggtcgcccgatcctccaggaaggactcctggcgcggtgtgtcacggttgtcccagtagcggttcagcaggctgccgtcggccagtttcaccacgtgcaggcgcgcctcgttggggcgcagcccggcggagccttccatccagtaggcgtattccttctgtagctgcggcaggtagcgccggtaggcggcgtcgccttcgcgtcttgcctggaggtccaccatgtaggcgaagaacggcggctgcgaacggctcaggtagtagctgcggttaccgttgggaatgtgcccgtaggtatcgatcaggtaggcgaagttgtcgagcatgtcgcgcacccgttggtgctgcccgctctccgcaaggccgagcatggtga

SEQ ID NO: 9010 - DNA, 1410 bp, Pseudomonas aeruginosa
tgccggccgggctatggctgtcgatcgcgacggtgctgctgctggcgctgggagaggcgctcctggcggtatccgcggaggaggtggcgcatggctagcctccactcgctgcgccccgtcgcgcttgccctcggcctggtcctggccggctgcaaccaggggtcgcagaacgatccgcagcagcagaccggcgccaatccggcgcttccggaaccgaagcacttccttctgccgccgatgaaggtaccggaaggcgtgggctggtcgggagaggccaagccgacggtggcccagggcctgaagatcgagaagatcgccgatggcctgcaacaccctcgccagttgctggtcttgcccaacggcgatgtgctggtggtggaggccaactcgcccggcaccgcgccggtgaccacgccgaagcaactcatcgcggggatggtcaaggggaagtccggcaaggccggcaagggcggcaaccgcatcaccctgctgcgccgagccggcgccggaggccagtggcagaagtacgtgttcctggaagggctggactcgccgttcggcgtgcagcgggtgggggattacctgtatgtcgccaataccgggaacatcatgcgctaccgctacgtgccgggtgaaacccgggtcgccgacccggggatggagttcaccgacctgccggacaccatcaaccaccactggaccaaggcgctgctcgccagtcccgacgggcgcaagctctacgtgggcgtcggttcgaacagcaacatcaccgagaacggcgcggcgatcgaataccgtcgtgcggcgattctcgaggtggacgtcgccagccgcggcagccgcatctacgcctccggcctgcgcaacccgaccggcctgcagtgggaaccggtctccggcaagctgtggaccatcgtcaacgagcgcgacgagatcggcaacgacctggtcccggactacctgacctcggtacgggagggcggcttctacggctggccctacagctacttcggccagcacctggattcgcgggtgaagccgcagcgtcccgacctggtggcgaaggccatcgtccccgactacgcgctgggttcccacgtggccgcgctgggcctgttcttctacaccggcaacgagttgcccgagcgctatcgcaacggcgccttcgtcagcgagcacggcagttggaaccgctcgccggtcagcggcttccaggtggtccatgtgccgttcgccgacggcaagcccgccggtgcgccgcagccggtggtgaccgggttcgtctccgcggacgagaagcagttgttcggcgcgccggtggggttggcgcaggcggccgacggggcgttgctgatcgccgacgacgtcggcaacgcgatctggcgggtgagcgccgcgggcaccgactag

SEQ ID NO: 9011 - DNA, 1710 bp, Pseudomonas aeruginosa
agacatgcacgtcgccaccagcgtcatcgaagaccagccgctccgcgccaccccggcggagggcgaaacgctctacgagttctctcagtcgcccttgctggaacggcaaagccgccaggagtccaacgcgcgcagctatccgcggcggattccgctggcgctgaagaaggccagggggctgctggtggaggacgtcgaggggcgtaccttcatcgattgcctggccggcgccggcaccctggcgctggggcacaaccatccggtggtgatcgaggcgatccgccaggttctggccgacgagctgccgctgcacaccctcgacctgaccaccccggtgaaggaccagttcgtccaggacctgttcggcctgctgccgccggcgctggccgccgaggcgaagatccagttctgcggcccgaccggcaccgacgcggtggaagccgcgctgaaactggtacgcaccgccaccgggcgcagcaccatcctgtcgttccagggcggctaccacggcatgagccagggcgcgctggggctgatgggcaatctcggaccgaagaagccgctgggcgcggtgctcagcacgggcgtgcagttcctgccgtatccctacgattaccgttgcccgttcggtctcggcggcgaggcgggggtcaaggcgaacctgcactacctggagaacctgctgaacgatccggaaggcggcgtgcagttgccggcggcggtgatcgtcgaggtggtccagggcgagggcggcgtggtcccggccgatctcgactggctgcgcggcttgcggcggatcaccgagcaggccggggtggcgctgatcgtcgacgagatccagagcggcttcgcccgtaccggcaggatgttcgccttcgagcacgccggcatcgtccccgacgtggtggtgctgtccaaggccatcggcggcagcctgccgctggcggtggtggtctaccgcgaatggctggacaaatggcagcccggcgcccacgccggcaccttccgtggcaaccagatggccatggccgccggttcggcggtgatgcgctacctgaaggaacacgacctggcggcccacgcggcggccatgggcgagcgcctggccgagcacctgcgcatcctccagcgcgactatccgcaactgggcgatatccgcggtcgggggctgatgctcggggtcgagatcgtcgacccgcagggcgaggcggatgccctcggtcatccgccgaccgacggcgccctggcctcgcgggtccagcgcgagtgcctgaggcgcggcctgatcctcgaactgggcggccgccacggcagcgtggtgcgcttcctgccgccgctgatcatcggcgccgaacagatcgacgaggtggcccggcgtttcgcccgcgccctcggcgcggcgctggccggctaattttcccgccgggcttttcgttatccaacgcaagggccgtgctgcgcgcggccgttcgatcccatcaggagcaagcaatgacttcagtgttcgaccgtgacgacatccagttccaggtagtggtcaaccatgaggagcagtattccatctggccggaatacaaggagattccccagggctggcgggcggccggcaagagcggcctgaagaaggactgcctggcctacatcgaggaagtctggaccgacatgcgcccgctgagcctgcgccagcacatggacaaggcggccggctga

SEQ ID NO: 9012 - DNA, 765 bp, Pseudomonas aeruginosa
gtgggcggtacgcccgtacggctgttctgcctgccgtattccggcgccagcgccatgacctacagccgctggcggcgcaagctgccggcctggctggcggtgcgtccggtggagttgccggggcgcggggcgcggatggccgagccgttgcagaccgacctggcgagcctggcgcagcaactggcgcgcgagctgcacgacgaggtccgccagggcccctacgcgatgctcgggcacagcctcggcgccttgctcgcctgcgaggtgctgtatgccttgcgcgagctgggttgcccgacgccgctggggttcttcgcctgcggcaccgcggcgccgtcgcgacgcgccgagtatgaccgcggtttcgccgaaccgaagagcgacgccgagctgatcgccgacctgcgcgacctgcaaggtacgccggaagaggtgctgggcaaccgcgagctgatgagcctgaccctgccgatcctgcgcgccgatttcctgctctgcggcagctatcgtcaccagcggcgcccgccgctggcctgtccgatccgaacgcttggcggcagggaggacaaggccagcgaggaacagttgctggcctgggccgaggaaacccgcagcggtttcgaactggaactgttcgacggcgggcacttcttcatccatcagcgcgaggccgaggtgctggcggtcgtcgagcgccaggtcgaggcctggcgcgcggggcagggcgccgcggcgttggcggtggagtcggcggcgatctgctga

SEQ ID NO: 9013 - DNA, 1323 bp, Pseudomonas aeruginosa
tgcccgcgagggcgccataggccctgcggcgggtccgatgtcgacgaaaaaaaggccggtgagcagcgctccccggcctttttcgttacgaggcgcggctcagcctttaccggccagcagcccttcgactatcgctttcatgtcgctttccaggccggccaccgggtccgccgcctcggtgtccaccactaccaggcgtgcgccgctggcggcgatggcatcggcgaggggcttgggtggctggcgatggtgcaggaccagggcgatatcctcgctcttcagctcctcggcgaaagcctggatattggtctcggtccagccgtcgtcggcctggatctccacgtccagcgggtccaggttgagcccggcgagcaggtagccgaggcgttcggagaggctgatcacgctgaggttgtcggccttcgccaggcgagtctcgttactggcggtcgcttccagcaattgcttcttcagcgtcgccaggttggcctggatggtcgctgcggcgccgggcgccaggcgttccaggtcgctggcgaggacatcggccatgcgccccaggttggtcgggttgagccaggggtaggcatgcaggtcgctgccggggcgcagggcgatgccgggcagggcgccgtccaccggacgcgcggcgtcgatctcgacgatacggatattgctacggcgggccagcgggtagagcgggtcgtcgctccagatcgagcgcaggtcgatcaccgcgtcggcctgcccggcggccttggccaggccgccggcgccgcgcccggcgaagaacgaggcctggcggctggccggcaggttggccggggcgacccgttgcagcttgacctcggtgtcccgcagcaggcgttcggcgagggcgtgggtgaccggcaggctggccagtaccgtgactggcgcggactgggccgcggccggcgtcgcggcgagggccgggagcgggccggcgagtccggcgcaagccagggccagggcgaggcaatggggtttcaggttcatccgggggttcctttcaggtgcggcaggcagccgcgagcgatggcggcgagaccgaaggccaggccggcgaccaggatgatcgcggcgccggagggaatcggcaggtcgaacatgatcggcaacaggataccggccagcgtgctgacggtggcgatcagcaccgccagccagaagaaccctttcagcgactggctgaccaggcgcgccgccgccgccgggatcaccagcagggctccgaccaggatcgcgccgatcactttcaccgcggcgacggtgaccagggtcaccagggccacgaacaggtag

SEQ ID NO: 9014 - DNA, 1104 bp, Pseudomonas aeruginosa
ccagcgaactcttgccgccgccgttcggtccgaccagcgcgtgcacgctaccggcctcgacgcgcaggcgcacgccatcgaggatgcggctgccgccgaggctcaggtcgatcccggcgaagtcgatggccggcccgcaaggcgtggcgcaaagccgttcggccacggtcatgcgccggactcctggatggcgcggaccacggtgtcgaggttgcgcgccatttcttcctcgtacttgccggcgctgtagtcgccataggaaatgtgcgacagcgaatagagcttcaccccggactcgcgctggatggtctcgacgtaggtggaggggaagtcgatctcggagaagatcaccttcacgtccagcgccttgagctggtcgatggtcttcttcaactggctcggactcggctcgatgccgtgggccggctcgaccacggcggtgacttccaggccgaattcgcgcagcaggtagtcgtaggcgccgtggatggtggcgacgcggaagtcggcggccggggccttgttcagccgcgccagggcgtcggcgcgcagggcccgcaggcgcttggcgtaggcccgggcgttgcgggtgtaggccttggcgttggccgggtcgagcttgcccagttcgcgggcgatggtgttgacctgggtgatcgaggcgctgatggacaggaaggtatgcgggttgaccaccttgccggcgccgcgcgcggccatgccggtggcggccagcagcggcaccttggcgttcgcctcgatcaccgggatgccgggcttttcgctggaggcgatcatgcgctcggcgaaatcgtcgtggccgacgccgttgagcaccaccacgtcgagcgtgccgatgcgcttgatgtcctcggcgcgcggctcgtaggcatgcgggttgaaaccggcggggatcagcggcaccacctcggccttgtcgccgacgatgttgctcacgtagctgtagtagggatgcagggtgatgccgatgcgcaggcgtttgccgtcttcggcctgggtcagcggggcgagcagggccagcagcagggcggccagcagggcgcggcccgggaggagggcggcgaggccgcgcggacgggatga

SEQ ID NO: 9015 - DNA, 1446 bp, Pseudomonas aeruginosa
aggtcagggtcgagtcggcgccgagcttgccgggaaccaggatctgctcgtcgtagccgatcacgtcgagggttacgccgggggcgccgctgccgtcggagaagccgcccttgcagcggatctcgccggcctgcacttcctcgcattcgcagatcgggttgtgcgccagggccgcgccgctcaggccgagcaacagggcggccaggggcaggcgccaggggcgggtgtggatgctcattgcttacctcgtttgttcagccaggccacggtggcgggggatgcctcggccaggggaatggaagcctggtgcatggagccgtcccaaccttccatggtgatccacagctcggcgtcgggccgggtgcgcggcgggatcggcacgctggtgcccatgcggtaggggctgccgaagaagatcaccccggcggcacgcaggctgcgcggcttgccgatgcgcaagtaggtcgccttgacctggggaatgcaggcctggcagagggcggcattgaagtccttcatgaagccggcggggccttcgtcgtgcggcggttcgatacgccattcggcgagcttgagactccaggggcctacctggacttcgccgatctcgcgttcacccagtccgctgctgccagagaacaacgccatgtcggcgaaataacgtggcatgaagccgagcgggatcaggatcagcagaacgttcaggtggaaacgccagcgcagccagaactggcgcagcggcgaaacgggctgggcgacggcggccttgctcatggctgtccctccgcggtctggttggccattaccggcgccggcttggccggtttcggctggcgcgccgggcgcttgccgcgcttgaccagcgcggcggtggcctgtgcggtgcgcttgctccagatcagcaggccgctgagcaccatcatgctcagcagcaggccgaagacgaaccagatcagcttgacccagataccgccgaaatcgccggtgtgcagggggcgcatggattcggtgacgaactgcaggggggtacggtcgctgagcaggcgggtggtttcgatcttgccccgtataaaggttcagcgcggccgactggaacatgagcggataccagccgcgtccggccacgaacatcgggctgtaggcgttgccgggcaggaacaccgcgctggcctccaggctggggatgcgcccggtgacgagccgcaccgcctcgtccagctcgatgtatggaaccttctgaccgggtgcggcgcggggcacgtcggcgcgtgcgatgaccggagggatgccgtcgttggtcagggtgacgtggttgtcggcaaggatggcctggatcaggaaccaggtgccggtgatggaaatcagggcgatgaaccagatcgaccagatgccgctcaggcgatggaagtcgccccagaagatccgggcgccctggttgatgcgtaa

SEQ ID NO: 9016 - DNA, 282 bp, Pseudomonas aeruginosa
cctacgcgaccgacctgttcgaggcgcggaccgtcgagcgcatggcgcggcattggcagaacctgctgcgcggcatgctggaaaacccgcaggccagcgtcgactcgctgccgatgctcgatgccgaggagcgctatcagttgctggaaggctggaacgccactgcggccgagtacccgctgcaacgcggcgtgcaccggttgttcgaggagcaggtcgagcgcacaccgacggcgccggcgctggccttcggcgaggagcgcctggactacgccgagctga

SEQ ID NO: 9017 - DNA, 1176 bp, Pseudomonas aeruginosa
ccacaacccgctgttccaggtgctgttcaactaccagagcgaagcccgtggcaacggccaggcattccgcttcgacgagttacagatggaaagcgtgcagttcgacagccggacggcgcagttcgacttgacgttggacctgacggacgaagagcagcgtttttgcgccgttttcgactacgccaccgatctgttcgacgcctccaccgtggaacgcctggccggccattggcgcaacctgttgcgcggcatcgtcgccaacccacgacagcggctcggcgagttgccgctgctggatgcgccggagcgccggcagaccctctccgaatggaacccggcccagcgcgagtgcgcggtgcagggcaccttgcagcagcgtttcgaggagcaggcgcggcaacggccacaggcggttgcgctgatcctcgacgaacaacggttgagctacggcgaactgaatgcgcgggccaatcgcctggcgcactgcctgatcgcccgtggcgttggcgcggacgtgccggtcgggctggcgctggagcgttcgctggacatgctggtcggcttgctggcgatcctcaaggccggcggcgcctacctgccgttggacccggcggcgccagaggagcgcctggcgcatatcctcgacgacagtggggtacggcttctgctgacccaggggcatctgctcgagcacctgccgcggcaggcgggggtggaggtgctggccatcgacggactggtgctggacggctacgccgagagcgatccgctcccgacgctatcggcggacaacctggcctacgtgatctatacctcgggctcgaccggcaagcccaagggcacattgctcacccaccgcaacgcgctgcgcctgttcagcgccaccgaggcctggttcggcttcgacgagcgggacgtgtggacattgttccattcctacgccttcgatttctcggtctgggaaatcttcggcgcgctgctctatggcgggtgcctggtgatcgtgccgcaatgggtgagccgttcgccggaagacttctaccgtctgctgtgccgcgaaggcgtgacggtgctcaaccagacgccgtcggcgttcaagcaactgatggcggtggcctgttccgccgacatggcgacgcagcagccggcgctgcgctacgtgatcttcggtggtga

SEQ ID NO: 9018 - DNA, 1659 bp, Pseudomonas aeruginosa
tttcatgctgttgctggcctcgttccaggcgctgttgtatcgctacagcgggcaggcggatatccgtgtcggtgtgccgatcgccaatcgcaaccgcgtggagaccgagcggctgatcggcttcttcgtcaacacccaggtgctcaaggccgacctggacggtcggatgggcttcgacgagctgctggcccaggcccgccaacgcgcgctggaggcccaggcgcaccaggacctgccgttcgagcaactggtggaagccttgcagccggagcgcaatgccagccacaacccactgttccaggtgctgttcaaccatcagagcgagatacgctcggtgacgcccgaggttcagttggaggacctgcgtctggaaggcctggcctgggacggccagactgcgcagttcgacctgacgctggatattcaggaagacgaaaacggcatctgggcctccttcgactatgccaccgatctgttcgacgcctccaccgtggaacgcctggccggccattggcgcaacctgttgcgcggcatcgtcgccaacccacgacagcggctcggcgagttgccgctgctggatgcgccggagcgccggcagaccctctccgaatggaacccggcccagcgcgagtgcgcggtgcagggcaccttgcagcagcgtttcgaggagcaggcgcggcaacggccacaggcggttgcgctgatcctcgacgaacaacggttgagctacggcgaactgaatgcgcgggccaatcgcctggcgcactgcctgatcgctcgcggcgttggcgcggatgtgccggtcgggctggcgctggagcgttcgctggacatgctggtcggcttgctggcgatcctcaaggccggcggcgcctacctgccgttggacccggcggcgccagaggagcgcctggcgcatatcctcgacgacagtggggtacggctgctgctgacccaggggcatctgctcgagcacctgccacggcaggcgggggtggaggtgctggccatcgacggactggtgctggacggctacgccgagagcgacccgttaacgacgttatcggcggacaacctggcctacgtgatctatacctcgggctcgaccggcaagcccaagggcacgttgctcacccaccgcaacgcgctgcgcctgttcagcgccaccgaggcctggttcggcttcgacgagcgggacgtgtggacgttgttccattcctacgccttcgatttctcggtctgggaaatcttcggcgcgctgctctatggcgggcgcctggtgatcgtgccgcaatgggtgagccgttcgccggaagacttctaccgtctgctgtgccgcgaaggcgtgacggtgctcaaccagacgccgtcggcgttcaagcaactgatggcgatggcctgttccgccgacatggcgacgcagcagccggcgctgcgctacgtgatcttcggtggcgaggcgctggatctgcagagcctgcggccgtggttccagcgcttcggcgatcgccagccgcaactggtgaacatgtacggcatcaccgagaccacggtacacgtaacctaccgtccggtgagcgaagccgacctgaagggtggcctggtcagtccgatcggcgggaccatcccggacctgtcctggtacatcctcgaccgtga

SEQ ID NO: 9019 - DNA, 489 bp, Pseudomonas aeruginosa
gcgcgaaggttcgccgctgttcatgttccatccgagtttcggctctgtgcactgttacaagaccctcgccatggcgctgcgggatcgtcatccggtcaagggtgttgtctgccgtgccctgctgggcgctggtcgcgaggtgccggagtgggacgatatggttgcggaatacgccgagcaattgctgcaggagcaccccgaaggggttttcaacctggcgggatggtcgctcggcggcaacctggcgatggatgtcgcggcccggctggagcagcgtgggcggcaggtggctttcgtcggctggatcgatgcgccggcaccggtcagggtcgaagcgttctggaacgagatcgggccgacgccggaggcagtcccgaacctatccgtgggcgagatgcgggtggaactgctcggtgtcatgtttccggagcgggccgagcatatcgaacgggcctggtcatcgatctgctccgccacgacggacgatga

SEQ ID NO: 9020 - DNA, 213 bp, Pseudomonas aeruginosa
agggccttgcgtgtgcgtgttctagtcattgccgtcccagtcaggttcgagatcgaaagcgcggatgagcgtctgccgaagcggactcacctgtcagggtgggacgaggccggagcgggaaaatttagcgccgcgggagggattgtcgagttgcctgtggaacggcatgtgggcggtaaatttgccgacggaaggaacgttctagctggataa

SEQ ID NO: 9021 - DNA, 855 bp, Pseudomonas aeruginosa
ctggctgcacatgcgctgggcctcggtgacgagggacccctccaacggcgccccggtcatgaccgaccgttttccggccgatttcgccccgcgctggttccgcccggagaacgacttcctcggcgacccgttttcctcccatgtgaatccggtgttctggtcgttccacggctggatcgacgaccgcatcgaggactggtatcgcgcccacgagcgtttccatcctggcgaagtgcagcgccgcgaagtggagggcatccaatggttcgcgcctggtcgatgggtcgaggtcggcgatccctggctgggcccggcgacccatggatgcgggctttcggatgtccaggcgagcagcaactcggtggagctggacgtggaaaccatgaagctggctttgcgcatcatcttcagcgaagaagaccagttgagcggctggctcaagcgtgcgccgcggcggccctggtacgcgcgcaacctgaagctggcgcgcgaccagctcaggcgctgaacggcgaaagagcgagtaaggatggaggaggcccgcgcaacgcgggcctcagtctttccgcgcgagaccctggcggtcgctctgccagccgccgccgagggccttgtacaggccgaccgaggcctgcaggcgggccagtcgcagttgcacggcggcatcctgcgccgcgtacagcgtgcgttgcgtttcgaggaccgtcagcagggtttccgcgccggcctggtagcggctgtcggagagatcgaaggcgcgctgcgcctgctccagctcctgctgctgccagtgcagctggcggtcgaggccgtcgatgctgttcagcgagcgttcggtgtcggcaaaggcggtga

SEQ ID NO: 9022 - DNA, 2571 bp, Pseudomonas aeruginosa
ggccggcggagaaggagtcgacggcatcgttgtcggaggtcgcgtcggtaccgctgtagcccgagtcgcgcaggagtttctgccggctggcgccgagcgtcgcattcagctccggcagcaacggcgcgccggcgatcaccgccgaggcctgggcctggcgtacgcgggccaccgccgcgccgaggtcctggctgttcagcagggcgcgttgcagcaggctgtccagttccggcgcgccgaaggccttccaccactggcggatgtcgctggcatcgctgcgcccggccgccaggtagcgccactggctgggcgcggccaggccgctgtcgaggggcgccggcgtgctgccgcaggcgccgagcagcaggcaggcggaaatcagggagagattcttcatggacatatccgtcattggctggccagggcggccaccgggtccagctgggcggccttgcgcgccggcatgaagccgaacaccaggccggtgaccagcgcgcaactgaaggcgccgacgatggccgacagggaaaaggccaccgcgacctggccgagcagcagcacgccgccgatgcacagggccagggcgatcccggccaggccgccgaccaccgagagcatcgccgcctcggtgaggaactggcggaggatatcgccctggcgggcgccagtggccatgcggatgccgatctcgcgggtgcgttcgcgcacggtcatgagcatgatgttcatcacgccgatcccgcctaccagcagggagatcgcggcgatcgagccgagcatcagcgacagggtgttctgggtcttcgcctcggcctggatcatcgccgcgttgttggtcagctcgtagtcgcgctggccgcggtgcaggcgcagcatcaactggtcgatggcgcgttcggcctggtgcacgcgctgggcgtcggcggcggcgatgatcacgtactcggggttgcgcgtgccgaacaggcggatgctggcagcggagtaggggatggcgatgcggttgtcggcatccttgtcgccggagctggagcctttctcggcgagcacgccgatgacctggaacggcacgttctcgatgaggatgtagcggccgatcgggttggcgctgccgaacagcttcttgcgcaccttgtagccgatcaccgcgaccgtggtggcggcgtcttcgtcgcgctcggtgaagtagctgccctcggccaccggccagttgaggatttccgggaagtcggtgttgttgccgccgacgtaggcgtggtagtcgatgttcccgtagcgcaccaccagctcgccgccgttcaccggcatgaccttcttcacctggggcagggtggcgatggcggcgacgtcgtcgctgctgacgatgcccatcggcgcgcgcgggttcggcgagtagccgctgagatagatgatgttcgagccgaacgcgcccatctgcgccatcacctggcgcttgctgccctcgccgacggcgagcatgaccaccaccgaggcgacgccgatgatgatcccgagcagggtcagcgcggtgcggaaccgattgatccacatcacccgccaggcggcgcgcaccgcctccagcagttcggcgcgccaggcccccgagggttcgctgctgccctcggcgaggcgctggctgagatcgtcggcctgcaggtggcgctcgacgccggcgctcggttgcgccgggcgctcgtcgttggcgctgtcgctgacgatctcgccgtcgcgcacctcgatgatgcgcttggcgcgggcggcgacgtcgcggtcgtgggtgatcaggatcaccacgtggccctggctggccagctcgtcgagcagcgccatgacttccgcgccgctgtggctgtcgagggcgccggtgggttcgtcggcgaggatgatatggccgccgttcatcagcgcgcgggcgatcgacacccgctgctgctggccgccggacaactggtgcggacggttggcggtgcgctcggccaggcccaggcgttcgagcagggcccgcgctcgggtgtgccgctcgctcgccgggatgccggcgtagatcgccggcatctcgacgttttcctgggccgaggcggaggggatcaggtgatagccctggaacacgaagccgaatgcctcgcggcgcagccaggcctgctcgtcgctgtccagttcggcgacgtcgtggccggcgaagtggtagctgccggagctgggccggtcgaggcagccgaggatgttcatcagggtcgacttgccggagccggaggcgccgacgatggcgacgaactcgccggcgtggatcgacagcgatacgcccttgagtacctcgacttccggagtgccattgccgccgtagcgcttgcggatgtcgcgcagttcgatcagggggacgggttgcgtggcgttttccatcagctgtcgctgccgtcgggagcggccatcaacaggcggtcgccttcctccaggccggcaagcacctgtacccgcaggcggtcgctgatgccggtcctgatctggcggctctgcggcttgccattgctgccgaccacccaggcgacctggccgcccttgccgtcgtcgtga

SEQ ID NO: 9023 - DNA, 825 bp, Pseudomonas aeruginosa
tcaacagatggccctccagggctgctctcgacttatcgctcccgcttgaaagggggccaatccagaggaactggaaatgactcaggcaactgcaaccgccgtggttcacgatctcatcggtgtcggcttcggcccttccaatatcgccctggcgattgccctccaggaacgggcccaggcgcagggcgccctggaagtgctgttcctggacaagcagggcgactaccgctggcacggcaacaccctggtgtcgcagagcgagttgcagatctccttcctcaaggacctggtgtccctgcgcaaccccaccagcccgtattccttcgtcaactacctgcacaagcacgatcgtctggtcgacttcatcaacctgggcaccttctatccctgccggatggagttcaacgactacctgcgctgggtcgccagccacttccaggagcagagccgctacggcgaagaggtcctgcgcatcgagccgatgctgagcgccggccaggtcgaggcgctgcgggtgatctcgcgcaacgccgacggcgaggagctggtgcgcaccatccgcgccctggtggtcagtcccggcggcaccccgcgtatcccgcaggtgttccgtgcgctcaagggcgacggccgggtgttccaccacagccagtacctggaacacatggccaagcagccctgcagcagtggcaagccgatgaagatcgccattatcggcggcgggcagagcgcggcggaggccttcatcgacctcaacgacagctacccgtcggtgcaggccgacatgatcctgcgtgcctcggcgctcaagccggcggacgatag

SEQ ID NO: 9024 - DNA, 2676 bp, Pseudomonas aeruginosa
gcgccagttgcaccgccaactgctcgaaccgctggcggagtacctcggcgaccacgagatcggccgcgactaccgcctgcagaccgacgagcgctgcaaggtggcgatctacgcgcagggcttcagccaggccagccatggcctcagcgacaccctgctgtcggtgctgccggtgcgtgccgaggaaatctccggctccctgtaccagcacctgaagcccggtactgcggcccgcgccctgcacgagcacgccctggccagctgatcggcgccacgccgccacgccctgtgttgcccgtttccccgccaggggatgcccggcacgcagggcgttttcgttgcatgtcccggccgttccggccaccactttgcagagaaacgacatcgatggggatgcgtaccgtactgaccggcctggccggcatgctgttgggttcgatgatgccggtccaggccgatatgccgcggccgaccgggctggccgcggacatccgctggaccgcctatggcgtgccgcacatccgggccaaggatgagcgcggcctgggctatggcatcggctacgcctacgcgcgcgacaacgcctgcctgctggccgaggagatcgtcaccgcgcgcggcgagcgggcgcgctatttcggcagcgagggcaagtcgtcggccgagctggacaacctgccgtccgacatcttctacgcctggctcaaccaacccgaggcgctgcaagccttctggcaggcgcagacgcccgcggtacgccagttgctcgaaggctacgccgccggtttcaaccgcttcctccgcgaggcagacggcaagaccaccagttgccttggccagccctggctgcgggccatcgcgaccgatgacctgctgcgcctgacccggcgcctgctggtcgaaggcggggtcggccagttcgccgacgcgctggtggccgccgcgccgcccggcacggagaaggtcgccctgagcggcgagcaggcgttccaggtcgccgagcagcggcgccagcgcttccgcctggagcgcggcagcaacgccattgccgttggcagcgaacgttcggcggacggcaagggcatgctcctggccaacccgcacttcccctggaacggcgcgatgcgtttctaccagatgcacctgaccattcccggccggctcgacgtgatgggggcctcgctgcccggcctgccggtggtcaacatcggcttcagccgccacctggcctggacccacacggtggatacctccagccacttcaccctgtatcgcctggcgctggacccgaaggacccgcggcgctacctggtcgacggtcgttcgctgccgctggaggagaagtccgtcgcgatcgaggtacgcggcgccgacggcaagctgtcgcgcgtcgagcacaaggtctaccagtcgatctacggcccgctggtggtctggcccggcaagctggactggaaccgcagcgaggcctatgcgctgcgtgacgccaacctggagaacacccgggtactgcagcagtggtactcgatcaaccaggccagcgacgtcgccgatctgcgtcggcgcgtcgaggcgctacagggcatcccctgggtcaacaccctggccgcggacgagcagggcaacgccctgtacatgaaccagtcggtggtgccctacctgaagccggaactgattcccgcctgcgccattccgcaactggtcgccgaaggcctgccggccctccaggggcaggacagccgctgtgcctggagtcgcgacccggccgcggcccaggctggcatcaccccggcggcgcaactgccggtgctgttgcgcagggacttcgtgcagaactccaacgacagcgcctggctgaccaacccggcgagcccgctgcagggcttctcgcccctggtcagccaggagaagcccatcggtccgcgggcgcgctacgccctgagccggctacagggcaagcagccgctggaggcgaagacgctcgaggagatggtcaccgccaaccatgtcttcagcgccgaccaggtgctgccggacctgctccgcctgtgccgcgacaaccagggcgagaattcccttgcccgtgcctgcgcggccctggtgcagtgggaccgtggcgccaacctcgacagtggcagcggcttcgtctacttccagcgcttcatgcaacgcttcgccgaactcgacggcgcgtggaaggaaccgttcgatgcgcaacgtcccctggatacgccgcaaggcatcgccctcgaccggccgcaggtggcgacccaggtgcgccaggcgctggcggacgcggcggcggaggtggagaagagcgggattcccgacggcgcgcgctggggcgacctgcaagtgagcacccgtggccaggaacgcatcgcgattcccggcggcgatggccatttcggggtctacaacgcgatccagagcgtccgcaagggcgaccacctggaggtggtcggcggcaccagctacatccagctggtgaccttccccgaggaagggcccaaggctcgcgggttgctggctttctcccagtccagcgatccgcgctcgccgcactaccgcgaccagaccgagctgttttcccgccagcaatggcagaccttgccgttcagcgacaggcagatcgacgccgacccgcaactgcaacggctaagcattcgcgaatga

SEQ ID NO: 9025 - DNA, 432 bp, Pseudomonas aeruginosa
aggcggcccacagccgcccggttccagggaacacgtgcaggcagcgagcagggatgctcggcttcggcggggacccgctacccactcgtccacgaaaggagcgtcacgatgacccattcgcccgtcaaacagatgttgaaggaggccggcctgaagatgagcctggcccggctgaaagtgatcgatgcgctctgggaagcctcgggggagcagggccgggtgccgatccgcaccctgcaccggcgtctctccgaaaccggtacgccgctgtccctggtgagcatccgccaggtcctcgggcgcctggtggaaagcggcctggtgaccctcgacgaacaggatgtctacagccccggcaaggcttcctggggcggtgccgccggttccgcggcgcccgagcgccgcgccgcggccaacgagcagcggctctga

SEQ ID NO: 9026 - DNA, 345 bp, Pseudomonas aeruginosa
tctcaagggcgaccccagggccaacctgctggcgatccgcctgctgttccgccagggccgcatcaccggcgtgctgctggacgaccccagcggtgccgaggaccagcatgggccgttgatctaccacgccgagcgcctgcgcgtgcggcgcggctaacgccgtttcccctggccgagccgctcgctttccggcgagcggcgaggagcgggccaccgggaatgctgcctcgcccgggcgattcccgcccggcttgggtatcgttgaattccattcaacgatacgttcagttttgccaggttatgcgccgcagtcctctcgccaataatctcccttcagtccgatga

SEQ ID NO: 9027 - DNA, 2454 bp, Pseudomonas aeruginosa
agagcaaccccgcgcccagcgacgagcagatcgaggcggccatggccggcaacatctgccgctgcggcacctacaaccggatcaagacggcgatccacaacgcctccgccaagttgcaggaggccaaggcatgaagcgctcgtaccccgacgatctggtcatcggcaatctcagccgccgcggtttcctcaagggcgtcggcgccaccggcgtgctgctggtggctgccaactggggctggcgcgacgccctggccgccgagaagaaggccttcggcgccgacgccatgccccacggctgggtggacaacccgaagatctacgtgagcatcgaccgggacggcacggtcggcatcgtctgcaaccgctcggaaatgggccagggcgtgcgcaccagcctggcgatggtggtggccgacgagctggaggccgactggagccgggtcaaggtgatccaggcgcccggcgacgaagcgcgctacggcaaccaggacaccgatggctcgcgcagcatgcgccattggttcgaacccatgcgccgctgcggtgcggcggcgcgacagatgctcgaacaggccgcggccaaccagtggaaggtcccgctgggcgagtgccgcgccgaacagaacaaggtgctgcatgcgcccagcggccgttcgctgtccttcggcgaactggccgaggccgccgcgggtctcgaagtgccggcgcgcgacaagctgctgctgaagaagcccgagcagttccgctacatcggcaaggacgtggcgcgcgccatcgacggcgccgatatcgtcaatggccgcgccggcttcggcttcgacgcgcgcttcgacgacatgctctacgccgtggtcgcccggccgccggtctacggcggcaagctcaagcgctacgacgccgccgcggcgctgaaggtgccgggggtggtcaaggtgatcgagatcgagggccggccgatcccgtccgagttccagccgctgggcggggtcgccgtggtggcgcagaacacctgggcggcgatcaaggggcgcgaggcgctggcggtcgagtgggacgccggggtcaacggcggctacgactcggtggcctaccgcaagcaactggaagaggccgcgcgcaagccgggcaaggtggtgcgcgacagcggcgatgccgcggcgctgttcgccaagggtggggatatcgtcgaggccgagtactacctgccgcacctggcccaggcgccgatggaaccgccggtctccaccgcctggtacaaggacggcgcctgcgaagtctgggccccgacccaggcgccgcaagtgacccgcgagcgcatcgccgagcgcctgaagctgccgttcgacaaggtcacggtcaacgtgaccctgctcggcggcggtttcggccgcaagtccaagcccgacttcgtgctggaagcggcgatcctggccaaggcgttccccggtcgccacttgcgggtgccagtggaacccggggggaccatctgcatttcccccaatttcccacacagtatccggtggagcgcctgccaggccgtggtcggcgcccgacggggttccggcaggcttggctgcatcgctcggtggcgccgagcatcaccgcactgttcggcccggacagcaagctccagggcgccttcgacctgggcatgggcctgaccaacctgccgttcgccatccccaacgtgcgcctggagaaccccgaggccccggcgcacacccgggtcggctggttccgctcggtctccttcttccccctcgccttcgccatccagagcttcgtcggcgaactggcggcgaaggccggccaggacccgaaggactacctgctcaagctgctcggcccggcgcggcgaatcgacaccgccgaactcggcgacagctggaactacggcgagtcgccggagcgctacccgctcgatgttggccgcctgcgcggggtgatcgaggaggcggcgcgccagtccggctggggcggcgagctgcccaggggcagggcgcggggaatcgccgcgcactacagcttcgtcacctacgtggcggtggtgatcgaggtggaggtgaaggacgacggcgcgctgctggtgcacaaggccaccatcgccgccgactgcggtccgcagatcaaccccgagcgcatccgctcgcagctcgaaggcgcctgcgtgatgggcctgggcctggcggcgctgggcgagatcagcttcaaggatggcaaggtccagcaggacaacttccaccagtacgagctggcgcgcatgccgctggcgcccaaggcggtgtcggtgcatctgctcaagccggatggcgacctgccgttgggcggggtcggcgagcccggcgtgccgccgatagcgccggcgctgtgcaacgcgatcttcgccgccaccggcaagcgcatccgcgagttgccgatccgcaatcagttgcaggggtggcggaaggcctag

SEQ ID NO: 9028 - DNA, 288 bp, Pseudomonas aeruginosa
cgcgggtggcctcgttcgccctgcgcagcgaaggcggcaagcggacgccagggcggacaacgggtagcgttatgcgccgccttgtcgtctcaacttaaagtgaattctagtattttatttatcttattaatcaataagataaatagtttattaaaagtatttcataagaagtgggagtcttcccagccgctccaggccgcctgcttaccgtcgaaacgtgataggcaattctccaggatcgacgaccccgcgtcgtccgtgcgcgaggccgtcatggcggttcagtag

SEQ ID NO: 9029 - DNA, 822 bp, Pseudomonas aeruginosa
ccgaggctggcctgcggcctgtcgtgctcgtcgatgcgcaacggaccttccaggctgccgtcgagcaggttgccggcgagatggctgtcgcctcgaaccaggtcgagcttgccggatgccgccatgcgcttctcctcagttgacctttaccaggccgcccttgagggtcagcatgccgccgccgtccaccgtctgttcggcgccggccttgttggtcaggctgacgccggcatcgttggtcaggctggtgccggccttgttggtgagggaggtgccggcctggttggtcagcgacgtcccggccttgctggtcagcgaggtgccggcctgggcggcgaggtcggcgtcgctcttcagggtcaggctgccgccgctctgcagggcgagggtgccgctgaccttgatggtcaggttgccgtccaccgtcagctcgaagttgccgctgaccttgtggctgtagttgccgccggtgctgtgggtctggtcggcgcccaccgtcaccgtgcgcgtgtccttcacatccaggctgtcgctgccggtctggatggtcaccgtgcgcttgcctttctccagggtgacggtctcgtcgccttccttcaccgtgcgggtgcgggcgttctgcaccgtcagggtctcgtcgtggccgatgctggcggtgctgtcgttgagcacgttgacgttgaggtccttctgcgcctggaggaagacttcctcggcgtccttcttgtcctcgaagcgcagctcgttgaagccgccaccgcccttcgacgagttggtcttgatcccggactgcgtctggttgtccggcagcgcgtagggtag

SEQ ID NO: 9030 - DNA, 1179 bp, Pseudomonas aeruginosa
ggcgttgtcgccgttgtagacgcagccggtgaccagcgggcggtccgggtcgccgtcgatgaaggtgacgatcacttcctggccgatgcgcggcacgaactgcatgccgaagcccttgccgctccagggcagcaccacgcgcacccagcaggaggaggtctcgtcgttcttgccgtcgcggtcccaggggaactggatcttgatccggccgtactggtcggtccagatctcctcgccggccttgcccaccaccagggcggtctgggtgtgcatgcgcggcttgggcgtgacccgcgcggggcggtaggcggtggccttggggatcgcctcgaagcggttgcggtagtgcgcgtggctggcgtcgtgggcgaccgagatcagcacccagtcgatattcagcgaatcgtcgtcatgcccgctgagggtgaaccagtggccgggcaccagccagcggcagtcgctctcgccgatcaggcgcgtctcctggctgcgcaggccgtcgatgcgttgcttggtcaggctgtcgccctgggccttggcggtgtagccgccggggtgctggtagacgccggcggcgccggaaaccgcctcggcctgggagtacagcgaggtgcccggggtggtgaactcgtagtcggtggcgctgtaggtcccggataccgcctggaggctgtactgcgccgaacgcacgccctgcaactcgcgcacgccgattccttggcccaggtaggccacttgcgggccgttgggaatcggcgggaaggcgtcgttgctgtcggccagcaccagggtgtgcttgccggcggcatgggtgaagaaccagaagatgccgtcttcctccagcagccgcgagacgaaggcgaggtcgctctcgccatactgcacgcagtattcgcggggctggtagctgccgctgagctgcaactggtagtcgctgaagccgtgctggtcgaagacctgggtgacgatgtcgctggtggccaggttctggaacacccggttgttgctggccagcgtcagccaccagagccaggggcgcaacagcacctggtagcgctcggcgctggcatcgccggggagttggcggatctccgcgaccaggccgtcgagcggacgctggtcggcgtcgttgtgcagggtggcggtgagatgggtggcgattgcgccgtccagggctaa

SEQ ID NO: 9031 - DNA, 1101 bp, Pseudomonas aeruginosa
ccgatacgttctccatcggaaacgggcggatgccgcgatgcctcgggacgctcattcgagtacccactccgccaacttccccgtcacctgcgccatcagcacgttctcgatatcccgcgcgcccgccgcgctgcacttggcgagcacggccttgacgatggccgggtcgaagtcgaactgtttgccggtagcggccttgtagcgttcccgcagtttttccagcttggccacgacgatgccttccagggtggcttcctccagcggccggtaaggcaccacggtcatgcgcgcgaggaacgccgggcggaaggtttgcagcaggactttgcgcaggcgctcgtcgaaggccggggtggcgacctgttcggccgggctgtccagcagcagttcggcgccgacgttgctggtggcgaggatcacggtgttcctgaagtccaccaccaggccggtgccgtcttccatcacgcccttgtcgaacacgttgtagaaggcttccagcacgtccggatgggctttctcgatctcgtccagcagcaccaccgaatagggcttgcggcgcaccgcttcggtgagcacgccaccgctgccgtagccgacgtagccgggcggggcgcccttgagctggctgacggtgtgggcctcctggtactcggagaggttgatgctgatcaggttgcgttcgccgccgtaaagggcgtcggccagggcgtaggcggtctcggtcttgcccacgccggtggggcctggcaggaggaatacgccgaccggcttggccgggtcgctgagtccggcgcgataggcctggatgccctggggcgatggcgcccagggcggcctcctggcccatcaccccctggcccattcgttgcgccagggaacggatggcgtgggcttcgtcggcgagcatcttgcccaccgggatgccggtccagccggcgatcaccgcggccacggtacgcgagtccacctgctcgggaaccagcgggtcgtcctggcggatggcttcgaggccggccgccaggcgcgccagttcggcggccaggtggtcgatgcgaccgtccagttcctcgtcgggcttggccgcgtcggcgctttcgctga

SEQ ID NO: 9032 - DNA, 429 bp, Pseudomonas aeruginosa
gcagcgagaagccttccagcagacgctcgacgtgcgggtcggggcattcgccgggggccagttgcaggcgccgggcgaccttcggatagcgctcggcgaaggcgccgccggcgtgccgtagccaggtcagctcgcgctggtagtagtcgagcaggtcggcatcaatcgaatcgctcatggcgcacctcgaggccatcgttgccctgttcgatgacgaacagcgcaggcgtcaggcgcgacccgctgcgcaggctgccgccgagctggatacgcaggcgctgcggattgcccgggtcaggttcgacctcgacctcggccagttgcaggcgcggctcgaaatgctcgaccgccacccgcacctcgcgcgccagctggcgccggtcttcggcgcgcaggcgttgcacggcggtccagtcggcgagcccatag

SEQ ID NO: 9033 - DNA, 1608 bp, Pseudomonas aeruginosa
ccgacgagcaggctgtcgcctttgatgtcgctgccgaaatcgagaatgatcgcatccatcgcatctgactcctggagaggggctgtctggaacgggaagggcgccccgccggcggtgccggcgggggcgagctcacgccgctaccggcggcggcaggttggcgaccaggcggatcgacgcgctgagttcctcgagctggaagtgcggccggaggaacaccgtggcgcggtaggcccccggtttgccggccacctcgctgacatccacccgcgcctcgcgcagcgggtactgcgccttgatttcctgcggtgcgttgtcgttgatcagcacgtagtcggcgatccagttgttcaggtaggtctgcacgttgtcgcgggtcatgaagctgccgaccttgtcgcgcatgatcaccttcaggtagtgggcgaagcgcgatgccgccagcacgtacggcagcatcgccgacaggcgcgcgttggcgttggcctcgttggtgttgtagagcctggccttgttggtggtctggccgccgaagaacaccgccacgtcgctgttcttcttgtggcacagggaaatgaagccgagatcgttgagttccttctcgcggcggtcggtgatcgccacttcggtcgggcatttcagcgacaggtcgccggagctggtgcggaacgtgtgcgctggcaggccctcgaccgcgccgccgccttccgcgccgcggatcgccgcgcaccagccgtacttggcgaaggcctcggtgatgcgctgcgccaggacccaggcggcgttgccccagaggtacttggagtggtcggtgccgttgacgtcctcgacatagttcatgccttccaccgggcgcgtctccgggccgtagggcaggcgcaggaggaagttcggcagcaccagggacacgtagcgcgaatcctcgctctcgcggaaggcgcgccacttgatcagctccaggctctcgaagatcttggtcaggtcgcgcggtacggccagttcggtgaagctgttcatgtcgaacaggcgtgggctggcggcggcgatgaacggcgcgtgggcagccgcggcgacgttcgacagcttctccagcaggccgatgtcctgcggatggcgaccgaaggtgaagtcgccgatcagcaggctgaaggggtgtccgccgaaggtgccgtattcctcttcgtagatcttcttgaacagtgcgctctggtcgaactcgaccgccttctccaggtcgttctgcagttcgttcttgccgacgttcagcaggcgcagcttgagccgcgcgctggtctcggtgttgctcaccagttggtgcaggccgcgccaggaggcttccagcttctgcaactcggggtggtggatgatctggttgagctggtcgctgatcagcgcatcgatctggctgatgcggtcgttgatcatcgccacggtgtccttgtcgacggccatgccctcgtcgaggacctgggtggcgaattccgcgagcatgtcgcgggcatagtcctgctggctgtcgtcgtgggccatgcggccctttgcgatgatctcgtcgagcagggacagggtctgggtcgaactctcgccggattgttcggcggcggatga

SEQ ID NO: 9034 - DNA, 1047 bp, Pseudomonas aeruginosa
cgcggtgtgctggcacgaagggatgcaactgcttccccagcatttccagttgcagggattgcgtgccgaggcgctggcggcgcgcatcggacaggcctgcaacccttggttctggggagtgaccgccctggaactggacccctctgcgttgtgcgccggccaagtgcgggtcctgcacctcgaagcgatcctgcccgacggcctgccggtgagcgtgcaggctggtgtcgacgcgccgctggagttcgatctggagacagcgctggcggccgccgaagggccgctgctgaacgtccacctggcggtcagtccgctgtggcgggcgggtcagttgctgccgctgaagggccgtctgcaatcgcgggtcggcgcgccgctgccggacctggccagcggcgagcaccccgagccgatcaccgtctggcgagcgtcgctgcggctggtcggcgacgacggcaaggccgactccgtgtgcctgccgttgctgcgcgtggcgaaggagggcggcgcctacgtcagcctgccctacgtcccgccgacgccactgatcctgccggagtcgcccctgggcagacgcgtgcagtcgctttgcgcgcgggcccgggagaaggcgctgttcctcggcgggcgcctgcgcctggcgcagcaggcgggcaaccaggacgacgcggtggaaatccgtcgccagcttgccgcgctctggacccgcctgccggaggtcgaaggcctgctggcaagccgtacggcctcgccgctggccctgcacggcagcctgctgggcctggccggtgcctgggcggcgctcgatccgctggccggcgtgccggccttcgaagcgctcgacttcctcgacctgcggcgtggctacgagccgctgctggactggctggagcgggccatcgagtcgatccgcgcgggctaccgctgcctgccgttcgagcaggaggaacaggtattttccgtgcgcctgcccgatccggcgccgcgtcagcgcctggtggtcggcctgcggatgcccgccggcgccggcgaacaggcggcggctga

SEQ ID NO: 9035 - DNA, 1044 bp, Pseudomonas aeruginosa
ctggctggagcgcgccatcgtcgcctccgacccgcacctgccgttgctcgcccggcaacgcatgagcgggctgccgcggcagccgatgaatcgccaggaacaggtggcctacagcgttggcgacgacacccgtttgttcgtcgtgcagggtgccggcgactggttcgatgccggccagccgctgcgcatcgtcgcgccggtcagcggggtcgccagcagtccctggcagatcgtgctgttcgtcgccgacggcagcgacaacacctagacaggaaggagccgccaatgcccgaagggagtgcagggcctttttcccaggcgtaccaggagcagccgctcagcacggcattccgccaggcctggcaggaatggctggaggcctggggcgccctcgaccgggacgcccaggatgtgccacggatggtcgagcgcgccctcgaactgtccacccgcatcacccggcgtctgtggcgcagcgccttcgccagcgtcggcgacgcggcgggcgtgcaggtcaaggcgatggtctatgccttcgtcgccctggtcgacgagaccctggtcttcagcgcctggccggggcagggcgcctggcaggacaaaccgctggagtcgcatctctacggcagtcgccaggcgggcgaatacctgccgctggcgatcaagcgcctgctcgacgaacgcgccccggccagtcgcgacctggccaacgtctacctgcaatgcctgatcctcggcttccgcggtcgcctgcgcgggccgcgcggcgaggcgctgcacgagaagtggcggcaggcgttgttcgccttcgcctggcagcgcgaggcggacgccgccgacctcggccgtcgccttgagcagcccgccgctgcgccgccacggcgtctgccggtgcgcgcagcgctgccggacggcttccgcctgggcctggcggtgctcgggctggtgctgttgatgagcggtatcggacacctgttctggcgcgacatccagcacgaaatggcggcggtgacccacctggccgatgcggagcaggcgccatga

SEQ ID NO: 9036 - DNA, 465 bp, Pseudomonas aeruginosa
acagccagttcaatgccatggcggccgtcgccgaacgccacgccccggcgctggagtggttgcaggcgcagcaatccagcctggccaccgccgactacaacgcgttcgtgcgcttcagcgcgctcaacgccgaactgcagaaattcaaggccgacaacccggcgagcaccgcggcgcagttggcgaagctggtgggtaacgatttcaaccagatggacatcggcagttgcgccgacattctcaacggcgtgctcctgccgtccagccgcagcgacctggcgacgcgcctggtggacctgcgccagggcgcgctcgggcgctgccagtcgttgcaacagcagcaggcggcgcaggcctggaaggacctcgccgactacttcaaccagtacctcgccggacgcttcccgttcgcctacagcctggaagcggccgatgccgagccggggcgggtgcggcacctgctga

SEQ ID NO: 9037 - DNA, 807 bp, Pseudomonas aeruginosa
cagcagcctgccgaccggcgtctggcaggcggaggccaagcgcgccgactgggccgcggtggagcagttggccagcgatctgttgcagcggcgcagcaaggatctgatgctcgccgcctggctcggcgaggcctggctgcaacgcggcgggctgggcggattgcagcgcgcgctggtgctgctggcggaactctgcgagcgctaccccgaggaggtgcatccgcaagcccaggacggcgaccagtcgtggcgggtgccgcccatcgactggctgttgcgccgctatgccgagctgctgcacacgcgcctgccgctgatggggcagggcgccttcgccgagatcaccctctatgcctggcagaggttgcagcgccagcaggtcgccagcggcgacagcaagagcgccaaggcggcgctggaagcggcgcaacttcagcagaagaagctcgacgaagcgttgcgcgcggagcccttggtgcaatggcagcgcaagcaggccagcctgctcgcctgccagcagcaactgcaacgcctggaacagtggtgcgaccgctgcctgggcgaactcgcccccagttgccagccgctgcgcgaggtcatcgcgcaatggctggccttgctcaaggagttcatcgccatgcacccgcaagcgccgctgcccgaagaacagccaccggtcgcggaggcggacgccgccgaaggcgacgcggacggcgaggaaagcgtcccggcgagcgcgccgagcgggccggctggcgcgccgaccagtcgcgaggacgcctatcggcaactgctgctgatcgctga

SEQ ID NO: 9038 - DNA, 627 bp, Pseudomonas aeruginosa
ccaaatcggtgcgcgccaccgtgctggtgttcaacgacccccgttcccgcgagctgctggagcgcatcgagcgcctggcgcccagcgaggccaacgcgctggtcatcggcgagaccggcaccggcaaggagctggtggcgcgccatatccacgccctcagcggacgcaacggcggcccgttcgtcgcggtcaactgcggtgctttcgccgagagcctggtggagagcgagctgttcggccacgagaagggcgcctttaccggtgcgttgcagagcaaggccggctggttcgaggcggccaacggcggcaccctgttcctcgacgagatcggcgacctgccgccgagcatccaggtcaagctgctgcgcgtgctgcaggaacgcgaggtggtgcggctcggttcgcgccggccgatccccatcgacgtgcggctggtggcggcgaccaacgtcgacctggctgacgcggtggtcgccggacacttccgcgaggacctgttctaccgcctgcacgtggcgaccatccaactgccgccgttgcgcgagcgccgcggcgatatcctgccgctggccgagtacttcatcgtcgagcactgccggcgcctcggctacaccagcgcgagcctga

SEQ ID NO: 9039 - DNA, 585 bp, Pseudomonas aeruginosa
cgcaacagtccacagggaaatcccatgaccagccccttcaaagtcgtcgccgtctccggcggcacctatcgcccgtcccgcaccctggtactcacccaggccctgatcgccgagcttggccagtcgttgccgatcgacagccgggtcatcgagctgaccgacatcgccgcgccgctgggcgctaccctggcgcgcaaccaggcgccggcggaactgcaggcggtgctcgacgagatcgaaagcgccgacctgctgctggtcgcctcgccggtctaccgtggctcctatccgggcctgctcaagcacctgttcgacctgatcgacctcaacgccttgatcgacaccccggtgctgctcgccgccactggcggcaccgagcgccacgcgctggtcctcgaccaccagttgcgcccgctgttcagcttcttccaggcgatcaccctgcccatcggggtttacgccagcgaggccgacttcgacaactaccggatcgtcagcgagccgctgaaggcgcgcatccgcctcgccgccgagcgcgccgcgccgctgttcggcggacgctccgaactgttgaagatcgcctga

SEQ ID NO: 9040 - DNA, 2370 bp, Pseudomonas aeruginosa
ggtgcgccgatgaacgtgttctggttcctcccgacccacggcgatggccacttcctcggcaccagccagggcgcgcggccggtctcgctgccttacctgaagcaggtggcacaggcggccgacagccttggctatcacggcgtgctgatccccaccggacgctcctgcgaggactcctgggtggtggcctcggcgctggcgccgctgaccgagcgcctgcgcttcctggtggcgatgccgtccgggaatcgtttcgccgaccgtctcggcgcggatggcggcgaccctcgaccgcctgtccggcgggcgcctgctgatcaacgtggtcaccggcggcgatcccgacgagaaccgcggcgacggcatccatctcggccacgccgagcgctacgaggtcaccgacgagttccttcgggtctggcggcgcgtcctgcagggcgaggcggtggacttccacggcaagcacatccacgtggagaacgccaaggcgctctatccgccgctgcaacggccgtatccgccgctgtacttcggcggttcctcggaggccgcccacgaactggccggcgaacaggtggacgtctacctgacctggggcgagccgttgccggcggtggcggcgaaaatcgccgacgtgcgccagcgagcggctcgccatgggcgtacggtgaagttcggcatccgcctgcatgtgatcgtccgcgaaaccgccgaagaagcctggcgcgccgcggacaggctgatcgaacacatctccgacgagaccatcgccgccgcgcagcagtccttcgcccgtttcgactccgaaggccagcgacgcatggccgcgctgcacggcggccgccgcgatcgcctggagatccagccgaacctctgggccggggtcggcctggtgcgcggcggcgccggcaccgcgctggtcggcgatccgcggcaggtggcggagcgcatcggggaatacgccgagctcggcatcgacagcttcatcttctccggctatccgcacctggaagaggcctaccgcttcgccgaactggtcttcccgctgctgcccgaaccctacgccagcctggccggccgtgggctgaccaacctgaccgggccgttcggcgaaatgatcgccaacgacgtgctgccggctcgcgccggcgcttgagcagccgggcccccgaggagaaaccccctgtgaatgcgaagacccgccccgaggcgcaaacgccgttgcagatcgcccggcgcctggccgccgatttcgccgagaacgccgccgagcgcgacgtcgccggcggtaccccgaaggccgagcgcgacgcgttgcgccgcagcggcctgttgtcgctgatcatcccgcgcgaatacggcggcctgggggcgagctggagcgaaaccctgcaaaccgtgcgcgaactggcccgggtcgacagctcgatcgcccacgtctatggcttccagcacctgatgctggccaccgtgcgcctgttctcgcggcccgagcaatggcagccgtggttcgagctgaccgcgcgcaaccgctggttctggggcaacgcgctgaacccgctggacaaccgtaccgtggcccggcgcttcgacggctggcgcgagttctccgggaagaagagcttctgctccggcgcccgcgattcggagatgctcatcgcctcggcactggacggcgagggcggggcgctgctgattgccgccatccccaccgcgcgcagcggtatcagcctgggccaggattgggacaacatgggccagcggcagaccgacagcggcagcgcgatcttcgagcgggtgcgggtggaggagagcgagttgctgctcgatcccgggccgctgagcacgccgttcgcctgcctgcggccgctgatcgcccagttgatcttcaccgaggtgttcctcggcatcgccgaaggcgccttcgaggaggctcgccagtacaccctgcgcgaagcgcgaccgtggttccgctccgaggtcgccgaggccaatgccgacccctatgtgctggcgcgctacggcgaattctgggtcggcctggaaagcacccgggcgctggtcgagcgcgccgcgcagcgcctcgacgccgcctggtccaagggcccggcgctggacgccagcgagcgcggccagttggccctggccatcgccgccgccaaggtcgccgcgacgcgcaacggcctcgacctgtgcaaccgcatgttcgaagtcaccggcgcccgctccactcacgccgccctgcgcctggaccgctactggcgcaacctgcgcacccagaccctgcacgacccgctggactacaagatccgcgagctgggcgactgggcgctgaaccagtcaccgccgcaaccgaccttctactcatga

SEQ ID NO: 9041 - DNA, 465 bp, Pseudomonas aeruginosa
tcggcgagaccggcaccggcaaggaactggtggcgcggcatatccacaacctcagcgcgcggcgcaacggcccgttcgtggcggtcaactgcggggccttctccgagtcactggtggaagccgagctgttcggccacgagaagggtgccttcaccggcgccctggcggccaaggccggctggttcgaggaggccaacggcggcaccctgttcctcgacgagatcggcgacctgccgatgccgatccaggtcaagttgctgcgcgtgttgcaggagcgcgaggtggtgcgcctggggtcgcgcaagagcatccccatcgacgtgcgcgtgctggcggcgaccaacgtgcaactggagcgggcgatcaatgccgggcacttccgcgaggacctgtactaccggctcaatgtcgtcagtctcgaactgtcgccgttgcgcgagcgacccggcgacatcctgccgctga

SEQ ID NO: 9042 - DNA, 417 bp, Pseudomonas aeruginosa
cccgtggcaccgaggacggcgcgcaactggtggaggcgggggatcgcgaattgccgcagttgtcggtgcacgacgacggcgtgcggcgcttcatcgccctggtggacgaatgctacgaccgcaaggtgccgctctacctggaggccagggtgccgttggaggcactttataccgagggctacctggccttcgccttccgtcgcaccctcagccggctgcgcgagatgcagctggcacgcttcggcagcgacagcgccggctagcgccgcgccgccgaagcgggaactgcggatggccgcccgcgctcatccgccggccaggccgaggctcagtagccgtgccggcgcagcagcgcgtccatgtcttgcgccgccgggcggccctggaacttcagcagttccgaggtgcggttggtga

SEQ ID NO: 9043 - DNA, 1278 bp, Pseudomonas aeruginosa
ccagcaccagggccagcgggatacccaccagcaggacgatggcggaggacgcgccgatcatcagcagcgtatcgaggaaaccttgccagagccgttcaagcatgggcgacatggccgagcacctccaccttgtccgccaccagcgcggccttggccagcacgccgggaagctcgccgggcggcgcgccgacctgtagcagcaggcgccccagggcgcggccctggatacgctctatgccgccgtggagcaggtcgacgcgctggccgatggccctggcgatggccagcaggtccggcacccgtcggctggcgccggtgtactggagatcgagcagcaccgggtcgccggcgccgggagcctggcgcaggcgcgcctggaggtcggccgggagggcggcgcgcaggctgccgaacaggcttcgggtgacgggcatggcgcggatcgccgaagacttcccagacttcgccctgttcgacgatgcggccgcattcgaggaccaccacgcggtcgcagatctcgcggatgaccgccatctcgtgggtgatcaggacgatggtcaggcccagccggcggttgatgtcgcgcagcagcgcgaggatcgcctgggtgctctccgggtccagcgccgaggtggcttcgtcgcagagcagtatctgcggctggtgcaccagcgcgcgggcgatgccgacgcgctgtttctgcccgccggagagctgcgccggataggcgtcgcgtttttcctccaggccgaccagttgcagcagcccggcgacccgctcctcgatccgtgcccggggcaccccggccacccgcagcggcagggcgatgttctgccacacggtcttggccgacatcaggttgaagtgctggaagatcatgccgatgcgtcggcgcagggcgaccaggcgctggccgtcgtagccgccgatgtcttcgtcgtcgatcagcacctgcccctcgctgggacgctccaggcgattgagggtgcggatcagcgaggactttccggcgccgctgcggccgatgatgccgaacacttcgccgcggcggatttccaggtcgatctcccgcagggcctggactccaccggggtagcgcttgcccaggccttggagacggatgtgcggcgtggaggcgcgcgtgtcgggcgccgtcgggaacggttcgaggggcagcaggctcgggggaacggtcatggccgtcactcccagcccggctggtacagcgtgccatgggccttgtccagcgcggcgcggaccaccggtgaatgctggtag

SEQ ID NO: 9044 - DNA, 1386 bp, Pseudomonas aeruginosa
acgaaagggaaagtggggtcaggcctggcgctggcgcgcggccgggggctggcggaaggcggcgccggcgtgttccgcctgcaggcgcgcgcggccgccgccgaagagcttctcccgcagggtgccgggggcataggcggtcttgtagctgccgcgtgcctgcaactcgggcaccaccaggtcgatgaagtcggcgtagctctccggctccacggtgcgggtcagattgaagccgtccaggccggtatcggcgatccagccttcgaggtcgtcggcgacctggcgcgggtcgcctaccagggtcacgtagcggccgcccagggccaactggtcgaggagcttgcgcacggtggagtcggtgcgcgccacggtgaggttcttcaccaccgactcgatggcgttgttcttctcgtagcggatcggctcgtcgagtccgtagcgcgacaggtcgatgccgctggagctggcgaagtgcgccaggccggcctcggggctggcgtagcggcggtactcggcatgcttgtcgcgggcctcggccgcggtggctgcgacgatcacgttgatgcccatgaagatcctgatgtcctcggcgcgacggccggcgccgaccaccgccgcgcggatgcgctgcaccaactggcgggtggcctcgcgggtctgtccggagacgaacacgcattcggcgtggcgcgcggcgaaggccaggccacgctccgaggagccggcctggaacagcaccggggtgcgctgtggagagggctcggcgaggtggtagccctcgacctggtagaactcgccatggtggcggatcttgtggatcttctccggccgcgcgtagacccgtcgctggcggtcggcgagcaccgcgtcgtcttcccagctgccctcccagagcttgtagaggacctccaggtactcgtcggcgcggtcgtagcggcggtcgtgctcgatctgcgcggactggcccatggccttggccgcgctttccaggtagccggtgacgatgttccagccgatccgcccgtcgctcaaatggtcgagggtcgagagccgccgggcgaacgggtagggcgcctcgtaggtgaggttggcggtgacgccgaaacccaggtgctcggtgaccccggccatggccgagaccagcatcagcgggtcgttcaccggcaactggacggcttcgcgggcggtcacctcgatgccgccctggtagacgtcgtagacgccgaggatatcggcgatgaacaggccgtcgaacaggccgcgctccagcagccgggccagctcggtccagtggcgcagtttgcggtagtcgctggagcggtcgcgtgggtgggtccagaggccgtggttgatatggccgacgcaattcatgctgaaggcgtttag

SEQ ID NO: 9045 - DNA, 552 bp, Pseudomonas aeruginosa
tcgccgaccgcgtggtacttccagcgcaccgggtcgtgcagggtgtgtacgcgggcgttgcgccagtggcggtcgagaccgagttcggcgagacaggcgcggctgccgccaagctcgatcagcttgctgccggccagcagggcgacctcggtggtcagcgcgcgggcttcggcgacggcgatcgaggcggccgccacgctttccgcgtccggctcggcggtggcccggtcgagcacccgcccggcacgctccagcagcgcttcggcggcgtgcaggcggatcgccaggcggccgatctcatggatggtcagtgggtcgtcgctggccttgtcgacgccggagtcgacccagggccgggcgcgctcgcggacgaaacgcagggtgtcctcgaaggcgccgcgggcgatcccggcgtcgatcgccgcgtggaggatctgtgccagcgggccgacggtggtcgggcgctcgaaggcgtcctggaacgagaccacgtcctcggcggccaccgctacccggtcgaacagcgccgaaccgctgccggtggtgcgttga

SEQ ID NO: 9046 - DNA, 1089 bp, Pseudomonas aeruginosa
gtgacgcgccggacgggcgccgttcaggtagtagtcgccgaccgcgtggactttccagcgcaccgggtcgtgcagggtatgggtgcgggcgttgcgccagtgccggtcgaggttgaactcggcgagcgtggcacggctgccggccagttcgaagagcttctcgctggcggccaggctgatctcggtgctcagcaccttggcctcggccacggcgatcgaggcgcgtgccgccgactcggcgtccaccggccgcgcggccacttcgtcgaggacctggccggccttctccagcagggcgttggcagcgtgcagctcgatttgcaggcggccgacctcggcgatgctgtagagctcatcgctggcgcgttcgacctgggcgtcgatccagggccggctgcgttcgcggacgaaagcctgggcgtcgtccagcgccgcctgggcgatgccggcgtcgatggcggcctggatcagttgcgagacggcgccctggaggctcgggatctcggccagcaggccgttgtggatcagcatgtcgccggctaccggaacctcgtccagcagtaccgtgccgctggcggtggtgcgctggccgaagccggaccagtcgtcgacgatgcgcaggccgggagcgccgcgctcgacgaagagcatcaccgcgcgctcttcctcgtcgatggccttgaccgccacccagtgggcgaacaaggctccggtggagtagaacttctcgccgctgacccggtagccgtcgccgtcgcgacggacccgcgccttcagctccagggtgtggcgggtattgcgctccgggccggcgttggccagccggcggccgtcgaggatgccacggaacagcttgcgtttctgcgccgggctggcgacgttgtcgatcacgctgagcaggccgaactggttctgcggaatctgtccgagggccgggtcggcggcacagatgacacggaacacctcggccagggtcacatgggaaacctgcgcgccgccatgggcgcggggaatgccgatgccgcccaggccgaggcgggtgaagagttccagttcctgccagggcaggcgtcgttcgcggtcgcgtag

SEQ ID NO: 9047 - DNA, 195 bp, Pseudomonas aeruginosa
ccggggcgcctggtcacgaagatccttgggtgcggtttcgtcggtcatggttcagccttgcagcgtggtggttccgccagcggcatcggtgtggcgcggcttgcgggttctgtggtgcgggtggaacgcctggaggagggaggggaaacaggcggtaacgacatgctcgctgggcacctctggcagttcggatag

SEQ ID NO: 9048 - DNA, 1314 bp, Pseudomonas aeruginosa
cgcttcagaactcaccaccgacatcgccgtgatcggcggcggcgcggccggcatcggcgtgatcgccagcctgctgaaacgttcgccggggttgcgtatcagcctgatcgagccggcggacacccactactaccaaccgggctggaccctggtcggtggcggcgcctacgcacagggcgacaccgcgcggccgatggccgggctggtcccgcccggcgtggagtggttgcgcacccgcgtcgagcgggtcgaccccgaggcgcgccgactgttgctggagggcggcgacagcctggaataccgcaacctgatcgtctgccccggcctgcgcctggcctgggagcgcatcgagggcctggaggagaccctggggcgcaacggcgtcacctccaactaccgctacgacctggcgccctacacctgggagctggtgcgcggcctgcgcggcggcaaggcgctgttcacccagccggcgatgccgatcaagtgcgccggggcgccgcagaaggccatgtacctgtcctgcgaccactggctgcgggagggcgtgctgcaggacatcgaggtcgagttcgacctggccggcgcggcgttgttcggtgtcgccgatttcgttccgccgctgatggagtacgtgcgcaagtattcggccgagctggcgttcaattccaacctggtgaaggtcgacggcgcggcgcgcaaggcctggttcgaggtgaaggacgccgacggcaacaccaatctggcggaaaaggacttcgacctgctgcacgtggtgccgccgcagctgccgccgacctttgtcgccgccagcggcctgggcgacgcggccggctggtgcgaagtcgacccggcgaccctgcaacatgtccgccatggcgagatcttcgccctcggcgatgtctgcggcaccgccaacgcgaagaccgcggcggcggcgcgcaagcagatcgtggtggtggccgagaaccttctcggcctgcgcagcggccgtggcctgccgctgcgctacgacggctacggcggttgtccgctgaccgtcgagcgcggccgggtggtgctggcggagttcggctatgccggcaagctgctgccgaccttcccgctggagcccaccgcggccagccgcttcgcctggctgctcaagcgccacgtactgccctgggtgtactggaacgccatgctcaagggccgggagtggctggcgcggccggggcgctagaccgggcggcagccctcggcctgaccctccgcacggccggcctcaaagctcgtgggcgaacggcaggtccggccccacccgcgagcaggtga

SEQ ID NO: 9049 - DNA, 1128 bp, Pseudomonas aeruginosa
cgccggaacccgctcgccgtcgaagaacggcagcatcagcagaccctcggcgccgaccggcgcctgggcggccagccgggagaattcgtcgaggtcgaggtgcagcaggtcctgtaccaggccgcaggcgccggtgaggttcatcgtgcaggccagcggcagccaaccgccggacgaggcgcagaaggtcgccagctcgccgtgcggactgaccagcggccgctcggcataggcgctcagggtgccggaggtgcccaggctggcggtgagcaggccggggcggatgttgccggtgccgatggcggcgagcatgttgtcgccgccgccgcaggcgacccgcgtgtggggagccaggccgagggcggcggccgcttcggggcgcaggttgccgatgcaggcgccgggctcgatcagctccggcagcgccgccgccaggcgtccgcccggctcgaccagctccagcacgtcgctggcccaggtgcgccggcgcacgtcgaagtagccgctgccggaggcgtcgcccgcttcgctgcagacgcggccggtgagccagtggttgaggtagtcgtggggcaggaggatgtgcgcgacgcgggcgaacagctcgggaaagcggcgcctgctccagagcagcttggacagcgtgtagcccggcgcgagcaccagtcccaggcgttccagcgagccggccgggccgccgagggcttccagcagctcgcggttttccgccgcgctctcggtgtcgcaccagagcttggccgggcgcagcgcccggccctcggcgtcgagcaggagcagcccatgctgctgggcggaaaccgccagggcgcggacctcgcggccgtccaccgcggcttcttccagggccatgcgtaccgcgctggccatggcttccagccagtccgccggatcctgctcgcggcgtccgtcacggccttccggcgggcgctgcgcggcgctgcccaggcccagcgtgcggccgctgccggcgtcgagcagcagcgccttgctaccctgggtgccgcaatcgatgccgaggaacaatccgtgcatgcggccctccggcgtcattcgccgagtacctggcgcagggtttcgctgacgccgtgtcggcgcaggctgtcgtag

SEQ ID NO: 9050 - DNA, 465 bp, Pseudomonas aeruginosa
ggcgtgacgtcgtcggtgaactgcacgccgaccttttcccaggccgggcgcccagcgctgaaacgatcttccagcacccattgcacgaagggttcgcagaccaccggccaggcgtcttccacgtcgtgccgttgggccagttggcggcggtgggcggggctggtcatcggggtgatgcggtcgaccatggcgttgggaaagctgacgtgcgtcgcgatccagcgcgccagccccgggtcgagccgttcggcgaaggccagcagcgccttgcgcgccacctcgccgttatgcgggaggttgtcgcaggacatcacggtgaacgccggcacgcctgtgtcgcggcgccgccgcagagcctcgcagagaaagccgaagaccccgcgcggggtccgcgggttggccaggtcgtggcgcaccagcggcaactcggcgaggaactcgccgctgccatcgtcgatgcagtag

SEQ ID NO: 9051 - DNA, 1701 bp, Pseudomonas aeruginosa
cggcaggccgacgcgcgcgccgcattcgagggcgacctcgcagcgctcgccctggttgcggctgagatggccgcgcaggaagcccatcttcggcgtgccgaggaagccggcgacgaacaggttggccggatggtggtaaagctccagcggcgagccgacctgctcgacgcgcccgccgttgagcaccacgaccttgtccgccagggtcatcgcctcgacctggtcgtgggtcacgtagatcatggtcgccgccagttcctggtgcagccgcgccagttccaggcgcatctgcacgcgcagggcggcgtcgaggttggacagcggttcgtcgaagaggaatatcttcgggttgcgcacgatcgcccggccgatcgccacccgctgccgttggccgccggagagctggcgcggcttgcgctccagcagcgcttgcagttcgaggatgcgtgcggcggcgtcgaccttggcggcgacctcgcgcttgtcgacgccggccaggtcgagggcgaaggagaggttcctgcgcaccgtcatgtgcgggtacagcgcgtaggtctggaagaccatcgccaggtcgcgtttcgccggcggggtgtcggtgatgtccgtgccgtcgagggcgatgctgccgccgctggcctcttcgaggccggcgatcaggcgcagcagggtcgacttgccgcagccggaggggccgacgaagactacgaactcgcggtcgcggacgtcgaggtcgatgcccttgatgatggcctggccgtcgaagcctttctgcaggttgcggatcttgagatcagccatggcggaatacctccgtggacgaaaggatggggatgcgcttcatttcacggcgccgaaggaaaggccgcgtaccagctgcttctggctgatccagccgaagaccaggatcggcgcgcaggcgagggtggagacggccgagagcttggcccagaacagtccttcggggctggaataggaggcgaccagggcggtcagcggggcggcggccgaggaggtcaggttgagcgaccagaaggcctcgttccaacacaggatcagcgacagcagcagggtcgaggcgagcccgccgcgggcgatcggcagcagtacgcggacgatctcctgccaggtgccggcgccgtccaggcgcgctgcttcgaggatgtccacggggatgtccttgaagtaggtgtacaccatccagaccacgatcggcaggttgatcagggtgtagacgatgatcagcgccagccgcgaatcgagcaggccgaactgcttggccagcaggtagatcggcatcagtacgccgaccggcggaagcatcttggtcgacagcatccagagcagcgtgcgcttggtgtggcgggtctcgaagaaggccatggagtaggccgccggcaccgcgacgagcatgcacaggagagtcgccgaggaggagatcagcaacgagttccaggcgtaggcgaagtagtcgctgcgctcgttgatgtgcaggtagttctccagggtcggctggaagatgaactgcggcggcgtggcgaaggcgtcgatctcgctcttgaagctggtcagcagcatccagaagatcgggaagaacagcagcagggcgatgccccagcagagcaggccgagcagggcattgcgcaggcggcgggattgcttgagtgtcagcatggcgggttcctcagctgcgctcggtaa

SEQ ID NO: 9052 - DNA, 600 bp, Pseudomonas aeruginosa
cctttcgcaatcggccttcagccgcagcatccaggcgctcgaacacagcgctggctgccgcctggtggaccgcgcggccaaggacctgcgtccgaccaagcagggcctgatcgtcctcgaacatgcgcgccggctggtcagcggcgcgcacaacctggccaacgagatcgccctgttcaacggcctggaggccggcgaactgcgcttcggcgccggaccggctcccgccacctggctggtgccgcgtgcggtagggcgcttcaacgtgcgttatccgaaggcgcgggtgagtttccaggtcgaacactggcaggcgctgaaccgccgcctgcaggccgaggagttcgagttcttcgtcgccgacacccggcatttcgaggccgacccgcaataccggacctcgcgcctgcgtccccggcgctggcatttctgctgccgcgaggggcatccgctggccgctcgcgagagcgtttccgccgaggagctgttgagcttcccgctggcgaccaacatcagcccgccgaacatccgcaaggtgctggtggacctcagcgggcgtcccgacttccgcccggccatcgagtgcgagaacggccatag

SEQ ID NO: 9053 - DNA, 558 bp, Pseudomonas aeruginosa
cccggccttcgccgacaagcgcgaaagcgcgccctacacccactacctgcggcgcctcggcttcaccggcgacaacccctggcacgactgggccaactccgccgccagcgccgacggggaaatcctcagcggctggcggatgcgccatgccggattgccgacacgcttgccggaggcgcacagcgagaccgcctataccacccgtcgcgccatggatttcatcgacgagcagggcgagcgtccctggtgcctgcacctgtcctacatcaagccgcactggccctacatcgcgccggcgccgtaccacgcgctgtaccgcgccgaccaggtgctcccggcgctacgcgcggcgcccggcgaagaaagcgaccacccggtgtaccgcgccttccgcgaacatcgcgagagcctcaatttctcccgcgaagacgtgcgccggcaggtgatacctacctacatggggctgatccgccaggtcgacgaccagctcggccggctcttccagcacatgcgcgccagcgggcgctgggacgataccctgatcgtcttcaccagtga

SEQ ID NO: 9054 - DNA, 618 bp, Pseudomonas aeruginosa
atggatttcttattaccaagagacttcttcgacacctcaaccaccggagtcgaaagcatgtcacgcgttcccgtgctcaccctggaaaacgcccccgaggcggcgcgtccgttcctccagaccgcgctgaacaactcgggttatatcccgaatctgctcggcgtgctggccaatgcgccggccgccctggaaacctacctcaccgtgtccgggctgaacgccaaggccagcctcggcctgcccgagcgggaagtggtgcaactggtggcggccaccacccatggctgcgacttctgcgttgccgggcacaccgcggtggcgcgcaacaaggcgcgcctgccggagccggtgatcgaggccctgcgcgcccgcggcgaactgcccgatgcccgctacgaagccctggccgacttcacccgcgcggtgatcgccagccgcggtgcggtcaccgacgagcagttcgaagccttccgcgccgccggtttcgaccaggcccaggccctggaagtgatcctcggggtgagcctggcgacgctctgcaacttcgccaacgtgttcgcccgcacgccgctcaatgccgagctggagcaatatcgctggaccaacccgcaggcctga

SEQ ID NO: 9055 - DNA, 1893 bp, Pseudomonas aeruginosa
cccgaccctgagcgactggctcgaccgccaggccgacgccctcgaccgcggcgacgccgatcccgccgcgctgctgccgcgcctggccgccgccggcgtgctcggcgtggcggtggaggaacgcctcggcggcgccggcggcacgctcgccgacgcggtggagcgggtggccgcagtggcggcgcgctcgctgaccgcggcgttcgtcttctggggccagcgcgccttcatcgagtacctgttgcagagtcccaaccaggaactgcgccaacgcctgctcggcgacctgctggccggccgcctggccggcgccactgggctgtccaacgcgatgaagttcctctccgggatcgaggcgctgcaggtggtggcgcacgcggaggaggccggctggcgcctggacggtcgcctgccgtgggtgaccaacctgcgcagcggcgatttcgtggtggcggcggcgatcgaacacggggagggcggcaagcccttcgtcctggcgattcccgaaggactcgccggcttgcagcgctcggcggacctgcgcctgctcggcctgcaatgcagcaacaccgccgccctcgatctgcgcgcggtggcggtcgggcgcgactggctgttgcacgacgacgcccggcagttcctgccacgggtgcgcccggccttcctcggcctgcaatgcggcatggccatcggcctggcgcgccgcgcactggacgaagtgcagcggcacctgggcggcagccgttcgctcctggatggcgagctggcggcacagcgcgaaaccctcgacggacacgtggcggcgctgcacgccggactggccagcggcgagttcgccagccagccggcacgcctgttccgcatccgcatcgggctcgccgaagccgccgccaatgccgtgcaactggagttgcaggccagcggcggcaaggcatacctgagcgagcacggcgccggtttcgcccgccgctggcgcgagtcggcgttcgtcccgatcgttacgccgagcctggtgcaactgcgcgccgaactgcaacgccaggccgaggccaaggcatgagcgaggcgctcctcgacgctcgcgggatcgccctcggctatccgcgcggtgccggctggcaggcggtgctcggcgatttcgaattgcgcctgggcgccggcgaggtggtctcgatcctcggtcccagcggcgtcggcaagtccagcctgctgcgcgtgctggccggcctgcaggagccggccgccggcagcgtgcgggtactcggcgagcccctgcgcggaccgcatccgggcgtcgcggtggcgttccaggaccccagcctgctgccctggctgaacctggagaagaacgtcgccttcggcctcgatttcgcccgccagccgcacctcgacgcggccacccgccaggcccgcgtcgaccaggcgatcgccgcggtcggcctggagcacgcccgtgcccgctacccggcgcaactctccggcggcatggcccagcgcaccgcgctggcccgctgcctggcgcggcagccgaaggtgctgctgctcgacgaacctttcggcgcgctggacgaagtgacccgcgccgacatgcagcagctgctgctgcgggcgatccacgagcgcggcaccgccgtggtcctgatcacccacgatatcgacgaggccctgctgctctccgaacgcatcctgctactgggtgacagcccggcgcggaccctcggcgagtggcgcatcgacctgccgcagccacgcgcggagctggtcgaggaactgggcgcgttgcgcatcgagatcctgaaaaccctacggcgggcgagccgcacccatgcccatcccatcgctcagccggaggcctcccatgtgcctggacgacccgacccattcccgacgtga

SEQ ID NO: 9056 - DNA, 867 bp, Pseudomonas aeruginosa
cctggtggacgaccgcttcgtccgccaggccctggcagaggtcggcgggttgcaggcgttcggcctcgccgagggcttccagcgcagcgaggagatcagcccgtgaggcagacgctgcgccagggcgcgctaggcgtcgccgggctgttgacgctgttcgccctgtggtggctcggcgtggccctgttcggcgccgccgacggcctttcggcacgcttctcgccgcaggcgacgttgctcagcctgggtgaactgctggaacgccgcgaactctacgagcacgtgctggtgagcctgaaacgggtcctgctgggcttgttcctggcgctgctggtgggagtgccgctggggctgctggtgggcgcctcgcgcaacctggaagcggcgaccactccggcgtttcagttcctgcggatgatctcgccgctgtcgtggatgcccatcgcggtgatgctgatgggcgtgggcgaccagccgatctatttcctgctggccttcgccgcgctctggccgatcctgctgaataccgccgccggcgtgcgccagctcgacccgcgctggctgcaactgagccgcagcctcgccgccacgccctgggaaaccctgcgccgggtgatcctgccgggcatcctcggccatgtgctgaccggcgtgcgcctggccatcggcatcctctggatcgtcctggtgccctgcgagatgcttggcgtcagcgccgggctcggctactacatcctcgacacccgcgaccgcctggcgtactccgagctgatggcgatggtgctgctgatcggcctgctcggctacctgctcgacgcggcggcgcgcggactctaccggcgctgggcgcacggggcgctcgggtag

SEQ ID NO: 9057 - DNA, 1710 bp, Pseudomonas aeruginosa
cgccggggcgctattcgccctacgggtaatggagaggttcgggtagggcgaatagccgctcgcggctatccgccggacggggttccagtgcgctggcggatagcgctggggcgctattcgccctacggggttcggggctcgggtggggcgggcgaatgtgttgatccaccaacacttgcccagcagttgcgcccgcacagcgacaggggcttgccacccaggccttgtccggcgcggccccgcggcccggcacgggctgtgcacggggtgccggatgcacaggcaagccaaggagtccccatgccgcgcgaaatccgtctcaacgccttcgaaatgaactgtgtcggccaccagtcgcccggcctctgggcgcatccgcgcgaccgctcctcgcagtacaaggacctggagtactggaccgacctggcgcggttgctcgaacgcggccgtttcgacggactgttcatcgccgacgtgctgggcatctacgatgtgctcgacggcaatggcgacgcggcgatccgccaggccgcccaggtaccggtgaacgacccgctggcgctgatcacgccgatggccgcggtgactcgccacctgggcttcggcctgaccgcctcgctgtccttcgagcatccctatcccttcgcccgccgactctcgaccctggaccacctgaccaagggccggatcggctggaacgtagtgacctcctacctggaaagcggcgcgcgcaacctcggtcagcaggcccagctcgaccacgaccgccgctacgactatgccgacgaatacctacaggtgctctacaaactcttcgaaggcagttgggaggacggcgcggtgctccgcgaccgtcgccgaaggatcttcagcgacccgggcaagattcacgagatccgccatgtcggcgagcacttccaggtacccggcatccatctctgcgaaccgtcgccgcagcgcacgccggtgctctaccaggccggcgcgtcgagtcgtggcaagcgcttcgccgccgagcacgccgagtgcgtgttcgtcgccgcgccatcgaagaccgtgctcaagcaggcggtcgccgacatccgccagcgcgtcgccgaggccggccgcgatccgcgcaaggtactggtgttcaacctgcagacggtggtgctgggcgaaaccgacgccaaggccagggccaagttcgacgaataccgcgccttcgtcagctacgaaggggccctggcgctgatctccggctggaccgggatcgacttcggccagtatcggccggaccaggtgctgcggcacatccacaccaatgcgatccaatcggcggtggaagcgttttccagcgccgatccgacgcgcacctggacggtccgcgagctggccgactgggtcggtatcggcggcttcggaccgctgttcgtcggcagcccggcgaccgtcgccgacctgttgcaggagtgggtggaggacaccgacgtggatggcttcaacctggcctatgcgctggcccacgaaaccttcagcgacgtggtcgaattgctggtgccggagttgcagaagcgcggggtgtacaagaccgaatatgcgccgggaaccctgcgcgagaagttgttcggcgacggcccgcggctgccggattcccatccggcggccggctatcgcgacctgcgggccctctgggagaaggaggccgggcgcaacgcgctgccggcctga

SEQ ID NO: 9058 - DNA, 1206 bp, Pseudomonas aeruginosa
ccagggcttggaggggtggatgcatggaacacctcaagcgtgagacagcgctatctttgcgacctggaaaaaatcgcgcgagcctggctccgccttcttgtcgttgtggtctgtcgaatcccgcgcgggcagtggcggacaggccgcctcaggcgattgcccaggtcgcgagacagcgctaccttagtgcctggaattttgtttggcaagcaggccacgatgagcatcaccaagaacgacaagaacacgcgaaccaccggacgtcccaccctcaacgaagtcgcgcgccgcgccggggtcagcccgatcaccgcgtcgcgcgcgttgcgcggcgtcgccagcgtcgccgaagaactggcgcagaaggtccgcgacgccgcccgcgaactcggctacgtggccaaccccgcggcgcgcgcgctggcctcggcgcaaagccacagcgtggcggtgctggtgccgtcgctggccaacctgctgttcatcgagaccctcgaggcgatccacgcggtactgcggccgcagggcctggaagtgctgatcggcaacttccactactcgcgcaacgaggaagaggacctgatccgcaactacctggcctaccagccgcgcggcctgctgctgaccggcttcgagcgcaccgagagcgcccggcggatgatcgaggccagcggcattccctgcgtgtacatgatggacctggactccggctccgggctcaattgcgtcggcttctcccagttgcgcgccggcgaggccgccgccgagcacctgcctggcacgcggccgcaggcgcctggcctacatcggcgcccagctcgaccagcgcaccctgctgcgcggcgaggggttccgccgcgccttgcaaaaggccggctgctacgacccggggctggaaatccttacgccgcggccgtcctcggtggccctcggcggcgaactcttcgtgcagttgctggccagccagccgcaggtcgacggggtgttcttctgcaacgacgacctggcccagggcgcgctgctggaggccctgcgccgtggggtcaaggtgccggaacagatcgccgtgctcggtttcaacgacctgccgggttcggactgcacggtcccgcgcctgagcagcatccgcaccccgcgcgaagccatcggccggcgcgcggcggagcagttgctggcgctgatcgccggcaaggaggtgcgcgatag

SEQ ID NO: 9059 - DNA, 621 bp, Pseudomonas aeruginosa
gtttcagcgccggccgttccagtagccggagagctggtgccaggtcttgcccgcgctgagcagcagcgggcggaagtggtccttgccgtggatcgggatgcggcgcaccgagctgagcaggtcgtagcgcgccgagccttcgctcatgccttcggcgaggaccttgcagacgatgtggctgggggtcacgccgaacccggaataaccctggacgaagaacgcgttgggccgccccgagaggctgccgatctgcgggaacaggttggcgctgcaagccatcggcccaccccaggcgaggtcgatgcggacgtgctccaggtaggggaaaatcttcagcatcagcttgcggttccaggccttgaggtcgccggggatgcgttcgacgaagggtgtggcggcgccgaacagcaggcggttctcgttggtcacccggtagtagtcgatgaccgggcggatgtcgctgtaggcgccgcggatcgggctgatccgctggatcagttcgtccggcagcggctcggtcatcatctggaacgcgtaggtattgatggtggtgcggtgcagctcgggttcgagccggttgaggaagctgtcgcatgcccaagagcatcttgttcgcggtga

SEQ ID NO: 9060 - DNA, 516 bp, Pseudomonas aeruginosa
gcctgcatgaaatcggcgagcgtcggcaggaccagcccgctgaccagcggcaggctgacccgtaggcgcccgcgcggggtctcgcggctttgcgacagctccagctcggtggcttcgatctcggccaggatgcgccggctgcgctcgaggaacaggctgccttcggcggtcagggtgatgctgcgggtgctgcggtggaacaggcgcacgccgagtttctcttccaggcgggcgacccgcttgcccaccgccgaggcgctgacgccgagggtccgggcggcgccgacgatgctgcgggtctcggcgacgcggacgaagacggtgaaaccgctgaggctgtccatgcaaggctccgattacggacatgacagtccggatagaacggaactctatccgtctttttccgcttttgcagcgctcttatcctgtccgcatccttcatctgcggagagtcccgcatgtccagtttcgaacgagagccaggctgcggcctggcggaaaatgtcgatcaggtga

SEQ ID NO: 9061 - DNA, 1734 bp, Pseudomonas aeruginosa
cgcctggcctggcggaggagatgggccgcgaccaggtacccggcctggaactgccggccaatcccggtttcggcttcggcctgggtttctccgtgctgcgcgacccggctatcgcgcaatcgccggaggctcccggcacctggcgctggggcggcgcctacgggcattcctggttcgtcgaccgggcccgcgaactgtcggtggtggcgcttaccaacaccctgttcgagggcatgtcgggacgcttcgtcaacgacctgcgcgacgccgtctaccgttccgcggagctgcgctgatgggacgccgcgaagcatttccggagaacgccggggccgctgcgtcggccgtggcgccgcggctgccgctgagtgcgctgctggcgatggcgatgtccggcttcgtcgccattctcagcgaaaccctgccggccggcctgctgccgcaaatcggcgcggggctggcggtcagcgaggcgctggccgggcaactggtcagcgtctacgccttgggttcgctactggccgcgctgccggcggcgagcctgacccagggctggcggcggcgccgggtgctgctgctggcgctgctgatcttcttcgtctgcaacagcctaaccgccgtttcctcggattaccgcctgaccctgctggcgcgcttcggcagcggcgtcgccgccggcctcgcctggggcctgctggccggctacgcgcggcgcctggtgccgccggagcagcaggggcgggcgctggcggtggccatgctcggtgcgccgctggcgctgtcgctcggcgttccgctgggcacctggctgggcggcctgctcggctggcgctgggccttcggcctgttgtcgctgaccgcgctgctgctggtcggctgggtgctgcgcagcgtgccggacttccctggccagccggccgggcggcgcctgcgcctgctcggggtgctgcgcacgccgggcgtgcgtccggtattgctggtgatcgtcgcctgggtgctggcgcacaacatcctctacacctatatcgcgccgttcctcgccaaggtcggcctgggcgcctcggtggacctggccctgctggtattcggcagcgccgcggtggcgggaatctggctggtcggcgtgctggtcgaccggcacctgcggcggatggtcctggccagcctggcgctgttcgccgtggcggcgctggcgctgtgcctgggcgctcgctggagctggctggcgttcgccggcctggccctctgggggctgacgttcggtggcgcggcgacgctgctgcagaccgcctcggcggacgccgccggggagggcgccgacctggcccagtcgatgatcgtggtggcctggaacctggccatcgccggcggcggagcgttgggtggcatggtgttgcagcgctggggcagcgagatgctgccctggaccctgctaccgctgatcggcttggccgccgtgctggtctggggcaatgccgcgcacgctttccgcgtcggcccgcgcgacttccgcagggcatcgtccgagcaccggaaagcggcgcaatagacggggctgcgcccggcaaggggaaaaaggctgcgggtcttagaacgtttattcacctgggttatttggataggtccgtttcgaatatccatcgcgtcgaaataccggctgtgacgatgcgttcctccgccatgcagcggaatccgctgtcattgcgccgaacatcttcgctgtctcgccgctag

SEQ ID NO: 9062 - DNA, 1182 bp, Pseudomonas aeruginosa
cccggcgaaagatgcaggaagaactgctgcgcctgtgggaagaggtgcgtttcaccctgctgttcgtcacccactccatcgaggaggcgttggtggtgggcaaccgcatcctgctgctctcgccgcacccggggcgggtccgggccgaagtgcacggccacccgttcgggctgcacagccttggcggcgagccgctgcaagccgcggcgcgacgcatccaccgcttgctgttcgacgagggcggcgaaccgacggcggccgcgaccctcgacttcgccgatatccggctggcccattgagcagaggaatcgatcgatgagtcgagtcacgcgcgttcgcgaagaatacgaagtccagctcgaacccctgctggaggtctccctggagcggcgcctgcccctgagccagcgtctctggcaacagggctggctgcgcaaggggctgatcctggcgctgctggcgctggcctgggagctggcggcgcgggtccagggcaacgacctgctgctgccaggcttcctgcagacggccagggccctcggcgagggcctggccagcggcgaactgccggccaaggcggggatctccctgctggtgctgttcaagggctacctgctggggatcgtcctggccttcgttctgaccagcctggcggtctccacgcagttgggccgcgacctgctcgggaccctcacggcgatgttcaacccgctgccggcgatcgcgctgctgccgctggcgctgctctggttcggcctgggccagaacagcctgatcttcgtgctggtgcattcggtgctctgggcgctggcgctgaacacctatgccggtttcctcggtgtctcggagaccctgcgtatggcagggcgcaactacggcctgcgtggcctgcgcttcgtcctcctgatcctggtgccggcggcgctgccgtcgattctcgccgggctgaagatcggctgggccttcgcctggcgcacgctgatcgccgcggaactggtgttcggcgcgagcagcggcaagggcgggctcggctggtacattttccagaaccgcaacgagctgtacaccgacaaggtattcgccggcctggccgtggtggtgctgatcggcctgctggtggagaacctggtgttcggcagcatcgagcgcctcacggtgaagcgctggggagtgcaacgctag

SEQ ID NO: 9063 - DNA, 987 bp, Pseudomonas aeruginosa
agagtttttcgctcggtgcccagcctcggaagggggagagcgatgcaggagcgacatggcttaccgttacgcagcttttcgtcgggcaaggcgctgaccgcgggacgcgcagtgcgcccggaggttgcgcaggagcggcgctacctgcaaggcgccccgctggggctggagttgccgggacgaatcgccttgcgcgacccgcattgcgcctggcaatggttcgagccggaggcggccgcggaagcgttcccggcggcgcactggctggcggcgttcctggtactgctgggacgctacggcaacgaagagatcaccctgggctttcccgagccgatcacggttcgcgggcggcaggcgcccgcgctgctgcgttccgcctaccgggcgatggagtcgtccgccgaacgtagcgcgcggctggcggaagaactcgatgacgcccggcggcagctatccgccgacggccaggagcgcgccgccctggccgggtgctgcgcggtccaggtgctggcggcgcggccaacggcgagcagccccggctggctggccctggtgctggcggcggacggcagcgtcggcctggctctgcgcgatccccagtacgacgaattgcggcgtatcgccggccatctcgcgcgcatggcgcgcggcatggtcgacgcccaggcatgcgtcggccggctgccctggatggacgccgacgaagagcgccgtatgcaggccatgcgcagcgagccccaggccgccccgtcgcgcggcgtactccaccatctgttcgaggcccaggcgcggcgcacaccgcagcgcatcgccgtgcacgccgccgaccgtagcctcagatatgccgagctggagcgcgaaagcgccgcgctcgccgtgcgcctgcgcgccgccggggtggctccggagcagcgggtcggggtctgcatgcggcgcgacagcggcctgctggtcggcctgcttggcgtgctccgcgccggcggttga

SEQ ID NO: 9064 - DNA, 2805 bp, Pseudomonas aeruginosa
tacgtcccgctggacccggcctatccggaggagcgggtggcatacatgctcgacgacgccgactgcctgctggtgctggtcgacgcgagcacccgcgagcgggtcgccgcgctgggccggccatgcctgacgctggaggagggcggcgaccaggcgaacgacctggcgctgcccgcgagcgaggtcggcgccgaccacctcgcctacatcatctacacctccggttccaccggacgccccaagggcgtcgccatcgagcacggcagcgcccatgccttcctgcgctgggccggccagcactatgccgccgaagaatggagcggggtactggcggcgacctcggtgtgcttcgacctgtcggtctacgagctgttcggtaccctggccgaaggcggcacgctgcacctggtggaaaacctgttcagcctgccggactacccgcgccgcgacgagatcagcctgctcaataccgtgccctcggtgtgtgccgcgctgctcgccctcggcgacctgccgggcggggtgcgcacgctgaacctggccggcgaaccgctgcgcggccacctggtgcgacagattcgtggccaaccccaggtacggcgcctggtcaatctctacgggccgaccgaggacaccacctattcgacggcgcacgaactggacctgcacgccgaagcgctcgacgagccgcccatcggccgaccgctgcccggcaccacggtggaggtgctcgacggcttcgaggcgccgctgccgctgggcgtggccggggagctgtacctcggcggcatcggcctggcgcgtggctatttcggcaagccggagcagaccgccgagcgtttccgcgtcgatccgggcagcggcgagcgccgctatcgcaccggcgaccgcgtacgcatgcgcgaggacggcgtgctggaacacctcggccggctcgacgaccaggtcaagttcaacggcttccgcatcgagctgggcgagatcgcctcgtgcctggcgagttttcccggggtgagcgaagcctgcgccatgctcaccgaggacagcgccggcctgcgtcggctggtcggctacctggcggcgccgttcgccccgccgctccaggcgctgaacgagcaccttgggcaaagtctgccgcactacatgttgccgtcagcgttcgtggtcctggcggagctgcccaagacgctcaacggcaagatcgaccgcaaggccctgccgcgtccccaggcgagcggcgccgagccgcaggcgctgcccagcgatccgctggagcaggcgctacaccaggcctggcaggcgcagcttggtgcgccgccgcgcgccggacagggcttctacgccgccggcggcgattccctgcgggcggtgcacctgctcgcgacgctgcgccagcgactgtcccgacgcgtaccgttgcaggcgttcgccggtggcccggcgacccccgaggccctgctggaactgctgcgccaggccgcgcccgagggcgacgagccggagccgagcgccggcgccgccgggctgagcctcgccgaacggcgcctgtgggtggcccagcaactggcgccggaggacacctcctacaacctgctggcccacctgcgcatagtcggcgccacggccgacgccatcgaacaggccttgcgccagttgctggaacggcatgtggcgctgcgccggcgtgtcgaaacgggcgtcgacgggccgcagccgcatgcgctggcggcgcatgcggtgcccctgcaacgcctgctggcgagcgacgccgtccacgccgagcggttgctggaggatggcgtgcgccgtgagggcgcgcgagtcttcgacctcgcccacgaggcgccggcacgcctgctgctggtcgtcacccgcgacagcgcgcgcgccgacctcctgctcagcgtccatcactacgccttcgacgatgtgtcgctggcggtctttgccgcggaactgaagacgctgctcgatggcggtcgcctgggcgtgctcgccagcacgccggaacaggttgccgcccgcgagcgcgcggcgttggcctcgggacgcctggaccgtgtcgccgagcgctgggctgagcgtttgttgccgctggcgaaggctcccggcgccgcgccggcgcgcccggaggagagcggcgggcgcgccggccaacgcctcgccctgccggtttccgccgccgtccatgccgcctgccgggcgctggccgaacgcacctcggtaagcccgttcagtgctgcgctacaggccttcgccgaagtgctcggcgccgaactgggcgtcgacgacctgctcgtcggcgtggccctggccgggcgttcgcgcctggaaatgcaggggctggtcggctgcttcgtcaacctcctgccgctggcggtcggcctgcgtccggagcagtccgtggagtggcgcctgcgccaggtcggccatgatctgctggaactgctcgaacaccaggacgtgcccctcgaatgcgtgacccaggccctgcgccagcgcggcgccagcggcctgccgatccgcatcgcctgcggcgcgcacaacggtcgggcggccccggcggtggatgccggggtgcgcgtcgaagccgacttcatcccggtgcctggcgcgcgcctggacctgacgctgtggctggaagaccagccgcagggttggctggccgtctggaccggggccagcgcgatcttcgacctgcaccgcatcgagcgcctgcaccaggcctgggagcggcgcctgctggcgaatgccggcgaacctatttcgaaacgcatgtcgccggagggctgcaacgcttcctga

SEQ ID NO: 9065 - DNA, 672 bp, Pseudomonas aeruginosa
gaggcttcgaggtcgactcggcagagcgcttccgcgcagccgccgctgccttcgccccgcaactgctcgactacaaggagcgttcctcgccgcgtagccaggtcagcggcgaggtctacacctccaccgagcatccggtggaccagccgatcttcctgcataacgagcagtcctataccgccgactggccgctgtacatcatgttccattgccaggtcgcgccgctcgagggcggcgccaccccggtggcggccaaccggctggtgctccgccacctgccggacgaattgctggaacgcttcgggcgcctgggcatcctctacgtgcgcaactaccgcgccggcctcggcctgtcctggcgcgaagcgttccagaccgacagccgagccgaggtcgaggcgttctgcgctgagcaccggatcgcccatgcctggatcggcgacgagcacctgcgcacctggcagaggcgcgcggcgttccaacgccacccgtataccggcgagcgcctgtggttcaaccacggcatgttcttccatgccaccagtctcgagccgggcctgcgcgatgcgctgctgcgcagcgtcgccgaggaagacctgccgtaccagacctactacggcgatggcagcccgatcgaggcgcagaccctggcgaccatccgcagcgccatag

SEQ ID NO: 9066 - DNA, 3126 bp, Pseudomonas aeruginosa
gcctgccggtgcaggtactggatgggcgcgcggccgatctgctggtcgagcgcctgccgggagatggcgactgggccggacgcttcgcgcgcgaaagcgcgcgtctcgccgcttcgcccctgggcggggaaggccagccggtactggcgctcggcctgctgctggacgccgccggagagacgctccaggggctgttgctggcggcgccggcgttcgtcgtcgatgcggccagcctggtggcgctgctgcgccgcggcctggggccggccggccaggcgagcgcggacgagggagacgaggcgctgctgttccagcatttctccgagtgggccaacgaggcgctggccggcgaagacggcgaaagcgccagcggttactggcgagagcaggcggccgttgcggcggaaagtccgctggcgctggcggacgacctgggcgaaggcgattggacgggcgcggcgcctgctgccgcgcgcgctgctcgaacgcctggccgccaacggcttgccggaggcggccgccctgctggcctggacccaggtcgccgggcagttccagggcgacgagggactccctctggaaatggcgcgactggtctcggggcgcctgttcaacgagttcgccgagctggccggaccgttcgccggggtcgcgccgctgtgcctggagaatgtccgcgcgggcagcgtcggcgagcggctcgacgccctccaggcggcgatcctcgcccaggaggaggcagcggccctgcgcgatccctttgcccccgactggccgctcgccgagttgggcttcgcctggctggcgggcgaactggatggcgccggggtggccgagctggattgccgtcagccgccgctgggcgggttcctcgagttgcaggtgctgccccacggcgaaggccggctggccagcctgcgggtccgccgcgaccatgacggaacgctggccgggcgcttgctcgacgcctgggtcgaatgcctggaaagcatcgccgccgacaggcaactgccattggccgggctgccgttgatcggcgcggccgagcgcgagcgctaccaggcctggcagggcgagcgcgtggagcccgcgccggtggaatccctggtggccgcgttcgatctgcgggccgccctgcagccgcaggcgccggcgttgctggatgcccacggcagcctggatttcgccacgctgtgcgcgcgcagcgaagcggtcgccgaagcgctgctggctgccggcgtgcggcccggccaggcggtggcggtgatgaccgggcgcaaccgcgaggcgatcgtcgccctgctcggggtgatgcgcgcggcggcggtgtacaccccggtcaatccggagtttccggcggcgcgggtggagcggatgcgcgaagcgggcgggatcgtcttcgctcttgccgatgccgagtgcgccgggcgcgcccgcgaggccttcgccggggcctgcctggacctgtcgacgctgccgctggccggcagcggcatgagcctgccggcgccgggcgggcgcgatgcggcctacatgatcttcacctcgggcaccagcggccagcccaaaggcgtggtggtcgagcacgccagcgcgctcaacctgtcccaggccctggcgcgcacggtatacgcgaacgtggtgggcgagggcctgcgggtgacggtcaacgcgccgttctccttcgactcctcgatcaagcagattctccagttgctctccggccattgcctggtcctggtgccgcaggaggtgcgcagcgatccgcagcggatgctggggttcctcgaagaacggcgcatcgacgtgctcgactgcaccccgtcgctgttccgcctgctgctccaggccggcctcgacgatgcccacccggcgctgcccgggcgcatcctggtagggggcgagcgcttcgacgaagcgtcctgggaggtcgccgccggctggcgccgctgccaggtgttcaatctctacggtcctaccgaagccacggtgaacgccagcctggcgcgggtcgccgagcatgcgcggccgaccatcggccgcgccctggccaacgtcgatctgcatgtggtcgatggcctcggtcgtcgcaagacccgtggcgccagcggcgaactgtggatcggcggcgccggggtggcgcgcggctatgccggcgacgccggcgaggcgggccgggcgcttcctcgacgagggctggccgggcagcggccgcctgtaccgcagcggcgacctggtgcgctggcgcgccgacggttgcctggagttcctcgggcggatcgacgaacaggtgaagatcaacggctaccgcatcgaactgggcgagatccgcagcgcgctgctggaacacccagcggtgggcgaggcggcggtactcaccgacgaggccgatgcggccgagccgggcgcggatcgccggatcgtcgccttcgtcaccgccgccggggagaccgcggacgagtcctggctggaagtcgacctgcccagcgggcaccgggtcgccggactgaacctcaacgaaaccgagtacgtctaccaggaaatcttcgtcgacgaggtctacagccgcgacggcatcgtcctgccgccggacgcggtggtcctcgacgtcggtgccaacatcggcctgttctcgctgtacatcgccagccgcgcgccgcgcgcgcgagtggtcgccttcgagccgctggcaccgatccgccggcgcctggaggccaacctcggacgctacgcaccgcaggtcgaggtattcggcatcggcctgtccgacgccgagcgcgaagaaaccttcacctactatccgggctactcgaccttctccgggatcgccgagtacgccgacgccagcggcgaacgcgacgtcatccgacgctacctgagcaaccagggcgaggagggcggggccaacctgctgctggacaacatcgacgaaatcctcgacgaccgcctgcgcgccgaagcccaccgctgccgcctgcgccgcctcgaccaggtgatcggcgaactgggcctggagcgtatcgacctgctgaagatcgacgtgcagcgcgcggaaatggatgtgctgctcggtctcgacgatgcggcgctggccaaggtccggcagatcgtcctggaggtccatga

SEQ ID NO: 9067 - DNA, 1851 bp, Pseudomonas aeruginosa
agtagtcaccggcttcgtcagccacgggcgccccgaggagccgggagcggaccgcctgctcggcctgttcctgaacaccctgccgtgccggctgtcggcttccgtcgatctgctcgacagcgcccgtcgcgcattcgactacgagcgcgcgagcctggaacatcggcgccatccgctggcggcgattcgcaggcgcaaccgcgagttgcgcctggacagcctgttcaacttcgtcgacttccaccaggacgacgccgcgccggcggcgggagtaaggcacggcggcatcctcgaccaggtggtggtggacgtcgacgtgccgctggcggtggacttcgaggtggccggcgagcgcctcgaggtgggcttccagtatgccgccggacgtttccccgccgagcgcgccgaggcactggccggcgcctaccgcgaggcgttgctggcgctgctcggagacccggtgcagccgcccgcggcggcccaggccgaggacagcgtggagctgcggcgggtgctcaaggtgttgtcccgggtgctcggccggccgctggcggccgaccagggcttcgccagtgccggcgggcattcgctgctgggcgtgcaggcgatcgccgaattgcgccggctgaccggcaggcaactgagcctggggctgttgcagggcgatccggatgcccgcgaagtggtgcgccgctgccatgccgccgacgcgccgccgttgccgcccgccaccgagcgcgcccgggccctgtggttgcagcgcagcgggagcgcgcagccgcgcctgcgcctgatcgcgctgccgcccgcgggcggcaacgccggcactttccgtggttgggacgcgcgcctgccggcggacgtggagctgctggcgatccagtatccggggcgccaggaacgccaggacgagccattcgtcaccgatgtagaggccatgctctgtgccatcgacgacgcgctcctgccattgctcgaccgtccgttcgccctgatcggcgccagcctcggcggcatgctcgcctacgaactggcggcacgcctggaaagcctgcacggcctgcgcgccaggcagttgttcgtgatcagcagccgcgctccggggccggacctggaatacccgcgcttccatgcgatgggcgacgccgagttgctgcgaaccctgcgcgagtacgacgtgctgccgctggaagtgctcgacgacccggagctgcgcgagatcagcctggccaccctgcgcgccgattcgcgcctggccgccgactatcgctaccgcccgcgcgagccgctggccataccgatcaccgcgatcctcggcgagcaggacccgggcgtctccagggtggccatcgacggctggcggcggcacgccagccgctacgagctggagaccctggccggcggccacggcctggtggtgacggcggcggaggaggtttgcgcgatcctgcggcagcgcctggcgcccgatgtgcctggcggcgtgccggcgaacctggcaacctgaaccgccggcccctgccgcccgcctggcggcaggggccggtgccgtccgtcttcattcgaggttgcccatggttgtgcgcgaatacacccaacgccaccggcttgacgccgtcgccccggccgactaccaccgccatctgccggagcaggtcgcgcgcggcctgccttccgccgagctggtggtgttccgcgtcgccgacgagcattccgacaccgcggcgttcagcgcacgctacggctttggcctggaggactgcgccaacaccctggtcctgcgctacaagcgcgacggcgccgaaggctatgccgcggtggtcaacctgggctcgcggcggctcgacgtga

SEQ ID NO: 9068 - DNA, 405 bp, Pseudomonas aeruginosa
tttcgctggggggcgccgacgcgcacatcgagttgcacgccgggcaggagcaggcgctggccgccgagatcgtccgtctggtggaaacctacggtttcgacggcctggacatcgacctcgagcagagcgccatcgacctggccgacaaccagcgggtgctgccggcggccctcaagctggtgcgcgagcactacgccgggcagggcaagcacttcatcgtcagcatggccccggagtttccctatctgcacaagaacggcaagtacgtgccttatctgcaggccctggaaggcgtctacgacttcatcgcgccgcagtactacaaccagggcggcgacggcctgtgggtccaggaggcgaacggcggcaagggcgcctggatcgcgcagaacaacgacgcgatga

SEQ ID NO: 9069 - DNA, 786 bp, Pseudomonas aeruginosa
caagtgtccgagccactccgacaagcgaatccgaccatgggcaaactgctcccgctttctcccgtgccgctgtacagccagctcaaggagctgctgcgcgggcgcatcctcgacggcgtctacccgccgctcagccgcatgccctcggagaacgagctgggcaaggccttcgacgtcagccgcatcaccgtgcgccaggcgctcggcgacctgcagaaggaagggctgatcttcaagatccacggcaagggcaccttcgtcgcccggccgaaggcgttccagaacgtcagcaccctgcaaggcctgggcgagtccatgacgcagatgggctacgaggtcatcaaccgcctgcacggcctgcgctacgtgccggccggcgcgcgggtggccgagcgcctgcgggtggaagagggcagccctgtgtgcgagatcaagcgggtgcggctggtcaaccgcgagccggtttcgctggaagtcacctacctgccgcaggcgctcggcgagcgcctggagaaggccgacctggtgacccgcgacatcttcctgatcctcgagaacgattgcggcattcccctcggccatgccgacctggccatcgacgcggtgctcgccgatgccgacctgacccgcgccctggcggtcgaggagggcgcgccgatcatgcgtatcgagcgcctgacccatgccgccgacggcgcgccgctggacttcgaatacctctactaccgcggcgacgctttccagtatcgcctgcgcatcgatcggcagaagggagagcgggcatga

SEQ ID NO: 9070 - DNA, 348 bp, Pseudomonas aeruginosa
ggaacgacgccgcctagggccccacgccccggcgtagtaccgctagacaccgagcccgccgccacgaaagcgggccagatcgaaccacgaggaccgcgtgccatggcctaccgaccccaggacatcttcttccgcagcagcgccccggtgaccatcgacgaagaccgctgcatcgccgacaagggctgcaccgtctgcgtcgaggtctgcccgatggacctgctggccatcgatccgacgacccgcaaggcctacatggcctacgacgagtgctggtactgcatgccttgcgaaaaggactgcccgaccggcgcggtgaaggtcgagattccctacctgctgcgctga

SEQ ID NO: 9071 - DNA, 1848 bp, Pseudomonas aeruginosa
cgccctggtacgcggcgggaggcaaggtccgatgacgacggccggcaacagcctggggcgcatccagatccgcgacctgagcatccgcctggggcaggggagcgaagccttcgaggcggtccgcgatctgagcctggaggcgcggccgggcgagttcgtctgcctgctcgggccttcgggatgcggcaagtcgaccctgctcggcgccctggccggccacctgcggccaagcgccggcagcgtgagggtcgacggccggagcgtggaaggaccttcgccgcagcgtggcatggtattccagcagcacaccctgttcccctggcggcgggtccgcgacaacgtcgccttcggcctgaagatgcagggcctggcccgcgccgagcgcaaccggcgcgccatggagatgctcggactggtggggctggcggacttcgccgggcgctggcccggccaactgtccgggggtatgcagcagcgcgtggagatcgcccgggtgctggtcaaccggccgcgcctgctgctgatggacgagcccttcggcgccctcgacgcgcagacccggctgaagatgcagaccttgctgctggacgtatgggcgcgggtccgcaccacggtgctgttcgtcacccacgacatcgacgaggccctgtacctggcggacagggtgctggtgatgagcccccgtccgggacggatcatcgccgacctggcgctggacttcccgcgccctcgcgacacccggctggtgaccagcgccgacttcgtgcgcctgaaacgccactgcctggaactgctcgaccacgacgacggccgccagttgccgcgcctgaccccgctcggcttgccgccgggcatcaccccggaccgactgcggatcgccatatgacctgtaaaaacgccaccctgcccgaaatcctcgaactgtcgccgcgcctggaggacgccgaccccggcgtacgccgcctggcgctgatcgaactggccgacctggagctgccggaggcgctgccgttgctgattgcggccctgcgcggcgatcccgaccccggcgtgcgcggcgaggccgcgcgcctgctggaggcctgggaggaagacgcagtggtcgatgcgctctgtgcggccctggccgatccggtgccggcggtggccgatgccgccgcgcagagccttggcgaactcaaggaaccggccgccgggcggcgcctgctgccgtggctcgggcatgccgatgccttcgtccgcgccagcgtattgcgtgcgttgcgcgaactgcgcctggaggagagcgccgcgccggccctggccgccctcggcgatccgcaggcggcggtgcgccgcgaggcggtggcggtgctcggctggctccgccaccagccggccctggccgaactggccaggctggccagcgccgatgtcgacccggaggtacgccgggcggccaccggcgccctcggcctgagccgcgaggcgacggtgctgccggcgctctgcgcggcgctggcggacgctcaatggcaggttcgcgaagaggcggcgacgacccttggcaagctgggccgggaggaggccggcgagccgctgctgaaggccctggcggacgactactggcaggtccgcctgcgcgccgcgcgggcgctcgggcgcttgcgccaccggccggcgcgggaggcgctggaagcattgctcggccatcccatcggcaacctgcgcaaggaggccgccctggccctcggcgaactggcggacccggcctcggcccaggccttgcgggtcgccgaaggcgacggcgatcccgaggtgcgcaaggcggtgcgtatcgccctggcgcaactgcgggtgccggcatga

SEQ ID NO: 9072 - DNA, 1782 bp, Pseudomonas aeruginosa
ccgcagtcgatcgcgcctgctgccgagcctgctcggcctgttgatcctgctgtccggcctggcgctgctggccggcggcatcaagctggcgagcctgggcggctcgctgtactacctgctggccggcatcggcctggccctgagcggactgttgctgctgctgggcaagcgtgcggcgctaggcctgtacgctctggtgctgttcgccagcaccgtctgggcgctgtgggaagtcggcctggactggtggcaactggtgccgcgcctggctctgtggttcgtcttcggcctgctgctctggctaccctggttccgccgcccgctgctggccgacggtccggcgccgctgggcaccgcggcgctgggcgtggcggtggtcctggccggcaccgccgcggtgggcagccagttcaccaatccggggcagatcgtcggtcgcatcgaccgcgacagcggcatgaccagcaccgccccggcgatgccggacggcgactggcaggcctacgggcgcaccgagttcggcgaccgctactcgccgttgaagcagatcaccccggccaacgtcggccagctcgaggaagcctggcgcatccgtaccggcgacctgccgaccgccgacgatccgctcgaactgaccaacgagaacaccccgctgaaggtcaacggcatgctctacgcctgcaccgcgcacagcaaggtgctggccctcgacccggacaccggcgcagaaatctggcgcttcgatccgcagatccagagcccggtaggcttcaagggcttcgcccacatgacttgccgtggcgtctcctactacgacgaagagcagtacgccaggagcgacgtcggcgcgccgccggccgcgctctccaaggccggcaaggcggtcgccgccagttgtccgcggcgcctgttcctgcccaccgccgacgcccgcctgatcgcgatcaacgccgacaacggcaaggtctgcgaggacttcggggtcaagggcgcggtcgacctgacggccggcatcggtccgttcaccccgggcggctactactccacatcgccggcggcggtcacccgcaatctggtgatcatcggcggccacgtcaccgacaacgagtcgaccaacgagccgtccggggtgatccgcgccttcgacgtgcacgacggcaagctggtgtggaactgggacagcggcaacccggacgagaccgagcccctggctcccggcaagttctatacccgcaactcgccgaacatgtggtcgctggccagcgtcgacgagaagctcggccaggtctacctgccgctgggcaaccagatgcccgaccagtggggcggcaaccgcacccctggcgccgagaagttcagcgccggcctggtggccctcgacctgaacaccggcaagctgcgctggaactaccagttcacccaccacgacctgtgggacatggacgtcggcagccagccgaccctgctcgacctgaagaccgccgatggcgtcaagccggcgctgatcgcgccgaccaagcagggcagcctgtacgtgctggaccgccgcgacggcacgccgatcgtgccgatccgcgaagtgccggcgccgcagggcgcggtggagggcgaccataccgcgccgacccaggcgcgttccgacctcaacctgctgcgcccgccgctgaccgagcgcgacatgtggggcagcagcccgttcgaccagatgctctgccgcatccagttccgctcgctgcgctacgagggccagtacaccccgccgtcggagccagggcagcctga

SEQ ID NO: 9073 - DNA, 516 bp, Pseudomonas aeruginosa
gcgagcactggaacgccaacctggcctatacccggctatccgccacctacgattcggatttcgaggccggcggcaagaccatcggcaagggcaagcacctgccgggcgtgccggaaagcagcctgttcggcgaactggtgtggaagcccgcggagggcatcagcatgggctgggaaggcatgtaccgcagccaggtctacgtcgaggacagcaacagcgaaaaggccgcgccgagctatgcggtattcaactggcgcacccgcttcgagcagcgcctgggaacctgggccttccaccagctggtgcgcctggacaacctgttcgaccgccagtacgtcggctcggtcatcgtcggcgacggcaaccggcgttactacgaagcggcccccgggctgtcctggtacgcgggagccggggtcgaataccagttctgaagtgccggatgcgcttgttcgcgctacccggccagcccttgtcagcgtcgtcaattccgattactgtatgaatgtacagtaa

SEQ ID NO: 9074 - DNA, 1461 bp, Pseudomonas aeruginosa
  unsure (951),(1078): Identity of nucleotide at the above locations are unknown.
cgtccagagttccggtgcatcctcttcgcccagccggcggccgatgacatccagggccggcgccgggcgcaggcgcaagcgggtgatcttcgccagcatttgccacgccgacgccagcaggccgagaaggatcagcgccacgctcagttgggtgcgtccttcgctgaccggaacctggccgacccgccacagcccgaggatctcgaacgttccggcacaggccagggccagggcgagcaggccgatctgggcgaggagcaggcagggcagcaggcgtcggcccagctcgaaccacaggagcaggcagcgacgcgagcgcagtgcgctgcgtgcggcgccggcgatgccggccagggagacggctcccaatacggcgaccagcgccgccaggcaggctccgctatcggcgaggacggcggcgaagcgattcaggcgctgtgcgcttcgtgtgtcggcgagtcgctcgtcgagccgcgccagggccaggtcgcgcacataggcccggccgtccacccggacgctggccctcggcggcagcgcccgcgcttcggcgagcgcgcgctcgacccgctgctgcgcggcgcccagtcgctcggcctgctgctcggcgcgccaggactgccaggcgccgagccccgccagcagcgctggaaccagcaccaggcaaagcagcagccttcgcggatggaccgtgcccttcactcagccctggctgcgcagttgttgcaggtagcgctgggcgtgggcggcctggatgtaggcgtcgaggatcgccgccatgtcgtcgcagtccagcttcttgccatcgctctgcaggccggccgacatgatggtgatgcgcgggtccttgcctttgaaggccatggcctgggaggcgaacacctggcgtacggcgcgatgggtcggcagcggcgtttcgggccgcaggtggagggtctgggtggtttgcancatgtcggccttgacgctgaaatcgatgacgtcggccagctcgaccggagccgacaggctgtcggcccagagctgggtacgggtcaggcgcatgaagggggtcttgccggagttgcgatgctggtanccgaggaacagcccgaacaggccgagcagcaagccgacgacgccgacccccggcttgccctgggagaaccacatgccggtcatgatgaagggcacgatgctcagcagcggacccagcaccacgtacttgcgggtattggtgaactcggtggccggcggtacgttggcgatcacccgctccaggtgggcgatgacctcggcggtcttcgcctggttcagctcttcgtgttcggcaccgagggtttcggcgaggttggagacgaggtcccggggttcctggttgctcatggaaatatccttggagttgggagtgaagaggaagcactgggcgggatctcgcccagttggcggaaccgggcctgggcgcgggcgatgtccaggtag

SEQ ID NO: 9075 - DNA, 609 bp, Pseudomonas aeruginosa
aggtcgatgacctccgcggcttccagtagcgacaggttgcgaccgttgaggcgccagccgggggacagcaggcgaacccgtgggccgtcccggcattcgctgacggcacgcgcggcgaacggatcgagcgggcgcgtggatggtgccggtagcgccttgccgtgcagttcgaggactatcgcggagaaccagaccccgtcctccaggcgcaggtcggcgacctccagcaggtccagcggcgccgacaggctgcgggcgcgcaggcgcccctggccgaggacgaggaacggcgcgctcctggcgttgcgctgcaggcaggccaggcacatgaggagggcggccgccgccagcaggcacagcgccgccgcctcatgcccgggaccggggtggtcgcgcaaggtccaggcgccgccgagcagcagcaggccgagcagggcggacagcggcgccgcgccacgggcggcgccgatgcttatccggttggggacgctggcgacgaagcgccgcaactgcgtggcttcgtcgccccttgtcccggcggggcagggcgtttgcgcgcccggcgggatcaccggctttccccgtggcctgcatcgagcaggcggttga

SEQ ID NO: 9076 - DNA, 1233 bp, Pseudomonas aeruginosa
caaccccgtgcgcgcctgggcagtggcggcacgcaacatcggcacgaatgggcaaggcttcgacaggaatggacattctgcggcggcgcccatccggcgaacaattgccccccgaacggaccgccgccagcaagccgtcgcggcccgccatcctgcgcagaggacacaccgatgaccctacagatccgcggctacgccgcccagtccgccagcaccccgctgaccgcccatcgcttcgaacgccgcgcgccgcgcgccgacgacctggtgatcgacatcctctactgcggcgtctgccactcggacctccatcaggcgcgcaacgaatggcacaacagcctgtacccgctggtgccgggccacgagatcatcggccgggtcgccagcgtcggcgaggcggtgagcggtttcgcggtcggcgaactggtcggcgtcggctgcatggtcgactcctgccggcactgcgccgcctgctccgagggcctggagcagtattgcgcggaatacccgaccctgacctacaacggccgcgaccgccacgacggcctgccgaccttcggcggctactcggagcgcatcgtggtctcggccaggttcgtcctgcgcattccccaggggctcgatccgaagacggcggcgccgctgctgtgcgccgggatcacgtcctactcgccactgcgtcactggaaggtcggtcccggcagccgggtggcggtggtcggcctgggcggcctcggtcacatgggcctgaagttcgccagggcgctcggtgccgaggtggccctgttcacccgctcgccgggcaaggaagaggaagcgcggcggctcggcgccgaccaggtgatcctttccaccgacccacagcggatggccgccgtcgccggacgcttcgacctgatcctggacaccgtgccgcaccagcatgacctcaatccctatctggcgaccctcaagcgcgacggcaccctcgtactggtcggcctgctcgagccgctggagccggcggtgcacggtgcgcaactggtgatgggacgccgctcgatcgccggctcggccatcggcggcatcgccgagacccaggaaatgctggatttctgcgcggcccacgggatcgcctgcgacatcgagatgatcgagatccagcagatcaaccaggcctacgagcggatgctggccagcgacgtgaagtatcgcttcgtgatcgacatggcctccctgcagaagtccttctga

SEQ ID NO: 9077 - DNA, 960 bp, Pseudomonas aeruginosa
cgatccggccatgatgtcgctgaaggtgggcgccgagaccaggccgccgaagtagccgatcctggtcggcgaatcgatcatcaccgccagcaccagttgcgggtcggacgccggcgccatgccgacgaacagcgaacggtaggacttgtccgcgtagccccggcccgaggccttgcgcgcggtgccgctcttgcccgccacgtggtagcccggcacgcgggcgcggaccacgcccttcgggtcttccaccacggtttgcagcatcgcccggatgcgccgtgcgatctgcgggtccatcgcctggcgcacctggttctgcgggttgtcgcggagcaggctgagcggcaccagcttgccgtcgttggcgaacaccgagtaggcctgggccagctcggcggtgttcaccgccaggctgtagccgaacgacatgctggcggtggcgatgttcgaccatttctcgtggaacggcaggtagcccgggttctcgccggggaagcccagcgacagcggcgcgccgaaaccgacccggccgagctgttcgaggatcggcttgggtccgatctgcagggcgaccttgctcatgccgatgttcgaggagttgatcagcactccggtcatggtcagtacgtcgcgccgggcgacgtcgtggatggtgtgcccgtcgatggtcatccagcccggtgccacgctgacttgactgttctcgtcgaacttgccggaggccagcgccgccgacatgctgaacggcttgatcaccgagcccggctcgaaggtatcggtgagggtgcggttgcgcatgaaggccggggcgaagctggcgcggttgttcgggttgtaggaggggaagttggccatcgccaggatctgcccgctcttcgggttcaccaggaccgccgagccggagtgcgcgccgaacttgagcacggccttttccagcgccttgtaggcgatgaactgtag

SEQ ID NO: 9078 - DNA, 1263 bp, Pseudomonas aeruginosa
atttcgtcttctcccgtcgtcgccggttccgctggagccggccagccgaggctttccatgagcaacccctatctcgaactgttcgccgcgcccggcgccaagggcttttcagccgccggcctgctggcgcggatgcccctgtcgatgaccggcctgggcatcgtcaccatgctttcccaggtgcatgccgactactggctggccggtaccgtggcggccaccttcgtgttctgcaatgccttgctcgcgccgcaggtatcgcgcctggtggaccgcttcggccagggccgggtgctgctcccggccgcgctggccagcgccctggcgatgagcgcgctgttgctgtgtacgcactatcgagcgccgaatgcctggctctacctgttcgccttgctcgccggggcgatgccgagcatgccggccatggtacgggcgcgctggaccgagctgtaccggggctcgccgaagctgcacacggcgttttccttcgaatcggtgatggacgaggtgtgctacatcatcgggccggtgctggcggtgagcctcagcgtcggctggttcgccgaggcggggccgctgctggcgacgctgttcctggtcgccggggtgagcctgttcagcctgcaacgcggcaccgaaccgccgctgcatgcccatccgcggcgccgcgccggcagcgcgctggcctatccggcggtacgcgtgctggcgctggtgctggccgccatcggggtgatcttcggcgcggtggaagtggtcagcgtggccttcgccgaggcgcacggcaacaaggctgcggcaagcctggtgttgtcggtctatgccgtcggctcatgtctcgcgggattgctgttcgggctgctgcgctggcgcctggcgctttcccggcaactgctctgcatggttacgctgatggccctgagcctgatgccgctgctaggggtggagagcatccttgcgcttgccctgaccgtgctggtggccggcttcagcgtggcgccgacgatgatcctggccatgggcctggtcgagcgcgcggtggacccggcgcgcctcaccgaaggcctgacctgggccatcaccgggctgggcatcggcatggccttgggctcggcgctggccggttgggtggtggagggctacggcgccgccagcggtttcctcgtcgcggtcggcgccggctggctggcctggctgctggccctggcctgcttccgggtgctggctcaggacgaggccggagactgcgcggtgtccggctga

SEQ ID NO: 9079 - DNA, 279 bp, Pseudomonas aeruginosa
tccgcctcgatccagtcggcggcatacgccagggccaggcgcgagccgcgcagcaggcggacatcctcgcgggcttcgagcagagcgcagggcagggcggcgatcaccgcctggtcgctgtgcggatgctcctcaccatgggtcgccgcctgccagccgagggcgttgcgggcgaactcgaggatcgtgtgctggaagccggcgcaggtaccgaggaacggccggcgccggccccgggcatgggcgatcaggcgcagcaccgcgtcggcgtcgcgatag

SEQ ID NO: 9080 - DNA, 1158 bp, Pseudomonas aeruginosa
cgctccagcgccggctcggcgggcaggcggtcgctggccagccagtcgaatgcgatctccaggccgagtgcctcgccggccaggcgcagggccaggggaatcgcccggtgggcggtgatgtgcgggtcgtggtcgccgaccagggcaatgcgcagcggcgccgcgggaggggtggacatccgttttcgctccagtttcgccacgccggttggcgggccctggcgctcactctatagttgcgtttccgcactcgatatcggcgccaatgcaaaagatgaatgcaccgctgcaatatcgcctggaccatgccgatcttgccctggtcctcgccctggttcgcggcggcagcctggcgcgggccgcagagttgctcagggtcgatgtgtcgacggtcttccgggccatccgccggctggagaagaacctcggcaaggcattgttcgacaagagccgcagcggctacctggcgaaccagaccgcccgccgtctggcgcagcaggcggaactggcggagcaggcgctggaggcggcgcgcatcggcctcgaactggagcgcgaggtgctcagcggtaccgtgcgcatgacctgctccgacgccgtcctgcatggcctgctgctgccggcgctggcgcgcttcatgcctggctatccggccctgcaactggagctggcgacctccaacgactttgccaacctcagccggcgcgacgccgacatcgccctgcgcatgacccgcacgccgccggaacacttggtcgggcgcaacctcggcgaggtgcgctacgtgctctgcgccagcgaacgctacctggagggccgcgacgcgacggagcccgccatgctgcactggatcgccccggacgattttcttcccgaccacccgagcgtggtctggcgtcgtcgacactatcctggggtgctgccggcctaccgctgcaacggcgtgctggcggtcgccgagatggcccgcgccggcctcggcctggcggcgatccctgcctacctgctacgcgacggcgacggcctgcgggtactggacgccgacctcgagggctgcgccagcgccctgtggctgctgacccgtccggactgccgggcgttgcgctcggtggtcgcattgttcgacgagctggggcggcatgtgcgattgggagatga

SEQ ID NO: 9081 - DNA, 1944 bp, Pseudomonas aeruginosa
  unsure (4): Identity of nucleotide at the above locations are unknown.
ccanggccgggtccggcgctgcggcggcctgggcgatgccgcacgcgaaggcggagaaggcgaggaaagctgtcggtttcatcgttgcgctcctcatgcctgcaccagcggaccggggttcttcaggtattgctcgcggatcgccttggccgaccagtaggccagcgccgccaccagcccagtggggttgtagccggtgccctgggggaaggccgaggcgcccatgacgaagacgttgtgcacgtcccagctctgcaggtagcggttgagcacgctggtcttcggatcgctgcccatgatcgccccgccgagcaggtgggtggtctggtagacccgtgtattgaagtggtcgccgaagttcttgacgctcaccgagatggccttcgggttcatcgcttcggcgatcttgcgcatgtgctcggtgacgtagcggctcatgcggatctcgttgtccttccagtcgaaggtcatgcgcaacagtggctggccgtaagcgtccttgtaggtcgggtcgatgtcggactatttgtcgcggtaggtcatgttgctgccgtgggcgtccatcgacacggtgtgcgtgtaggcgtccttgaccgcctgtttccagccgctgccccagctcggcgtgccgggcggcacggcgaggccgccgatcggcttggagccggcctggttgacccacatcggcgagccgccgacgaagcccagcggtccgtggtcgaagttgtcggcgttgaagtcgtccaccgccacgccgccgccgccggtgccgacaaaggggttggtatgcacgtccttgtcgaaaaacgccttgatggtggccatgttctggtaggcgaagttcttccccaccacgccctcgccggtgcgcgggtcgtagggcttgccgatgccggagagcagcagcaggcgcacgttgtggaactggaaggcactgatgatcaccagcttcgccggctgcacgatctcgcgcccctgggcgtcgacgtaggtcacgccggtggcctgcctgccatcgctatcgaggttgaccttgagcacgttgcagttggcgcgcagttcgaacagcggggtctggcgcagcgccgggaggatgttcaggttcggcgaggccttggaatacatgtagcaggcgtagccgctgcagaagccgcagaagttgcacggccccatctgcaccccgtaggggttggtccagggccccgaagcgttggccgccggcaggtcgtaagggtgcaggccgagttcctcggcggccttgcggaacagttgcgcggagtacacctggcgcagtgccggcagcgggaagtcgtccgagcggtcggcggcgaacggattgcccttgccgaccacctggcccttgaccgtatgcgcggtgccggaggtgccgaagaccttctcggcgaaatcgaagtgcggctccagctcttcgtagctgaccccgtagtcctggatggtcatgccttcggggatgaatttcttgccgtagcgttcctcgtaatggctgcgcaggcgcagttcctcgggcatgatccggaaatgcacgccggaccagtgcaggccggcgccaccgacgccgtcgccgggaaggaaggcggagagctggcggtagggcagcgcggtgtcgttgatcccgtggcggatgctcacggtgctcttggagagattctggaacagcttgccgcgggtgttgtaggtcagctcgtcgagggtgttggggtaggcgccgtcgggataggtatcgcggttctcgccgcgctccagcgccaccacgttgagccccggcctcggtcagctccttggccaggatcgctccggtccagccgaaagccgaccaccaccgcgtccaccggtttgagtgtcgtcgccatgttcagcccctctcgccggaaatcgccaccggcgggaagggatacttctcgccacggtcggcccagtccatga

SEQ ID NO: 9082 - DNA, 2706 bp, Pseudomonas aeruginosa
aaaaacgtttcagcaaggattcaggcgggccaataccggcaagtgaagcagaacggcgcgccgggcgtcggcccggcgcggccttcaggcgcctcgccgtcgcgcccaggccgaaggattgaccaggttcagcggccgctcgccggcgagggcggccagcaggttgtccaccgcgcagcgggccatggcttcgcgggtttcctcggtggccgagccgatgtgcggggtggccaccacgttcggcaggcgcagcagcggcgagtcgggagacagcggctcgcgctcgaacacgtcgaggccggcggcgcggatccgccgctgggccagggcctcgatcagggccgcctcgtcgaccacccggccacgggagatgttgatgaagatcgcctgcgggcgcatccgggcgaactgcgcggcaccgatcaggccttcggtggcggcggtcagcggcagggtcaggcagacgaagtcggattcctcgagcagcgcgtcgagggggcggtagctcgctgcgtagcgttcttcgacgtggggcttcgggctatggctgtggtacagcacgcgcatgccgaagccgtggtgcccgcgccgggccagggcctcgccgatgcggcccatgccgacgataccgagggtcttgccatgcacgtcggtaccgaactgggcggcgccgacgctcttcttccattccccggcgcgcacccaaccggccagttccactacccgccgggctgtcgccaggatcagcgcgaagccggtgtcggcggtggtctcggtgagcacgtcgggggtattgctgaggaggatgccgcggcggtcgaggtagtcgatgtcatagttgtcgacgcccaccgagacgctggcgatggcttccagtcgcggtgccaggtcgagcagtccggcgtccaggcgcaggctggcgccgagcaggccgtgggcctcgggcagggcgtcgcgcaggcgggccaggccgtcgcggccgggctcctcgaccaggagcacctcgacccgttcgcgcaggcgttccatcaggggcgcggagagacgtttgtagagaaccactttcttcatcggatgctccggagtcggtcaggggtgggccggcgccgcccgccgcgaggcgtgcgcgcgagcggcatcgggctcgcgcttgtcggcgtgcgggttgaggaacacggtgagcagcaccgacagcagcagcgctccgctcatgaacagataggaagccccgggcccgccggtgatgccgttcaggtagccgaccagccaggagccggagaacgagcccagcgcgcccatgctgttgatcagcgccatggcgccgccggcgacgttggccgggaggacttccgggacgatggcgaagaacggtccgtagggcgcgtacatgcaggccccggccagcaccagcagggcgtaggacagccagaagtgctcgctgccgagggcgtaggaaccgtagaaggcgatggacgcgatgagcagcggcggccagacgaaacgcttgcgtttctgcaaccggtccgaggcccaggacaccccgagcatggcgatcaccgccgccaggtagggcagcgccgacagccagccggcttcgatgatgtcgatgttggcgccgtgcttgaggatcgacggcaaccagaggacgaagccgtagacgccgatgctccagcagaaatactgcagcgagaggacgatgacctttggcgaacggaacgcctcgcggtagttcttcaccggcttgatgccctgctgctcggcggccagggcgtcttccagggcgcgtttttccgagccgctcagccaggcggcctggcgcgggcggtcatccaccaggcgccaccagatgaaggcccagatcaccgccggcaggccttcgatgatgaacatccagcgccagctgaaatgctccaccaggtagccggagaccaccgacatccagaggatggtcaccgggttgccgaggatcaggaaggtattcgcccgcgagcgctcggcgcgggtgaaccagtggcagaggtagaccagcatcgccggcatcaccgccgcctcgaccacgccgaggaggaagcggatgccgatcagcaggtagacgttggcgaccatcccggtcagggtggccagcccgccccagaggatcaggctgacgaagatcagcttcttgacgctgcgcttttccgcgtagatcgcccccggcacctggaagaagaagtaaccgaggaagaacagcgcgcccagcagcgaggacagcccgggggtgatccgcaggtcgtcggccatcccggaggcggcggcgaagccgtagttggcgcggtccaggtaggccaggctgtaggtgacgaaaacgatcggcatgatgtaccaccagcggctgctggcgaggcgaggcatggtcatggtcgggtatctcctgagcttgtcttgttcttgtcgcaacaggtgccgcgtgggcggcgggttcaggcgctcttgcggcgctcgcggtcgagcagttggctgcgtttcggcagcccctccatgtcgccgcggacctgtaccgcgcggctgccgatccagttgccgcgcgccaccgcgtcgggcagcggcaggccttccagcagcgcgctgaccaccccgaccgcgaagccgtcgccggcgcccacggtgtccaccacggtcgccaccggcacgccggggaccagcccttcgccgtgggcatcgcgatag

SEQ ID NO: 9083 - DNA, 708 bp, Pseudomonas aeruginosa
aacgcggcgatatccgcgggttcctgccagccgctgagcaggcggccttcctccaggcccggcaggacccagtgggcatgcgcggcgagggcgttgatctcggcgatcatgcggcgctcgctgggccacagcgagggccgcaggttggggtcgaaggacaggctggcgcccttgccgcgcatgcgccgcatcagttcgtgggacagttcgcaggcactcgccgagagtgccggcggaatgccggtggcgtgcaggtggcgggcgccgagcatttcttcgcggatatgggcgaggcccagccggctggccgccgagccgcggcggaagtactcgacccgcgggtcggcaccatcgacctcgcgggacttcatctggaacccggtgggcgcttgcgcgtcgacctcgacgaagcggcagtcgaggccctcgcgggtcaggctgtcgagtacgaagcggccgagcgagtcgtcgccgacccggctcagccaggccaccgtgaagccgaggcgggcgaggccgatggcgacgttgctgtcggcgccggcgatgcgcttgccgaactgctcgacccggtccagttcgccgggctgttcggcgacgaacatggccatggtctcgccgaagcagaggatctcgaagtcagccatgctggcgttcctcctggggctggccgacggcgggcgagggcggcgatgtgccggcggctga

SEQ ID NO: 9084 - DNA, 414 bp, Pseudomonas aeruginosa
gcaggtcgtcgccctgcagcgggtattcgatggcccgcgccacgccttccgggaaatgctgcagcaggcgctgccagtactgcaggtcggcggccgacggcggcaccgcgaccagcttgccgtcgcggttgcggatcaccgccttgcagtgcacgtagccgacatagcggccaaggcgcagggcggcttcgtcggccgcctgctcctgccagcgccagttgccgatgtcgaaggtcatcgccaggtccagctgctggcgttcggcgaggcggaagaagcgttccagcacctcgatccggccgccctggggcgtctggtcgttctccaccagcagttgcaagccgtggcgcgccaggcgccggccgagggcggcgagatcgggctgttccggcagaaggccgagcgagaccttga

SEQ ID NO: 9085 - DNA, 1071 bp, Pseudomonas aeruginosa
aaccggtttcatttcaagccgtgcgaaagccgccggcaacgcgccggcggcgggccgctagccgcgtggatgggtcgagccgcgaacgatcagttgcgccgggaaggtcacccggcgcgccggctcgcggtcgccttcgagtcgcgccagaaggcgctcgaaggcggtgcggccgatttcgtcggtgggttgggcgagggcggtgatgccgctgcccaccagtgggtaccagtcgagttcgtccagggccagcaggccgacctcatcgaacagccggcagccgaggtcgcgcagttggcgggtggcgcagagggtggcgacgccgttgcaggtgaacagcgccttcggcccggggccgctggccgaaaggaaggcgcgcaggccgtcgcggaagaagtcgtcggtttgcaggacctggcccttgagcgccggtcgccggccgatggaggcattgaaggcctggacccgctcgatccgcgagctggtgccgtcgagcggttcggtgaccagcaggatgtcgcggaagccgcggtgctgcaggtggtcgagggcctgttcgacggcgtcggcgttgtccaggccgaccaggtcggtatccagctcggccaactggcggtccaccagcaccatcggcagttcgcggtgcagggcgcgcaattcgccgggatggtggccgagggtgttcacgatcagtccttcgacgttgtaggactgcagggcggccaggtgatgacgctcctgctcgtcgtcgcggtcggtattgcacaccaccaggctgtagccgtgttcgcggcaggcggtttccacgccatgcatgacggccacggagtaggggttgaggatgtccgccaccagcattccgatcagccgtgtgcgcccgcgcttgaggcctcgggccatctggttggggcggtagtcgagctggtcgatggcgcgctcgatgcgccgggcggtggcatcggcgagcaactggcggtcgccgccgatatagcgcgacacgctggccttggagacgccggcggcctcggccacctggttgatggtgacgcggccacggctgggcagtactga

SEQ ID NO: 9086 - DNA, 1062 bp, Pseudomonas aeruginosa
ccgcccggtcgcgtcatcacgctcaccgatcgttgcgggtcctgtcgaatgccgccgttccgtcgcagcaggatttttcgacaagacccgtccggacccacttcccggctaaggaatgacaggatgagcgccgccctggagcgattgaatcatctgaacctgaatcacttgtatgccttcgtcgccgtcgccgaacacaacagcttcaccgccgcggcggaggccctgggcttgtcgaaatcgctactcagcgagcagttgcgacgcctggaggccgacctcgggatccagttgctgacccgtaccacccgtcgcatgacccttaccgatcgcggcgaactgctgttcggcgtggcccagcgcatgctcggcgagctggacggcgcgctctccgatgtgcgcgacctgcagggcgagcccagtggccggttgcgcatcaccgcgccgcaggacttcgtcaagtggcacatcagcagcgtttccgcggcgttcatccggcagtttcccaaggtccaggtggaaatgctggccgacgaccagttcagcgatctggtcggccagcgcatcgacctcgcggtgcgtatcggctggccgcgcgattccggcctgcatgccagcaagctgtgcgacttccagcaggttgccgtggcgacgccgggatacctcgccggcttgtcgccagtgctccagccgcacgacctggcgcgctgcgaatggatcggccatacccgcctgagcacgccctggacctggaccttcgaacgccagcgcgagcgtgccacggtacagacccgagggcgcctgctggcgaacaacaccctggcggtgtaccgcttggtgctcgacggtgccggcgtcagcgtgctgccgagcttcctggtggcccgcgagatcgcccgtgggcggctggtccggctgctgcccggctggcacctgccgcagggcggcatctacgccctgtacccctcggcgcgctacatgccggtgcgggtcagggcgttcatcgagtcgctgcgcgagcatctcggtcgcgagccgttccgcctggcgcagggcgaatga

SEQ ID NO: 9087 - DNA, 999 bp, Pseudomonas aeruginosa
ttcccgggagtgggaaccggtagtccgcaaatcaagtctcagagtctcgcacgtggaacgatgagtggtgagctggtgttcgatctgaacgcgcttttcatctatgccaaggtggtcgagcacggtggcttcgcccccgccgggcgggtgttggggattcccaagtcgaccatcagccgcaaggtcgcgcagctcgaggcgcgcctgggcgtacgcctggtgcagcgctcgacgcggcaattccaggtgaccgagatcggccaggcctactaccgtcattgcgtggcgatgacggtggaagcggaggctgccgaggacgtcatcgaacagaaccgctcggagccgtgcggaatggtccgcctgacctgctcgacgccgctgctgcacttcgaactggcgccgatgctggcgcgcttcatggcgcagtatccgaacgtcgagctgtatgtgaagaccttcaatcgccgggtcgacgtgatcgccgaaggctacgacatctcgctgtcgctgcgtttcccgccgctggaggacagcgacctggtgatgaaggtgctggcacgtagcccgcaggtgctggtggccagcccggagctgctggcccgctaccgcccgccggagctgccggccgacctgtcggcgatgccctacgtcggctgggagcgttcgcgcctggacggcagcctgcggctggtcggcgcggatggcagcagcgcggccctcaacctgcgcccgcaactgctcagcgacgacctcggcaccttgcgccaggcggtgctggagggcgtcgggatcggcggcctgccgctctgcgtggtcagtcgcgacctggccgagcgccggctggtgcgggtgctgccggagtggacgccggtggaaggcatggtggtggcaatgttcccctcgcggcgcgggctgttgccttcggtccgcgcgctgatcgactttctcgccgcaggcttcgccgacgccgcgcagcgccagtacccggagccgggctga

SEQ ID NO: 9088 - DNA, 522 bp, Pseudomonas aeruginosa
cgggaagaggctggcggcgttgatccgctcgatgggccgccggcgttgccagtcgtagtcggcgtagtagcccgccgggtgccagaggtggccttcgatggcctgtcgtcgcttctccgcgcgggctccgtagccttgctcgcaggccttcagcgcgctgctggcgcaggccttggcgatggttcgttcgagatggtagagcagggcgttgaggtccaccgggacgatggcggtggtgcggatgctggccagttcgcggccgtcgtccagccagcgggaggagaagtcccagccgctttccgcgccggcccgcaggtcgcgatagacctcgcccgcggggcgctgcggggcgcgcgcggcggtcgcccgatcctccaggaaggactcctggcgcggtgtgtcacggttgtcccagtagcggttcagcaggctgccgtcggccagtttcaccacgtgcaggcgcgcctcgttggggcgcagcccggcggagccttccatccagtaggcgtattccttctgtag

SEQ ID NO: 9089 - DNA, 705 bp, Pseudomonas aeruginosa
ctgcggcaggtagcgccggtaggcggcgtcgccttcgcgtcttgcctggaggtccaccatgtaggcgaagaacggcggctgcgaacggctcaggtagtagctgcggttaccgttgggaatgtgcccgtaggtatcgatcaggtaggcgaagttgtcgagcatgtcgcgcacccgttggtgctgcccgctctccgcaaggccgagcatggtgaagtaggagtcccagtagtacacctcgcggaagcgtccgccggggaccacgtagggtttcggcagcggcagcaggctgctgtgggccggcacctgctcgtagtggcgggtcaacgccggccacaggtcgctgatgtggctggcgagatcggcacccgcttccggcggggcggtctcgacgctgccggactcctcgaagttgcggccgacgaaggcgcgcaggtcgaagccgggccgctccctctcgcgcaggtagtcggcgcggatccgtgcaggctcgcgcagcgggagcgcatcgacgaagtgcttctggtcgctgaacagccggctttcctgcaccgcctggaacagctcgggataggcttcgtcgggggcgatcgcgcgttcgccgctggcgtcctgccaaccccaggacgcgggcggggtaggcgccgggccctggctgcaggccgccagcaggagcaggacccaggccgcgagcatggcgcggggtaa

SEQ ID NO: 9090 - DNA, 555 bp, Pseudomonas aeruginosa
ccacgccgaagcaactcatcgcggggatggtcaaggggaagtccggcaaggccggcaagggcggcaaccgcatcaccctgctgcgccgagccggcgccggaggccagtggcagaagtacgtgttcctggaagggctggactcgccgttcggcgtgcagcgggtgggggattacctgtatgtcgccaataccgggaacatcatgcgctaccgctacgtgccgggtgaaacccgggtcgccgacccggggatggagttcaccgacctgccggacaccatcaaccaccactggaccaaggcgctgctcgccagtcccgacgggcgcaagctctacgtgggcgtcggttcgaacagcaacatcaccgagaacggcgcggcgatcgaataccgtcgtgcggcgattctcgaggtggacgtcgccagccgcggcagccgcatctacgcctccggcctgcgcaacccgaccggcctgcagtgggaaccggtctccggcaagctgtggaccatcgtcaacgagcgcgacgagatcggcaacgacctggtcccggactacctga

SEQ ID NO: 9091 - DNA, 1608 bp, Pseudomonas aeruginosa
gcgccgcgggcaccgactagcggcctgctcgacggtgtccgggccgaagctggcggtccgggctcggtgctgcggtccggcgcagtaaatccgtgcgtccctcctgcgtctcctgtgcatccgatccgcgaatgccgcccctggcggccggatcgccggttgccagtggaacaccaccacgccttgagggttgaagacatgcacgtcgccaccagcgtcatcgaagaccagccgctccgcgccaccccggcggagggcgaaacgctctacgagttctctcagtcgcccttgctggaacggcaaagccgccaggagtccaacgcgcgcagctatccgcggcggattccgctggcgctgaagaaggccagggggctgctggtggaggacgtcgaggggcgtaccttcatcgattgcctggccggcgccggcaccctggcgctggggcacaaccatccggtggtgatcgaggcgatccgccaggttctggccgacgagctgccgctgcacaccctcgacctgaccaccccggtgaaggaccagttcgtccaggacctgttcggcctgctgccgccggcgctggccgccgaggcgaagatccagttctgcggcccgaccggcaccgacgcggtggaagccgcgctgaaactggtacgcaccgccaccgggcgcagcaccatcctgtcgttccagggcggctaccacggcatgagccagggcgcgctggggctgatgggcaatctcggaccgaagaagccgctgggcgcggtgctcagcacgggcgtgcagttcctgccgtatccctacgattaccgttgcccgttcggtctcggcggcgaggcgggggtcaaggcgaacctgcactacctggagaacctgctgaacgatccggaaggcggcgtgcagttgccggcggcggtgatcgtcgaggtggtccagggcgagggcggcgtggtcccggccgatctcgactggctgcgcggcttgcggcggatcaccgagcaggccggggtggcgctgatcgtcgacgagatccagagcggcttcgcccgtaccggcaggatgttcgccttcgagcacgccggcatcgtccccgacgtggtggtgctgtccaaggccatcggcggcagcctgccgctggcggtggtggtctaccgcgaatggctggacaaatggcagcccggcgcccacgccggcaccttccgtggcaaccagatggccatggccgccggttcggcggtgatgcgctacctgaaggaacacgacctggcggcccacgcggcggccatgggcgagcgcctggccgagcacctgcgcatcctccagcgcgactatccgcaactgggcgatatccgcggtcgggggctgatgctcggggtcgagatcgtcgacccgcagggcgaggcggatgccctcggtcatccgccgaccgacggcgccctggcctcgcgggtccagcgcgagtgcctgaggcgcggcctgatcctcgaactgggcggccgccacggcagcgtggtgcgcttcctgccgccgctgatcatcggcgccgaacagatcgacgaggtggcccggcgtttcgcccgcgccctcggcgcggcgctggccggctaa

SEQ ID NO: 9092 - DNA, 921 bp, Pseudomonas aeruginosa
cgacgaagccgtaggccagggtctccggaaggtagccggcggcggcccaggcctggacggcctggcgcagttgttcgtaggcgtcgttcatcggctggcctccgcgttcttccggggctgggtggagaacagcgtgagcaggcgttccggggtcaggctgctggccgccggaccgtcgaacagcaggtggcggttgagaccgctgacccggtcggcgaggcggccgacggcctccaggtcgtgctcgatccagagcacggtgacgccggcctggcgccagtccagcagcagccgctcgaagacctggatgccgccctcgtcgagggccgacatcggttcgtccagcaccagcagttgcggcggcggtaccaggccctgggccagcagcacgcgctggcgctcgccgccggagagggcgcccatgcgccgaccgcgcttggccagcatgccgacccgttccagggccgcgtcgatcgccgggcgccggctgcgcgacaggccgaggaaagccggacggcgctggcacatggcggccatgaaatcgtcgacggtgagcggcaggccgcggtcgaactccagcgcctgcggcacgtagccgatgcagccgggcgcgccgggccactccaggcgcagctcgccgcgatgcggcatctgcccgagcagggtcttgaccagcgaactcttgccgccgccgttcggtccgaccagcgcgtgcacgctaccggcctcgacgcgcaggcgcacgccatcgaggatgcggctgccgccgaggctcaggtcgatcccggcgaagtcgatggccggcccgcaaggcgtggcgcaaagccgttcggccacggtcatgcgccggactcctggatggcgcggaccacggtgtcgaggttgcgcgccatttcttcctcgtacttgccggcgctgtag

SEQ ID NO: 9093 - DNA, 993 bp, Pseudomonas aeruginosa
cgggcagaccgacctgcgggtcggcgtccccatcgccaaccgcaaccgcgccgaggtggaagggctgatcggcctgttcgtcaacacccaggtgctgcgctcggtattcgacggccgcacgtcggtggcgaccctgctggccgggctcaaggacaccgtgcttggcgcccaggcccatcaggatctgccgttcgaacgcctggtcgaggcgttcaaggtcgagcgcagcctgagccacagcccgctgttccaggtgatgtacaaccaccagccgctggtggccgacatcgaggcgctggacagcgtggccggcctgagcttcggccagctcgactggaagagccgtaccacccagttcgacctgagcctggatacctacgagaagggcggtcgcctgtacgccgcgctgacctacgcgaccgacctgttcgaggcgcggaccgtcgagcgcatggcgcggcattggcagaacctgctgcgcggcatgctggaaaacccgcaggccagcgtcgactcgctgccgatgctcgatgccgaggagcgctatcagttgctggaaggctggaacgccactgcggccgagtacccgctgcaacgcggcgtgcaccggttgttcgaggagcaggtcgagcgcacaccgacggcgccggcgctggccttcggcgaggagcgcctggactacgccgagctgaaccgccgggccaaccgcctggcgcatgccctgatcgagcgcggggtcggtgcggaccgcctggtgggcgtggccatggaacgttccatcgagatggtcgtggccctgatggcgatcctcaaggccggcggcgcctacgtgccggtggacccggagtatcccgaggagcgccaggcctacatgctggaggacagcggcgtgcaactgctgctcagccagtcgcacctgaagctgccgctggcgcaaggcgtgcagcggatcgacctggatcgcggtgcgccctggttcgaggattacagtga

SEQ ID NO: 9094 - DNA, 468 bp, Pseudomonas aeruginosa
ggcgaacccggatattcatctcgatggcgagaacctcgcctatgtcatctacacctccggctccaccggcaagcccaagggcgccggcaaccgccattcggcgctgagcaaccgcttgtgctggatgcagcaggcctacggcctgggcgtcggcgacacggtgttgcagaagaccccgttcagcttcgacgtgtcggtctgggagttcttctggccgctgatgagcggggcacgtttggtggttgccgcgccgggcgaccatcgcgatccggcgaagctggtggagctgatcaatcgcgagggggtcgacacgctgcacttcgtgccgtcgatgctgcaggccttcctgcaggacgaagacgtcgcctcctgcaccagcctgaaacgcatcgtttgcagcggcgaggcgctgccggcggacgcccagcagcaggtgttcgccaagctgccgcaggccggcctctataa

SEQ ID NO: 9095 - DNA, 648 bp, Pseudomonas aeruginosa
cctctatggcccgaccgaggcggccatcgacgtcacccactggacctgcatggaggagggcaaggacgcggtgccgatcggccggccgatcgccaacctggcctgctacatcctcgatggcaacctggagccggtaccggtgggcgtgctcggcgagctgtacctggccggtcggggcctggcccgtggctaccaccagcgtccggggctgactgccgagcgtttcgtcgccagcccgttcgtggctggggagcggatgtaccgcaccggcgacctggcgcgctaccgcgccgacggggtgatcgagtacgccgggcggatcgaccaccaggtgaagctgcgcggcctgcgcatcgagctgggcgagatcgaggcgcgcctgctggagcatccgtgggtgcgcgaggcggcggtgctggcggtggacggcaggcagttggtcggctacgtggtgctggagagcgagagcggcgactggcgcgaagccctgaccgcgcacctggcggcgagcctgccggaatacatggtgccggcgcagtggctggcgctggagcggatgccgctgagtccgaacggcaagctggatcgcaaggcgttgccgcgaccgcaagctgctgcggggcagacgcatgttgcgccgcagaatga

SEQ ID NO: 9096 - DNA, 810 bp, Pseudomonas aeruginosa
cggctacatcctcgacgggcagttgaacctgctgccggtaggcgtggcgggcgaactgtacctgggcggggaaggggtggcgcgtggctacctggagcgtccggcgctgaccgccgagcgtttcgtgccggatccctttggtgcgccgggcagccggctgtaccgcagcggcgacctgacccgtgggcgtgcggatggggtggtggattacctcggacgggtggatcaccaggtgaagatccgaggcttccgcatcgaactgggagagatcgaggcgcgcctgcgcgagcatccggcggtgcgcgaggcggtggtggtggcccagccgggcgcggtgggccagcagttggtgggctacgtggtggcgcaggagccggcggtcgcggattcgccggaagcgcaggcggagtgccgggcgcagttgaagacggcgctgcgcgagcgcctgccggaatacatggtgccatcgcacctgttgttcctggcgcggatgccgctgacgccgaacggcaagctggaccgcaagggcctgccgcagccggatgcgagcctgttgcagcaggtctacgtggcgccgcgaagcgatctggagcaacaggtcgcggggatctgggcggaggtcctgcaattgcaacaggtcgggctcgacgacaacttcttcgagcttggcggccactcgttgctggcgatccaggtgactgcccggatgcagagcgaggtcggcgtggagctgccgctggcggcgttgttccagaccgagtcgctgcaagcctatgccgagcttgccgcggcgcagacttccagcaatga

SEQ ID NO: 9097 - DNA, 948 bp, Pseudomonas aeruginosa
aaccgagcggctgatcggtttcttcgtcaacacccaggtgctcaaggccgacatcaatggccggatgggtttcgacgagttgctggcccaggcccgccagcgcgcgctggaggcacaggcgcaccaggacctgccgttcgagcaactggtggaggctttgcagccggagcgcagcctcggccacaacccgttgttccaggtcatgttcaatcaccaggccgactctcgttcggccaaccagggcgtgcaactgccaggcctgtcgctggagcggatggagtggcggagcagctccgtggccttcgacctgacgctggacgtgcacgaggccgaggacggtatctgggcatcgttcggctatgccacggatctgttcgaggcctcgaccgtcgagcgcctggctcggcactggcagaatctcctgcgcggcatcgtggccgaaccgggccggccggtcgccgagttgccgctgttgctggacgaggagcgcgattgcctgttgcgggcctgggcagagaacgccgacgagggtgggttgccgcccctggtccagttgcagatccaggagcaggcccgtctgcgtccgcaggcgcaagcactggcgctggaggggcaggcgttgagctacgccgagctcaacgcccgcgccaatcgtctggctcactgcctgatagcgcgtggcgtcggtcccgatgtgctggtgggaatcgccgtcgagcgctcgctggacatggtggtcggtctgctggcgatcctcaaggccggtggtgcctatgtgccgctggacccgacctatccgcaggaccgtttgcgtcacatgctcgaggacagcgccgtcggcctgttgctcagccaggagcatttgctgcccgggctgcctttgcacgaagggctggaggtgctctccatcgaccgcctggaacgggacgcatcggtgtctacggatga

SEQ ID NO: 9098 - DNA, 792 bp, Pseudomonas aeruginosa
ccatgtgctggtcatggtccagcaccatatcgtctccgacggttggtcgatgcagttgatggtcgaagagctggtccagctctacgccgcctacagccaggggcgcgaagcggccctgccggcgctgccgatacagtatccggactatgccgtctggcagcgcgaatggatggaggccggagagagggagcgccagttggcgtactggatcggcctgctgggtggcgaacagccggtgctggagctgccgttcgatcgtccccgtcctgcggagcagagctttcgcggcgcgcggctggagttcgaactcggcgccgagcgggccaggcggctgaaggcgcttgcccaacggcagggtgcgagtaccttcatgttgctgctggcgtcgttccaggcgctgctgtatcgctacagcggtcagccggatatccgtgtcggcgtgccggtcgccaatcgcaaccgggtcgaaaccgagcgactgatcgggttcttcgtcaacacccaggtgctcaaggccgacatcgatgggcagatggggttcgaccgattgctgcaccaggttcgccagcgctcgctggaggcgcaggcgcaccaggacttgccgttcgagcaactggtggaagccttgcaaccggagcgcagtctcagccacagcccgctgttccaggtgctattcaactaccaggcggagcggggcgagcacggcttgccggaagtcgcgggactgagcatcgaagagcaggcgtgggaaagccatacggcgcagttcgacctggtgctggatacctgtga

SEQ ID NO: 9099 - DNA, 771 bp, Pseudomonas aeruginosa
cggctacatcctcgacgggcagttgaacctgctgccggtaggcgtggcgggcgaactgtacctgggcggggaaggggtggcgcgcggctacctggagcgtccggcgctgaccgccgagcgtttcgtgccggacccctttggcgcgccgggcagccggctgtaccgcagcggcgacctgacccgtgggcgtgcggatggggtggtggactacctcggacgggtggaccaccaggtgaagatccgaggcttccgcatcgaactgggagagatcgaggcgcgcctgcgcgagcatccggcggtgcgcgaggcggtggtggtggcccagccgggtgcggtgggccagcagttggtgggctacgtggtggcgcaggcgccggcggtcgcggattcgccggaagcgcaggcggagtgccgggcgcagttgaagacggcgctgcgcgagcgcctgccggaatacatggtgccatcgcacctgttgttcctggcgcggatgccgctgacgccgaacggcaagctggaccgcaagggcctgccgcagccggatgcgagcctgttgcagcaggtctacgtggcgccgcgaagcgatctggagcaacaggtcgcggggatctgggcggaggtcctgcaattgcaacaggtcgggctcgacgacaacttcttcgagcttggcggccactcgttgctggccacccaggtcattggccgcctacgcgaacgactgcacctggaggtgccgatcaagtcgatgttcaccgcggagacactgggtga

SEQ ID NO: 9100 - DNA, 7374 bp, Pseudomonas aeruginosa
aaaactgatttcctaagaggcggtagcgtgcaagcactcatagagaaggtgggctccctttccccccaggaaaggaaggcattggctgtcctgctcaagcagcaaggtgtcaatctcttcgagatcgcgccagtgttcaagcgccaggacggcgagcccctgcggctctcctatgcccaggagcgacagtggtttctctggcaactggagccggaaagcgcggcctaccatatcccgagtgtcttgcgtctacgtgggcggctggacctggatgccctgcaacgcagcttcgacagcctggttgcgcggcacgagaccctacgcacccgttttcgcctcgacggcgacgaggcgcgccaggagatcgccgcatccatggcattgccgttggatatcgtcgcgttggggccgctcgaggagggcgccctcgctcggcaggtcgagacgacgatcgcgcggccgttcgacctggagcgtgggccgctgctgcgggtgagcctgttgcggctggccgaggacgaccatgtgctggtgctggtccagcatcacatcgtgtccgacggttggtcgatgcaggtgatggtcgaggaactggtccagctctatgccgcctatagtcgagggctcgaggtagcgctgccggctttgccgatccagtacgcggactacgccctgtggcagcgcagctggatggaggcaggagaaaaggagcgccagttggcgtactggaccggcctgctgggcggcgagcagccggtgctggagttgccgttcgaccggccgcgcccggttcggcaaagccatcgtggtgcccagttcatcctggaactggatattgatctgtcccaggcgctcaggcgcgtggcccagcaggagggggttactgccttcgccctgttgctggcttcgttccaggcgctgctgtatcgctacagcgggcaggcggatatccgtgtcggcgtgccgatcgccaatcgcaaccgcgtggagaccgagcggctgatcggcttcttcgtcaacacccaggtgctcaaggccgacctggacggtcggatgggcttcgacgagctgctggcacaggcccgccaacgcgcgctggaggcccaggcgcaccaggacctgccgttcgagcaactggtggaggccttgcagccggagcgcagtcttagccacaacccgctgttccaggtgctgttcaactaccagagcgaagcccgtggcaacggccaggcattccgcttcgacgagttacagatggaaagcgtgcagttcgacagccggacggcgcagttcgacttgacgttggacctgacggacgaagagcagcgtttttgcgccgttttcgactacgccaccgatctgttcgacgcctccaccgtggaacgcctggccggccattggcgcaacctgttgcgcggcatcgtcgccaacccacgacagcggctcggcgagttgccgctgctggatgcgccggagcgccggcagaccctctccgaatggaacccggcccagcgcgagtgcgcggtgcagggcaccttgcagcagcgtttcgaggagcaggcgcggcaacggccacaggcggttgcgctgatcctcgacgaacaacggttgagctacggcgaactgaatgcgcgggccaatcgcctggcgcactgcctgatcgcccgtggcgttggcgcggacgtgccggtcgggctggcgctggagcgttcgctggacatgctggtcggcttgctggcgatcctcaaggccggcggcgcctacctgccgttggacccggcggcgccagaggagcgcctggcgcatatcctcgacgacagtggggtacggcttctgctgacccaggggcatctgctcgagcacctgccgcggcaggcgggggtggaggtgctggccatcgacggactggtgctggacggctacgccgagagcgatccgctcccgacgctatcggcggacaacctggcctacgtgatctatacctcgggctcgaccggcaagcccaagggcacattgctcacccaccgcaacgcgctgcgcctgttcagcgccaccgaggcctggttcggcttcgacgagcgggacgtgtggacattgttccattcctacgccttcgatttctcggtctgggaaatcttcggcgcgctgctctatggcgggtgcctggtgatcgtgccgcaatgggtgagccgttcgccggaagacttctaccgtctgctgtgccgcgaaggcgtgacggtgctcaaccagacgccgtcggcgttcaagcaactgatggcggtggcctgttccgccgacatggcgacgcagcagccggcgctgcgctacgtgatcttcggtggtgaggcgctggatctgcagagcctgcggccgtggttccagcgctttggcgatcgccagccgcaactggtgaacatgtacggcatcaccgagaccacggtacacgtaacctaccgtccggtgagcgaagccgacctggaaggtggcctggtcagtccgatcggcgggaccatcccggacctgtcctggtacatcctcgaccgtgacctgaacccggtgccgcgcggcgcggtgggcgagctgtacatcggtcgcgccggtctggcgcgcggctacctgaggcggcccgggttgagtgccacccgcttcgtgccgaacccgttccccggcggtgccggcgagcggctgtaccgtaccggcgacctggcacggttccaggcggatggcaatatcgagtacatcgggcgtatcgaccaccaggtgaaggttcgcggcttccgtatcgaactgggtgagatcgaagcggcgctcgccggtctggccggggtacgcgatgccgtggtgctggcccatgacggggtcggcggcacgcaactggtgggatacgtggtggcggactcggcggaggatgccgagcgtctgcgggagtcgctgcgggagtcgctgaagcggcacctgccggactacatggtgccggcgcacctgatgctgctggagcggatgccgctgacggtcaatggcaagctcgaccggcaggcgttgccgcaaccggatgcgagcttgtcgcagcaggcctatcgagcgcccggtagcgagctggagcagcgcatcgcagcgatctgggcggagatcctgggagtggaacgggttggcctggacgacaacttcttcgaactgggcggtcattcgttgctggctacccgggtgatttctcgggttcgccaggagcagcagttggacgcaagcctgaaggcgttgttcgagcggccggttctggaagcgttcgcccagggattggaacgcacgacggatgcggtctcgacgataccgcttgccgatcggcagcaaccgttggcactgtccttcgctcaggagcgtcagtggttcctctggcaactggagccggaaagcgcggcctaccatattccgagtgccttgcgcctacgcgggcggctggacgtggatgccttgcaacgcagcttcgacagcctggtcgcgcggcatgaaaccttgcgtacccgcttccggctggagggagggcgttcgtaccagcaggtacaacctgcggttagcgtttccatcgagcgggaacagttcggtgaagaaggcctgatcgaacggatacaggccatcgttgtgcagccattcgacctggaacgggggccgctgctgcgggtgaacctgttgcaactggccgaagacgaccatgtactggtgctggtccagcaccacatcgtgtccgacggttggtcgatgcaggtgatggtcgaggaactggtccagctctatgccgcctatagccaagggctcgacgtggtgttgccagccctgccgatccagtacgcggactacgccctgtggcagcgcagctggatggaggcgggggaaaaggagcgccagttggcgtactggaccggcctgctgggcggcgagcagccggtgctggagttgccgttcgatcggccgcgtccggcccggcagagccatcgtggcgcgcagttgggtttcgagctaccacgggaactggtcgaggccgtgagagccttggcccagcgtgaaggcgccagtagtttcatgctgttgctggcctcgttccaggcgctgttgtatcgctacagcgggcaggcggatatccgtgtcggtgtgccgatcgccaatcgcaaccgcgtggagaccgagcggctgatcggcttcttcgtcaacacccaggtgctcaaggccgacctggacggtcggatgggcttcgacgagctgctggcccaggcccgccaacgcgcgctggaggcccaggcgcaccaggacctgccgttcgagcaactggtggaagccttgcagccggagcgcaatgccagccacaacccactgttccaggtgctgttcaaccatcagagcgagatacgctcggtgacgcccgaggttcagttggaggacctgcgtctggaaggcctggcctgggacggccagactgcgcagttcgacctgacgctggatattcaggaagacgaaaacggcatctgggcctccttcgactatgccaccgatctgttcgacgcctccaccgtggaacgcctggccggccattggcgcaacctgttgcgcggcatcgtcgccaacccacgacagcggctcggcgagttgccgctgctggatgcgccggagcgccggcagaccctctccgaatggaacccggcccagcgcgagtgcgcggtgcagggcaccttgcagcagcgtttcgaggagcaggcgcggcaacggccacaggcggttgcgctgatcctcgacgaacaacggttgagctacggcgaactgaatgcgcgggccaatcgcctggcgcactgcctgatcgctcgcggcgttggcgcggatgtgccggtcgggctggcgctggagcgttcgctggacatgctggtcggcttgctggcgatcctcaaggccggcggcgcctacctgccgttggacccggcggcgccagaggagcgcctggcgcatatcctcgacgacagtggggtacggctgctgctgacccaggggcatctgctcgagcacctgccacggcaggcgggggtggaggtgctggccatcgacggactggtgctggacggctacgccgagagcgacccgttaacgacgttatcggcggacaacctggcctacgtgatctatacctcgggctcgaccggcaagcccaagggcacgttgctcacccaccgcaacgcgctgcgcctgttcagcgccaccgaggcctggttcggcttcgacgagcgggacgtgtggacgttgttccattcctacgccttcgatttctcggtctgggaaatcttcggcgcgctgctctatggcgggcgcctggtgatcgtgccgcaatgggtgagccgttcgccggaagacttctaccgtctgctgtgccgcgaaggcgtgacggtgctcaaccagacgccgtcggcgttcaagcaactgatggcgatggcctgttccgccgacatggcgacgcagcagccggcgctgcgctacgtgatcttcggtggcgaggcgctggatctgcagagcctgcggccgtggttccagcgcttcggcgatcgccagccgcaactggtgaacatgtacggcatcaccgagaccacggtacacgtaacctaccgtccggtgagcgaagccgacctgaagggtggcctggtcagtccgatcggcgggaccatcccggacctgtcctggtacatcctcgaccgtgacctgaacccggtgccgcgcggcgcggtgggcgagctgtacatcggtcgcgccggtctggcgcgcggctacctgaggcggcccgggttgagtgccacccgcttcgtgccgaacccgttccccggcggtgccggcgagcggctgtaccgtaccggcgacctggcacggttccaggcggatggcaatatcgagtacatcgggcgtatcgaccaccaggtgaaggttcgcggcttccgtatcgaactgggtgagatcgaagcggcgctcgccggtctggccggggtacgtgatgccgtggtgctggcccatgacggggtcggcggcacgcaactggtgggatacgtggtggcggactcggcggaggatgccgagcgtctgcgggagtcgctgcgggagtcgctgaagcggcacctgccggactacatggtgccggcgcacctgatgctgctggagcggatgccgctgacggtcaatggcaagctcgaccggcaggcgttgccgcaaccggatgcgagcttgtcgcagcaggcctatcgagcgcccggtagcgagctggagcagcgcatcgcagcgatctgggcggagatcctgggagtggaacgggtcggcctggacgacaacttcttcgaactgggcggtcactcattgttgctgctgatgctcaaggagcggatcggcgatacctgccaggctacgctgagcatcagccaactgatgacccatgccagcgtcgcggaacaggcggcatgcatcgaggggcaggcgcgtgagtcgttgctggtgccgctcaacggtaggcgcgaaggttcgccgctgttcatgttccatccgagtttcggctctgtgcactgttacaagaccctcgccatggcgctgcgggatcgtcatccggtcaagggtgttgtctgccgtgccctgctgggcgctggtcgcgaggtgccggagtgggacgatatggttgcggaatacgccgagcaattgctgcaggagcaccccgaaggggttttcaacctggcgggatggtcgctcggcggcaacctggcgatggatgtcgcggcccggctggagcagcgtgggcggcaggtggctttcgtcggctggatcgatgcgccggcaccggtcagggtcgaagcgttctggaacgagatcgggccgacgccggaggcagtcccgaacctatccgtgggcgagatgcgggtggaactgctcggtgtcatgtttccggagcgggccgagcatatcgaacgggcctggtcatcgatctgctccgccacgacggacgatgagcagcgctggacgaggatgagcgactgggcggaagcggagatcggcgccgagttcgcgacactgcgcagcgaaatcgcacagagcaacgaactggaagtgtcctgggagttgaaacagatcctcgacgagcgcctgaaagcgatggattacccgcgtctgacggcgaaggtcagcctctggtgggccgcgcgcagcaccaatgccatccagcggagcgcggtggagcgctcgatggccgaggcgatcggggcggagcgtgtcgaaccggtgcgggtgctggatacccggcacgacaagatcatcgaccaccctgagtttgtgcagagcttccgggccgccctggagcgtgccgggcgctga

SEQ ID NO: 9101 - DNA, 972 bp, Pseudomonas aeruginosa
gttcttccacgtaaattgcaggcgatgccgttcgttgcagatcaggaagaggtgtcgcgcccgcccgtcgcaggtcgacgcgcgcttcgactcgacatggcgctgccttcctctggcgctcgatccactcctgggaatgatgaaatgacgaaaaggaaactggcctatatctggtccctgagaaacgccgcggccgacaaggccggccagtacgtgccgtacaagggcgaacagcggtacatgaagtcggtactggagtccttggtggaggcgctgaatcagactgcgctgggcgatgcctacgagctcgtgggcgtgatctacgacgacgacgcggagctgcctcgcgaccagggaaaaatcaaggactacggtttcgcctatcgtcccgggcagcaatggttctatccggcagacctgcaggtgcaaggcaagaccctgaacgacctcttgctcagcgtgccgtccacctaccgtcggtacccgcggggtacccccgagcatgtggccggcaagagcgatttcgagcgacgcctgcatgacaccctggtggagctgggcgccgatgtggtggtattggacgggctcctggtcatcctcgatgagctggtacgcccgggcgctccgttcgcacggcggatcatgaatatccatcctggcgtgacgcgcgaggactcgccttacgagcgtcgtggcgcctatgcgaccctggacgcgttgtatggagcgcggggcgagaaggtggtggattgggcgaccatggaaaaggtcgcggtcgagccgctgtactggactggagcatcgttccactatgtggacaatggcatcgattccggcgaagtgttccatgatgtgctgaaaacggagatttcacccgacgacaccatcctcgagctgcgctggaacaacttcaacaacagcctgttcccggccttgcacgaagggctggcgctgctcgccgagaagctctga

SEQ ID NO: 9102 - DNA, 1677 bp, Pseudomonas aeruginosa
cggctgatggcgaacggcttggcgaaggtcacgtcgtgcagcgggccctcgtcgggctggcggccgacctcgtcgtccggggtgcccatggtgaagctgccggcgggcagtacgaccatctccgggcagtccttgcaatccttgaacaccgtgccgggtttcttcgcttcgtcggcgaaggcgggggcggtggcgacgatcagtgcggccagggccaggggcgataatgcgtgcatggcggttctcgttgagtggcgaaaggggtcaggcgagttgcggggcgaggatttccagcacccggtcgatctccgcctcgtcgttcagcaggctcggcgccaggcgcaccaccgggccgacatcgcgatccacggcgtcgctgattacccggtgcgccatcaggtgtttggcgaccgcctcgcaatcgcggccttcgacgcggaagaaggtgaagcccgaagacagctcggggctggtcggcgtgaccaggcggaccttgggatgctcgcccaggcgctgcttgaggtaggcgttgagctggtggatacgcgcctggacctcggccttgcccaactgcaggtgcagctcgaaggccgtgcccagggccaggcgatgttcgaaggcgtggtagccgccaggggtcatcagggtgccgaagttgtcggcgcgggagaaggtcgggatgctcggcaccaggtgctcctggagctgttccgagcgggcgatgatgaccccggtgccacgcgggccgaacagccacttgtgggtgccggcgatgaagtagtcgcagtcgaagtcggcgaagctgacgtcttccacgccgaaaccatgcacgccgtcgaccacgtagatgatccggtcctgctcgtcgcgcttctggttgagttcgcgcaccagcttgccgatctcgcggatcggcagcttcacgccgctgcccgactgcacccaggtcatgcccagcacccgggtctgcgggcggatctgagcggcgatgctggacaggatctcgtcggcggaaacccggtgcgggtccttgaacagcgggaactcgcggacctgggtacccatgcgcttgtgccggtattccagggtggtgtaggtggagtagtgctcgtgggaggaggtcaggatctccttgcccggctgcaccagcaggccgccgtagatcgccgccaggccgtcggtggtgctgccggtgagcgccacctggccaggttgcacggcgaagtagcgacctgcccaggcgcgagcctcgtcctcgtatttccagatttcctcgcgatgccagtccaccgcttcgcccgggttgcggtcgaagcggacccgcaggcgctcgatggcctcccgcaccggccgagggtgggaggtgaggaggaagttggcgaagtgcagatactgcgggtcgagatcgaattgctggcgcagcgctttccatttattgccggcgtcgctcggtacgccttcggcgcggagcgactgggcagcggaaagcagcggcaggccggcggcgagaatgccggcctgcttgagaaaggtacgacggtcgttcatcgggaggtccgttgcggcgtggtcagggggtggctgtcggcttggcgcgtttttgcacttcgccccaggcgcgcaggaagttgcctccccagagcttggcgatgtcggcatcggaataaccgcgggtga

SEQ ID NO: 9103 - DNA, 1674 bp, Pseudomonas aeruginosa
ctggataaagcgagcttcacggttgatacaggtaggacgatgacggtttctcgacgcggattcatggcgggcctggcccttaccggggcggcggcgctgccggtggcttactacacacatcgtcatctgacccgcgaagaggagccgcagacgcctgacgaggcttcgctcgacctggcggctaccgatggcatacgactgggcgaccgcctgcgcggtctatgggacctgcgcctggtaggcggtgatgccgaactgcccgggctgcctcgggagggcttgcaactggtgctggacgtggcacccaaggggcgcggcctgattggctacctggatactcctgaacgtctcctcgcggcggagccgccgcgcttccgtgtgcttggcgacttgctcggagccagttctgcaagcatccgctggcgtttggtggaccaggcgagcggttccgtggcgccgactcacgattgctcggcggtgttcgacgaggtctgggcagactatgcgaacgcgggcgacggaaccctgagcggacgcatacagcgcctggagcgttcgccgctgtcgccgaacgaggattttcgcttcgttgcggtaaagcgtcacttccccctggcccatgagcgcatcgtgctcaacgagaaacttctcggttggctggtgtcgccgcagcaccgactgttccaccagctatggcacgcttcgcgggacaaatggcatcggctttcggaaaaacaacgcaatgcgttgcgcggagtcggttggcagcccggcccgctggaccgcgaacgcgatgcgcgagggccgcgcaaggatcgcaatgcctcgggtatcgacttctttttcatgcaccggcacatgctgcacaccgcgcgttccatgcaggacctgccgtcctgggagcgtctgccgcgacctgtggtgccgctggagtacgatcgtcccggcttcatccgttacttcgacaatccggacgggttttccgtgcctccggcctgggtggcagtggatgacgacgagtacagcgagtggctgcatggcctgaaaagcgccgaggcctaccatgccaatttcctggtctgggaatcgcagtaccaggacccgacgtacctggcgaagctgaccctcggccagttcggttcggagctggagctgggcatgcatgactggctgcacatgcgctgggcctcggtgacgagggacccctccaacggcgccccggtcatgaccgaccgttttccggccgatttcgccccgcgctggttccgcccggagaacgacttcctcggcgacccgttttcctcccatgtgaatccggtgttctggtcgttccacggctggatcgacgaccgcatcgaggactggtatcgcgcccacgagcgtttccatcctggcgaagtgcagcgccgcgaagtggagggcatccaatggttcgcgcctggtcgatgggtcgaggtcggcgatccctggctgggcccggcgacccatggatgcgggctttcggatgtccaggcgagcagcaactcggtggagctggacgtggaaaccatgaagctggctttgcgcatcatcttcagcgaagaagaccagttgagcggctggctcaagcgtgcgccgcggcggccctggtacgcgcgcaacctgaagctggcgcgcgaccagctcaggcgctga

SEQ ID NO: 9104 - DNA, 696 bp, Pseudomonas aeruginosa
acggcgaaagagcgagtaaggatggaggaggcccgcgcaacgcgggcctcagtctttccgcgcgagaccctggcggtcgctctgccagccgccgccgagggccttgtacaggccgaccgaggcctgcaggcgggccagtcgcagttgcacggcggcatcctgcgccgcgtacagcgtgcgttgcgtttcgaggaccgtcagcagggtttccgcgccggcctggtagcggctgtcggagagatcgaaggcgcgctgcgcctgctccagctcctgctgctgccagtgcagctggcggtcgaggccgtcgatgctgttcagcgagcgttcggtgtcggcaaaggcggtgaggatcgccttgcggtaggtttccagcagttcttcctggcgcgccaggctgcggtcgcgctcggcgcgcaggcggccgtggttgaagatcggggcgagcaggttggcgcccaggttgtaataggggttgcggaaagtgtcggcggcgcggttggcgccggacgacagcgaggcgctcagggtcagcttggggaacagcgccgcgcgcgccacctgcacgtcggcctgggccgcggccagttgcgcttcggcgttggcgatatcgggacggcggctgagcagttcgctcggcaggcccgctccggtctccggccagcgcaggctgtcgaaaggccgctcggccacctgtag

SEQ ID NO: 9105 - DNA, 1221 bp, Pseudomonas aeruginosa
cgcctgcaccggctcgccgatcagggtggccagggtaatcagcgcctcatgggcctgctgctcgagcagcggcagctgcttgcgctggctggcgaccaggctgctctgctgggcgacctccagggcggtggccgagcccgcggcatggcgggtctccaccaggcgcaggacgtgctcggcgttgtccaggttgagcctggcgatgcgctgctgttcgcgcagcgccaatacctgcaggtagctgttggcgacgccggagagcagggtcagctctaccgttgcgcggtcgtactcgctggccttgaggctttccagggcactgcggtaggcagcccggcgaccgccccagaagtccacttcgtagctggcgctgaggccggcggagaaggagtcgacggcatcgttgtcggaggtcgcgtcggtaccgctgtagcccgagtcgcgcaggagtttctgccggctggcgccgagcgtcgcattcagctccggcagcaacggcgcgccggcgatcaccgccgaggcctgggcctggcgtacgcgggccaccgccgcgccgaggtcctggctgttcagcagggcgcgttgcagcaggctgtccagttccggcgcgccgaaggccttccaccactggcggatgtcgctggcatcgctgcgcccggccgccaggtagcgccactggctgggcgcggccaggccgctgtcgaggggcgccggcgtgctgccgcaggcgccgagcagcaggcaggcggaaatcagggagagattcttcatggacatatccgtcattggctggccagggcggccaccgggtccagctgggcggccttgcgcgccggcatgaagccgaacaccaggccggtgaccagcgcgcaactgaaggcgccgacgatggccgacagggaaaaggccaccgcgacctggccgagcagcagcacgccgccgatgcacagggccagggcgatcccggccaggccgccgaccaccgagagcatcgccgcctcggtgaggaactggcggaggatatcgccctggcgggcgccagtggccatgcggatgccgatctcgcgggtgcgttcgcgcacggtcatgagcatgatgttcatcacgccgatcccgcctaccagcagggagatcgcggcgatcgagccgagcatcagcgacagggtgttctgggtcttcgcctcggcctggatcatcgccgcgttgttggtcagctcgtag

SEQ ID NO: 9106 - DNA, 636 bp, Pseudomonas aeruginosa
atgatgttcgagccgaacgcgcccatctgcgccatcacctggcgcttgctgccctcgccgacggcgagcatgaccaccaccgaggcgacgccgatgatgatcccgagcagggtcagcgcggtgcggaaccgattgatccacatcacccgccaggcggcgcgcaccgcctccagcagttcggcgcgccaggcccccgagggttcgctgctgccctcggcgaggcgctggctgagatcgtcggcctgcaggtggcgctcgacgccggcgctcggttgcgccgggcgctcgtcgttggcgctgtcgctgacgatctcgccgtcgcgcacctcgatgatgcgcttggcgcgggcggcgacgtcgcggtcgtgggtgatcaggatcaccacgtggccctggctggccagctcgtcgagcagcgccatgacttccgcgccgctgtggctgtcgagggcgccggtgggttcgtcggcgaggatgatatggccgccgttcatcagcgcgcgggcgatcgacacccgctgctgctggccgccggacaactggtgcggacggttggcggtgcgctcggccaggcccaggcgttcgagcagggcccgcgctcgggtgtgccgctcgctcgccgggatgccggcgtag

SEQ ID NO: 9107 - DNA, 501 bp, Pseudomonas aeruginosa
aggcagcgagcaggagtcgtcttggaaaaccattatcgggagctgctgcgattcctcagtgccaggctcggggatcgacatgcagcggcggatgtcgcccacgacgcgtatttgcgcgttctggagcgctccagtcaagcgcagatcgagcatccgaaggcttttctgtaccggacggcgctcaacctggcggtggacgagcaccgtcgtagccgggtgcgccgggcggaacccctggaggtcctggacgacgaggagggcctggccagtccctcgccgcagacggtggtcgaccaggggcagcgcctggacaacctgcagcgcgcgctggccgagttgccggccatctgccgcagttccttcctgttgcgcaagctggacggcctgtcccattcgcagatcgccgaacatctcaatatttcccgcagcctggtggaaaagcacatcgtcaacgcgatgaagcactgtcgggtgcgcatgcgcgaatgggaagccgactga

SEQ ID NO: 9108 - DNA, 1359 bp, Pseudomonas aeruginosa
aagggggccaatccagaggaactggaaatgactcaggcaactgcaaccgccgtggttcacgatctcatcggtgtcggcttcggcccttccaatatcgccctggcgattgccctccaggaacgggcccaggcgcagggcgccctggaagtgctgttcctggacaagcagggcgactaccgctggcacggcaacaccctggtgtcgcagagcgagttgcagatctccttcctcaaggacctggtgtccctgcgcaaccccaccagcccgtattccttcgtcaactacctgcacaagcacgatcgtctggtcgacttcatcaacctgggcaccttctatccctgccggatggagttcaacgactacctgcgctgggtcgccagccacttccaggagcagagccgctacggcgaagaggtcctgcgcatcgagccgatgctgagcgccggccaggtcgaggcgctgcgggtgatctcgcgcaacgccgacggcgaggagctggtgcgcaccatccgcgccctggtggtcagtcccggcggcaccccgcgtatcccgcaggtgttccgtgcgctcaagggcgacggccgggtgttccaccacagccagtacctggaacacatggccaagcagccctgcagcagtggcaagccgatgaagatcgccattatcggcggcgggcagagcgcggcggaggccttcatcgacctcaacgacagctacccgtcggtgcaggccgacatgatcctgcgtgcctcggcgctcaagccggcggacgatagcccgttcgtcaacgaagtgttcgcgccgaagttcaccgatctcatctacagccgcgaacatgccgaacgcgagcgtttgctgcgcgaataccacaacaccaactattcggtggtggataccgacctgatcgagcgcatctacggcgtcttctaccgccagaaagtctccggcatcccgcgccacgccttccgttgcatgaccaccgtggagcgcgcgaccgccaccgcccagggcatcgagctggcgttgcgcgacgccggtagcggcgagctaagcgtagagacctacgacgcagtgatcctggccaccggctatgagcgccagttgcaccgccaactgctcgaaccgctggcggagtacctcggcgaccacgagatcggccgcgactaccgcctgcagaccgacgagcgctgcaaggtggcgatctacgcgcagggcttcagccaggccagccatggcctcagcgacaccctgctgtcggtgctgccggtgcgtgccgaggaaatctccggctccctgtaccagcacctgaagcccggtactgcggcccgcgccctgcacgagcacgccctggccagctga

SEQ ID NO: 9109 - DNA, 441 bp, Pseudomonas aeruginosa
tgccggtccaggccgatatgccgcggccgaccgggctggccgcggacatccgctggaccgcctatggcgtgccgcacatccgggccaaggatgagcgcggcctgggctatggcatcggctacgcctacgcgcgcgacaacgcctgcctgctggccgaggagatcgtcaccgcgcgcggcgagcgggcgcgctatttcggcagcgagggcaagtcgtcggccgagctggacaacctgccgtccgacatcttctacgcctggctcaaccaacccgaggcgctgcaagccttctggcaggcgcagacgcccgcggtacgccagttgctcgaaggctacgccgccggtttcaaccgcttcctccgcgaggcagacggcaagaccaccagttgccttggccagccctggctgcgggccatcgcgaccgatgacctgctgcgcctga

SEQ ID NO: 9110 - DNA, 2583 bp, Pseudomonas aeruginosa
agtctgccccatgctcaatcccgacgatttccgttttccttccatcgaagcgttgcaggcgttcgaagcggctgcccggctgggtaccttcgagcgcgccgccgaactcctgtcgatcaccggcagcgccgccagcaagcgggtttccggtctcgaggggatgctcggggtgagcctgttgcagcgcgacggccgctcgctggcgctgacctcccacggccgcgagtacctcgaacagatcgcgccgatcctcgcccagctcgcggcggttccgctgcatcgtcgccaggtccagcgccagcagcggctgaccctgcgcacgccgccgaccttcgcccggcagatcctgattccgcgcctggcgtccttcgccgaggcctgtccggaaatcgagctggagattctcctgtcgagtccttcggacggccaggacctgccgctggccgatgtcgaggtgcgcggcgacagccatggcgtggcggccggcgagcggctgctggaggagcgcgtgctaccgatggccgcgccggggctgctgctcggcctgccgcggccctggacgccagccatgctcgctggcctgccgttgctgcgctcgccgctggagccctggcagccgtggttccgcgtggccgggctggactggccggagccctgcgccgggccgcgcctgctcgatttgggcatgaccctggaagccgccgccaacggccagggcgtggccctcgcgcgaccctcgctggcgcgcgcctggcttgccgaggggcggctggtggtgctgttcccgctgcgttcggcgcccacccaccattaccacctgcgcagccaccaggcctcgccggccagccagcgtttcgccgcctggctggcggcgatctgccgcgaggcggtggcccagggcagggaattccttccggcggcggacgactgaaacggcggaatttccttccgccgatgccgacaattattccgcctgcggcggtacgtcgcgctctaccatccagccacccccgaaggagtggactgcatgagcgtcatcaccgatatcgaagacctgcgccgcctggcgcgcaagcgcgtgccgcggatgttctacgactacgccgactccggttcctggagcgaaggcacctaccgcgccaaccaggacgacttcgccgcgatcaagctgcgccagcgggtcgcgcggaatatcgagaaccgctcgctgcgcacccgcatgctcggccaggagatggccatgccggtggccatcgcgcccaccgggctggccggcatgcagcatgccgacggcgagatcctcgccgcccgcgccgccgccgagttcggcgtgcgctacaccctgtcgaccatgagcatctgttccctggaggacatcgccacggaagtcggccagccgttctggttccagctctacgtgatgcgcgaccgcgatttcatcgaacgcctgatcgaccgtgccaaggccgccggctgcgacgcgctggtgctgaccctcgacctgcagatcatcggccagcgccacaaggacctgaagaacggtctctcggcgccgccgcggccgaccctggccaacctgctgaacatcgccaccaagccgcgctgggcgctgggcatgctcggcacccggcgtcgcggtttcggcaacatcgtcgggcacgtcaagggcgtcgacgacatgggctcactgtccgagtggaccgcccgccagttcgacccgcggctgaactggggcgacgtcgaatggatcaagcggcgctggggcggcaagctggtgctcaagggcattctcgatgccgaggatgcgcggttggccgccgactccggcgccgatgcgctggtcgtcagcaaccatggcggacgccaactggacggcgcgccctcgaccatcagcgcgctgccggcgatcgtcgaggcggtgggcgagcgcatcgaggtctggctcgacagcggcatccgttccgggcaggacgtgctcaaggccatcgccctcggtgcgcgcgggaccatgatcggccgtccctatctctacgggctgggcgcgctggggcaggccggagtgacgcgggcgctggagatcatagcccgcgagctggacctgaccatggccttctgcggccataccgacatccgcgaggtcggccgggacatcctgttgccgggaagctatccgcgatagccgcgaacagcgaatggaagggaagggaagagcgcaagccgcgcggctcgacggccgcgcggcaaacaggatcaggcggcggaactccagcgcaggacgatgctgccgtcgcgctgcgggtcgagcagccactggttggaacggtcgaagctttccagcaggtgggcccagtcgccctcgtcttcgccgggcaatcgggaaatgcaggcctggcaggcctgttgcgcggccggggcgtggatgatgcgctggatgcgggtgttcagcaggtcataggccgtgggcagggcggggatcgatgcagtgtggttcatgggtgcctccgcttgctttctcggttatgggtgggtggacaaaggaaccctcggttccggcgagatacctttgtagcggaactcgtgtga

SEQ ID NO: 9111 - DNA, 264 bp, Pseudomonas aeruginosa
ccggtacttctcgacggatacgactgcatggcgttagaaccttccgatgttttgctcgaatcggtgttttgtcagctggatgccgacaccccgcgttccctccatgatctcaagggcgaccccagggccaacctgctggcgatccgcctgctgttccgccagggccgcatcaccggcgtgctgctggacgaccccagcggtgccgaggaccagcatgggccgttgatctaccacgccgagcgcctgcgcgtgcggcgcggctaa

SEQ ID NO: 9112 - DNA, 2157 bp, Pseudomonas aeruginosa
attccattcaacgatacgttcagttttgccaggttatgcgccgcagtcctctcgccaataatctcccttcagtccgatgagagactcgccgcgcccatggggggcggcgcagtcgccgtgcgactccataaccagaaaccagaaaaggcgtgcaccgatgattaccctgaacctcaatggcaaggatcatcagctcgatgtcaccgaggatatgcccttgctctgggctatccgcgacgtcgtcggctataccgggaccaagttcggctgcggcatgggcctgtgcggctcctgcaccatccatatcgacggccaggccacccgttcctgcatcacgccggtgagcctggcgcagggcaggaaggtcaccaccatcgaccacctgcacaccgacaaggtcggcgaagtcgtccagcaggcctggctggacatcggcgtggcgcagtgcggctactgccagggcgggcagatcatgtcggccacggcgttgctgaagagcaaccccgcgcccagcgacgagcagatcgaggcggccatggccggcaacatctgccgctgcggcacctacaaccggatcaagacggcgatccacaacgcctccgccaagttgcaggaggccaaggcatgaagcgctcgtaccccgacgatctggtcatcggcaatctcagccgccgcggtttcctcaagggcgtcggcgccaccggcgtgctgctggtggctgccaactggggctggcgcgacgccctggccgccgagaagaaggccttcggcgccgacgccatgccccacggctgggtggacaacccgaagatctacgtgagcatcgaccgggacggcacggtcggcatcgtctgcaaccgctcggaaatgggccagggcgtgcgcaccagcctggcgatggtggtggccgacgagctggaggccgactggagccgggtcaaggtgatccaggcgcccggcgacgaagcgcgctacggcaaccaggacaccgatggctcgcgcagcatgcgccattggttcgaacccatgcgccgctgcggtgcggcggcgcgacagatgctcgaacaggccgcggccaaccagtggaaggtcccgctgggcgagtgccgcgccgaacagaacaaggtgctgcatgcgcccagcggccgttcgctgtccttcggcgaactggccgaggccgccgcgggtctcgaagtgccggcgcgcgacaagctgctgctgaagaagcccgagcagttccgctacatcggcaaggacgtggcgcgcgccatcgacggcgccgatatcgtcaatggccgcgccggcttcggcttcgacgcgcgcttcgacgacatgctctacgccgtggtcgcccggccgccggtctacggcggcaagctcaagcgctacgacgccgccgcggcgctgaaggtgccgggggtggtcaaggtgatcgagatcgagggccggccgatcccgtccgagttccagccgctgggcggggtcgccgtggtggcgcagaacacctgggcggcgatcaaggggcgcgaggcgctggcggtcgagtgggacgccggggtcaacggcggctacgactcggtggcctaccgcaagcaactggaagaggccgcgcgcaagccgggcaaggtggtgcgcgacagcggcgatgccgcggcgctgttcgccaagggtggggatatcgtcgaggccgagtactacctgccgcacctggcccaggcgccgatggaaccgccggtctccaccgcctggtacaaggacggcgcctgcgaagtctgggccccgacccaggcgccgcaagtgacccgcgagcgcatcgccgagcgcctgaagctgccgttcgacaaggtcacggtcaacgtgaccctgctcggcggcggtttcggccgcaagtccaagcccgacttcgtgctggaagcggcgatcctggccaaggcgttccccggtcgccacttgcgggtgccagtggaacccggggggaccatctgcatttcccccaatttcccacacagtatccggtggagcgcctgccaggccgtggtcggcgcccgacggggttccggcaggcttggctgcatcgctcggtggcgccgagcatcaccgcactgttcggcccggacagcaagctccagggcgccttcgacctgggcatgggcctga

SEQ ID NO: 9113 - DNA, 1647 bp, Pseudomonas aeruginosa
ccagggtcgcccccgcggtttccggccctagagctggctttcgtggcaattttcccgccgtttcgctggcgaacgaagaagatgcgaagaccagaacccatgccgccatcagcggcttcaccctgtcgatcatatgccgttcctctgctgaaaacgagcgtcgccgctcccggtgaggccggcgcgcaggcgcgcccctcatggatgggactggtccgccgcgacgggcttcagcgccgcgaggagacttcgcggaaaatcgcggcagacttctcgtttcggcattctcggatgcttgcgcgggaactccgggtacggccgcgtggaacctgcctagaagccggccttcaccgccagcgccgcggcggccgtccgcgtgttcacttccagggcgcgcagcagcgaggaaacgtgcacgcgcacggtgaacggagagatcgacagcgcgcggccgatttccttgttcgacaggccatcggcgatcagccgcagtaccgcttgctgccgtggggtcagggcgtccaggagggcgcgttgccgactgccggcgctcgacccgccgcgcaggcgcaccaccggttcgccgctgccgagcgtctgcaacgccgtgccgatctccccggcctccagggatttgccgaggtagccgtcggcgccggcggccagcacctcgtccaccagacgcgggtcgtcgagcatcgagacgatgacgattgcgctgtgccgataggcgcgacgcaagcgctcgatggactgggaggcggcgaagccgggaagcagcaggtcgaggacgaagagggcgggaggttccggcgagacgctcgaggccaggcgcagcacctcgtcgaagctgcccgcttcgcttacggcggcttgcgggaggtagcggcggacgacccgtctcaggccatcgcggaacaggggatagtcatcggcgacgatgacccgtgcggggaggcttcttgtgctaggcattgtcgtcccgtccatgggggcggccagggtacggcaacccctgcatcgaccggccgcgggccggccggcgagggcgctgcgggcaccgttcgatccgccgaaaatcctttttcgtcgatccctgtcgcggagctccgccccgcatcacagcggaattctagcgccgctggcgacacgcatgtcgggcattcgtcagaaaaacagcaagccagccccacggcgagcgcgatgggctggtctatcctgctacaacgccatcgcgctcgggaggacggcatgggctgcccgcaggtctgcgccggcgccaccctgcaatgcagcttcggggcggcgccgacggtgctcaacgtgttgccgcagaaccgcaccctgaccagcgggatgccggcggcgaacatcatggaccacatcccgctgctgaacattcccaccttcggtctctgccagagtccggccaaccccgtggtggccgccgccaccgccgccgccctcggcgtactgacgccgatgccgtgcattcccgccaccgccagcccgtggatccccggcggcccgccgaccctgctgctgggcgggatgcccgcgctggacgccaatggcacgctgatctgcacctggggcggggtgatcaagatcagcgtgccgggacaggtgcagatgctgattccctga

SEQ ID NO: 9114 - DNA, 2067 bp, Pseudomonas aeruginosa
gcctggatgccctggggcgatggcgcccagggcggcctcctggcccatcaccccctggcccattcgttgcgccagggaacggatggcgtgggcttcgtcggcgagcatcttgcccaccgggatgccggtccagccggcgatcaccgcggccacggtacgcgagtccacctgctcgggaaccagcgggtcgtcctggcggatggcttcgaggccggccgccaggcgcgccagttcggcggccaggtggtcgatgcgaccgtccagttcctcgtcgggcttggccgcgtcggcgctttcgctgagggccagcagttcgcggcgggtgtcgagcagttcgcgcaccgcttcgcgttcctcgtcccagcgggtctccagctcgcggatggtccggcggttatcgcccgactcgctttccagggcggtgatacgcgcgctgtggtcgaggccggtggcctgttcccggcgcagccgctgcaattcctcttccagcgcctgctcgcgatggcgcaggctttccagcggcggcggcacgtcgtgctggccgagggcgacccgcgcgcaggcggtgtcgagcacgctgatcgccttgtccggcaactggcggccggagatgtagcgatgcgacagcttcaccgcatcgacgatggccgcgtccatgatctgcacgccgtgatgcagttccagcttgccggcgaccccgcgcagcatctccacggcggtggcctcgtccggctcctcgacctggaccagctggaagcgccgggtcagcgccgggtccttctcgaagtatttcttgtattccagccaggtggtggccgccagggtgcgcagttcgccgcgcgccagggccggcttgagcaggttggcggcgtcgctgccgccttccgcgccgccggcgccgatcagcgtgtgcgcctcgtcgatgaacaggatgatcggctgcgcgctgttgcgcacggcgtcgatcacccccttgaggcgctgctcgaactcgcccttcatgctggcgccggcctgcaacaggccgaggtcgagcacccgcaggatcacctcctgcaacgacggcggcacttcgccggcggcgatgcgcagggccaggccctcgaccaccgcggtcttgccgacgcccggcgcgccgaccaggatcgggttgttctgccgccggcgcaggaggatgtcgacgcactggcggatttccccgtcgcgcccgacgatggggtcgatgcgcccggcgcgggcctcggcggtgaggtcctgggtgtactggtcgagcagcgggtccggggcgctttccggcttgtcgccgcctgccgccggacggttcggcgcgggcggctgttcgcgggaggcctggatccactccagcaggttggcctgcaaggcctcgtggggaatccgcagcagcgacgacgcgctgttcagcaacagggcgcggcgctcctcgcggtcgagcaaggcgagcagcagcaggccggaacggatctgcgcctggccgagcacactggcgtgcaccacggcgtcttcgagcaggccgatggtgtgcgcggacagcgccggagtgcgggtattgccggccttgaacagctccagcgacaggttgatctcggcgaccagggcgtcgcgctccaggccgaagcgcggcagcaggcaggcgaagtcgccgccgtcgatgtccagcagctccagcagcaggtgctcgatctctacgtaatgatgggtgcgttgcaggcagcgttgcgcggcgcgctccagggcgcggcgacaatccgggttgaggcggccgatcagggcggcgagttccatttcaagctacctccggctgccgcaggtcgagatcgatgcgctgccgctggccgtcttcgatgcgccgcaggccggtgttccagctcagcctgggcggtgtaccgcgctccaggcgcagcggcgcgccgccgctcaccagcaggctcaggcgacaatccaggtcggggccgaagtacagcgcggcgaggctggccaactggccatgggcgtcgccgtcggggaagaagcgggcggcctcgcgggcatccagcggaccgaggctga

SEQ ID NO: 9115 - DNA, 873 bp, Pseudomonas aeruginosa
  unsure (577): Identity of nucleotide at the above locations are unknown.
gcaggcggtgctggaacaggtcgaggaactcggcgggggcatggtccttctgccgggcgcgttgttgcagccattcctggtaggcatagggcaacgggccgtcggggccgccgaggccgaacaccggggtggacagcaccggttgctgcgggtcgtcgagcaggctttccacctcgctcgaggcgaacagcggcagcagcggcccgcgcaggcgcagggcctccgcccgcggcgcgttgccggtgcccagcggcaacgcctggggacgctcgcgttcgagcagcagcagcgcctgcaacagttcgaagcgctgcggcgtgcggcgcagccgctgactcagagggagagcggcgagccggcctggggttgccatgtcttcacctccttgtcggcttccaccaggaccgtgcgcacgaagcggttggcggtggcatacagcgagaagaactgcgccagcacggcggagaacagcacgccgctggcgccgacgaagtgctgcggatcgagtcgcaggcggatttccaggccattgcgccagccgcgccaggcatcctcgccgacgtgcgccaccacccgntggcagtcgagttgccgcagaccttctatctgccggcgggcgctggcgtcgtcgcgcaggttgtgcagggcgaggatttcccgcagggcttcgagggcgcgcgggccttccaccagcgagaggtggttgagggtcagctgcgagaccagtctccagcgcgattggccgtccaggcgcggctggctctgcgcgctgggcgcgttgcgcaggcgtgcggcggcgaccggcccgggccgttcgaagcccagcgcggtgccggcacccaggcgctcggccagatagcgattggtgcatag

SEQ ID NO: 9116 - DNA, 1200 bp, Pseudomonas aeruginosa
cagctcggcggtcaggctgaaggccggggtctcgcgcaacgggtcgaagccggtatccaccacgctcagcagcagatcgctgcccagccggttcggggtcagcccggcgatgcgccgggcgtgccagtagagcgtgccgaggtggctgtcgtggcggcagccatagtacgccgggactggctgcacggtgctcccggcaaccgagcgcacggcgcggatgctatggatttccacgctgttctcgcggtgactgtcggcgaccaggcggtactcgctgcgggtgccgtccgggcgcagcggctccgaggtctgcggaaagaggttgatcgccggcgcgcagccgagctggaagtcttccgcctgcaaatgcaggcgtgccgtcggtgcgcgatcgaagaccaggtacaggtagagcgcctgtccgtcggcgagcgcgccggacagcggcaagtcgaagaagtggaacttgtcgggaaaggcgaagtactcggcgagcaggcgcaggcccggatgtccgccgtcttcctccggcagcagcgcctcgtcggcggcgaagccgacgatcgccggcattccgcagagcgccgccggcggcgtgccgggcgcccccgccatgacctgcacggtatgcgcggcgagcaggtcgtagaggatcgcgcagcccatcggcgaagccgccaggtggatgcgcaggcgctcgatcgacagctcctcccagcggtactcgcccaggcagcgcaggctcaggcgcaacgccgagcgggcggcgccgactccggtcagggcttgcgcctcctcgccgccgagcagggtcgcttcgtcgatcgccagcggccacagggtcgcctcggcgctgctgcggaaatgcacgctgtcgccgccgcgggtggtgacgaacagcgcggtgtcgcgcggcagccggtagccctcggcgaggttgccctgggtcgggtccggttcgaactggacgatcgcgcaggacggcagcgggcgcagcgccagcgggtagagctgttcgaggagggcgtcgctgaactccgcgtagtcgtcgtcgaggcgccgttgcaggcgcgcggtgagcagcgagaagccttccagcagacgctcgacgtgcgggtcggggcattcgccgggggccagttgcaggcgccgggcgaccttcggatagcgctcggcgaaggcgccgccggcgtgccgtag

SEQ ID NO: 9117 - DNA, 1494 bp, Pseudomonas aeruginosa
cacacccggcgcgcaccgcttgcgcctcgaccagcagcagcgcgtctggctgcgtctggatacccgggaaatgcgactggtcaacgatcccgccacgcgttagcggaggggcaggcgagcgaccgtcgtgcacgacaacgtaggacgtcgaaggggagtcgtatgagtgttctgcctgacgcggtgtgctggcacgaagggatgcaactgcttccccagcatttccagttgcagggattgcgtgccgaggcgctggcggcgcgcatcggacaggcctgcaacccttggttctggggagtgaccgccctggaactggacccctctgcgttgtgcgccggccaagtgcgggtcctgcacctcgaagcgatcctgcccgacggcctgccggtgagcgtgcaggctggtgtcgacgcgccgctggagttcgatctggagacagcgctggcggccgccgaagggccgctgctgaacgtccacctggcggtcagtccgctgtggcgggcgggtcagttgctgccgctgaagggccgtctgcaatcgcgggtcggcgcgccgctgccggacctggccagcggcgagcaccccgagccgatcaccgtctggcgagcgtcgctgcggctggtcggcgacgacggcaaggccgactccgtgtgcctgccgttgctgcgcgtggcgaaggagggcggcgcctacgtcagcctgccctacgtcccgccgacgccactgatcctgccggagtcgcccctgggcagacgcgtgcagtcgctttgcgcgcgggcccgggagaaggcgctgttcctcggcgggcgcctgcgcctggcgcagcaggcgggcaaccaggacgacgcggtggaaatccgtcgccagcttgccgcgctctggacccgcctgccggaggtcgaaggcctgctggcaagccgtacggcctcgccgctggccctgcacggcagcctgctgggcctggccggtgcctgggcggcgctcgatccgctggccggcgtgccggccttcgaagcgctcgacttcctcgacctgcggcgtggctacgagccgctgctggactggctggagcgggccatcgagtcgatccgcgcgggctaccgctgcctgccgttcgagcaggaggaacaggtattttccgtgcgcctgcccgatccggcgccgcgtcagcgcctggtggtcggcctgcggatgcccgccggcgccggcgaacaggcggcggctgactggctggagcgcgccatcgtcgcctccgacccgcacctgccgttgctcgcccggcaacgcatgagcgggctgccgcggcagccgatgaatcgccaggaacaggtggcctacagcgttggcgacgacacccgtttgttcgtcgtgcagggtgccggcgactggttcgatgccggccagccgctgcgcatcgtcgcgccggtcagcggggtcgccagcagtccctggcagatcgtgctgttcgtcgccgacggcagcgacaacacctag

SEQ ID NO: 9118 - DNA, 780 bp, Pseudomonas aeruginosa
cccacctggccgatgcggagcaggcgccatgagcggcgcgaccctgttcatgctggttctcctcctggtgctgctggcgctgctgctgggggcgctgggctggtggtggcgaacccgcggtggtacggagatccgcagcttctacgcggcggtccggcagatggagcgcgagcagggctggcagggccgctacgaatcgccctggctgctgatgctcggcaacgagaccgagggcgagcagttgtgcgccacctggcgcctgctgccggtggcgcgtccggcctggttcggccgctggtggtcggacggcgagggggcgatcctgctggtgcccgagtcggtgttcctgcccgacgagggcctgcgccggcaaagcggcgcctggctgcgcctgttgcgtctgttcctgcgcctgcgcggcaggcgcgcgctggacggggtggtctggaacattccgctggcgcggttgcaggatggcgagcaggcggccaacctcggcctcgccgcgcgccgtcgctacgtggaactgacccagcgccttggcctgagcctgccggtttacgtggtgatcactggcctggaagacctgccgggtttccaggaacttctcgcggcgctgcccgaggaggcgcgcgagcgcgccctcggctggtcctcgccgttcgccgccgaagcggcctggcagtcgcgctggtgcgagcaggcgctggaggaaatcaccgccaccctgaccgagtcgatcgtcgaactcggtaccttgcgcggccaggtggacaatga

SEQ ID NO: 9119 - DNA, 2046 bp, Pseudomonas aeruginosa
cgatttcaaccagatggacatcggcagttgcgccgacattctcaacggcgtgctcctgccgtccagccgcagcgacctggcgacgcgcctggtggacctgcgccagggcgcgctcgggcgctgccagtcgttgcaacagcagcaggcggcgcaggcctggaaggacctcgccgactacttcaaccagtacctcgccggacgcttcccgttcgcctacagcctggaagcggccgatgccgagccggggcgggtgcggcacctgctgaaactgatggagacgcgcttgccgcaggtgcgcgaagggctggcccaggttcgctcgccggacctgccggccgccgaggacttcgtccgccgcctggagcaggcgcagcgctggctcggcccgctgttcgagcgcgacaagtcgggcctgctcggcgtcgccctggacatcgactggcgcagcgaccgcagcctggaacgcggcgccgaccaggtgatcgcctggagcctgtactcgggcgaccaggaaagccgtttccccggcgcgcaggacaagggcctgacctggaatgtcggcgatccgctgaaaatcatgctgcgctgggcgaagaacggctcgcagcgtccggcagacgacccgcgccaggccagcctggcggtggccgacctcgaggccggctggagctaccagggctcctgggcgctgttgcgcatgatgcgcgcgcacttctcccggcagcgcccgccgaacgtcgactacacggagtttccgctggtcctgcaactgccggtgtatgcgccctacagcccggaaaacgaggcgcggatgttcctccgcctgtcgttgatgagcctgggcggcaagaccccgctgtccatccagccgctgccggtgcgcgcgccgcaatcgccgttcgcgacgctgttgccggccaccgtcgccagcacgggaggtaccccatgaccctgcctctttccggcaacgccctgtccctggaagtgctgctcgaaccgatcgaccccggacagccgtgcggccccagcctgcgctacgacccggactacgaccgcctgcgcgagttgcgccgggaggatgacagcagcctgccgaccggcgtctggcaggcggaggccaagcgcgccgactgggccgcggtggagcagttggccagcgatctgttgcagcggcgcagcaaggatctgatgctcgccgcctggctcggcgaggcctggctgcaacgcggcgggctgggcggattgcagcgcgcgctggtgctgctggcggaactctgcgagcgctaccccgaggaggtgcatccgcaagcccaggacggcgaccagtcgtggcgggtgccgcccatcgactggctgttgcgccgctatgccgagctgctgcacacgcgcctgccgctgatggggcagggcgccttcgccgagatcaccctctatgcctggcagaggttgcagcgccagcaggtcgccagcggcgacagcaagagcgccaaggcggcgctggaagcggcgcaacttcagcagaagaagctcgacgaagcgttgcgcgcggagcccttggtgcaatggcagcgcaagcaggccagcctgctcgcctgccagcagcaactgcaacgcctggaacagtggtgcgaccgctgcctgggcgaactcgcccccagttgccagccgctgcgcgaggtcatcgcgcaatggctggccttgctcaaggagttcatcgccatgcacccgcaagcgccgctgcccgaagaacagccaccggtcgcggaggcggacgccgccgaaggcgacgcggacggcgaggaaagcgtcccggcgagcgcgccgagcgggccggctggcgcgccgaccagtcgcgaggacgcctatcggcaactgctgctgatcgctgactacctggcgcgcaccgagccgcacagcccggttccctacctgatcaagcgcgcggtggagtggggcaacaagccgctgagcgagttgctggcggagctgatcaatgcggactcggaggcgcgccgagtctggtcgctgcttggcgtactgccctaa

SEQ ID NO: 9120 - DNA, 606 bp, Pseudomonas aeruginosa
gcggggttatattttttattcgaatatataaatacgaattcagaattttttaatctatgggttcctggggcaagatgggcgcacattccccggctcggaacccagcatgtccgtcatcacccatccccacgcccgcgagctgaccaaatcggtgcgcgccaccgtgctggtgttcaacgacccccgttcccgcgagctgctggagcgcatcgagcgcctggcgcccagcgaggccaacgcgctggtcatcggcgagaccggcaccggcaaggagctggtggcgcgccatatccacgccctcagcggacgcaacggcggcccgttcgtcgcggtcaactgcggtgctttcgccgagagcctggtggagagcgagctgttcggccacgagaagggcgcctttaccggtgcgttgcagagcaaggccggctggttcgaggcggccaacggcggcaccctgttcctcgacgagatcggcgacctgccgccgagcatccaggtcaagctgctgcgcgtgctgcaggaacgcgaggtggtgcggctcggttcgcgccggccgatccccatcgacgtgcggctggtggcggcgaccaacgtcgacctggctga

SEQ ID NO: 9121 - DNA, 948 bp, Pseudomonas aeruginosa
ccgagcgcctgcgcttcctggtggcgatgccgtccgggaatcgtttcgccgaccgtctcggcgcggatggcggcgaccctcgaccgcctgtccggcgggcgcctgctgatcaacgtggtcaccggcggcgatcccgacgagaaccgcggcgacggcatccatctcggccacgccgagcgctacgaggtcaccgacgagttccttcgggtctggcggcgcgtcctgcagggcgaggcggtggacttccacggcaagcacatccacgtggagaacgccaaggcgctctatccgccgctgcaacggccgtatccgccgctgtacttcggcggttcctcggaggccgcccacgaactggccggcgaacaggtggacgtctacctgacctggggcgagccgttgccggcggtggcggcgaaaatcgccgacgtgcgccagcgagcggctcgccatgggcgtacggtgaagttcggcatccgcctgcatgtgatcgtccgcgaaaccgccgaagaagcctggcgcgccgcggacaggctgatcgaacacatctccgacgagaccatcgccgccgcgcagcagtccttcgcccgtttcgactccgaaggccagcgacgcatggccgcgctgcacggcggccgccgcgatcgcctggagatccagccgaacctctgggccggggtcggcctggtgcgcggcggcgccggcaccgcgctggtcggcgatccgcggcaggtggcggagcgcatcggggaatacgccgagctcggcatcgacagcttcatcttctccggctatccgcacctggaagaggcctaccgcttcgccgaactggtcttcccgctgctgcccgaaccctacgccagcctggccggccgtgggctgaccaacctgaccgggccgttcggcgaaatgatcgccaacgacgtgctgccggctcgcgccggcgcttga

SEQ ID NO: 9122 - DNA, 450 bp, Pseudomonas aeruginosa
tcttcaccgaggtgttcctcggcatcgccgaaggcgccttcgaggaggctcgccagtacaccctgcgcgaagcgcgaccgtggttccgctccgaggtcgccgaggccaatgccgacccctatgtgctggcgcgctacggcgaattctgggtcggcctggaaagcacccgggcgctggtcgagcgcgccgcgcagcgcctcgacgccgcctggtccaagggcccggcgctggacgccagcgagcgcggccagttggccctggccatcgccgccgccaaggtcgccgcgacgcgcaacggcctcgacctgtgcaaccgcatgttcgaagtcaccggcgcccgctccactcacgccgccctgcgcctggaccgctactggcgcaacctgcgcacccagaccctgcacgacccgctggactacaagatccgcgagctgggcgactgggcgctga

SEQ ID NO: 9123 - DNA, 837 bp, Pseudomonas aeruginosa
accagtcaccgccgcaaccgaccttctactcatgaacgcttctacccgtactcccgaccggctgctgacgctgccacgttcgccgaacctggcgacctcgatccgcgccaccgcccaggtcttcgaggatccgaagtcccaggccctgctcgaacacctgcgccaggtggcgccgagcgaggccagcgtgctggtgatcggcgagaccggcaccggcaaggaactggtggcgcggcatatccacaacctcagcgcgcggcgcaacggcccgttcgtggcggtcaactgcggggccttctccgagtcactggtggaagccgagctgttcggccacgagaagggtgccttcaccggcgccctggcggccaaggccggctggttcgaggaggccaacggcggcaccctgttcctcgacgagatcggcgacctgccgatgccgatccaggtcaagttgctgcgcgtgttgcaggagcgcgaggtggtgcgcctggggtcgcgcaagagcatccccatcgacgtgcgcgtgctggcggcgaccaacgtgcaactggagcgggcgatcaatgccgggcacttccgcgaggacctgtactaccggctcaatgtcgtcagtctcgaactgtcgccgttgcgcgagcgacccggcgacatcctgccgctgacccgccacttcatcgccgaatacagccgtcgcctgggctacggccagagccagttgagcccggaggcggcgcagaagttgcgtgcctattcctggccggggaacatccgcgagctggagaacgtcatccaccataccttgctgatctgccgcgacgggctgatccgcgcggatga

SEQ ID NO: 9124 - DNA, 1194 bp, Pseudomonas aeruginosa
agctcaccgccacggcgcgatccagggcgtctacctgtggggaccggtaggacgcggcaagacctggctgatggatcacttctaccagtgcctgcgcgtgcccgcgcggcgccagcacttccaccacttcatgcaatgggtgcaccagcgccagttcgaactgaccggtacagccgacccgttgcgcgccctggcccgcgagttggcgcgggatgtgcgggtgctgtgcttcgacgagctgttcgtcagcgatatcggcgatgccatcctgctcggcagcctgctgcgcatcatgttcgaggagggcgtggtgctggtggtcacttccaaccagccaccggagcagttgtacgccgacggtttcaaccgcgaacgcttcctcccggcgatcgaggcgatccagcggcacatggcggtggtcgcggtggatggcggccaggaccaccgcctgcatcccggccgggccgagcaacgctactgggtggtggaggcggggcaggcgagcggtttcgccgaactcttcgcgcgcctgagtgccggcgaagcggcatccacgcagcccatcgaactggggcaccgcccgctggcggtgcaccggcacagcgaatcggtgctctggtgcagctatgcgcagctctgcgaggcgccgctgtcggcgctggacttcatcggcctttgcgaccgctaccgggcgatcctgatggacgacctgccgtgcctgagcgccagccagcgcgaaggccgcatagcccgtggcaccgaggacggcgcgcaactggtggaggcgggggatcgcgaattgccgcagttgtcggtgcacgacgacggcgtgcggcgcttcatcgccctggtggacgaatgctacgaccgcaaggtgccgctctacctggaggccagggtgccgttggaggcactttataccgagggctacctggccttcgccttccgtcgcaccctcagccggctgcgcgagatgcagctggcacgcttcggcagcgacagcgccggctagcgccgcgccgccgaagcgggaactgcggatggccgcccgcgctcatccgccggccaggccgaggctcagtagccgtgccggcgcagcagcgcgtccatgtcttgcgccgccgggcggccctggaacttcagcagttccgaggtgcggttggtgaagaaaccgtcgacgccggccgcgcctag

SEQ ID NO: 9125 - DNA, 2157 bp, Pseudomonas aeruginosa
ggccttgaagtcttccgccgagtccaccgagtaggcatggatgaacaacccgcgcgcgtgggtcatgcggttcatccagggtttcaccaggtcggcgtagctctgttcgccgcgttcgctgagggtcgccgagggcccggtgcccagcgcgccgtgggccttggcccagtccagccaggcgccgaactcggcttcggacttcacttcctgcctggcatagaaggccgccttgtcggtttccccggattccttgaaggtcactggcgaacgggcttccaggtaaccgtcgccgagccacagcaggagaatcttcggcacttgcggcatgctttcttgcagcagttccaggctgctcttctcgaaggtctgcaggatcacccggccattgccgtgggccacgtcgacatgcccggcggcggcgcgctcgcggggttgcagccagccgcggcgttccagcagcttgcgcaggtcgtcttcgatgccggggaattgcgccggtaccttggtctccaggtacaggcccggcttgttggcgccgccctcggcgatgtcgagcatctcgtcgagggtgaggatgcgcaggccgacgaagccgggccgggcgcgctcggggaaggcgcgattgaaccaggagccggcgtccaggcgcttgagttcggcgagagtgaagctgctcaccgggtccttggcgcgtcccgggaagacctcggcgacgtcggtggtgcgctccagggtgtcgtcgtggagggcgaccagtacgccgtcgcggctgcgctgcacgtcggcttccaggtagtcggcgccgaggtcgcgggccaccaggtaggccgcggcggtttcctcgggggcgtcgtacgaggcgccgcggtgggcgatgaccgccggccagggcacgccggcggcggcgctgagggccttgccggacggctccgcggcctgggcggcgagccccgccgtcaggccgaggaggcccagggtcttgaatgttccttgccagaatctttgccgcatgaggcgcctttccttctttctttttcacgggattgccgaccagtctggcgtcgccggatgaccgcaggacgacagatacaggtctgtccggcgcggggaaagatgcgctgtcgcggcgacgctggttcctgtcgccctcggcaaagcgccagccctcccaggccgggagggcggattctacaggcgtttgttcagcaggcgggccaggcggtcgccgccgaattggatcaacgtgaccagcagcacaaggacgatgatcacggtgagcatcacctgggtgtcgaagcgctggtagccgtagcggtaggccaggtcgccgaggccgccggcaccgatcgcgccggccaaggccgaggaattgatcatggtcaccagggtgatggtgaagccgccgacgatgcccggtcgcgcctccggcaacagtacgttgcagatgatgtggcggcgttcgcagcccatcgcctgggccgcctccaccaggccgtggtcgacttcgcgcaggctgacctcggcgatccgcgcgaagaacggcgtggcggcgatggtcagcggcaccaccgcggcccagactccatagctggtgccgacgatcatccgggtaaagggaatcagcgccaccatcaggatcaggaagggtaccgagcgcagcacgttgaccagaccgcccaggatgcgattgagcaggcgcgcctcgaagatcccgcccggcccggtggtgaccagcaccagggccagcgggatacccaccagcaggacgatggcggaggacgcgccgatcatcagcagcgtatcgaggaaaccttgccagagccgttcaagcatgggcgacatggccgagcacctccaccttgtccgccaccagcgcggccttggccagcacgccgggaagctcgccgggcggcgcgccgacctgtagcagcaggcgccccagggcgcggccctggatacgctctatgccgccgtggagcaggtcgacgcgctggccgatggccctggcgatggccagcaggtccggcacccgtcggctggcgccggtgtactggagatcgagcagcaccgggtcgccggcgccgggagcctggcgcaggcgcgcctggaggtcggccgggagggcggcgcgcaggctgccgaacaggcttcgggtga

SEQ ID NO: 9126 - DNA, 300 bp, Pseudomonas aeruginosa
cgggcatggcgcggatcgccgaagacttcccagacttcgccctgttcgacgatgcggccgcattcgaggaccaccacgcggtcgcagatctcgcggatgaccgccatctcgtgggtgatcaggacgatggtcaggcccagccggcggttgatgtcgcgcagcagcgcgaggatcgcctgggtgctctccgggtccagcgccgaggtggcttcgtcgcagagcagtatctgcggctggtgcaccagcgcgcgggcgatgccgacgcgctgtttctgcccgccggagagctgcgccggatag

SEQ ID NO: 9127 - DNA, 273 bp, Pseudomonas aeruginosa
cggcggtactcggcatgcttgtcgcgggcctcggccgcggtggctgcgacgatcacgttgatgcccatgaagatcctgatgtcctcggcgcgacggccggcgccgaccaccgccgcgcggatgcgctgcaccaactggcgggtggcctcgcgggtctgtccggagacgaacacgcattcggcgtggcgcgcggcgaaggccaggccacgctccgaggagccggcctggaacagcaccggggtgcgctgtggagagggctcggcgaggtggtag

SEQ ID NO: 9128 - DNA, 921 bp, Pseudomonas aeruginosa
ggtagtagtcgccgaccgcgtggtacttccagcgcaccgggtcgtgcagggtgtgtacgcgggcgttgcgccagtggcggtcgagaccgagttcggcgagacaggcgcggctgccgccaagctcgatcagcttgctgccggccagcagggcgacctcggtggtcagcgcgcgggcttcggcgacggcgatcgaggcggccgccacgctttccgcgtccggctcggcggtggcccggtcgagcacccgcccggcacgctccagcagcgcttcggcggcgtgcaggcggatcgccaggcggccgatctcatggatggtcagtgggtcgtcgctggccttgtcgacgccggagtcgacccagggccgggcgcgctcgcggacgaaacgcagggtgtcctcgaaggcgccgcgggcgatcccggcgtcgatcgccgcgtggaggatctgtgccagcgggccgacggtggtcgggcgctcgaaggcgtcctggaacgagaccacgtcctcggcggccaccgctacccggtcgaacagcgccgaaccgctgccggtggtgcgttgaccgaagccggaccagtcgtcgacgatttccagcccggcgctgtcgcgcgggacgaaggccagttgctggcggccctcgtcgtccaccgccagggtcggcacccgctgcgcgtagagtgcgccggtgcagtagaacttgcgcccgtccaggcggtagccgtcgccgtcggcgcgcaggcgggtacggcgctcgctggcggtacgcgtgccgatctcggccagggcgttgccgaaacgctcgccggccagggcggcgccgaacaggcgacctttctgcgccggcgagccgttcacccgcagcacttcgagggcgtagaaatggttctgcggaatctgccccagggaactgtcggcggcgctga

SEQ ID NO: 9129 - DNA, 2133 bp, Pseudomonas aeruginosa
ccgtcgccgtcgcgacggacccgcgccttcagctccagggtgtggcgggtattgcgctccgggccggcgttggccagccggcggccgtcgaggatgccacggaacagcttgcgtttctgcgccgggctggcgacgttgtcgatcacgctgagcaggccgaactggttctgcggaatctgtccgagggccgggtcggcggcacagatgacacggaacacctcggccagggtcacatgggaaacctgcgcgccgccatgggcgcggggaatgccgatgccgcccaggccgaggcgggtgaagagttccagttcctgccagggcaggcgtcgttcgcggtcgcgtagcgccgcttcgcgacgggccagtccggctacctcgtgggcggcctgcaacgcctgggcgtcgttctcgatgaggcgtgccgggagtagccggggcgcctggtcacgaagatccttgggtgcggtttcgtcggtcatggttcagccttgcagcgtggtggttccgccagcggcatcggtgtggcgcggcttgcgggttctgtggtgcgggtggaacgcctggaggagggaggggaaacaggcggtaacgacatgctcgctgggcacctctggcagttcggataggtggccggcgcgatcgccaagcctctgccgggtctgtttgcacaagccgtgccgtttgctaatccatagaaaaatcaaagagttggaggttttctccaacagtttctgctggtccgcgggcgctgcctgttgctccgctgttgccagggcaacagttaccggcggattacagccggatgccgcgcgccggcgccgtgctgctagggtgatagggtttcgcgcgcggcggcctggcgcgcgtccacccactcggatcgtcgaaggaactcccatgcagagcgctaacgcttcagaactcaccaccgacatcgccgtgatcggcggcggcgcggccggcatcggcgtgatcgccagcctgctgaaacgttcgccggggttgcgtatcagcctgatcgagccggcggacacccactactaccaaccgggctggaccctggtcggtggcggcgcctacgcacagggcgacaccgcgcggccgatggccgggctggtcccgcccggcgtggagtggttgcgcacccgcgtcgagcgggtcgaccccgaggcgcgccgactgttgctggagggcggcgacagcctggaataccgcaacctgatcgtctgccccggcctgcgcctggcctgggagcgcatcgagggcctggaggagaccctggggcgcaacggcgtcacctccaactaccgctacgacctggcgccctacacctgggagctggtgcgcggcctgcgcggcggcaaggcgctgttcacccagccggcgatgccgatcaagtgcgccggggcgccgcagaaggccatgtacctgtcctgcgaccactggctgcgggagggcgtgctgcaggacatcgaggtcgagttcgacctggccggcgcggcgttgttcggtgtcgccgatttcgttccgccgctgatggagtacgtgcgcaagtattcggccgagctggcgttcaattccaacctggtgaaggtcgacggcgcggcgcgcaaggcctggttcgaggtgaaggacgccgacggcaacaccaatctggcggaaaaggacttcgacctgctgcacgtggtgccgccgcagctgccgccgacctttgtcgccgccagcggcctgggcgacgcggccggctggtgcgaagtcgacccggcgaccctgcaacatgtccgccatggcgagatcttcgccctcggcgatgtctgcggcaccgccaacgcgaagaccgcggcggcggcgcgcaagcagatcgtggtggtggccgagaaccttctcggcctgcgcagcggccgtggcctgccgctgcgctacgacggctacggcggttgtccgctgaccgtcgagcgcggccgggtggtgctggcggagttcggctatgccggcaagctgctgccgaccttcccgctggagcccaccgcggccagccgcttcgcctggctgctcaagcgccacgtactgccctgggtgtactggaacgccatgctcaagggccgggagtggctggcgcggccggggcgctag

SEQ ID NO: 9130 - DNA, 453 bp, Pseudomonas aeruginosa
cccggcgcgagcaccagtcccaggcgttccagcgagccggccgggccgccgagggcttccagcagctcgcggttttccgccgcgctctcggtgtcgcaccagagcttggccgggcgcagcgcccggccctcggcgtcgagcaggagcagcccatgctgctgggcggaaaccgccagggcgcggacctcgcggccgtccaccgcggcttcttccagggccatgcgtaccgcgctggccatggcttccagccagtccgccggatcctgctcgcggcgtccgtcacggccttccggcgggcgctgcgcggcgctgcccaggcccagcgtgcggccgctgccggcgtcgagcagcagcgccttgctaccctgggtgccgcaatcgatgccgaggaacaatccgtgcatgcggccctccggcgtcattcgccgagtacctggcgcagggtttcgctga

SEQ ID NO: 9131 - DNA, 423 bp, Pseudomonas aeruginosa
gtctggaagaccatcgccaggtcgcgtttcgccggcggggtgtcggtgatgtccgtgccgtcgagggcgatgctgccgccgctggcctcttcgaggccggcgatcaggcgcagcagggtcgacttgccgcagccggaggggccgacgaagactacgaactcgcggtcgcggacgtcgaggtcgatgcccttgatgatggcctggccgtcgaagcctttctgcaggttgcggatcttgagatcagccatggcggaatacctccgtggacgaaaggatggggatgcgcttcatttcacggcgccgaaggaaaggccgcgtaccagctgcttctggctgatccagccgaagaccaggatcggcgcgcaggcgagggtggagacggccgagagcttggcccagaacagtccttcggggctggaatag

SEQ ID NO: 9132 - DNA, 2511 bp, Pseudomonas aeruginosa
ttctccagggtcggctggaagatgaactgcggcggcgtggcgaaggcgtcgatctcgctcttgaagctggtcagcagcatccagaagatcgggaagaacagcagcagggcgatgccccagcagagcaggccgagcagggcattgcgcaggcggcgggattgcttgagtgtcagcatggcgggttcctcagctgcgctcggtaaggttcttgccgatcatccgcaccagcacgatggcggcgatattggcgatcagcaccgcgatcaggcccccggccgaggccatgccgacatcgaactgcagcagcgcctggttgtagatcaggtaggcgaggttggtcgattcgtagccggggccgccgctggtggtggtgaagatctcggcgaacaccgagagcaggaagatcgtctcgatcatcagcaccaccgcgatgggccgcgccaggtgcggcagggtcaggtgccagaagatcgccagcggaccggcgccgtcgaggcgggcagcctccttctgctcctggtcgagggactgcatggcggtcatcaggatcaggatggcgaagggcagccattgccaggagacgatgaggatgatcgacagcagcggatagtgcgccagccaatccaccggctcggcgccgaacaggcgccagacggcggcgaggatgcccgagaccgggtggaagatcaggttcttccagagcagcgcgctcaccgtcggcatgatgaagaacggcgagatcagcaacacccgcaccgcgccgcggccgaagaattcgccggcctccagcagcgcggcgatgagcacgccgaacgccacgctgatcgccagcacgctgcccaccagcagcagggtgttcagcgcgccgggcaggaagccggcgtcggtgacgaagaaggtgaagttctccaggccgacgaaggcattctcgccgggatacagcaggttgtagcggatcagcgagaaatacagggtcatgcccaggggcacgatcatccacaacagcagcagcgccaccgaggggctgaccaggagccagccagggccgcgccggcggcgctggagacggcggcgggcgggacgggccgggagcggggtatcgagggccgaggtgttcatggcgactccgtctggatcttcaaggacaagcgctcgagcagcgccgcgccgggcgcggctgcgcccggcggcggactacttcggatagccggcgcgcttcatctcgcgggcggtgctctgctgcgcggcggcgagcgcctggtcgctgctcatctgcccggtgagggcggcggagaacagcttgccgacctgggtgccgatggcctggaactcggggatggtgaccaactggatgccgacatagggcaccggcttcagcgtcggatggttgggatcgacgcgcttcagcgattccagggtgacccgcgcgaacggcgcggcggccaggtaggcctcgctgtaggtcgaggcgcgggtgccgggcggcacgttggccacgccttccctgtccgccaccagcttgccgtacgcctgcgaggtggcccaggtggcgaaggccttcgccacgtccttggcgcgcgagctggcgggaatcgccagggcccaggaatacagccaggaggcgcccttgtcggtgacttcccggggggcgaaggcgaagccggtggcgtcggcgaccttgctctggctcttgtcggtgacgaacgaaccggcgacgctggcgtccacccagatcgcgcacttgccgctgttgaacagcgccaggttctcgttgaatccgttgctggaggcgccgggcgggccgtaccgcttgagggtggagacatagaagtcgagagccttcttccattcgccgccgctgaattcgggctgccatcgctcgtcgaaccagcgtgcgccgaaggcgttggccagggtgccgatcaacgccatgttctcgccccagccggccttgccgcgcaggcagatgccgtactggccctggtccgggcggttgagcctggcggcgaattcgccgagctgggtccaggtcggttgctcgggcatccgcagcccggcctgctggaacaggtccttgcggtagtaggtgatcgaggcttcggcgtagaacggcagggcgtacagcgtgcccttgacggagagaccgtcgcgcaccgagggcaacaggtcgtccagggcgtagtcggcgggcagcccgctcatcggctccagccagcccttggcgccccacagcgcggcttcgtacatgccgatggtgagcaggtcgagctgtccgccctgggtggcgatgtcggtggtcaggcgctggcgcaggacgttctcttcgagcaccacccatttcagcgcgatgtccgggtggctttcctcgaacaccttggacaggcgttgcatgcggatcatgtcgttgttgttgaccgtggcgatggtcagggtctcggcgccctgggccagcaggggcagggcaaggcaggcggcggccaggcaggccttgatcgagtcgttcatcggtga

SEQ ID NO: 9133 - DNA, 915 bp, Pseudomonas aeruginosa
aaaatgcatatcgatctccgccagctccgccacttcatcgcccttcacgagcaccgcagcttcgtcgccgcggcgctggcggttaacctttcgcaatcggccttcagccgcagcatccaggcgctcgaacacagcgctggctgccgcctggtggaccgcgcggccaaggacctgcgtccgaccaagcagggcctgatcgtcctcgaacatgcgcgccggctggtcagcggcgcgcacaacctggccaacgagatcgccctgttcaacggcctggaggccggcgaactgcgcttcggcgccggaccggctcccgccacctggctggtgccgcgtgcggtagggcgcttcaacgtgcgttatccgaaggcgcgggtgagtttccaggtcgaacactggcaggcgctgaaccgccgcctgcaggccgaggagttcgagttcttcgtcgccgacacccggcatttcgaggccgacccgcaataccggacctcgcgcctgcgtccccggcgctggcatttctgctgccgcgaggggcatccgctggccgctcgcgagagcgtttccgccgaggagctgttgagcttcccgctggcgaccaacatcagcccgccgaacatccgcaaggtgctggtggacctcagcgggcgtcccgacttccgcccggccatcgagtgcgagaacggccatagcctgctcggcgtggttctcgcctcggatgccatcggcatcagcagcggcctcggcgacctggcgccgccgggacagggaggcctgcgtccgctgcgggtgcgcgagctgcccgacgacctcgacgaactgcatacccgctacggcatcgtcagccgcgccggctacagcctgtcgccgctggcggaggcgatgatcgacgaactgaagcgggtcgacgacgccacctga

SEQ ID NO: 9134 - DNA, 1644 bp, Pseudomonas aeruginosa
agcgtcgtttccttttcgcgagccgtcatgagccagcccaagccgatccgcaacgtcctctacatcatgtgcgaccaactgcgtcgcgattacctgtcctgctacggccatccctatctgcacacgccgaacatcgaccgcctggccgcggagggcgtgcgcttcgcccgtgcctatacccagggcaccatctgcgggccgtcgcggatgtcctcgtacaccgggcgctacgtcagcagccaccaggtggcctggaacgcggtgccgctgccgctggaggagctgaccctgggcgactacctgcgcgccgcgggagtccgcaccgcgctggtcggcaagacccacgccacggccaacctggaaggcatgcggcggctcggcatcgatccggccagcgcgcgcggcgcggccctcgccgaagccggcttcgagccctacgaccgcaatgacggggtctacccggatgacccggccttcgccgacaagcgcgaaagcgcgccctacacccactacctgcggcgcctcggcttcaccggcgacaacccctggcacgactgggccaactccgccgccagcgccgacggggaaatcctcagcggctggcggatgcgccatgccggattgccgacacgcttgccggaggcgcacagcgagaccgcctataccacccgtcgcgccatggatttcatcgacgagcagggcgagcgtccctggtgcctgcacctgtcctacatcaagccgcactggccctacatcgcgccggcgccgtaccacgcgctgtaccgcgccgaccaggtgctcccggcgctacgcgcggcgcccggcgaagaaagcgaccacccggtgtaccgcgccttccgcgaacatcgcgagagcctcaatttctcccgcgaagacgtgcgccggcaggtgatacctacctacatggggctgatccgccaggtcgacgaccagctcggccggctcttccagcacatgcgcgccagcgggcgctgggacgataccctgatcgtcttcaccagtgaccatggcgatttcctcggcgaccacggcctgggcgagaaggagttcctcctcgagtcggcggtgggcgtgccgttgctgatccgcgatccgcgccccgaggcggacgccacccgcggccgggtggaggaggcgctggtgcagtccatcgacgtactgccgagcatcctcgaagccttcgccgtcgagcccgccagccatcgcatcgagggccgttcgctgctgcccttcgtccatggcgcgccgccggcggactggcgccgctacgccatcgccgagtacgactacgccttccaggcgccggcgcgggagcgcctgggccgacccatcgatgcctgccgcatgtacatggtgcgcagcgagcgctggaagtacatcgcctacgacggcttccgcgcccaactgttcgaccttgccagcgaccccggcgaattgcgcgacctcggcgccgacccggcgcatgcggcggtgcgcgaggcccatgccgggatgctgttcgactggctgcgcgggctgaagcggcggactaccatcagcaacgcggagatcgacctgcgcggccaggcgttccgctacggcgagccggaaggcgggcgcctggtaccgatcggtctctggtga

SEQ ID NO: 9135 - DNA, 1212 bp, Pseudomonas aeruginosa
gcctggcgacgctctgcaacttcgccaacgtgttcgcccgcacgccgctcaatgccgagctggagcaatatcgctggaccaacccgcaggcctgagcctgcgcttgccgggcggcatgccgcgccggcgcaaggagtgacgaccatgcttgacccgaccctgagcgactggctcgaccgccaggccgacgccctcgaccgcggcgacgccgatcccgccgcgctgctgccgcgcctggccgccgccggcgtgctcggcgtggcggtggaggaacgcctcggcggcgccggcggcacgctcgccgacgcggtggagcgggtggccgcagtggcggcgcgctcgctgaccgcggcgttcgtcttctggggccagcgcgccttcatcgagtacctgttgcagagtcccaaccaggaactgcgccaacgcctgctcggcgacctgctggccggccgcctggccggcgccactgggctgtccaacgcgatgaagttcctctccgggatcgaggcgctgcaggtggtggcgcacgcggaggaggccggctggcgcctggacggtcgcctgccgtgggtgaccaacctgcgcagcggcgatttcgtggtggcggcggcgatcgaacacggggagggcggcaagcccttcgtcctggcgattcccgaaggactcgccggcttgcagcgctcggcggacctgcgcctgctcggcctgcaatgcagcaacaccgccgccctcgatctgcgcgcggtggcggtcgggcgcgactggctgttgcacgacgacgcccggcagttcctgccacgggtgcgcccggccttcctcggcctgcaatgcggcatggccatcggcctggcgcgccgcgcactggacgaagtgcagcggcacctgggcggcagccgttcgctcctggatggcgagctggcggcacagcgcgaaaccctcgacggacacgtggcggcgctgcacgccggactggccagcggcgagttcgccagccagccggcacgcctgttccgcatccgcatcgggctcgccgaagccgccgccaatgccgtgcaactggagttgcaggccagcggcggcaaggcatacctgagcgagcacggcgccggtttcgcccgccgctggcgcgagtcggcgttcgtcccgatcgttacgccgagcctggtgcaactgcgcgccgaactgcaacgccaggccgaggccaaggcatga

SEQ ID NO: 9136 - DNA, 1260 bp, Pseudomonas aeruginosa
aaaccctacggcgggcgagccgcacccatgcccatcccatcgctcagccggaggcctcccatgtgcctggacgacccgacccattcccgacgtgacatcctcaagctcgccgcgctgctcagcgctgccggcgcgttgccgctgctgagcagcctgcaggcgcgtgccgccgccgaacccgacgcgccggtgcgcatcggctacctgccgatcaccgacgccacgcccttgctggtggcccatgccaacggcctgttcgaggccgagggcatccaggccgaacggccggtgctgttgcgtagctgggcgcaggtgatcgaggcgttcatctccggccaggtcaacgtcatccacctgctgtcgccgatgaccgtctgggcccgctacggcagcaaggtgccggccaaggtggtggcctggaaccacgtcggcggctcggggctcacggtggctccggagatcgccgacgtgcgccagctcggcggcaagagcgtggcgatcccgttctggtactcgatccacaacgtggtgttgcagcaactgctgcgcgacaacggcctgcgcgcggtgagccgtgcggtgggcgcggcgctggccgccgacgaggtcaacctggtggtgctgccgccttcggacatgccaccggcgctggccagcaagcgcatccacggctacatcgtcgccgagccgttcaacgccctggcggagaacctcaaggtcggccgggtacagcgcttcaccggcgatgtctggcgcaaccacgcctgctgcgtggtgttcatgcacgaacacgacctggagcggcggccgcagtggtcgcaaaaggtggtcaacgccatcgtcaaggcccagctatggactcgcgagcaccgcgccgaggccgcacagttgctgtccaaggccggagccaaccgctacacgccgcacgcaccggaggtcctcggccgggtgctggcgccgggcgccgaggagcagcaggcctatctcgccagcggcgcgatccgccacgccgactggcaggagcgacgcatcgacttccagccctatccctatccgagctataccgaggaactggtgcggcggctgaaggacaccctgatcgaaggcaataatgccttcctcgccagcctcgatccgcgccaggtggccagtgacctggtggacgaccgcttcgtccgccaggccctggcagaggtcggcgggttgcaggcgttcggcctcgccgagggcttccagcgcagcgaggagatcagcccgtga

SEQ ID NO: 9137 - DNA, 528 bp, Pseudomonas aeruginosa
cctcctacctggaaagcggcgcgcgcaacctcggtcagcaggcccagctcgaccacgaccgccgctacgactatgccgacgaatacctacaggtgctctacaaactcttcgaaggcagttgggaggacggcgcggtgctccgcgaccgtcgccgaaggatcttcagcgacccgggcaagattcacgagatccgccatgtcggcgagcacttccaggtacccggcatccatctctgcgaaccgtcgccgcagcgcacgccggtgctctaccaggccggcgcgtcgagtcgtggcaagcgcttcgccgccgagcacgccgagtgcgtgttcgtcgccgcgccatcgaagaccgtgctcaagcaggcggtcgccgacatccgccagcgcgtcgccgaggccggccgcgatccgcgcaaggtactggtgttcaacctgcagacggtggtgctgggcgaaaccgacgccaaggccagggccaagttcgacgaataccgcgccttcgtcagctacgaaggggccctggcgctga

SEQ ID NO: 9138 - DNA, 663 bp, Pseudomonas aeruginosa
tctccggctggaccgggatcgacttcggccagtatcggccggaccaggtgctgcggcacatccacaccaatgcgatccaatcggcggtggaagcgttttccagcgccgatccgacgcgcacctggacggtccgcgagctggccgactgggtcggtatcggcggcttcggaccgctgttcgtcggcagcccggcgaccgtcgccgacctgttgcaggagtgggtggaggacaccgacgtggatggcttcaacctggcctatgcgctggcccacgaaaccttcagcgacgtggtcgaattgctggtgccggagttgcagaagcgcggggtgtacaagaccgaatatgcgccgggaaccctgcgcgagaagttgttcggcgacggcccgcggctgccggattcccatccggcggccggctatcgcgacctgcgggccctctgggagaaggaggccgggcgcaacgcgctgccggcctgacctgggcggacggcggatgacgccagtggcgatatccgccccagggcccgggacggctcctagagccaggcgtgccgcggtggcttcaccccattcaactggtagttgccgatggcatggtatttccagcgcaccgggtcatgcagggtgtgggtgcgggcgttgcgccagtggcggtcgagattga

SEQ ID NO: 9139 - DNA, 1503 bp, Pseudomonas aeruginosa
gccgctctgcgagaaggcttccagttcggccaccggcagccggcgctggcggtcgcgcagcgaggcttcctcggcgaacagcccggccagttcgcgggcgacgcggatcgcctcggcgtcgtcggcgatgcgccgggccggggtccgtggcagcggttgccgatagggatcggcggcgttcttttccagtgcgctcatggcaactccttgcgatgggatgggcgaggttcagcgggacgccgtggccggaccgctgccgatctgccagacgtagggcggctcgctgccgttgatctcccagtcgccgacgatccgttgcttgtagatcaggggattgtgcgaggcggcggtgcgcgcattgcgccagtggcggtcgagctgcttgccgcggccgacggcggaagcgccgctggcgtcgaacagctcgctggtggcctgcaacaccagttcggcgacgatcgcctgggccttggccgattcgatctcggcggcgatattggcctccttctccgcctgcgggtcgcctacgaagcgcgccaggtaggcgcgctgggccgcttcggcggcgcgcagggtggccgcctcggcggcgtagacgcgcgcggcgatgcgcccgaccacctgctgcacctggggatcctggctgactcgcggggcattgccgtggctgtagatacgggtccgcccgcgcacctcggcggcgacgtcgcgcaaggcggcgcggccggtgccggccagcaccgcgagcaggaccaactggtagaacgcggtctggtacttgaagcggctggcgaagtcgatgaggttctcttcctccacctcggcatcctcgaacagcgacgtgccgctgccggtggtgcgctggccgaagccgtcccagtcgtcgctctggcgcacgccgggctggtcggtgcggatcgccgcgatcacatcggcgccggtgtcgtcgcgctgggcatacagatcgatccagtcggagaagaggctgccggtgctgtagtacttactgccgttcaccacccagcgaccgtcgtccttgcgcgagacgcgggtgagcacttcgcccagccgtaccgaaccgacctcggtccaggcgcagccgaccaggtcgccctcgacgaagcgccgcagccaacggtcgcggccagggccgggctcggcattgagacggtcctcgacgaaggcgaagtggccgcgcagggcctgggtgatgttggagtcggcctcggccagttcgatcagcaactgaaccaactgcggcagcgaggcgccggcgccgccgtgctcgcgcggcacgcgcacggcgccgaagccggcctgcttgagccaggcgatcgcctcgtggggcagttcgcgttgccgttcgcgctcgacggcgccttcggcgatgcgcgcgaagatcggtcggaaacgctgggcgagcagttcgtagtcggcgccttcggagagactggtggcggtggcttcgggatggacgcgggcgttcatgcggactcctggtag

SEQ ID NO: 9140 - DNA, 1437 bp, Pseudomonas aeruginosa
cgctggcggatatcgaagtcgcgcggccagcgcgaggcttcgtggtcggggcgttgcattggttcggtcatggctgaactccggtcgggctggtgctcagagcaccagcgacagcaacaggatgaagaccaggccgaccacggagaggatggtctccatcgcggtccaggtcttgaaagtctcgctgacgctcatgttgaagtactgcttgaccagccagaacccggcgtcgttgacatgggagaggatcagcgagccggcgccggtggcgagcaccagcaactcgcggttgacgccgggaatcaggtcgatcaccggcaccacgatgccggccccggtgatggtggcgacggtggccgagccggtggcgatgcggatcaccgcggccaccagccaggccagcaggatcggcgagatctgcgcgttcaccgcgagatggccgatgacgtcgccgaccccgctggccaccagcatctgcttgaagccgccgccggcgccgatgatcatcacgatggcggcggccggtgccaggctctggtccagcagcctgaggatcttctccagttcaaacccacgggcgtacccgaaggtatagagcgccaccagcagggccaggagcagggcgctgatcggatggccgatcatgtccatccaggcgcggaacgcgtggccatcggggaaggcgacgtcggcgaaggtcttcagcagcatcaggaacaccggcagcagcacggtcgccagggtcacgccgaagctgggcaggtcctgggtctcgggctcgtgggcgatctgctcgaccagttccgccgatggcgtgccgggtatgtagcgcgagaccagcgcgccgaacagcgggccggcgatggcggcggtgggcagggcgacgatcaggccgtagaggatggtcttgccgatgtcggcgccgaacacgccgatcgccagcagcgggccgggatgcggcggcaccagaccgtgcaccgcggaaaggccggcgagcaacgggatgccgatcttgatcagggacacgccgctgcgccgggcgacgatgaataccagcgggatcagcaggatgaagccgatctcgaagaacagcgggatgcccaccaggaacgcggcgagcatcatcgaccagtgcacccgctccttgccgaaggcgcggatcagggtgcgggcgatctggtcggcgccgccggaatcggccatcagcttgccgagcatggtgcccagggcgaggatcacgccgacgaagccgagcacgccgccgaagccgtcctgaaaggatttgacgatcttctccaccggcatccccgaggtcaggccgaggaagccggcggcgatgatcagggcgatgaagggatgcaccttgaagcgggtgatcagcacgatcaggccgatgatggtcaccagggcgtcgaggagcaggtaggcatcgtgtga

SEQ ID NO: 9141 - DNA, 648 bp, Pseudomonas aeruginosa
catgccgaacatggagggctctccttttgtcgttgttctaccggagttgctgtttcattgaagcgctttttcggggtagcgctatctttgtcggacaagcgaaagaattcaggcggcggtgtgctccagccaccaggcgtgggcggcctgcgccaggcattccaccggcagggtggcgtccaggcgcagggtcaggggttcgtcgagcggcggctcgagggcggcgaactggctgtcgatcagggtcgccggcatgaagtggccggggcgctgggcgacgcgctcggcggcgaccgccggggtcagttccaggtagacgatgccgaggccgggcaccgcgcggcgcaaccggtcgcggtaggcgcgcttgagggcggaacaggtcagtaccggcagcttgccggcggccaccgcctggcgcagctgctcggcgagggtgtccagccagccggcgcggtcgtcgtcggtgaggggaatgccggcgctcatcttgcggatgttggcggcgggatggaagctgtcgccttcgatgccgtgggcgccgctgcgctggcaaagggcctggctgacgctggacttgccgcaaccggcgacacccatgatgaccagggcttggaggggtggatgcatggaacacctcaagcgtga

SEQ ID NO: 9142 - DNA, 558 bp, Pseudomonas aeruginosa
tggacctggactccggctccgggctcaattgcgtcggcttctcccagttgcgcgccggcgaggccgccgccgagcacctgcctggcacgcggccgcaggcgcctggcctacatcggcgcccagctcgaccagcgcaccctgctgcgcggcgaggggttccgccgcgccttgcaaaaggccggctgctacgacccggggctggaaatccttacgccgcggccgtcctcggtggccctcggcggcgaactcttcgtgcagttgctggccagccagccgcaggtcgacggggtgttcttctgcaacgacgacctggcccagggcgcgctgctggaggccctgcgccgtggggtcaaggtgccggaacagatcgccgtgctcggtttcaacgacctgccgggttcggactgcacggtcccgcgcctgagcagcatccgcaccccgcgcgaagccatcggccggcgcgcggcggagcagttgctggcgctgatcgccggcaaggaggtgcgcgatagcgcgctggacatggggttcgagctgatggcgcgggagagcacctga

SEQ ID NO: 9143 - DNA, 801 bp, Pseudomonas aeruginosa
gtattgatggtggtgcggtgcagctcgggttcgagccggttgaggaagctgtcgcatgcccaagagcatcttgttcgcggtgaccgagcccttggccgtgcgcacgcggatgcgctcgccgtattgcacctccagcgccgggctgtattcgaatatccgtgcgccgaggccggccagcgccttggcttcgccgagcagcaggttgagcgagtgcacatggccgccgcccatgtgcagcagggcgctgccgtaggcgtccgagccgatgatctgacgcacctcggcaccgtgcaggtaacggatctcatggggcgagccgagcgaccggaattccttttcccaggccagcagggtcttcgcctggcgtgcgttgaagcccatgtagccgtagccgtggcagaagtcggcgtcgatggcgtacttctcgatacggcccttgatgatgtcggcgccgaggtcgctgatctcgaagatcgcccgcaggccgtcctcgccgacgtccttgcggatcttctccaggtcgtggccgatgccggccatgatctgcccgccgttgcgcccggtaccgccgaagccgaggtggcgggcctccagcacgacgatgtcggtgatgccgtgctcggccagctcaagcgcggtgttgatcccggagaagccgccgccgatcaccaccacgtcggcgtccaggtcggtttccagggaggggaaggacaattcgtacttcttggtcgccgtgtagtaggtcggcgtctcgatgttgatcatggatgcggcctggcaaggggtggatgtacctattag

SEQ ID NO: 9144 - DNA, 2154 bp, Pseudomonas aeruginosa
gccgatcgccgactggttgccggcgttccgtccgcgcctggccgacggccgcgaggcgcgcatcacgccgcggcagttgctgagccacagcgccggcctcggctatcgcttcctcgaagccgacgcagacggcccctatgcccgcgccgggatttccgatggcatggacctgccgggtttcgacctggccgagaatctccgtcgcctggcctccgtgcccttgctctacgaacccggccgcgcctggggctattcgctggccaccgacgtgctcggcgcgctggtggagcgggtcgacgggcggccgctggcggaagcgctgcggcagcgggtcgggattccagccggcatgcgcgacagcggcttcctctgcgccgacgcgtgccgactggcggcggtctacgtcagcgaccggccacgcccgcgccgaatggccgggcgggagaccgtggcgccgttcgaggacagcgtcggcattcgcttcgagccgagtcgggccttcgaaccgtctgcctatgcgtccggcggggcggggatgatcggcagcgccggcgacgtgctgcgccttttggaaatccttcgccagggcggcgcgccgttgctgacgcctggcctggcggaggagatgggccgcgaccaggtacccggcctggaactgccggccaatcccggtttcggcttcggcctgggtttctccgtgctgcgcgacccggctatcgcgcaatcgccggaggctcccggcacctggcgctggggcggcgcctacgggcattcctggttcgtcgaccgggcccgcgaactgtcggtggtggcgcttaccaacaccctgttcgagggcatgtcgggacgcttcgtcaacgacctgcgcgacgccgtctaccgttccgcggagctgcgctgatgggacgccgcgaagcatttccggagaacgccggggccgctgcgtcggccgtggcgccgcggctgccgctgagtgcgctgctggcgatggcgatgtccggcttcgtcgccattctcagcgaaaccctgccggccggcctgctgccgcaaatcggcgcggggctggcggtcagcgaggcgctggccgggcaactggtcagcgtctacgccttgggttcgctactggccgcgctgccggcggcgagcctgacccagggctggcggcggcgccgggtgctgctgctggcgctgctgatcttcttcgtctgcaacagcctaaccgccgtttcctcggattaccgcctgaccctgctggcgcgcttcggcagcggcgtcgccgccggcctcgcctggggcctgctggccggctacgcgcggcgcctggtgccgccggagcagcaggggcgggcgctggcggtggccatgctcggtgcgccgctggcgctgtcgctcggcgttccgctgggcacctggctgggcggcctgctcggctggcgctgggccttcggcctgttgtcgctgaccgcgctgctgctggtcggctgggtgctgcgcagcgtgccggacttccctggccagccggccgggcggcgcctgcgcctgctcggggtgctgcgcacgccgggcgtgcgtccggtattgctggtgatcgtcgcctgggtgctggcgcacaacatcctctacacctatatcgcgccgttcctcgccaaggtcggcctgggcgcctcggtggacctggccctgctggtattcggcagcgccgcggtggcgggaatctggctggtcggcgtgctggtcgaccggcacctgcggcggatggtcctggccagcctggcgctgttcgccgtggcggcgctggcgctgtgcctgggcgctcgctggagctggctggcgttcgccggcctggccctctgggggctgacgttcggtggcgcggcgacgctgctgcagaccgcctcggcggacgccgccggggagggcgccgacctggcccagtcgatgatcgtggtggcctggaacctggccatcgccggcggcggagcgttgggtggcatggtgttgcagcgctggggcagcgagatgctgccctggaccctgctaccgctgatcggcttggccgccgtgctggtctggggcaatgccgcgcacgctttccgcgtcggcccgcgcgacttccgcagggcatcgtccgagcaccggaaagcggcgcaatag

SEQ ID NO: 9145 - DNA, 1020 bp, Pseudomonas aeruginosa
accgcattccccgttttcacccgcctggtcgccgcgctcggcctgggcctgagcttcgccaccacggtgctggccagccggccggcgcaggccgagggcgagatccgcatcgccgagcagttcggcatcgtctacctgctgctcaacgtggtccgcgaccagcgcctgatcgaaaagcacggccaggccgagggcctgcaaatcaaggtcgactggacccaactgtccggcggcgcggcggtcaacgatgcgctgctgtccggggcgatcgatatcgccggtgccggcgtcggtccgctgctgaccatctgggaccgtacccgcgggcgccagaacgtcaaggcggtggcttcgctgggcaacttcccctactacctgctgagcaacgacccgcgggtcaggagcatcgccgacttcggcgccggggatcgcatcgccgtgccggcggtgggggtttcggtgcagtcgcgcttcctccagtacgccgcggcgaagcagtggggcgacaagcagttcgaccgcctcgacaagtacaccgtggcgctgccgcatccggacgccaccgccgcgctggtggccggcggcaccgagctgaccgggcatttctccaacccgccgttccaggaccaggcgctggccaacccgaaggtccacgtggtgctcgacagctacgagctgctggggccgaattcgccgaccgtgctgttcgccacggagaagttccgccaggacaacccgaagacctaccgggccttcgtcgaggcgctgaaggaagcggcggccttcgcccagaacgacaaggcggccgccgccgatacctatatccgggtgaccggggcgaagatcgaccgagccgcgctgctgaagatcatcgccaatccgcaggtggagttcagcgtcacgccgaagaacacctatccgctggcggagtttctctaccgggtcggtgcgatccgcaacaagccggcctcctggcaggactatttcttccaggacggcgcgccgttgcaggggagttga

SEQ ID NO: 9146 - DNA, 750 bp, Pseudomonas aeruginosa
agcgctggggagtgcaacgctagggcggcggacgggtggagtgttacggcaactttctcggcaactgttgcgctggcgcggcggcaaagcggagtaacgtcttgcccgcacccacttcaaaggatggaacgaatgtcgctctccgtggatctgctgctggcgttctccctgttcgccttcgtcacctccgtcacgcccggtccgaacaacaccatgttgctggcctcgggggtcaacttcggtttcgtccgctccatcccgcacatcctcgggatcagttgcggcttcttcatcatggtgatggcggtgggcttcggcctgggcacggtgttcgaggcctatccggtgctgtacaccatcctgcgctacgtcggcgcggcctacctgctgtacctggcctggaagatcgccacgtccggcccggccggcaacgacccggagggacgtggcaagccgttgagctactggggcgcggcggcgttccagtgggtcaacccgaaggcctgggtgatggcggtcggcgccataagcacctatacgccgttgcagggctacttcaccaacgtggtggtgatctcgacggtatttgccctgatcaacgcgccgaccatcggaatctgggccggtttcggcagcatgctgcgcaacgtgctgcgcgatccgcgctggctgagggtgttcaacgtagggatggcgctgctgttggtcgcgtcgctgtacccgatcctcgcggaaagccattcggcctga

SEQ ID NO: 9147 - DNA, 405 bp, Pseudomonas aeruginosa
cgctggaggagggcggcgaccaggcgaacgacctggcgctgcccgcgagcgaggtcggcgccgaccacctcgcctacatcatctacacctccggttccaccggacgccccaagggcgtcgccatcgagcacggcagcgcccatgccttcctgcgctgggccggccagcactatgccgccgaagaatggagcggggtactggcggcgacctcggtgtgcttcgacctgtcggtctacgagctgttcggtaccctggccgaaggcggcacgctgcacctggtggaaaacctgttcagcctgccggactacccgcgccgcgacgagatcagcctgctcaataccgtgccctcggtgtgtgccgcgctgctcgccctcggcgacctgccgggcggggtgcgcacgctga

SEQ ID NO: 9148 - DNA, 525 bp, Pseudomonas aeruginosa
cgctgtggctggaagaccagccgcagggttggctggccgtctggaccggggccagcgcgatcttcgacctgcaccgcatcgagcgcctgcaccaggcctgggagcggcgcctgctggcgaatgccggcgaacctatttcgaaacgcatgtcgccggagggctgcaacgcttcctgacgaccccgagcctcccacggagaacagcgatggaacgaacagctcccagtctcaccggtcgcggcttcgcccggccgcgcaatctcagcccgcgcagcagcgaggcgctggtgcggcgcccggcggcggagcgcgacggcctgccgctgctgatcgaggcacaggctcccggcctgtccctggccgactggattcgcgagcagggccagtccctgcacgacgacctgaacctggctggcggcctgttgctgagaggcttcgaggtcgactcggcagagcgcttccgcgcagccgccgctgccttcgccccgcaactgctcgactacaaggagcgttcctcgccgcgtag

SEQ ID NO: 9149 - DNA, 1470 bp, Pseudomonas aeruginosa
gcaccggatcgcccatgcctggatcggcgacgagcacctgcgcacctggcagaggcgcgcggcgttccaacgccacccgtataccggcgagcgcctgtggttcaaccacggcatgttcttccatgccaccagtctcgagccgggcctgcgcgatgcgctgctgcgcagcgtcgccgaggaagacctgccgtaccagacctactacggcgatggcagcccgatcgaggcgcagaccctggcgaccatccgcagcgccatagaccgcgagacgcggcgcttcgactggcgcgtgggcgacgtgctgatcctcgacaacatgctcgcccagcacggccgcgagccgttccgcgggccgcgacggatcctcaccatcatgtccacgccgtattccagcctggcgcccgccgatgtcccgccgacaccttcgcgcctggcgctcggaggtaccgcatgagcgcctcgttcagcgcgccgcgcctgcgcccccggcagctctcggccggcgacctggtggaggaaagcctgctcgacccggccaacgactacctgcgcatcgtccgcgcgcgccagccgggcatggacctgcggcaatggatcgccgccgccggcgcagggctgcgcgacagcctgctgcggcatggcggcatcctgtttcgtggcttcgcggtagacggagcggagggcttctcccaggcggtacaaagcttttcgccgaacatgctcgactacctggagcgcgcggcggcacgccaggaagtggcgcaccgggtgttcacctccaccgagttctcgccggacggctggattccgccgcaccacgagatgtcctactcgcacaactggccgagctatatccacttctactgccagacaccgcccgccacccagggccgcacgcccctggccgacgagcgccgggtcagcgctcggatacccgaggcgatcaggcagcgcttcctccgccatggggtgtgctacgtgcgcaactacgggccggagatcgacctgacctggcaggaaggcttccagaccgacagtcgcgccgaggtcgaggcctactgccggcagaccggtacccaatggacctggctcgacgaccagcgcctgaatacccgccaggtacgccaggcgatggtgcgccacccgctcagcggcgagacgctgtggttcaaccacgcgcacatgttccatgtctccaacatgccgccggccctggcccgggccttgctcgacgaggtcggcgaacagggcctgccgcgcaacgcctactacggcgacggcagcccgatcgaggcggaggtgctggacaccatccgcgccgcctaccgcgaggaaacccgcgcgttcgcctgggagcgcggcgatgtcctgatgctcgacaacttcatcagcgtccacggccgcgagccgtacaccggcgagcgcaaggtgctggtggcgatgaccgacctgcatgtccaccaaccctga

SEQ ID NO: 9150 - DNA, 1296 bp, Pseudomonas aeruginosa
acccgtgcgagggatagccatgagtgcgtcagaagacctgcaatccgctgtgcaaccggccgcgagcgaagcgctcgaaggattcccgctgtctcccttgcagacccgcgcctggcgccgccatgccgagcggccggaaaatacggttgtcggcgtgcgcctgcacgccccggccgataccgtggcgacgctggagcggctgcgccgggcgctggacggcgaggcgcaactgcgcgtggcctaccggacgatgccgggcatgagcctgccggtgcaggtactggatgggcgcgcggccgatctgctggtcgagcgcctgccgggagatggcgactgggccggacgcttcgcgcgcgaaagcgcgcgtctcgccgcttcgcccctgggcggggaaggccagccggtactggcgctcggcctgctgctggacgccgccggagagacgctccaggggctgttgctggcggcgccggcgttcgtcgtcgatgcggccagcctggtggcgctgctgcgccgcggcctggggccggccggccaggcgagcgcggacgagggagacgaggcgctgctgttccagcatttctccgagtgggccaacgaggcgctggccggcgaagacggcgaaagcgccagcggttactggcgagagcaggcggccgttgcggcggaaagtccgctggcgctggcggacgacctgggcgaaggcgattggacgggcgcggcgcctgctgccgcgcgcgctgctcgaacgcctggccgccaacggcttgccggaggcggccgccctgctggcctggacccaggtcgccgggcagttccagggcgacgagggactccctctggaaatggcgcgactggtctcggggcgcctgttcaacgagttcgccgagctggccggaccgttcgccggggtcgcgccgctgtgcctggagaatgtccgcgcgggcagcgtcggcgagcggctcgacgccctccaggcggcgatcctcgcccaggaggaggcagcggccctgcgcgatccctttgcccccgactggccgctcgccgagttgggcttcgcctggctggcgggcgaactggatggcgccggggtggccgagctggattgccgtcagccgccgctgggcgggttcctcgagttgcaggtgctgccccacggcgaaggccggctggccagcctgcgggtccgccgcgaccatgacggaacgctggccgggcgcttgctcgacgcctgggtcgaatgcctggaaagcatcgccgccgacaggcaactgccattggccgggctgccgttga

SEQ ID NO: 9151 - DNA, 4143 bp, Pseudomonas aeruginosa
acgccagcctggcgcgggtcgccgagcatgcgcggccgaccatcggccgcgccctggccaacgtcgatctgcatgtggtcgatggcctcggtcgtcgcaagacccgtggcgccagcggcgaactgtggatcggcggcgccggggtggcgcgcggctatgccggcgacgccggcgaggcgggccgggcgcttcctcgacgagggctggccgggcagcggccgcctgtaccgcagcggcgacctggtgcgctggcgcgccgacggttgcctggagttcctcgggcggatcgacgaacaggtgaagatcaacggctaccgcatcgaactgggcgagatccgcagcgcgctgctggaacacccagcggtgggcgaggcggcggtactcaccgacgaggccgatgcggccgagccgggcgcggatcgccggatcgtcgccttcgtcaccgccgccggggagaccgcggacgagtcctggctggaagtcgacctgcccagcgggcaccgggtcgccggactgaacctcaacgaaaccgagtacgtctaccaggaaatcttcgtcgacgaggtctacagccgcgacggcatcgtcctgccgccggacgcggtggtcctcgacgtcggtgccaacatcggcctgttctcgctgtacatcgccagccgcgcgccgcgcgcgcgagtggtcgccttcgagccgctggcaccgatccgccggcgcctggaggccaacctcggacgctacgcaccgcaggtcgaggtattcggcatcggcctgtccgacgccgagcgcgaagaaaccttcacctactatccgggctactcgaccttctccgggatcgccgagtacgccgacgccagcggcgaacgcgacgtcatccgacgctacctgagcaaccagggcgaggagggcggggccaacctgctgctggacaacatcgacgaaatcctcgacgaccgcctgcgcgccgaagcccaccgctgccgcctgcgccgcctcgaccaggtgatcggcgaactgggcctggagcgtatcgacctgctgaagatcgacgtgcagcgcgcggaaatggatgtgctgctcggtctcgacgatgcggcgctggccaaggtccggcagatcgtcctggaggtccatgacaagcgcgacggtgccaccgccggccgcgccgatgccttgagcgaccttttgcgccgccatggcttcgaggtgagcatccgtcaggacgcgctgctggagggtaccgaccgttacaactgctacgcggtgcgcccgggctatgccgagtcgctggctgagcgcatcgactggcgcgcgctcgcgccgcgccccgccgcggccctcggcggcgagctgagcgagcaggccctgcgtggcttcctcgaggcgcgcctgccggcctacatgctgccgagccggatcgcccgggtcgaacgcctgccgctgaccgccgaaggcaagctcgaccgtcgcgcgctgttggcggcgctggccgccgaggcggccgcgcagaccctggaagcgccggccaatgccaccgaggcggccctgctggagatctggaagagcgtgctgaaacgcccggcgatcggcgtcagcgacaatttcttccaggtcggcggcgactccatccgcctgatccagatgcaggtcatggcgcgcgaggcggggctttcctttaccctgcgcgacgtgttcaaccaccagagcatccgcgaactggcgcgcctgctggccgctccggcgagtccggcggatgcggccgcgagctcggcgccgcagacgctggagccgttcgccctgttgtcggcggcggaacgcaagcgcctgccggaggggctcgacgacgcctatccgatgaccagcctgcaacagggcatgctcctgcaaagcgaggccagcggcgatccacggctgttgcacaacgtcgtcctgcacgaggtgcatggacgcctggacggcgagttgctggcgcgcgcctgggcgatcctgatcggccgccacgcgatcctgcgtaccggcttcgatctgcacggtggccaggttcccctgcaatgggtccacccggccgctgcggtcgccgccgaggtgccggtgcacgacctgtgtggcctcgacggggaaacacggcgcctgcgcctgcgtgcctggatcgaggaagagcaggccaccccgttcgactggagccgcccaccgctggtgcgcctcgccgcgctggcgctggacgagcggcgcttcgccctgggcgtcgccgaacaccatagcgtgctggacggctggagcctgcaaagcctggtggacgagctgctggcggtctacgccgaccttctcgccggtgtcgtcgcgcgggaagcggaagcgcccgcagtaggcttccgcgactacgtggcgctggagcgtgaggccgaggccaacgccgcctcggcgctgttctggctcgactacctggccggcgcccgctaccggccgttgcccggactggcggaggagggaccccggcgcatggcggcggtccgcgtggacgtgccggccgacagcctgtcgcgcttgcgcgccctggccgaacgcagcggcttgcccttgcgttcgttgttgctggcggcgcatggccgagcgttgtgccgcttcagcgatgccgatgaagtagtcaccggcttcgtcagccacgggcgccccgaggagccgggagcggaccgcctgctcggcctgttcctgaacaccctgccgtgccggctgtcggcttccgtcgatctgctcgacagcgcccgtcgcgcattcgactacgagcgcgcgagcctggaacatcggcgccatccgctggcggcgattcgcaggcgcaaccgcgagttgcgcctggacagcctgttcaacttcgtcgacttccaccaggacgacgccgcgccggcggcgggagtaaggcacggcggcatcctcgaccaggtggtggtggacgtcgacgtgccgctggcggtggacttcgaggtggccggcgagcgcctcgaggtgggcttccagtatgccgccggacgtttccccgccgagcgcgccgaggcactggccggcgcctaccgcgaggcgttgctggcgctgctcggagacccggtgcagccgcccgcggcggcccaggccgaggacagcgtggagctgcggcgggtgctcaaggtgttgtcccgggtgctcggccggccgctggcggccgaccagggcttcgccagtgccggcgggcattcgctgctgggcgtgcaggcgatcgccgaattgcgccggctgaccggcaggcaactgagcctggggctgttgcagggcgatccggatgcccgcgaagtggtgcgccgctgccatgccgccgacgcgccgccgttgccgcccgccaccgagcgcgcccgggccctgtggttgcagcgcagcgggagcgcgcagccgcgcctgcgcctgatcgcgctgccgcccgcgggcggcaacgccggcactttccgtggttgggacgcgcgcctgccggcggacgtggagctgctggcgatccagtatccggggcgccaggaacgccaggacgagccattcgtcaccgatgtagaggccatgctctgtgccatcgacgacgcgctcctgccattgctcgaccgtccgttcgccctgatcggcgccagcctcggcggcatgctcgcctacgaactggcggcacgcctggaaagcctgcacggcctgcgcgccaggcagttgttcgtgatcagcagccgcgctccggggccggacctggaatacccgcgcttccatgcgatgggcgacgccgagttgctgcgaaccctgcgcgagtacgacgtgctgccgctggaagtgctcgacgacccggagctgcgcgagatcagcctggccaccctgcgcgccgattcgcgcctggccgccgactatcgctaccgcccgcgcgagccgctggccataccgatcaccgcgatcctcggcgagcaggacccgggcgtctccagggtggccatcgacggctggcggcggcacgccagccgctacgagctggagaccctggccggcggccacggcctggtggtgacggcggcggaggaggtttgcgcgatcctgcggcagcgcctggcgcccgatgtgcctggcggcgtgccggcgaacctggcaacctga

SEQ ID NO: 9152 - DNA, 1728 bp, Pseudomonas aeruginosa
cgccgtcgccccggccgactaccaccgccatctgccggagcaggtcgcgcgcggcctgccttccgccgagctggtggtgttccgcgtcgccgacgagcattccgacaccgcggcgttcagcgcacgctacggctttggcctggaggactgcgccaacaccctggtcctgcgctacaagcgcgacggcgccgaaggctatgccgcggtggtcaacctgggctcgcggcggctcgacgtgaacggcgcggtcaaggcgctgctcggggcccgccggctgtccttcgccgcccgcgaggtcgccaccgagctgaccggcatgcagttcggcggcatcaccgcgttcggcttgcccgaaggcatgccgctgctggtcgacgcggcggtcttcgaacggccgttggtggtgatgggcgccggggtccgcgagaccaagctgctgctgtccccggcactgctgaaagaccttcccggagtggtggtcgccgaactcagcgaagccggttgaacccggcgcggagcatcgccgccgcggctctgccaattgtggtaggtgaagccttccgccgtctctgcaaccatgcccccgccctgatcgcgacaaacgccggaatgccccgtggtagacgctcgcgcctgttttttctaagcgttcgcggcggccacggcgcggttcgtcggacagcccctccggatgcgtttcctaccttcatccgaggagcggtaaatgatcaggatcgacttttcccagttgcaccaggcccgcgaagatgccgcggcggccatgccgagcatcgccggcaagaagattctcatgggcttctggcacaactggccggccggcgccgccgacggctaccagcagggctcgttcgccaacatcgcgctggaagacgtgccgagcgagtacaacgtggtcgccgtggccttcatgaaagggcgcggcatcccgaccttccagccatacaacctgtccgacgcggagtttcgccgccaggtcggcgtgctcaacgcccagggccgcgcggtgctgatttcgctggggggcgccgacgcgcacatcgagttgcacgccgggcaggagcaggcgctggccgccgagatcgtccgtctggtggaaacctacggtttcgacggcctggacatcgacctcgagcagagcgccatcgacctggccgacaaccagcgggtgctgccggcggccctcaagctggtgcgcgagcactacgccgggcagggcaagcacttcatcgtcagcatggccccggagtttccctatctgcacaagaacggcaagtacgtgccttatctgcaggccctggaaggcgtctacgacttcatcgcgccgcagtactacaaccagggcggcgacggcctgtgggtccaggaggcgaacggcggcaagggcgcctggatcgcgcagaacaacgacgcgatgaaagaagacttcctctactacctcaccgagagcctggccaccggcagccgcgacttcgtgcggatcccggcgcagcgcctggccatcggcctgccgagcaacgtcgatgcggcggctaccggctacgtgatcgatcccgccgcggtgagcaacgcgtttcgccgcctggaagccgccggtcacgcgatcaagggcctgatgacctggtcggtgaactgggacgatggcctgaacaagcgcggcgagcgctacaactgggagttccgcaagcgctacgccagcctcatccatga

SEQ ID NO: 9153 - DNA, 909 bp, Pseudomonas aeruginosa
cccatgccgccgacggcgcgccgctggacttcgaatacctctactaccgcggcgacgctttccagtatcgcctgcgcatcgatcggcagaagggagagcgggcatgaacaccctggagcaggaatacgacatcgtggtgatcggcggcggcaccgccgggccgatggcggcgatcaaggccaaggagcacgaccgcgaactgcgcgtgctgctggtggacaaggccaacgtcaagcgcagcggcgccatcagcatgggcatggacgggttgaacaacgccatcgtccccggccacgccacggccgagcagtacacccgggaaatcaccgtggccaacgacggcatcgtcaaccaggcggcggtctacgcctatgccagccacagcttcgagaccctgcggcagctggatcgctggggcgtcaggttcgaaaaggacgagaccggcgactatgcggtgaagaaggtccaccacatgggcgcctatgtgctgccgatgccggaagggcacgacatcaagaaggtgctctaccgccagctcaagcgtgcgcggatccccatcgccaaccgcctggtctgcacccgcctgctcaccgatgccgagggcgcggtgaacggcgtactcggtttcgactgccgcagcggcgacttccatgtgatccgcgccaaggcggtgatcctttgctgcggcgcggcgggccgcctgggcctgccgtcctcgggctacctgatgggtacctacgagaacccgaccaacgccggcgacggctacgccatggcctatcatgccggcgccgagctggccaacctggaatgcttccagatcaacccgctgatcaaggactacaacggcccggcctgtgcctacgtcaccggcccgctgggtggctataccgccaacgccaggggtga

SEQ ID NO: 9154 - DNA, 939 bp, Pseudomonas aeruginosa
gcgcttcatcgaatgcgactactggagcgggcagatgatgtgggagttccaccaggaactcgaaggcggcaatggcccggtgttcctcaagctcgaccacctggcggaggaaaccatccagaccatcgaggacatcctccatggcaacgaacgccccagtcgcgggcagttccacgccgggcgcggcaccgactaccgccagcagatggtcgagatgcacatttccgagatcggcttctgctccggccactcggcctccggcgtgtgggtcaacgagaaggccgagaccagcgtgaagggcctctacgctgccggcgacatggccgcggtgccgcacaactacatgctcggcgccttcacctatggctggttcgccgggcgcaacgccgccgaatacgtcgccgggcgcgccttcagcgcggtcgaccgcgcccaggtcgagcgcgagcgtgcgcggatcgaggcgccgctgctgcgcgagcatggcctgccggcggcgcaggtggagtacaagctgcgccggctggtcaacgactacctgcaaccgcccaaggtgacccgcaagatggaattgggcctgcaacgcatccaggccatcgccgaggacctggagcggatcaaggcggacaacccccacgagctgatgcgcgccctggaagtcagcgttatccgcgattgcgcggagatgcccgcgcgcgcctcgctgttccgcaccgagagccgctggggcctgtaccaccaccgggtggactatccgcggcgcgacgacgctgcctggttctgccacgcgcacctgaagaaggacgagcagggacgcatggccagcttcaggaaaccggtcgaaacctacctgttcgccatcgacgagggcgaacagcaggcctaccagcgcctgcggctgaggaacgacgccgcctagggccccacgccccggcgtag

SEQ ID NO: 9155 - DNA, 1257 bp, Pseudomonas aeruginosa
ttcgaggggaatccccatgcgactgcgtgcaatcctggccagcctggcgctggccctgacttccctgggtgcccaggcggaaaccatccgcgtggccatcggcactcaggacaccaccatcaactgcgccgccggcgggctgctgatccgcgagctgggcctgctggagaaatacctgccgcgcgacggccgctacaaggatgcggactaccgggtggagtggaagaacttcaccagtggcgcaccgctgaccaacgagatggtcgccggcaagctcgacttcggcgccatggccgactttcccggcaccttcaacggcgtggccttcgccgccgccggcaagcgcagcctgttcatcagcgtgctgtccggcagcacccgtggcagcggcaacggcatcgtggtaccgagcggctcgccggtgcagtcgctggccgaactgaaaggccagaccatctccgtaccgttcgcctccactgcccatggcatgctgctgcgcgcggtggcggcgcaaggctgggacccgcagcgcgacgtgaccatcatcgcccagccgccggaaatcgccggttcggccttgcaggcgaacaagattgccgcccatgccgacttcgtacccttcgccgagctgttccccaatcgcggcttcgcccgcaagatctacgacggttcccaggccaacgcgccgaccttccatggcgcgctggtggacgccgcctacgccgagcgctatccggaggtggtggtggcctacctgcgggcgagcatcgaagccaatcgactgctggccgccgaaccggagaaatacagcgagctgatcgagaaggtcaccggcatcgaggccgaggtcaattacctgttccacggtccgctcggcctgcagacccgcgaccaggcctggaaacccgaataccgccaggcgctggcgacctccatcgacaccctgaagctgctgaagaaggccgaccgtgggctggacgtcgagcgtttcgtcgacgaccgctacatccgcgaggcctaccgtcaggccgggctggactaccaggcggcgctggcagactacgcaccgtcgccgctgcgcgccagcgacgcgcgcagcggccggccgatcgaggagttcgaacgggtagcgcagatctgggtgaagggcgaggccagggtgcgccattacgcttcgccggagtcggccctggccgatcttgccgagctgaaggcgcagggcaaggcgattcgtgcgatctacgcccaggatcgtga

SEQ ID NO: 9156 - DNA, 1839 bp, Pseudomonas aeruginosa
cagcgggatcaagctgctggccaaccaggcgtggttcgtccgcgacggcgagggtcgcctcaacgccttcctgctccgcgagcaggcccaggactatgcccgccgccatggcggcgaggtacgcgactttgccgccgccagccagcaggcgctggcgctccgctgaggcgggcgtcttcggagtccgcccatgagttcgcttccgatctcccgaccctggcgctgggccacccgcgccgcttcgctggcggcctgcctggcgttctggcagctcgccgccggtctgcaactgaatctgggcctggtgaccttcgccaacgtgccgacgcccggtgcggtgttgctggcggcctgcaacctggcccagtccagcgtgctcctggcgcaccttggcgccagtctggcgcgggtcttcgccggctatctgctggccgccgcgctgggcatcgccctcggcctggcgatcggccgctcggcctgggccgaggccttgctgctgccgccgctggaagtgctgcggccgatcccggcggtggcctggattcccctggcgatcctgatgttcccttcgtcggaggcctcgatgatcttcattaccttcaccggcgcgctgttcccgatcctgctcaataccgtgcatggcgtggaggcgctcgatccgcgcctgctggcttcggcgcgcagcctgggggcggggcgccgggcactgctgcgcgaggtgctgctgcccggcgccggaccgggcatcttcaccggcctggcgatcggcatgggcacctcctggttctgcctggtgaccgccgagatgatctccgggcaatggggactgggttactacacctgggcttcctacaacatccagaactacgacgaggtggtggtcggcatgctgctcatcggcctcttcggcatgggcagcagtgggttggtgaagcgcgtcggcgcgtcgctgacgccctggtacgcggcgggaggcaaggtccgatgacgacggccggcaacagcctggggcgcatccagatccgcgacctgagcatccgcctggggcaggggagcgaagccttcgaggcggtccgcgatctgagcctggaggcgcggccgggcgagttcgtctgcctgctcgggccttcgggatgcggcaagtcgaccctgctcggcgccctggccggccacctgcggccaagcgccggcagcgtgagggtcgacggccggagcgtggaaggaccttcgccgcagcgtggcatggtattccagcagcacaccctgttcccctggcggcgggtccgcgacaacgtcgccttcggcctgaagatgcagggcctggcccgcgccgagcgcaaccggcgcgccatggagatgctcggactggtggggctggcggacttcgccgggcgctggcccggccaactgtccgggggtatgcagcagcgcgtggagatcgcccgggtgctggtcaaccggccgcgcctgctgctgatggacgagcccttcggcgccctcgacgcgcagacccggctgaagatgcagaccttgctgctggacgtatgggcgcgggtccgcaccacggtgctgttcgtcacccacgacatcgacgaggccctgtacctggcggacagggtgctggtgatgagcccccgtccgggacggatcatcgccgacctggcgctggacttcccgcgccctcgcgacacccggctggtgaccagcgccgacttcgtgcgcctgaaacgccactgcctggaactgctcgaccacgacgacggccgccagttgccgcgcctgaccccgctcggcttgccgccgggcatcaccccggaccgactgcggatcgccatatga

SEQ ID NO: 9157 - DNA, 693 bp, Pseudomonas aeruginosa
aggccctggcggacgactactggcaggtccgcctgcgcgccgcgcgggcgctcgggcgcttgcgccaccggccggcgcgggaggcgctggaagcattgctcggccatcccatcggcaacctgcgcaaggaggccgccctggccctcggcgaactggcggacccggcctcggcccaggccttgcgggtcgccgaaggcgacggcgatcccgaggtgcgcaaggcggtgcgtatcgccctggcgcaactgcgggtgccggcatgacccagccgccgctgcgcctgcgcaattccgccagggacggctggctgatgctcgaatgggcggacggcgcggtcagccggatcgaccatgctcgcctgcgcgccgcctgtccctgtgcgcaatgccgggcgcagcgcctgcgcggacggatcgtcgcggcggagcagggcgtgcgcctgcgcgatatccgcctgcagggctacggcgtgcagttgctgttcgacgatggccacgagcgcggtatctacccctggtcctatctgcgcgacgaactctgaggcgggtattgttccgctcccggcaacaacgtgaagcgcgttcatgggtttcagattgttgccactccctgcgttgtccccgtcccgccacggccaccacccgggtgacccgctcgaaggcccgccgcctggcttcgttgtcgtttccgtaa

SEQ ID NO: 9158 - DNA, 1410 bp, Pseudomonas aeruginosa
agcggtcgctgcgtgcggccagtcgaccattcgcaacgaggaagcgttcgcgtgaaatcccatcttctccgcccggccctgcgccccgtggccggcggcctattgtccgcctccctgctgtgcaacgcggtgcacgccgccgaggcgttctcgccgaactcgaaatggatgctcggcgactggggcggcaagcgcaccgagctgctggagaagggctacgacttcaagctggagtacgtcggcgaggcggcggccaacctcgacggcggctatgacgacgacaagaccgggcgctacaccgaccagttcgccctgggcgtgcacatggacctggagaagatcctcggctggaaggctaccgagttccagttcaccgtcaccgagcgcaacggcaagaacctttccaacgaccgcatcggcgacccgcgtgccgggcacatcagctcggtgcaggaggtctggggccgcgggcagacctggcggctgacccagctgtggctcaagcagcagtacttcgacggcgcgctggacgtgaaattcggccgtttcggcgagggcgaggacttcaacagcttcccctgcgatttccagaacctggccttctgcggctcgcaggtgggcaactgggcggggagcatctggtacaactggccggtcagccagtgggcgttgcgggtgaagtacaacttcgcgccggactggtacgtgcaggtcggcgcctacgagcagaacccgtcgaacctggagaccggcaacggcttcaagatgagcggcagcgggaccaagggcgcgttgctgccggtggagctgatctggcagccgaaggtcggcgccgagcaactgccgggcgagtaccggctgggctactactacagcacggcgaaggccgatgacgtctacgacgacgtcgacggccagccgcaggggctgaccggcaacgacttcaagtcgcgcggcagcaagcatggctggtgggtggtggcgcagcagcaggtcacttcgcacaacggcgatgcctcgcgcgggttgagcctgttcgccaacctgacggtccacgacaaggcgaccaacgtggtggacaactaccagcagctcgggatggtctacaaggggccgttcgacgcgcggccgaaggacgacatcggcctgggcatcgcgcgcatccatgtcaacgacgatgtgaagaagcgccagcgcctggtgaaccaggtgaacggcatcgacgactacgacaacccgctgtaccagccgctgcaggacaccgagtacaacgccgagctgtactacggggtgcatgtgaccgactggctgacggtgcggccgaacctgcagtacatcaagcagccgggcggggtcgacgaggtcgacaacgcgctggtggcggggatcaagatccagacggtgttctag

SEQ ID NO: 9159 - DNA, 2121 bp, Pseudomonas aeruginosa
acagcccggcgtgcagaacgtaataggagagtaagcaatgcctgtcatcaaccccgaagggagtaccggacgatgagcgaaggtaaccgcagtcgatcgcgcctgctgccgagcctgctcggcctgttgatcctgctgtccggcctggcgctgctggccggcggcatcaagctggcgagcctgggcggctcgctgtactacctgctggccggcatcggcctggccctgagcggactgttgctgctgctgggcaagcgtgcggcgctaggcctgtacgctctggtgctgttcgccagcaccgtctgggcgctgtgggaagtcggcctggactggtggcaactggtgccgcgcctggctctgtggttcgtcttcggcctgctgctctggctaccctggttccgccgcccgctgctggccgacggtccggcgccgctgggcaccgcggcgctgggcgtggcggtggtcctggccggcaccgccgcggtgggcagccagttcaccaatccggggcagatcgtcggtcgcatcgaccgcgacagcggcatgaccagcaccgccccggcgatgccggacggcgactggcaggcctacgggcgcaccgagttcggcgaccgctactcgccgttgaagcagatcaccccggccaacgtcggccagctcgaggaagcctggcgcatccgtaccggcgacctgccgaccgccgacgatccgctcgaactgaccaacgagaacaccccgctgaaggtcaacggcatgctctacgcctgcaccgcgcacagcaaggtgctggccctcgacccggacaccggcgcagaaatctggcgcttcgatccgcagatccagagcccggtaggcttcaagggcttcgcccacatgacttgccgtggcgtctcctactacgacgaagagcagtacgccaggagcgacgtcggcgcgccgccggccgcgctctccaaggccggcaaggcggtcgccgccagttgtccgcggcgcctgttcctgcccaccgccgacgcccgcctgatcgcgatcaacgccgacaacggcaaggtctgcgaggacttcggggtcaagggcgcggtcgacctgacggccggcatcggtccgttcaccccgggcggctactactccacatcgccggcggcggtcacccgcaatctggtgatcatcggcggccacgtcaccgacaacgagtcgaccaacgagccgtccggggtgatccgcgccttcgacgtgcacgacggcaagctggtgtggaactgggacagcggcaacccggacgagaccgagcccctggctcccggcaagttctatacccgcaactcgccgaacatgtggtcgctggccagcgtcgacgagaagctcggccaggtctacctgccgctgggcaaccagatgcccgaccagtggggcggcaaccgcacccctggcgccgagaagttcagcgccggcctggtggccctcgacctgaacaccggcaagctgcgctggaactaccagttcacccaccacgacctgtgggacatggacgtcggcagccagccgaccctgctcgacctgaagaccgccgatggcgtcaagccggcgctgatcgcgccgaccaagcagggcagcctgtacgtgctggaccgccgcgacggcacgccgatcgtgccgatccgcgaagtgccggcgccgcagggcgcggtggagggcgaccataccgcgccgacccaggcgcgttccgacctcaacctgctgcgcccgccgctgaccgagcgcgacatgtggggcagcagcccgttcgaccagatgctctgccgcatccagttccgctcgctgcgctacgagggccagtacaccccgccgtcggagccagggcagcctgatctatccgggcaacgtcggagtgttcaactggggcggggtgtcggtcgacccggtgcgccagatcctcttcaccagccccaactacatggccttcgtctcgcagatggtgccgcgcgacaaggtgcccagcggaagcaagcgcgagggcgagaccagcggcgtgcagccgaacaccggcgcgccctacgcggtgatcatgcatccgttcatgtcgcccatcggcctgccgtgccaggcgccgtcctggggtga

SEQ ID NO: 9160 - DNA, 1254 bp, Pseudomonas aeruginosa
cgtggcgggtatcgacctgaccaccgccaaggtcgtctggcagcacaagaacggcaccagccgcgacaacaccccggtgccgatcggcctcaccgtcggcgtaccgagcatgggcggctcgatcaccaccgccggcggcgtggccttcctcagcggcacgctcgaccagtacctgcgcgcctacgacgtgaaggacggcaagcagctctggcaggcgcgcctgccggccggcggccaggccacgccgatgagctacaccggcaaggacggtcgccagtacgtgctgatcgtcgctggcggacacggctccttcggtacccgcatgggcgactacatcatcgcctacgccctgcccaggcaatgacccgcccaccgggagcccacagccggctcccggccttccgggcctcggcccggaaggggctttgccaaggggaggcgagttcccgcccttggcaaagccccttcgataccttgcgacccgcggaaccctgcatgccgtcccgaccccgacccagcttcgtctcccacctgttgcccggctccctggcgatctgcggcctggccatcgcctgcgccgtccagggcgaggagcgacgcagcctcgaacccatggtggtgaccggcagatacaaccccagcgacaccttcgacctgccgttgtcggtggatagcatcgagcgtcggcagatcgccgacggccagctcggcatcaacctctccgaagtcctgccgcgggtacctggcctggtggtgcagaaccgccagaataacgcccaggacctgcaaatctcctcgcgcggatacggcgcccgctcggccatcggtatccgcgggctgaagctggtccccggacggcatcccggccagtacgccggatggccagggccaggccgcgaccctcaacctagacgtcgccgagcgcatcgaggtactgcgcgggccggcctcgacgatctacggcagcaacgccggcggggtgatccagatgttctcccgcgacggccagggcgccccgcgggtcggcgcggaagccaccgtcggcagcgatggcctgagccgcaaccacctgtacacggaaggcgagggcgacggggtcggtttcctggtggatgcctcgcggatggacaccgacggctaccgcgaccacagcgccgcgcgccgcgaccagaccttcgccaagctgaacttcaggcccgacgccgacagccgcctggcgctgatctacagcagcctggaacagaacgacactga

SEQ ID NO: 9161 - DNA, 1224 bp, Pseudomonas aeruginosa
tccgcgttgccagagaaacggcgcggtgatcgacttcgaccgcgacttccacggtggcaccgtgcgctggctgcaaccggtaagccaggcgccgggcgagctgaacctgaccgtcggcctcgactacgaccagagccgcgacgaccgtcgcggctaccagaacttcaacggcgaccagctcggcgtgaagggcgagttgcgccgcgacgaggtggacaccgccaccagcctcgatccctacctgcaggcgagctgggccatcgacgcctggaccctgcaggccggggtgcgccacagcaccatgaagatggaggtcgacgaccgctacctgagcaacggcgatgccagcggctcgcggcgctaccggaagaacaccccgtcgttctcggtgatgtacgccttcacccccgacctgcacggctacctcagcgccggcaagggcttcgagactccgacccaggcggagatggcctatgcgccggtggcggcgaacgcgccggacgtcttcaacttcggcctcaagccagccaccagcagccagtacgaagccgggctgaaggcgcgcctgtggggcaatacgcgggtcaacgcggcgatcttccagatccgcaccgaggacgagatcgtcgtcgccagctccctcggcggtcgcaccagctaccagaacgccggcaagaccctgcgtcgcggcttcgaactgggcctggagagcgaactgagcgagcactggaacgccaacctggcctatacccggctatccgccacctacgattcggatttcgaggccggcggcaagaccatcggcaagggcaagcacctgccgggcgtgccggaaagcagcctgttcggcgaactggtgtggaagcccgcggagggcatcagcatgggctgggaaggcatgtaccgcagccaggtctacgtcgaggacagcaacagcgaaaaggccgcgccgagctatgcggtattcaactggcgcacccgcttcgagcagcgcctgggaacctgggccttccaccagctggtgcgcctggacaacctgttcgaccgccagtacgtcggctcggtcatcgtcggcgacggcaaccggcgttactacgaagcggcccccgggctgtcctggtacgcgggagccggggtcgaataccagttctgaagtgccggatgcgcttgttcgcgctacccggccagcccttgtcagcgtcgtcaattccgattactgtatga

SEQ ID NO: 9162 - DNA, 573 bp, Pseudomonas aeruginosa
  unsure (17): Identity of nucleotide at the above locations are unknown.
aagccctggccgagacntaccaacaggtgctgcggggctggcgtgtcgaggcgcgccgccagctcgcgcagtagcgtccagagttccggtgcatcctcttcgcccagccggcggccgatgacatccagggccggcgccgggcgcaggcgcaagcgggtgatcttcgccagcatttgccacgccgacgccagcaggccgagaaggatcagcgccacgctcagttgggtgcgtccttcgctgaccggaacctggccgacccgccacagcccgaggatctcgaacgttccggcacaggccagggccagggcgagcaggccgatctgggcgaggagcaggcagggcagcaggcgtcggcccagctcgaaccacaggagcaggcagcgacgcgagcgcagtgcgctgcgtgcggcgccggcgatgccggccagggagacggctcccaatacggcgaccagcgccgccaggcaggctccgctatcggcgaggacggcggcgaagcgattcaggcgctgtgcgcttcgtgtgtcggcgagtcgctcgtcgagccgcgccagggccaggtcgcgcacatag

SEQ ID NO: 9163 - DNA, 435 bp, Pseudomonas aeruginosa
cggcgctccggcgcggtcggcgatctgtcccagccattgccagaggccgggcgcggcgacccggtcgagttcgcggccgagcaggtggagcaccggttcctccagcggcagcagttcgccgcgcaggcgccgcagcatgagcaggccgccgaggaacagcagccacagcggcagcgagaagagccagggcgacgaagccgtggctgtgccagtggctgtagctccacagcgcttcgtagagcaactggctggccagggcggcgaccagcaggccagcgtgcagcgggaccagtcgaccgaggcgccgccaggccggcgcgaggtggccgagcaggtaggcttgcgagcgcatcgagcggcgcccgtcgtattccagtctcgccagcaaggcggccgcgaccagcgccgacgccagcgcgcagagcttgccgatag

SEQ ID NO: 9164 - DNA, 1269 bp, Pseudomonas aeruginosa
gcccctgctggccctggtaggccaccaccttgtcggcgactggcggccgcgcctcttcggcctgcgccgtgcaggatccccacgccagtgcgcccatcagcagtgccgcagtccactttgctatcattctcgccccctttggcaacgcgatgtaaaaggggcgcatctattaatacaggcgcgagccacgaacaaccgaggcggccgccgctcacaggaaaagcgtcgtcgcccacaggttcggttcgatcagcgcacggaaccatcctggaaagccgctgcctgaaccggttcagatggttgcgtcccaccgatacctacgccatggaaagctggaatccctaccacgacacggagctctatttcgacgctccttcacccctgagccagtcgcagatcctcgacgcgcgcgaaatgctcggcagcgccaccggtcactaccaggcgcggacggtgcgcccgtcgatgcagtatttcgattgcgacctgagcttcaccgagccgctgcgaacccacaaggtgctgccggaaggcctgtgcatcgtgcagatgttcgacggccagtggcggcacagcgtcgacggcggcgagccttatctctacaacctgggcggtccttcggtgctcggcaccggcgagccgatggaggccttcgatatcctgccggcgggcagccgcgtgcgcctgggcgggctgcggatcgccgccagctatctggaagaggaactggaaaccggcgatggcgccctgcggccgctggcgcggctgaagggcgacggcgcgagctttacccagttgtctcgttgcggcgccatcaccgccctgttcgagcgcctctaccagaatccataccgcggcgccctcggacgcctgcacgaagagagcctgaccctgggcctgctggtggagctggccgcctacctgggcggcgcggaccttcgccgcgcgcgcaccccacgcgcccagcgcgacctggcccatgaagcgcgccgcctgctggaggcgaacctcggtgagccgccggccagcctcgaactggcgcgccaactgggggtcggcgaaaccaccctgcggcggattttcaagaacgagttcggtcgctcgatgttgcagtacgtccgcgaccggcgtctcgagatcggccggcagatggtccgcgagggtcgctggcagatcgcgcagatagcctatcgcctgggttactccagtccggaaaacttcacccatgcctaccgcgcgcgcttcggccatccgccggggcgcgagtga

SEQ ID NO: 9165 - DNA, 1956 bp, Pseudomonas aeruginosa
ttgttcggacatgcttcctccggtcagagcgagccgatgcgctccagctcacgcttgagctggtcgcgatccagggtagcgaagggcaggccgaggaaggctcggcaacgctgttcgatgcgtgccagggtggcgtggaacgccgcatcccgcagggcttcgtcgccatccagggcggagggatcggccaggccccaatgggccttcagcgctgcgccgagatacagcgggcaggcttcccccgcggcggcgtcgcaaacggtgatgacgatgtccggcggtgcgccttcgaaggcttcgctgcccttgctgtacaggccgtgggtggcgatgccggcctgttcgagggtcgccaggctgcgcggatgcacccgcccgctgggctggctgccggcgctgcatgcctcgaaacccggcggggccaggtggttgaacatggcttcggaaagaatgctgcggcaactgttggccgtgcacatgaacaggactcgcatgggatgctcctgccgccgtcgccggcggccgtcagatggccaggcgcagggccagggccgaaagggtcgccagcaggaccggcagggtcagcagggcgccgaccctgaagtagtagccccaggtgatgcgcatgcctttgcgcgccagcacgtgcagccagagcagcgtcgccaggctgccgataggggtgatcttcggacccaggtcgcagccgatgacgttggcgtagatcatcgcttcgcgcaccgcgccggcggtgtcgctggcctggatcgacagggcgccgagcagcacgctgggcatgttgttcattaccgacgagagggcggcggaaagcagtccggtacccagcgcggccgcccatacgccgtgctcggccaggcggttcaggagctgcgccaggaggtctgtgagaccggcgttcttcaggccgtagaccaccaggtacatgcccagcgagaagaccacgatctgccagggcgcttcgcgcagcacccgccgggtcgagatcacccgcccgcgcccggccaccgccagcagcagcgccgcacaggtcgcggccaccgcgctgacggggacgcccagcggctccagggcgaacagcccggcgagcaggaccagcagcatccagccgccgacgatgaaggtcgcgcggtcgcggatcgccgcccgcggcggcttcaattgctccagcgcataaaccggcggcaggtcgcggcggaaatagaggaacagcaccagcagggaggtcgcgacgctcaccaggtttaccggcagcatgaccgcggcgtactcgccgaagccgagcccgaagtagtcggccgagacgatgttcaccaggttcgagaccaccagcggcaggctggcgctgtcggcgatgaagcccgccgccatgacgaaggccagggtcgccgccgggctgaagcgcagggccagcagcatcgacatcacgatgggcgtgaggatcagcgccgcgccgtcgttggcgaacagcgccgagaccgccgcgccgagcagcacgcagaaggcgaacaggcgccggccgtcgccgccagcccagcgcgcgacgtgcagcgcggcccattcgaagaagccggcctcgtccagcagcaggctgatgacgatcaccgcgatgaaggtggcggtggcattccagacgatgttccagacggtcgggatgtcgcccggcgcgacgctgcccagcgccagggcgagcagggcaccgatgctggcgctccagccgatgccgaggcccctgggctgccagatgaccaggaccagggtgaacaggaagatggcgaaggcgatcagcatggggcggctcgcgctattggcagcaggcggaggcgcgctgcgggcggccgtccatgtcgcgcaggcgcgctgcgtcggcttgcagccagtcgccgttggcccgcagggtcacttgcaggacttcgtggatccaggccggcagcgtag

SEQ ID NO: 9166 - DNA, 423 bp, Pseudomonas aeruginosa
gcagcgcagttggctggcctcgctgctggggctgccgaggatggccggggcatcgcgcaggacgatgcgctggatttccgcttccagggccatttccaggtaggcccggttgtaggcacggaagccgctccagaggtcctcgccggcagccaggatggcgccgaggcgaagattcatctcgtcgtcgatctgctgcaccaccgcggccagcaggcctttcttgtcgccgaagtggtgatacagcgcgccgcgggtgaggccggcgctggcggtcagttcgtccatcgaggcgccggcgtagccgttgtcggcgaacgctcggcgcgcggcgtcgatcagcttggcgcgggtttcctcgatcatctcggcgcgaggcttgcgggccatgcgaggtctccgggtggcgaaggggcttcaggataa

SEQ ID NO: 9167 - DNA, 474 bp, Pseudomonas aeruginosa
gttccgcggcgaagcgcggggcgattgcgtagcggcaatggtagtccgcctcgatccagtcggcggcatacgccagggccaggcgcgagccgcgcagcaggcggacatcctcgcgggcttcgagcagagcgcagggcagggcggcgatcaccgcctggtcgctgtgcggatgctcctcaccatgggtcgccgcctgccagccgagggcgttgcgggcgaactcgaggatcgtgtgctggaagccggcgcaggtaccgaggaacggccggcgccggccccgggcatgggcgatcaggcgcagcaccgcgtcggcgtcgcgataggggctgcccggcacgcaccagaacccgtcatagcgctccagcgccggctcggcgggcaggcggtcgctggccagccagtcgaatgcgatctccaggccgagtgcctcgccggccaggcgcagggccaggggaatcgcccggtgggcggtga

SEQ ID NO: 9168 - DNA, 1044 bp, Pseudomonas aeruginosa
tgtgcgggtcgtggtcgccgaccagggcaatgcgcagcggcgccgcgggaggggtggacatccgttttcgctccagtttcgccacgccggttggcgggccctggcgctcactctatagttgcgtttccgcactcgatatcggcgccaatgcaaaagatgaatgcaccgctgcaatatcgcctggaccatgccgatcttgccctggtcctcgccctggttcgcggcggcagcctggcgcgggccgcagagttgctcagggtcgatgtgtcgacggtcttccgggccatccgccggctggagaagaacctcggcaaggcattgttcgacaagagccgcagcggctacctggcgaaccagaccgcccgccgtctggcgcagcaggcggaactggcggagcaggcgctggaggcggcgcgcatcggcctcgaactggagcgcgaggtgctcagcggtaccgtgcgcatgacctgctccgacgccgtcctgcatggcctgctgctgccggcgctggcgcgcttcatgcctggctatccggccctgcaactggagctggcgacctccaacgactttgccaacctcagccggcgcgacgccgacatcgccctgcgcatgacccgcacgccgccggaacacttggtcgggcgcaacctcggcgaggtgcgctacgtgctctgcgccagcgaacgctacctggagggccgcgacgcgacggagcccgccatgctgcactggatcgccccggacgattttcttcccgaccacccgagcgtggtctggcgtcgtcgacactatcctggggtgctgccggcctaccgctgcaacggcgtgctggcggtcgccgagatggcccgcgccggcctcggcctggcggcgatccctgcctacctgctacgcgacggcgacggcctgcgggtactggacgccgacctcgagggctgcgccagcgccctgtggctgctgacccgtccggactgccgggcgttgcgctcggtggtcgcattgttcgacgagctggggcggcatgtgcgattgggagatgagtga

SEQ ID NO: 9169 - DNA, 1470 bp, Pseudomonas aeruginosa
  unsure (1314): Identity of nucleotide at the above locations are unknown.
aggggtggccgtgcctggtatggcaaccctctcccgcgagcgggagaggggctggaatggcaggcctggcgctcagccgcgatccgccgcggccggtcccggcggcggaatgtcgcccaccgccgccgcgccggtgtccttgcgcaggcgcctgacctcgtcgacgctgacgcttggcgcctggttgccccagctggtgcggatgaagttgaccacgtcggcgatctcctggtcgttcatccgccagccgaacggcggcatggtgaagctcgacggtgcctggtgggtggccggcagggtgccgcccttgagcacgatgtgcaccagggaggtcgggtcgctgccggtcactaccgggttgccggccagggccgggaagacccgcgcatagcccttgccgtcggtgcggtggcaggccccgcagttgtcgacgtagagcgccgcgccggtcttgctgtcgtcgccgtggaacagtgcctgggctacgctctcgtcgtagacgtgcggctggtcggcggggtccgccggcggcagcgacttgaggtagcgggcgatggcggtgaggtcggcgtcggtcatgtactgcatgctgtgcaccaccacgtcggacatgccgccgaacaccgcgctgcgctcgctgcggccggtacgcaggaagctgaccaggtcggcttcgctccagctgcccagtccggtccggtggtcgccgcgcaggctgttggcgatccagttctccagcggcgcgctgccggacaggtaggccgcgccatcgctcgccgccagggccttctcctgcatgcccagcccacgcggggtatggcaggcgccacagtggccaaggccttcgaccaggtaggcgccgcgcgccagcaccgggtccagcccggcggcggcctggaagtccttcacctcgggagcgaaggtccagcgccagaatgccagcggccagcgcatcgacagcggccaagggatgtcgctggccttgttgggctgctccaccggctccacgccatgcatgaagtaggcgtagagggcgcgcatgtccgcttcgctgactcgcgcgtaggacgggtagggcatcgccgggtaaagcgtgtcgccggacctggccacgccgtggcgcacggcacggtcgaagtcctcgaagctgtagtcgccgatgccggtcttgcggtccggggtgatgttggtcgagtacaccgcgccgatcggcgtttccatcggcaggcccccggcgaacggcttgccgtccctggcggtgtggcaggccacgcaatcgccggcgcgggccaggtattcaccctgcctgaccanggccgggtccggcgctgcggcggcctgggcgatgccgcacgcgaaggcggagaaggcgaggaaagctgtcggtttcatcgttgcgctcctcatgcctgcaccagcggaccggggttcttcaggtattgctcgcggatcgccttggccgaccagtag

SEQ ID NO: 9170 - DNA, 252 bp, Pseudomonas aeruginosa
gcgtccttgaccgcctgtttccagccgctgccccagctcggcgtgccgggcggcacggcgaggccgccgatcggcttggagccggcctggttgacccacatcggcgagccgccgacgaagcccagcggtccgtggtcgaagttgtcggcgttgaagtcgtccaccgccacgccgccgccgccggtgccgacaaaggggttggtatgcacgtccttgtcgaaaaacgccttgatggtggccatgttctggtag

SEQ ID NO: 9171 - DNA, 783 bp, Pseudomonas aeruginosa
gtgtcgtcgccatgttcagcccctctcgccggaaatcgccaccggcgggaagggatacttctcgccacggtcggcccagtccatgaagtcggcgcgggcgccggggaaaccgaccagcttccagcccaccaggccgcgattgccgccgtgctgcggatcggagaagaagccttcgcgggtgttctgcagcaactggccgaagagcagcttggccggcaggtcctgcaggtcgatctggccggcttccaggcgttgcaggatgtcgtcctgcgccgacggctccagatcggcgaacggcttgccctggttggccttgctccagcgttccagggcggcgatgccgacccggtagatgtcgcgtggcaccagcttcaactgatggccgaactccggcgcggcgtcggtgacgaacggcccctgcatgtaccagagtgcgccgtgcccgtagggggtttccatctgtcggtcgatgaactccggcaccccggcctcgatggcgccggggccgttgtcgtcgctggggatcagtcgcgccaccgcggcgttgacgaaagcccattcggtgttggtgaagaagcgaggctggtagcgttcgcggggtttgtcctgctcggcggcgggcgtctgcatggcatggccgacgccatagccggccagggtcaccgccgggatcacggtcagggtcttgcgcaggaagtcgcggcggccgttgacggccttgtcatcgggcatggtggggtcctctctggatcatcacggtttcgtctttctgataatgattag

SEQ ID NO: 9172 - DNA, 459 bp, Pseudomonas aeruginosa
agcagaacggcgcgccgggcgtcggcccggcgcggccttcaggcgcctcgccgtcgcgcccaggccgaaggattgaccaggttcagcggccgctcgccggcgagggcggccagcaggttgtccaccgcgcagcgggccatggcttcgcgggtttcctcggtggccgagccgatgtgcggggtggccaccacgttcggcaggcgcagcagcggcgagtcgggagacagcggctcgcgctcgaacacgtcgaggccggcggcgcggatccgccgctgggccagggcctcgatcagggccgcctcgtcgaccacccggccacgggagatgttgatgaagatcgcctgcgggcgcatccgggcgaactgcgcggcaccgatcaggccttcggtggcggcggtcagcggcagggtcaggcagacgaagtcggattcctcgagcagcgcgtcgagggggcggtag

SEQ ID NO: 9173 - DNA, 417 bp, Pseudomonas aeruginosa
cccttaccgatcgcggcgaactgctgttcggcgtggcccagcgcatgctcggcgagctggacggcgcgctctccgatgtgcgcgacctgcagggcgagcccagtggccggttgcgcatcaccgcgccgcaggacttcgtcaagtggcacatcagcagcgtttccgcggcgttcatccggcagtttcccaaggtccaggtggaaatgctggccgacgaccagttcagcgatctggtcggccagcgcatcgacctcgcggtgcgtatcggctggccgcgcgattccggcctgcatgccagcaagctgtgcgacttccagcaggttgccgtggcgacgccgggatacctcgccggcttgtcgccagtgctccagccgcacgacctggcgcgctgcgaatggatcggccatacccgcctga

SEQ ID NO: 9174 - DNA, 606 bp, Pseudomonas aeruginosa
ccagcggggcgccgccgagggcgccttccagcaactcgcggacacgcttccagatctgcggcacctggatgcgcagggcattggcgtactccaggcgcggcaccgccgacccggcggcgttgcgctccgggtcgcgggccatggcggtggtcagcgcctgcagcaggtgctgcagggcgatcagctcgccgagggccgcctgtatcccgcggaagccctgggtgccattggcgcgcacgccgagggaaagcaggccgatcatcagttccagcttcaccccgaggcggatgccggactggaagttgtacaggttggcgaagcccgactcggcatagaagccggtggcgcggcgcaggtcgcggtagaccaggacgtcctcccagggaatcagcgccttgtcgaacagcagcacgctgtcgttctcgtcgaaacgactggacagcgggtagtcgaaggggctgctcgcgcgctcctcgtaggatggccggcacatcaggcgcaggccggggttgtccatgcgggcgaagaacaccagggcgaagtcctcggccttgccggcctccatctgcgccgaggcgaccggggcgacgaaggtggcgttggtga

SEQ ID NO: 9175 - DNA, 1482 bp, Pseudomonas aeruginosa
cagggctgcacgcatgagggagtttctcttttttctggttccgtgggttcagagcaacctgatcgggtagtcgaccaccacccggtattcgtcggagctggagttgccgcgggtgttgccgggggcggtgtagccttcgccggggcggtgggtggcccagcgcagggtcacgctgaggcccttggccgggccggcggggaaggcgtagcgcagcgacaggtcgcgttcccagtgctgggcgttcttgccattggggttgtagaggtagccgtagcccgcgctgtccgggtcgacccgggtcaggtcggcctggccacggccgtaggcggcgccgaactgccagtccggggcggcgaggaaggccaggctggcctggtactggatcttccacgagcgctcgccggggccgttgaagtcggcgtactgcatggcgttgctttcgtagaggaaggtccggtcgttctgcgcgatgaagtcgaacggggtgtcgccatcgaccttttgcaggctgaggctcagcgactggccgccgccggccagggtcagcccggcgttgtagaggtcgttgtcgatccggccgagctggctgcggccctggtcgcgggtcttgtagtaatgcagccagggcgtcagggtcaattggctggaaagccgccacggctggctgaggccgaggtagtgctggttccagatatccgccaggcggccgctgtagagcgtcgcctggctgccgccgggggcgctgtagctggcgcccagccaggcgatgtgcgggctttcgcgatcggcggcgataccgcccttggtgccgttgccgtagccgctggtgagatgactgtggccgctctggttgcgcaggcgggtggcttcgacgaagccggcgtccagttcgagcgcgcggaaatggtagttcttcagggtcacgccacggtagctctgcggcaccatgcgactgacgccgctggcgatcaccgggttctccagcaactggtcgccgatcttcagcaggctgtccaggccgcgcagcttgagggccgcgccggccgccgagaagctgtcggcggggcgaccggcggagtccagcggcagcacgccggcaccgccgctgccgccaccgccgtccaggcgcaggccgtagaaggcgtgcgcatccaggccgatgcctatcggcgtgtcggtatagccggagcggaacgacagcatcaggccctgggcccattcgcgctggtcgcggcgggacggggtgtcgtggttgtcgcgggcgaaatagtagttgcggatgaaaccgttcagcgtcgagccttcgacgaagcccggcggcaccttcatttcggctttctgccgctggttcaggccggtgctgatgttgtcgcgatggcccagggagtcgtcggccaggagcgagcccggacctatggcaagggcaaggcagagcgtagccccgcgcttcatggaggaatcaggcatgggtccggtccgtag

SEQ ID NO: 9176 - DNA, 780 bp, Pseudomonas aeruginosa
  unsure (624): Identity of nucleotide at the above locations are unknown.
tcgttgctgtccaccaggctcctgctcggcaaaagaaggggcgtgcagccccttccttcccatggatcacttgcgctgcgaatccagttgctcgtggttgttgaccacggcctgggccttggcgtagctctcgatcagcagttggtagtgcgggaataccgcgctgtaggcttcggcgaactgcacggcgtcgtcgcggttccaggtacgctggatttccgagcagaccgcggcggtgtccatcggcaccacgccggcctggaccacccgtgccagggtgatttcctgggccatcttggagtaggtgccggaggcgtcgatcaccgcgaacacctggtagccgtcgtgtaccgcggcgatgctggggaaggccatgcacacgctggtgatggtgccggcgatgatcagttgcttcttgccggtggccttcaccgcggcgacgaattccgggttgtcccaggcattgatctcacccttgcgcgcgacgtactgggcgtgcggcgcggcctcgtggatctccgggatcagcgggccgttggggccctgcggtaccgaggcggtggtgatcaccgggatcttcgccagggtggcgaccttggccagggtggtggcgttggcgcgcanttcggtcatcggcatgtccttgaccgtctggaacaggccgctctggtggtcgatcagcaacatggcggcgttggccggatcgatcttcggggtctggccgttgaagttggcgggagcgctcatttccatttcctcttgcagggtggtcgtccgtga

SEQ ID NO: 9177 - DNA, 936 bp, Pseudomonas aeruginosa
gcttcgtcgggggcgatcgcgcgttcgccgctggcgtcctgccaaccccaggacgcgggcggggtaggcgccgggccctggctgcaggccgccagcaggagcaggacccaggccgcgagcatggcgcggggtaaagcggttcgatcaggcatcggctgtctcctcttcggcaaacgccgggcgcggatcggtcgccggcggggtgcgcctggggcggcgcggcaacccggcgggagggccgggaaggtcgctacccctgtttcggtgagtcgcggcgcacgaagttccatcggaaggatcgccagcgtacctatcgcttccgacaggtccttgcagatgaactccagcgcttcgcgcaggtccgtcgcagaaggggcgcgagccccccagtcgccgtttcgccgtgccgttccccgctgcccgcgccttgcgcagggcctcggcggttcgaatctcctgcccgtcccttcacgtcgggaagcctgcgtttcccgagaggagtgtttcgcaatggccaccgcactacgcttcagaccgctggacgccttctacaacgtcctcaacccggttcccttcggtttcttcgtcgccgccctggtcttcgacgccacctatttcgccacggcggaggtgatgtggggcaagagcgcggcctggctgatcagtctcggcctgctgttcgccatcctgccctgcgtcgtcgacctgtgccgcgtatggctgctgcggcgcgcggcggtcgtcgcggcggccagggtttcctccttgctgaagttcgccggtatcgtcctggccatcttcaatgccttcgtgcacagccgcgacgcctatgcggtgatgccggccgggctatggctgtcgatcgcgacggtgctgctgctggcgctgggagaggcgctcctggcggtatccgcggaggaggtggcgcatggctag

SEQ ID NO: 9178 - DNA, 843 bp, Pseudomonas aeruginosa
aacccgggtcgccgacccggggatggagttcaccgacctgccggacaccatcaaccaccactggaccaaggcgctgctcgccagtcccgacgggcgcaagctctacgtgggcgtcggttcgaacagcaacatcaccgagaacggcgcggcgatcgaataccgtcgtgcggcgattctcgaggtggacgtcgccagccgcggcagccgcatctacgcctccggcctgcgcaacccgaccggcctgcagtgggaaccggtctccggcaagctgtggaccatcgtcaacgagcgcgacgagatcggcaacgacctggtcccggactacctgacctcggtacgggagggcggcttctacggctggccctacagctacttcggccagcacctggattcgcgggtgaagccgcagcgtcccgacctggtggcgaaggccatcgtccccgactacgcgctgggttcccacgtggccgcgctgggcctgttcttctacaccggcaacgagttgcccgagcgctatcgcaacggcgccttcgtcagcgagcacggcagttggaaccgctcgccggtcagcggcttccaggtggtccatgtgccgttcgccgacggcaagcccgccggtgcgccgcagccggtggtgaccgggttcgtctccgcggacgagaagcagttgttcggcgcgccggtggggttggcgcaggcggccgacggggcgttgctgatcgccgacgacgtcggcaacgcgatctggcgggtgagcgccgcgggcaccgactagcggcctgctcgacggtgtccgggccgaagctggcggtccgggctcggtgctgcggtccggcgcagtaa

SEQ ID NO: 9179 - DNA, 519 bp, Pseudomonas aeruginosa
ggagcagtattccatctggccggaatacaaggagattccccagggctggcgggcggccggcaagagcggcctgaagaaggactgcctggcctacatcgaggaagtctggaccgacatgcgcccgctgagcctgcgccagcacatggacaaggcggccggctgagtgggcggtacgcccgtacggctgttctgcctgccgtattccggcgccagcgccatgacctacagccgctggcggcgcaagctgccggcctggctggcggtgcgtccggtggagttgccggggcgcggggcgcggatggccgagccgttgcagaccgacctggcgagcctggcgcagcaactggcgcgcgagctgcacgacgaggtccgccagggcccctacgcgatgctcgggcacagcctcggcgccttgctcgcctgcgaggtgctgtatgccttgcgcgagctgggttgcccgacgccgctggggttcttcgcctgcggcaccgcggcgccgtcgcgacgcgccgagtatga

SEQ ID NO: 9180 - DNA, 1512 bp, Pseudomonas aeruginosa
ctggcgcggactgggccgcggccggcgtcgcggcgagggccgggagcgggccggcgagtccggcgcaagccagggccagggcgaggcaatggggtttcaggttcatccgggggttcctttcaggtgcggcaggcagccgcgagcgatggcggcgagaccgaaggccaggccggcgaccaggatgatcgcggcgccggagggaatcggcaggtcgaacatgatcggcaacaggataccggccagcgtgctgacggtggcgatcagcaccgccagccagaagaaccctttcagcgactggctgaccaggcgcgccgccgccgccgggatcaccagcagggctccgaccaggatcgcgccgatcactttcaccgcggcgacggtgaccagggtcaccagggccacgaacaggtagtccaggctcttcaccgcgaccccgcgcaccgccgccagttgcgggttgaagctggccagcatgatgcggttgtacagcggcagggccaggcacggcaccagcacggcgaccgccgccagcaccgcgaggtcatggccgttcacggtcagcaccgagccgaacagcacgttctcgaggatatgcacgttgatcttgcccgccagcaccagcaacaggctggcgccgagcgccagggacaccgagaggaacaccccgatcagggtgtccggggccaggccggtgcggttgcgcaggtagttgagcaggacgccgaacagcaggcagtagccgaacaggctgccgtagggcccggtgtagggctcgccgaggaggatgccgatggccacgccggtgagcgcggcgtggccgaccgcctcggagaagaaggcgaagcgcttgaccaccaccagggtgccgaggccgccgagcaccgggccgatcagcaggccggcgaggagcgcgttgacgacgaagccgtaggccagggtctccggaaggtagccggcggcggcccaggcctggacggcctggcgcagttgttcgtaggcgtcgttcatcggctggcctccgcgttcttccggggctgggtggagaacagcgtgagcaggcgttccggggtcaggctgctggccgccggaccgtcgaacagcaggtggcggttgagaccgctgacccggtcggcgaggcggccgacggcctccaggtcgtgctcgatccagagcacggtgacgccggcctggcgccagtccagcagcagccgctcgaagacctggatgccgccctcgtcgagggccgacatcggttcgtccagcaccagcagttgcggcggcggtaccaggccctgggccagcagcacgcgctggcgctcgccgccggagagggcgcccatgcgccgaccgcgcttggccagcatgccgacccgttccagggccgcgtcgatcgccgggcgccggctgcgcgacaggccgaggaaagccggacggcgctggcacatggcggccatgaaatcgtcgacggtgagcggcaggccgcggtcgaactccagcgcctgcggcacgtag

SEQ ID NO: 9181 - DNA, 798 bp, Pseudomonas aeruginosa
tgccgatgcgcaggcgtttgccgtcttcggcctgggtcagcggggcgagcagggccagcagcagggcggccagcagggcgcggcccgggaggagggcggcgaggccgcgcggacgggatgagcgacgggagaacagcatggaaaaacgccttctgtggagtcgatgtgcgatcaatggcggtgctgacgggtcacgccggcgtcgaagcggctgaccacctggcgccagccggcgtcggccagggctcgggcgtcgcccggtacggcgccggcagcggccgcggcgggcttcagccagacttcggcggggccgagcagcaggaggaacgagccggccacctcgggtttgccgctgacgcccaggtagctcggacgcccggcggtttcgccgtggctccagcggtgctcgccgcgactgctcgcggcgatgtcggcgacgaagggcgggaagccctcggcggccagttcgtcgacggagggcgcggcttcgccgtcgtccaggcgcgcctggatgtcttcggcggcgacctgcaggtcggcgtagatgccctgttcggcggcattcaggtcgagccgggcgtccacctggtgggcgtccagggcttgcgcttcatgggactgctggcgcagcccgaccaccgtggcggcgagggccaggatcagcacactgccgagcagtacgtagagggtctcgtggccggcgccggccgggcggacggtttcgacgctcatggcgcggcgatgtcggcgtggtcgatttccaccacgtggccggggccggcgtcgaacagcacgtag

SEQ ID NO: 9182 - DNA, 7911 bp, Pseudomonas aeruginosa
ccgagccccgcgctcgttgcccatgtgcacggaagaagaccgatgaacgcagaagattccctcaagctcgcccgccgctttatcgaactacccgttgagaagcgtcgggtcttcctcgaaaccctgcgaggggagggaatcgatttctcgctgttcccgtttccggccggcgtgtcttcggccgagcgcgaccgcctgtcctacgcccagcagcgcatgtggttcctctggcacctggagccacagagtggcgcctacaacctgcccagcgcggtgcgcctgaacggaccgctggatcgccaggcgctggagcgcgccttcgccagcctggtgcagcgtcatgaaaccctgcgtacggtgttcccgcgcggcgccgacgacagcctggcgcaggcgcccctgcaacgcccgctggaggttgccttcgaggattgcagcggcctgcctgaggccgagcaggaagcccgcctgcgcgaggaggcgcagcgcgagtcgttgcagccgttcgacctgtgcgaggggccgttgctgcgggtccgcctgatccgcctgggcgaggagcggcatgtgctgctgttgaccctgcatcacatcgtgtccgacggctggtcgatgaacgtgctgatcgaagaattcagtcgtttctacagtgcctatgcgactggcgcggagcccggcctgccggccttgccgatccagtacgccgattacgccctgtggcagcgcagctggctggaggccggtgagcaggagcgccagctggagtactggcgcggcaagctcggcgagcggcatccggtcctggagttgccgaccgaccacccgcgtccggcggttcccagctaccgtggcagccgttacgagttcagcatcgagccggccctggccgaggccctgcgcggcaccgcccgacgccaggggctgaccctgttcatgctgttgctcggcggcttcaatatcctcctgcaacgctatagcgggcagaccgacctgcgggtcggcgtccccatcgccaaccgcaaccgcgccgaggtggaagggctgatcggcctgttcgtcaacacccaggtgctgcgctcggtattcgacggccgcacgtcggtggcgaccctgctggccgggctcaaggacaccgtgcttggcgcccaggcccatcaggatctgccgttcgaacgcctggtcgaggcgttcaaggtcgagcgcagcctgagccacagcccgctgttccaggtgatgtacaaccaccagccgctggtggccgacatcgaggcgctggacagcgtggccggcctgagcttcggccagctcgactggaagagccgtaccacccagttcgacctgagcctggatacctacgagaagggcggtcgcctgtacgccgcgctgacctacgcgaccgacctgttcgaggcgcggaccgtcgagcgcatggcgcggcattggcagaacctgctgcgcggcatgctggaaaacccgcaggccagcgtcgactcgctgccgatgctcgatgccgaggagcgctatcagttgctggaaggctggaacgccactgcggccgagtacccgctgcaacgcggcgtgcaccggttgttcgaggagcaggtcgagcgcacaccgacggcgccggcgctggccttcggcgaggagcgcctggactacgccgagctgaaccgccgggccaaccgcctggcgcatgccctgatcgagcgcggggtcggtgcggaccgcctggtgggcgtggccatggaacgttccatcgagatggtcgtggccctgatggcgatcctcaaggccggcggcgcctacgtgccggtggacccggagtatcccgaggagcgccaggcctacatgctggaggacagcggcgtgcaactgctgctcagccagtcgcacctgaagctgccgctggcgcaaggcgtgcagcggatcgacctggatcgcggtgcgccctggttcgaggattacagtgaggcgaacccggatattcatctcgatggcgagaacctcgcctatgtcatctacacctccggctccaccggcaagcccaagggcgccggcaaccgccattcggcgctgagcaaccgcttgtgctggatgcagcaggcctacggcctgggcgtcggcgacacggtgttgcagaagaccccgttcagcttcgacgtgtcggtctgggagttcttctggccgctgatgagcggggcacgtttggtggttgccgcgccgggcgaccatcgcgatccggcgaagctggtggagctgatcaatcgcgagggggtcgacacgctgcacttcgtgccgtcgatgctgcaggccttcctgcaggacgaagacgtcgcctcctgcaccagcctgaaacgcatcgtttgcagcggcgaggcgctgccggcggacgcccagcagcaggtgttcgccaagctgccgcaggccggcctctataacctctatggcccgaccgaggcggccatcgacgtcacccactggacctgcatggaggagggcaaggacgcggtgccgatcggccggccgatcgccaacctggcctgctacatcctcgatggcaacctggagccggtaccggtgggcgtgctcggcgagctgtacctggccggtcggggcctggcccgtggctaccaccagcgtccggggctgactgccgagcgtttcgtcgccagcccgttcgtggctggggagcggatgtaccgcaccggcgacctggcgcgctaccgcgccgacggggtgatcgagtacgccgggcggatcgaccaccaggtgaagctgcgcggcctgcgcatcgagctgggcgagatcgaggcgcgcctgctggagcatccgtgggtgcgcgaggcggcggtgctggcggtggacggcaggcagttggtcggctacgtggtgctggagagcgagagcggcgactggcgcgaagccctgaccgcgcacctggcggcgagcctgccggaatacatggtgccggcgcagtggctggcgctggagcggatgccgctgagtccgaacggcaagctggatcgcaaggcgttgccgcgaccgcaagctgctgcggggcagacgcatgttgcgccgcagaatgaaatggagcgacgtatcgcggccgtctgggcggacgtgctgaagctggaggaggtgggcgccaccgacaacttctttgccctgggtggcgattccatcgtttcgatccaggtggtgagtcgatgccgtgcggcgggcatccagttcactccgaaggacctgttccaacaacagaccgtacaggggctggcgcgagtcgcccgcgtaggggctgcggtgcaaatggagcaggggcctgtgagcggcgagacggtgttgttgccgttccagcggttgttcttcgaacagccgattcccaatcgccagcactggaaccagtcattgctgttgaagccgcgcgaggccctgaatgcgaaggcactcgaagcggccttgcaggccctggtcgaacatcacgacgcattgcgtctgcgcttccatgaaacggacggaacctggcatgccgaacatgccgaagcaacgctgggcggtgcgctgctctggcgtgccgaggcggtggaccgacaagcgctggagtcgctctgcgaggagtcgcagcgcagcctggacctggctgacggcccactgttgcggagcctgttggtggatatggccgacggcggccagcgtctgttgttggtgatccaccatctggtggtggacggggtgtcctggcgcattctgctggaggatttgcaaagggcttaccagcagagcctccgtggggaagctccgcggctgcctggcaagaccagcccgttcaaggcctgggccggccgagtgagcgagcatgcccgtggtgagtcgatgaaggcgcagttgcagttttggcgcgagctgctggaaggtgcgccggccgagcttccgtgcgtgcatccgcaaggcgctctggagcagcgtttcgccatctccgtgcagagtcgcttcgaccgcagcttgaccgaacgcctgctgaagcaggcgccggcagcctaccgtacccaggtcaacgatcttctgctgaccgccctggcgcgagtggtctgccgttggagcggcgcctcttcaagcctggtacagctggaagggcatgggcgcgaggagctgttcgccgatatcgacctgagtcgcaccgtcggttggttcaccagtttgttcccggtgcgcctgagcccggtcgcggatcttggcgagtccctgaaggcgatcaaggaacagttgcgtgcgattcccgacaagggcctgggttatggcttgctgcgctatctggctggagaggaaagtgcccgggtcctggcggggttgccgcaggcgcggatcactttcaattacctgggccagttcgacgctcagttcgacgagatggctctgctggacccggctggcgaaagcgcgggggcagagatggaccccggcgctccgctggacaactggctgagtctcaatggccgggtgttcgacggtgaactgagcatcgactggagcttcagctcgcagatgttcggcgaggaccaggtgcgtcgcctggccgatgactatgtggctgagctgacggcgctggtcgacttctgctgcgattctccacggcatggcgcgacgccttccgatttcccgctggcggggttggaccaggcgcgtctggatgccctgccggtcgcgctggaagaggtcgaggacatctatccgctgtcacccatgcagcagggcatgctgttccattcgctgtacgagcaggcatcgagcgactacatcaatcagatgcgtgtggatgtgtccggcctcgatatcccgcgcttccgcgcagcctggcagtccgccctggaccggcacgcgatcctgcgcagtggtttcgcctggcagggggagctgcagcagcccttgcagatcgtctatcgacagcgccagttgcccttcgccgaagaggacctgagccaggcggcgaatcgggacgccgcgctgctcgcgctggctgcggccgagcgcgaacgcggtttcgaactgcagcgtgcgccactgttgcggctgctgttggtgaagactgccgaaggtgagcatcacctgatctacacccatcatcacatcctgctggacggatggagcaatgcccagttgctcagcgaggtgctggagtcctatgccggacgctcgccggagcagctccgggatggccgctatagcgactacatcgcctggttgcagcggcaggacgcggcagctaccgaggcattctggcgcgagcagatggcggctctggacgagccgacgcgattggtcgaggcactggctcagccgggactgacatcggccaacggcgtcggagagcacctgcgtgaggtggacgcaacggctaccgcgcggctccgggatttcgcccggcgccaccaggtcactctcaataccctggtccaggcgggctgggcgctgctcctgcaacgctataccggacaacacaccgtggtcttcggcgccaccgtctccgggcgccctgccgatctgccgggtgtcgagaaccaggtcgggttgttcatcaataccttgccggtggtggtaacgctggctccacagatgaccctcgacgaactgctgcaggggctgcaacggcagaacctggcgttgcgcgaacaggagcacacgcctctgttcgagctgcagcgctgggcggggttcggcggcgaggcggttttcgacaacctgttggtgttcgaaaactacccggtggacgaggtgctcgaacggtcctccgctggaggcgtgcgtttcggtgccgtagcgatgcacgagcagaccaactatccgctggccctggcgctgggtggcggggatagcttgtcactgcaattcagctacgatcgcggactgttcccggccgctacgatcgagcgcctgggtcgccacctgacgactctgctggaggcattcgccgaacatccgcagcgacgtctggtcgatctgcagatgctcgagaaggcggagcttagcgctatcggcgctatctggaaccgcagcgattcgggctatccggcaacgccgctggtacaccagcgagtggccgagcgggcgcgtatggcgccggatgcggtggcggtgatcttcgacgaggaaaagctcacctacgccgagctggatagccgggccaaccgcctggcccatgcgttgatcgcccgaggcgtcggccccgaggtgcgggtggcgatcgccatgcagcgcagcgcggagatcatggtggcgttcctggcggtactgaaggccggcggcgcctacgtgccgctggacatcgaatacccgcgcgagcgcctgctgtacatgatgcaggacagtcgcgcgcacctgctgctgacccatagccacctgctggagcgtctgccgatccccgaggggttgtcctgcctgtccgtggatcgcgaggaggagtgggccggcttccccgcccatgatccagaggtggcgctgcacggcgacaacctggcctatgtgatctacacctccggctccaccggcatgcccaagggcgtggcggtgtcccacggtccgctgatcgcccatatcgtggctaccggcgagcgctacgagatgaccccggaggactgcgagctgcacttcatgtcgttcgccttcgacggttcccacgaaggctggatgcacccgttgatcaacggcgcgcgggtgctgatccgcgacgacagcctgtggctgccggaacggacctacaccgagatgcatcgccacggggtaacggtgggggtgttcccgccggtgtacctgcagcaactggccgagcatgccgcgcgcgacggcaatccgccgccggtacgggtctattgcttcggcggcgacgcggtggcgcaggccagctatgacctggcgtggcgggcgctgaagccgaagtacctgttcaacggctacggcccgaccgagacggtggtgacgccgctgctgtggaaagcacgggcgggcgatgcctgcggcgcgggctacatgccgatcggtacgctgctgggcaaccgtagcggctacatcctcgacgggcagttgaacctgctgccggtaggcgtggcgggcgaactgtacctgggcggggaaggggtggcgcgtggctacctggagcgtccggcgctgaccgccgagcgtttcgtgccggatccctttggtgcgccgggcagccggctgtaccgcagcggcgacctgacccgtgggcgtgcggatggggtggtggattacctcggacgggtggatcaccaggtgaagatccgaggcttccgcatcgaactgggagagatcgaggcgcgcctgcgcgagcatccggcggtgcgcgaggcggtggtggtggcccagccgggcgcggtgggccagcagttggtgggctacgtggtggcgcaggagccggcggtcgcggattcgccggaagcgcaggcggagtgccgggcgcagttgaagacggcgctgcgcgagcgcctgccggaatacatggtgccatcgcacctgttgttcctggcgcggatgccgctgacgccgaacggcaagctggaccgcaagggcctgccgcagccggatgcgagcctgttgcagcaggtctacgtggcgccgcgaagcgatctggagcaacaggtcgcggggatctgggcggaggtcctgcaattgcaacaggtcgggctcgacgacaacttcttcgagcttggcggccactcgttgctggcgatccaggtgactgcccggatgcagagcgaggtcggcgtggagctgccgctggcggcgttgttccagaccgagtcgctgcaagcctatgccgagcttgccgcggcgcagacttccagcaatgacaccgatttcgatgaccttcgtgaattcatgagcgaactagaggcgatctga

SEQ ID NO: 9183 - DNA, 6573 bp, Pseudomonas aeruginosa
  unsure (5574): Identity of nucleotide at the above locations are unknown.
cccatgctttccaatccaaacctggacctcgtgtcccgcttcgttcgcctgcctctggcgcagcagaaattgttctatcagcgtgtccaggccaagggcatgagcttcgcccgcctgccgatcccgcagactcgccaggagatgggcaacctgccgctgtcctatgcccaagagcggcagtggttcctctggcagctggagccggagagttccgcctaccacattcctaccgccctgcgcctgcgcggcaggttggacattgcgtccttgcagcgcagcttcgcggcgctcgtcgagcggcacgaaagcctgcgcacgcggatcgcgcggatgggtgatgaatgggtgcaggtcgtctccgccgacgtctcgctggcgctcgaagtcgaagtgcaacggggactcgacgaacagcgattgctggagcgggtcgaggcggagatcgcacgacccttcgatctcgaacagggaccgttactgcgggtgactttgctggaggtggacgccgacgagcatgtgctggtcatggtccagcaccatatcgtctccgacggttggtcgatgcaattgatggtcgaggaactggtccagctctatgccgcctatagccaagggctcgacgtggggttgccggccctgccgatccagtacgcggactacgccctgtggcagcgcagctggatggaggcgggggaaaaggagcgccagttggcgtactggaccggcctgctgggcggcgagcagccggtgatcgagttgcccctcgatcacccgcggcagccgctgcgcagctatcgtggagcgcaattggacctggagctggagccacacctggcccttgccttgaaacagctggttcagcgcaagggtgtgaccatgttcatgctgttgctggcttccttccaggcgctgttgcatcgctatagcggacaggcggatatccgtgtcggcgtgccgatcgccaaccgtaaccgggttgaaaccgagcggctgatcggtttcttcgtcaacacccaggtgctcaaggccgacatcaatggccggatgggtttcgacgagttgctggcccaggcccgccagcgcgcgctggaggcacaggcgcaccaggacctgccgttcgagcaactggtggaggctttgcagccggagcgcagcctcggccacaacccgttgttccaggtcatgttcaatcaccaggccgactctcgttcggccaaccagggcgtgcaactgccaggcctgtcgctggagcggatggagtggcggagcagctccgtggccttcgacctgacgctggacgtgcacgaggccgaggacggtatctgggcatcgttcggctatgccacggatctgttcgaggcctcgaccgtcgagcgcctggctcggcactggcagaatctcctgcgcggcatcgtggccgaaccgggccggccggtcgccgagttgccgctgttgctggacgaggagcgcgattgcctgttgcgggcctgggcagagaacgccgacgagggtgggttgccgcccctggtccagttgcagatccaggagcaggcccgtctgcgtccgcaggcgcaagcactggcgctggaggggcaggcgttgagctacgccgagctcaacgcccgcgccaatcgtctggctcactgcctgatagcgcgtggcgtcggtcccgatgtgctggtgggaatcgccgtcgagcgctcgctggacatggtggtcggtctgctggcgatcctcaaggccggtggtgcctatgtgccgctggacccgacctatccgcaggaccgtttgcgtcacatgctcgaggacagcgccgtcggcctgttgctcagccaggagcatttgctgcccgggctgcctttgcacgaagggctggaggtgctctccatcgaccgcctggaacgggacgcatcggtgtctacggatgatccggtggtgaacctgcggccggagaacctggcctatgtgatctacacctccggctccaccggaaaacccaagggcgtggccatcagccatgcggcgcttgcgcagttctcgcgtatcgccagtggttattccgcgctcaccccggaggatcggatattgcagttcgccaccctgagcttcgacggcttcgtcgaacagctctatccggcgctgacccgtggtgcctgcgtggtcctgcgtggcggcgacctctgggataccggtgagctgtatcggcagatagtcgagcagggcgtgacccttgccgacctgcccacggcgtactggaacctgttcctgctcgatgccctggccgagccacggcgttcctacggtgccctgcggcagatccacatcggtggcgaagccatgccactggaggggccgaagctctggcggcaagccggcatgggccgggtgaggttgctcaatacctatggaccgaccgaggccacggtggtgtccagcgtcttcgattgttccgccgagaacgcccgggtgggcaatgccagtcctatcggccaggcgctacccggccgtacgttgctggtgctggatgaacatctcggcctactgcccgtaggggcggtaggcgagctttatattgccagccgtgccgggctggcccgtgcctaccacgatcggcccggcttgaccgccgagcgcttcttgcccgaccccttcggcgaaccgggctcaaggctctaccggaccggcgacctggcgcgccgacgcggtgacggcgtgatcgagtacatggggcgtgccgaccatcaggtgaagatccgcggcttccgcatcgagctgggggaggtcgaagcccgcctcatggacttggagggaatacgcgaagcggcggctcttgcgctggacggtcaactggtggcctacctggtggctgaggggggcgaggacgagactcgccagccggctttgcgcgagcgtatccgcacagcgctacgggcctcgctaccggactacatggtgccctcgcacctgctgttcctcgagcggatgccgctcagtccaaatggcaagctggaccgtcgggcgctgccgaagccggatgccggcctgatgcaacacgaccacatggcgccggcgagcgcgctggagaaagacgtggccgcgatatggggcgagttgctgggcgtcgaacgggtcggccttaccgacaacttcttcgaattgggcggacactcgctgctggcgacgcgcctggtctcgcggattcgccaggatctcggtatcgaagtcagcctgaagagccttttcgagcagccggtcctgcagggattcgtcgagagcctgggcgagaaaccggcggaggttccgccgatcatgcccgttacccgcgagcagccgctgccgttgtcctatgcacaggagcgccagtggttcctctggcaattggaaccggagagcgcggcctatcacattcccgccgccctgcgcttgcgcggcggcctcgatgtcgtcgcgctacagcgcagtttcgagcgcctcgcacagcgtcacgagtcgttgcgtacccgcttccgccaggaaggcctgcgtaccgttcaggtggtggatgccgatgggcagttgcaggtttcccggcatagcctggcgaatgtcgatgacgcgtcgctcagggcggcagtcgaagcggagatggccaggcccttcgacctacgggcggatgcgttgctgcggatcagtctgttcgaagtggctccgaatgaccatgtgctggtcatggtccagcaccatatcgtctccgacggttggtcgatgcagttgatggtcgaagagctggtccagctctacgccgcctacagccaggggcgcgaagcggccctgccggcgctgccgatacagtatccggactatgccgtctggcagcgcgaatggatggaggccggagagagggagcgccagttggcgtactggatcggcctgctgggtggcgaacagccggtgctggagctgccgttcgatcgtccccgtcctgcggagcagagctttcgcggcgcgcggctggagttcgaactcggcgccgagcgggccaggcggctgaaggcgcttgcccaacggcagggtgcgagtaccttcatgttgctgctggcgtcgttccaggcgctgctgtatcgctacagcggtcagccggatatccgtgtcggcgtgccggtcgccaatcgcaaccgggtcgaaaccgagcgactgatcgggttcttcgtcaacacccaggtgctcaaggccgacatcgatgggcagatggggttcgaccgattgctgcaccaggttcgccagcgctcgctggaggcgcaggcgcaccaggacttgccgttcgagcaactggtggaagccttgcaaccggagcgcagtctcagccacagcccgctgttccaggtgctattcaactaccaggcggagcggggcgagcacggcttgccggaagtcgcgggactgagcatcgaagagcaggcgtgggaaagccatacggcgcagttcgacctggtgctggatacctgtgagtccgagtcggacatctgggcggcgctggtctatgcgaccgatctattcgatgcttcgaccgcagagcgcctggtacggcattggcagaacctgctggatgcgatcctggcgatgcctgacgctcgcctgggagagctggacatgctcgaccgcgaggagcgcgaagtcatcgggcagctctggaaccgcagcgattcgggctatccggcaacgccgctggtacaccagcgagtggccgagcgggcgcgtatggcgccggatgcggtggcggtgatcttcgacgaggaaaaactcacctacgccgagctggatagccgggccaaccgcctggcccatgcgttgatcgcccgaggcgtcggccccgaagtgcgggtggcgatcgccatgcagcgcagcgcggagatcatggtggcgttcctggcggtgctgaaggccggcggcgcctacgtgccgctggatatcgaatacccgcgcgagcgcctgctgtacatgatgcaggacagtcgcgcgcacctgctgctgacccatagccacctgctggagcgtctgccgatccccgaggggttgtcctgcctgtccgtggatcgcgaggaggagtgggccggcttccccgctcatgatccagaggtggcgctgcacggcgacaacctggcctatgtgatctacacctccggctccaccggcatgcccaagggcgtggcggtgtcccacggtccgttgatcgcccatatcgtggccaccggcgagcgctacgagatgaccccggaggactgcgagctgcacttcatgtcgttcgccttcgacggttcccacgaaggctggatgcacccgttgatcaacggcgcgcgggtgctgatccgcgacgacagcctgtggctgccggaacggacctacgccgagatgcatcgccacggggtaacggtgggggtgttcccgccggtgtacctgcagcaactggccgagcatgccgagcgcgacggcaatccgccgccggtacgggtgtattgcttcggcggcgacgcggtggcgcaggccagctatgacctggcgtggcgggcgctgaagccgaagtacctgttcaacggntacggcccgaccgagacggtggtgacgccgctgctgtggaaagcacgggcgggcgatgcctgcggcgcggcatacatgccgatcggtacgctgctgggcaaccgtagcggctacatcctcgacgggcagttgaacctgctgccggtaggcgtggcgggcgaactgtacctgggcggggaaggggtggcgcgcggctacctggagcgtccggcgctgaccgccgagcgtttcgtgccggacccctttggcgcgccgggcagccggctgtaccgcagcggcgacctgacccgtgggcgtgcggatggggtggtggactacctcggacgggtggaccaccaggtgaagatccgaggcttccgcatcgaactgggagagatcgaggcgcgcctgcgcgagcatccggcggtgcgcgaggcggtggtggtggcccagccgggtgcggtgggccagcagttggtgggctacgtggtggcgcaggcgccggcggtcgcggattcgccggaagcgcaggcggagtgccgggcgcagttgaagacggcgctgcgcgagcgcctgccggaatacatggtgccatcgcacctgttgttcctggcgcggatgccgctgacgccgaacggcaagctggaccgcaagggcctgccgcagccggatgcgagcctgttgcagcaggtctacgtggcgccgcgaagcgatctggagcaacaggtcgcggggatctgggcggaggtcctgcaattgcaacaggtcgggctcgacgacaacttcttcgagcttggcggccactcgttgctggccacccaggtcattggccgcctacgcgaacgactgcacctggaggtgccgatcaagtcgatgttcaccgcggagacactgggtgagttctgccacggcgtcgagaccctcaaggccgagagcgcgccggtggaagatgccctggctaaatccctggaggcgctcaaacgtctatctgccgatgaacttgaaaaactgatttcctaa

SEQ ID NO: 9184 - DNA, 861 bp, Pseudomonas aeruginosa
ccgagaagcagaacgccccgcattgcggggcgttctttttcgcagccgggctcagaagtcccagcgagtgctgaacatcaggttccgtggatcgccataggatgccgaggtgtagaaaccgatgttggtgtagtaggtcttgtcgaagacgttgttgacgttgacgctggccgacagcttgtcggtgatctggtagcgggccatcaggtccaccagccagtagtcttcctgggagaacttttcccagcggctgcggggattgttgtagaccatctgccagctcttgccctgccagcgggtgccgccgccgaccgtgagcttgtccagggcgcccttgaacttgtagctggtgtagaggctcaactggtcctgaggctcccaggtggaaaccttcttgccactgtcgtcgcgaatgatcttgtgggtatagccagcctgaacctgccagcctggcgccagttcacccgagatttccgcctcgtagcccttggtcttggccttgatgcccttgtaggcgtaggtgatggcggggttggtcggtttgctgttgtagagggcgtcttcctccgcgcggttttcctcatgaatctcgaagtaggcgagactggtattgagtcgtccgtcgagatattcacccttgatgccgatctcgtagttctggccttcgtcgggttcgagcagcttgttgctgctgtcgcgataccaactgtcctgcggcatgaagatgtcggtatagctggcgtagacggagtaggtatcgttcaggtcgtagaccgcgccgacgtagggaatgaagcgtccggactcgcgaatggtcggattcaggccggttacccggtagtcgaccacgcgtccacctag

SEQ ID NO: 9185 - DNA, 1644 bp, Pseudomonas aeruginosa
gaacaggttcaggtcatcggtcacattgaagcgggcggtcatgtagctgcccaactggcgggtcttgtcatcgatgtactgggagggggtaccccagtcgggcttgcctatatcgccgtcccagttgatgaagtcgtcggtggtgttgtcgtagttgcgcaggttccagtagctcttgccctcccagtgggagaaggaagccgaggtgccgaccaccagctcgtgctcgcgaccgaggaactggaaggggccggtgagatagatatccagcgagttgctcttggtttcgccggtgtacttctgcgcaacgatcttggcgctgttgtccggtgccggccagtcgcccatgatcgcgccgaggggcgcgtggtagccgttgatcttgtgatcgagctgcaccttgccgacccagccgttggcgaaattgtgctcgaggttggcgaagacggtgcgggtgtactgctcccaactgctccacttggctccgttgttgaaggagcgggagacgtcgttgcggttgccctggctgtcgaagagcgggaagctgcccgaccagcccgatcccttgggatcgttgtcctgatagtcggcgccgacggtaagcatggtgtcgggattcagatcgaactcgaggatgccgtaatagacgctggttttgcgctcgtagtgatccatgaacgagtgcttatcctggtaggcggctaccgcccggccgcggacgttgccggactcggtcagcgggccgctgacgtccagttcggagcggtaattgtcccaactgcccgcgcccagttcgacatggcccttgaattcatgggtaggtttcttgcggatcaggttgatcgtggcgccgagggaccccgcaccggtgagcaggccggtcgcccccttgagtacttccacccggtcgtagatggccatgtcactgagcgtattgcccgcggagtagccgacgttgcgggccgtcgagggaatcccgtcgtactggaagttgttgatcgagaagccgcgggcatagtagttgttgcggtcagtgtcgtaggccgagacggtgatgcccggcgtatggcgcatgacgtcgtcgatgttgttgaggccgaagtcgtccatgttctggcgggtgaccacggtgatcgactggggcgtctcgcgcggagtcaggaccaggcgggtcgccgtggcgatagtgcctggcgtataggagccgctgtcctcggtgatggtgcccaactggttggaggtgatcatggtggcgccgagatcgacgctgctgtccgccgcctcggcgacgctgatggttatcgcattgccctggaagtccaccgatgcgccggtgccacgaagcagctcggtaatcgcctggttcggctccagcttgcccttgatcgcactgctacgcttgttccggacctcttccgggcgatacagcacctggatatccgcctggcggccgaactcctggagtgcgctgcccagcgcctggggagggatgtcgaactcgacttcctgcgcctggacatatcccgccagcggcaggctcagggccatggcgagcgagtggggaagaatcctgcgttggaaggcacggcgcatcaaaaacgccttactcagaggactgagaccgtgtggtgctggcatgggtga

SEQ ID NO: 9186 - DNA, 1227 bp, Pseudomonas aeruginosa
cgttttacccacggaaaaccggatgaaaaagtttcacgccgtctcggtttccttgacgaccttgcctgccgagagccttatcaactggtccgccatttcgaaatagcgatcatcgtggctgatcacgatgatggtcttgccctggcgtttcaggtccggcaacagttcggtgtagaagaccctgcggaaagccgggtcctggtctgcggcccattcgtcgaagaccaggaccggtcgctcttcgagccaggcattgatcagcgcaaggcgcttgcgctgcccggtggagagatcggtggtgctgaagttgccgtccatgacgctgaccttgtgggcgatttccaggcgttgcagatattgggtcgcgttctgcaacgaagcctgcttgccctggaccaggtcgtcgaagaggtagtagtcggcgaagatggtgctgaagagctggcggtaatcgtcgcgggtctccgcgctgaccggttctccgttgagaaggatctcgccggactgcgggcgatagaggccgagcagcagcttgatcagggtcgtcttgccgcagccgttctcgccgacgatgaagacgatgtcaccttgggcgatacgcagattgatagggcccagatggaacggttcgctgccttcgacggcgggggggctgtagcgaacgtcgcgcagctccaggctgtcgacggtcttgtccggggcctcctgttcgctgagcagaagatggggttcgggagaggaaaaacgctcggaaagttcggcgacccgctggaaggcgacctgggcgcggctgacgatgggaaggatggtcaccacctgttcgagtggtcccttcatgtacagcaggaccatcacgaagccagtgatggcggccggattggacgaaggccagtaggcctggagcgtaagcgccagaccgatcaccacgaagaacagcatcgagccgaaggtcttggccaggatgaatatattgatggagctgatgtggaggtcgcggatgttgttcgcggtttcgctgatgcggccggtgtgcatgcgatagcgacgggggcggtggatgcgcagttccttcgcgcccgaagcgatggcggtgtagtgcttctgcaattcgtcttcgagatcgcgggcggcatagaaccctttgaaaccgcgggagcgcgccaggtactgggctgccgtgccgatgacgatggcgacgactgtcagcaggaacatcgggaccgatag

SEQ ID NO: 9187 - DNA, 468 bp, Pseudomonas aeruginosa
gggttgcggaaagtgtcggcggcgcggttggcgccggacgacagcgaggcgctcagggtcagcttggggaacagcgccgcgcgcgccacctgcacgtcggcctgggccgcggccagttgcgcttcggcgttggcgatatcgggacggcggctgagcagttcgctcggcaggcccgctccggtctccggccagcgcaggctgtcgaaaggccgctcggccacctgtagcgcctgcaccggctcgccgatcagggtggccagggtaatcagcgcctcatgggcctgctgctcgagcagcggcagctgcttgcgctggctggcgaccaggctgctctgctgggcgacctccagggcggtggccgagcccgcggcatggcgggtctccaccaggcgcaggacgtgctcggcgttgtccaggttgagcctggcgatgcgctgctgttcgcgcagcgccaatacctgcaggtag

SEQ ID NO: 9188 - DNA, 423 bp, Pseudomonas aeruginosa
tatggccgccgttcatcagcgcgcgggcgatcgacacccgctgctgctggccgccggacaactggtgcggacggttggcggtgcgctcggccaggcccaggcgttcgagcagggcccgcgctcgggtgtgccgctcgctcgccgggatgccggcgtagatcgccggcatctcgacgttttcctgggccgaggcggaggggatcaggtgatagccctggaacacgaagccgaatgcctcgcggcgcagccaggcctgctcgtcgctgtccagttcggcgacgtcgtggccggcgaagtggtagctgccggagctgggccggtcgaggcagccgaggatgttcatcagggtcgacttgccggagccggaggcgccgacgatggcgacgaactcgccggcgtggatcgacagcgatacgcccttga

SEQ ID NO: 9189 - DNA, 1353 bp, Pseudomonas aeruginosa
gtacctcgacttccggagtgccattgccgccgtagcgcttgcggatgtcgcgcagttcgatcagggggacgggttgcgtggcgttttccatcagctgtcgctgccgtcgggagcggccatcaacaggcggtcgccttcctccaggccggcaagcacctgtacccgcaggcggtcgctgatgccggtcctgatctggcggctctgcggcttgccattgctgccgaccacccaggcgacctggccgcccttgccgtcgtcgtgaatggcggcgaccggcgcggtgaggatgttttccgcggtggcggcgacgaagaacacctgggcggtcatttccgccatcagttggtggtcgccgttgtccacgtcgaccagcacggtatacagcaccacccggccgctgccgctctgcccgccgctgccgctggtggggctgccgccgccctggttgctctggtccagcggcttgggcggcaccgggaggatctgccggaccttgccggtccagcgccggccttcgccgctgagggtcgtgaagtaggccggcatgccgggcttgacccggccgatgtcggcttccgaaacctgggcccagacggtcatcggcgacaatttggcgatccgcaggatcaacggggtctgctgctgggcattgagggtctggccttcgcgcgcatcgaccgccaccaccgtgccggacatcggcgcgtagatgcgggtatagccgagctcggcttcgtcgctgcgcaacgaggcctgggcctggcggatctgcgcctggtacatctcgatccgtgcctgggtggcgagcatctgcgcctgggcgctctgcacgtcctcggtacgcgtcgcgccgccggcggccagccgctgctggcgctggtactgctggcgggcgagggtgtattgggcacgttgctcggccagctgggccttgagcatctcgatcgaatagcggccggcatcgaccttggcctgctgggtggaggggtcgatctcgaccagcaactggccttccgtcacatcgtccccggcctcgacgtgcaacttgcggatctgcccggaggcctgggcgccgacgtcgacgtagcgccgcggttgcagggtgccgagcgccgagacgctgctctcgatgctgccgcggctgacgctcacggtatcgaagctgttgctgcggaacggataggcctgccaggcggccagggcgatcagggggctgaggcagactgcgacgagcagtgcgcgacgagtactacgggttcgtctcattcgggaatccggccggtgcgtggagagaccgccgccgctggatcggcaggctgggcactgccagatatacgaggccagggcggctaa

SEQ ID NO: 9190 - DNA, 408 bp, Pseudomonas aeruginosa
ctcaggcaactgcaaccgccgtggttcacgatctcatcggtgtcggcttcggcccttccaatatcgccctggcgattgccctccaggaacgggcccaggcgcagggcgccctggaagtgctgttcctggacaagcagggcgactaccgctggcacggcaacaccctggtgtcgcagagcgagttgcagatctccttcctcaaggacctggtgtccctgcgcaaccccaccagcccgtattccttcgtcaactacctgcacaagcacgatcgtctggtcgacttcatcaacctgggcaccttctatccctgccggatggagttcaacgactacctgcgctgggtcgccagccacttccaggagcagagccgctacggcgaagaggtcctgcgcatcgagccgatgctga

SEQ ID NO: 9191 - DNA, 1215 bp, Pseudomonas aeruginosa
cgccaacctggagaacacccgggtactgcagcagtggtactcgatcaaccaggccagcgacgtcgccgatctgcgtcggcgcgtcgaggcgctacagggcatcccctgggtcaacaccctggccgcggacgagcagggcaacgccctgtacatgaaccagtcggtggtgccctacctgaagccggaactgattcccgcctgcgccattccgcaactggtcgccgaaggcctgccggccctccaggggcaggacagccgctgtgcctggagtcgcgacccggccgcggcccaggctggcatcaccccggcggcgcaactgccggtgctgttgcgcagggacttcgtgcagaactccaacgacagcgcctggctgaccaacccggcgagcccgctgcagggcttctcgcccctggtcagccaggagaagcccatcggtccgcgggcgcgctacgccctgagccggctacagggcaagcagccgctggaggcgaagacgctcgaggagatggtcaccgccaaccatgtcttcagcgccgaccaggtgctgccggacctgctccgcctgtgccgcgacaaccagggcgagaattcccttgcccgtgcctgcgcggccctggtgcagtgggaccgtggcgccaacctcgacagtggcagcggcttcgtctacttccagcgcttcatgcaacgcttcgccgaactcgacggcgcgtggaaggaaccgttcgatgcgcaacgtcccctggatacgccgcaaggcatcgccctcgaccggccgcaggtggcgacccaggtgcgccaggcgctggcggacgcggcggcggaggtggagaagagcgggattcccgacggcgcgcgctggggcgacctgcaagtgagcacccgtggccaggaacgcatcgcgattcccggcggcgatggccatttcggggtctacaacgcgatccagagcgtccgcaagggcgaccacctggaggtggtcggcggcaccagctacatccagctggtgaccttccccgaggaagggcccaaggctcgcgggttgctggctttctcccagtccagcgatccgcgctcgccgcactaccgcgaccagaccgagctgttttcccgccagcaatggcagaccttgccgttcagcgacaggcagatcgacgccgacccgcaactgcaacggctaagcattcgcgaatgataagcaatgcctatcagatctga

SEQ ID NO: 9192 - DNA, 948 bp, Pseudomonas aeruginosa
tctcgggcagcgggtaaagtctgccccatgctcaatcccgacgatttccgttttccttccatcgaagcgttgcaggcgttcgaagcggctgcccggctgggtaccttcgagcgcgccgccgaactcctgtcgatcaccggcagcgccgccagcaagcgggtttccggtctcgaggggatgctcggggtgagcctgttgcagcgcgacggccgctcgctggcgctgacctcccacggccgcgagtacctcgaacagatcgcgccgatcctcgcccagctcgcggcggttccgctgcatcgtcgccaggtccagcgccagcagcggctgaccctgcgcacgccgccgaccttcgcccggcagatcctgattccgcgcctggcgtccttcgccgaggcctgtccggaaatcgagctggagattctcctgtcgagtccttcggacggccaggacctgccgctggccgatgtcgaggtgcgcggcgacagccatggcgtggcggccggcgagcggctgctggaggagcgcgtgctaccgatggccgcgccggggctgctgctcggcctgccgcggccctggacgccagccatgctcgctggcctgccgttgctgcgctcgccgctggagccctggcagccgtggttccgcgtggccgggctggactggccggagccctgcgccgggccgcgcctgctcgatttgggcatgaccctggaagccgccgccaacggccagggcgtggccctcgcgcgaccctcgctggcgcgcgcctggcttgccgaggggcggctggtggtgctgttcccgctgcgttcggcgcccacccaccattaccacctgcgcagccaccaggcctcgccggccagccagcgtttcgccgcctggctggcggcgatctgccgcgaggcggtggcccagggcagggaattccttccggcggcggacgactga

SEQ ID NO: 9193 - DNA, 1248 bp, Pseudomonas aeruginosa
aacggcggaatttccttccgccgatgccgacaattattccgcctgcggcggtacgtcgcgctctaccatccagccacccccgaaggagtggactgcatgagcgtcatcaccgatatcgaagacctgcgccgcctggcgcgcaagcgcgtgccgcggatgttctacgactacgccgactccggttcctggagcgaaggcacctaccgcgccaaccaggacgacttcgccgcgatcaagctgcgccagcgggtcgcgcggaatatcgagaaccgctcgctgcgcacccgcatgctcggccaggagatggccatgccggtggccatcgcgcccaccgggctggccggcatgcagcatgccgacggcgagatcctcgccgcccgcgccgccgccgagttcggcgtgcgctacaccctgtcgaccatgagcatctgttccctggaggacatcgccacggaagtcggccagccgttctggttccagctctacgtgatgcgcgaccgcgatttcatcgaacgcctgatcgaccgtgccaaggccgccggctgcgacgcgctggtgctgaccctcgacctgcagatcatcggccagcgccacaaggacctgaagaacggtctctcggcgccgccgcggccgaccctggccaacctgctgaacatcgccaccaagccgcgctgggcgctgggcatgctcggcacccggcgtcgcggtttcggcaacatcgtcgggcacgtcaagggcgtcgacgacatgggctcactgtccgagtggaccgcccgccagttcgacccgcggctgaactggggcgacgtcgaatggatcaagcggcgctggggcggcaagctggtgctcaagggcattctcgatgccgaggatgcgcggttggccgccgactccggcgccgatgcgctggtcgtcagcaaccatggcggacgccaactggacggcgcgccctcgaccatcagcgcgctgccggcgatcgtcgaggcggtgggcgagcgcatcgaggtctggctcgacagcggcatccgttccgggcaggacgtgctcaaggccatcgccctcggtgcgcgcgggaccatgatcggccgtccctatctctacgggctgggcgcgctggggcaggccggagtgacgcgggcgctggagatcatagcccgcgagctggacctgaccatggccttctgcggccataccgacatccgcgaggtcggccgggacatcctgttgccgggaagctatccgcgatag

SEQ ID NO: 9194 - DNA, 567 bp, Pseudomonas aeruginosa
tctcccttcagtccgatgagagactcgccgcgcccatggggggcggcgcagtcgccgtgcgactccataaccagaaaccagaaaaggcgtgcaccgatgattaccctgaacctcaatggcaaggatcatcagctcgatgtcaccgaggatatgcccttgctctgggctatccgcgacgtcgtcggctataccgggaccaagttcggctgcggcatgggcctgtgcggctcctgcaccatccatatcgacggccaggccacccgttcctgcatcacgccggtgagcctggcgcagggcaggaaggtcaccaccatcgaccacctgcacaccgacaaggtcggcgaagtcgtccagcaggcctggctggacatcggcgtggcgcagtgcggctactgccagggcgggcagatcatgtcggccacggcgttgctgaagagcaaccccgcgcccagcgacgagcagatcgaggcggccatggccggcaacatctgccgctgcggcacctacaaccggatcaagacggcgatccacaacgcctccgccaagttgcaggaggccaaggcatga

SEQ ID NO: 9195 - DNA, 1116 bp, Pseudomonas aeruginosa
ccctgctcggcggcggtttcggccgcaagtccaagcccgacttcgtgctggaagcggcgatcctggccaaggcgttccccggtcgccacttgcgggtgccagtggaacccggggggaccatctgcatttcccccaatttcccacacagtatccggtggagcgcctgccaggccgtggtcggcgcccgacggggttccggcaggcttggctgcatcgctcggtggcgccgagcatcaccgcactgttcggcccggacagcaagctccagggcgccttcgacctgggcatgggcctgaccaacctgccgttcgccatccccaacgtgcgcctggagaaccccgaggccccggcgcacacccgggtcggctggttccgctcggtctccttcttccccctcgccttcgccatccagagcttcgtcggcgaactggcggcgaaggccggccaggacccgaaggactacctgctcaagctgctcggcccggcgcggcgaatcgacaccgccgaactcggcgacagctggaactacggcgagtcgccggagcgctacccgctcgatgttggccgcctgcgcggggtgatcgaggaggcggcgcgccagtccggctggggcggcgagctgcccaggggcagggcgcggggaatcgccgcgcactacagcttcgtcacctacgtggcggtggtgatcgaggtggaggtgaaggacgacggcgcgctgctggtgcacaaggccaccatcgccgccgactgcggtccgcagatcaaccccgagcgcatccgctcgcagctcgaaggcgcctgcgtgatgggcctgggcctggcggcgctgggcgagatcagcttcaaggatggcaaggtccagcaggacaacttccaccagtacgagctggcgcgcatgccgctggcgcccaaggcggtgtcggtgcatctgctcaagccggatggcgacctgccgttgggcggggtcggcgagcccggcgtgccgccgatagcgccggcgctgtgcaacgcgatcttcgccgccaccggcaagcgcatccgcgagttgccgatccgcaatcagttgcaggggtggcggaaggcctaggtccttcgtcctggtcgtcgtctgcgtga

SEQ ID NO: 9196 - DNA, 630 bp, Pseudomonas aeruginosa
gtccggcgcgataggcctggatgccctggggcgatggcgcccagggcggcctcctggcccatcaccccctggcccattcgttgcgccagggaacggatggcgtgggcttcgtcggcgagcatcttgcccaccgggatgccggtccagccggcgatcaccgcggccacggtacgcgagtccacctgctcgggaaccagcgggtcgtcctggcggatggcttcgaggccggccgccaggcgcgccagttcggcggccaggtggtcgatgcgaccgtccagttcctcgtcgggcttggccgcgtcggcgctttcgctgagggccagcagttcgcggcgggtgtcgagcagttcgcgcaccgcttcgcgttcctcgtcccagcgggtctccagctcgcggatggtccggcggttatcgcccgactcgctttccagggcggtgatacgcgcgctgtggtcgaggccggtggcctgttcccggcgcagccgctgcaattcctcttccagcgcctgctcgcgatggcgcaggctttccagcggcggcggcacgtcgtgctggccgagggcgacccgcgcgcaggcggtgtcgagcacgctgatcgccttgtccggcaactggcggccggagatgtag

SEQ ID NO: 9197 - DNA, 1038 bp, Pseudomonas aeruginosa
tgcagttccagcttgccggcgaccccgcgcagcatctccacggcggtggcctcgtccggctcctcgacctggaccagctggaagcgccgggtcagcgccgggtccttctcgaagtatttcttgtattccagccaggtggtggccgccagggtgcgcagttcgccgcgcgccagggccggcttgagcaggttggcggcgtcgctgccgccttccgcgccgccggcgccgatcagcgtgtgcgcctcgtcgatgaacaggatgatcggctgcgcgctgttgcgcacggcgtcgatcacccccttgaggcgctgctcgaactcgcccttcatgctggcgccggcctgcaacaggccgaggtcgagcacccgcaggatcacctcctgcaacgacggcggcacttcgccggcggcgatgcgcagggccaggccctcgaccaccgcggtcttgccgacgcccggcgcgccgaccaggatcgggttgttctgccgccggcgcaggaggatgtcgacgcactggcggatttccccgtcgcgcccgacgatggggtcgatgcgcccggcgcgggcctcggcggtgaggtcctgggtgtactggtcgagcagcgggtccggggcgctttccggcttgtcgccgcctgccgccggacggttcggcgcgggcggctgttcgcgggaggcctggatccactccagcaggttggcctgcaaggcctcgtggggaatccgcagcagcgacgacgcgctgttcagcaacagggcgcggcgctcctcgcggtcgagcaaggcgagcagcagcaggccggaacggatctgcgcctggccgagcacactggcgtgcaccacggcgtcttcgagcaggccgatggtgtgcgcggacagcgccggagtgcgggtattgccggccttgaacagctccagcgacaggttgatctcggcgaccagggcgtcgcgctccaggccgaagcgcggcagcaggcaggcgaagtcgccgccgtcgatgtccagcagctccagcagcaggtgctcgatctctacgtaa

SEQ ID NO: 9198 - DNA, 1599 bp, Pseudomonas aeruginosa
  unsure (1317): Identity of nucleotide at the above locations are unknown.
tgggtgcgttgcaggcagcgttgcgcggcgcgctccagggcgcggcgacaatccgggttgaggcggccgatcagggcggcgagttccatttcaagctacctccggctgccgcaggtcgagatcgatgcgctgccgctggccgtcttcgatgcgccgcaggccggtgttccagctcagcctgggcggtgtaccgcgctccaggcgcagcggcgcgccgccgctcaccagcaggctcaggcgacaatccaggtcggggccgaagtacagcgcggcgaggctggccaactggccatgggcgtcgccgtcggggaagaagcgggcggcctcgcgggcatccagcggaccgaggctgaaggcgatgccggcgtgttcgtcccaggtgcgcgtgccggctatggcatcgcgacccaggcgcaggttgcgcccgccgcgttgcacccgggctgcggctggccgtggggatttccttccaggcgccctggtatgcgtccagccgtgcctccacgccgaagtgctggcgcaccaggcccggcgaagccggccagggagcgacgcccgccggcgaacagcgcggtgcgtgccagcaccgcgctgtccggcagcgccaggcgctcatgcagggcttttggcaacaggccgttgagggcacgtagctgcggcctgcaccggggtcgccgccggcaccggggaaaccgagcgccaagcggatgcttggcgcagcacccggtagagcaggctgagcaggcggtgctggaacaggtcgaggaactcggcgggggcatggtccttctgccgggcgcgttgttgcagccattcctggtaggcatagggcaacgggccgtcggggccgccgaggccgaacaccggggtggacagcaccggttgctgcgggtcgtcgagcaggctttccacctcgctcgaggcgaacagcggcagcagcggcccgcgcaggcgcagggcctccgcccgcggcgcgttgccggtgcccagcggcaacgcctggggacgctcgcgttcgagcagcagcagcgcctgcaacagttcgaagcgctgcggcgtgcggcgcagccgctgactcagagggagagcggcgagccggcctggggttgccatgtcttcacctccttgtcggcttccaccaggaccgtgcgcacgaagcggttggcggtggcatacagcgagaagaactgcgccagcacggcggagaacagcacgccgctggcgccgacgaagtgctgcggatcgagtcgcaggcggatttccaggccattgcgccagccgcgccaggcatcctcgccgacgtgcgccaccacccgntggcagtcgagttgccgcagaccttctatctgccggcgggcgctggcgtcgtcgcgcaggttgtgcagggcgaggatttcccgcagggcttcgagggcgcgcgggccttccaccagcgagaggtggttgagggtcagctgcgagaccagtctccagcgcgattggccgtccaggcgcggctggctctgcgcgctgggcgcgttgcgcaggcgtgcggcggcgaccggcccgggccgttcgaagcccagcgcggtgccggcacccaggcgctcggccagatag

SEQ ID NO: 9199 - DNA, 579 bp, Pseudomonas aeruginosa
tctcgtcgagcagggacagggtctgggtcgaactctcgccggattgttcggcggcggatgacttgggcatggcggcttctccgggaagagggtcaggccggctggtcggccgggggttcgctgtcgccggccggggccgcttcggcttccgggcgggccgctttgatttcctgcaggccttcggtgttggccaccacgtcctgcagcaactggtcgaggtcgtcgttgccgtcgagcttggtcagcaggtcgcgcaggcgctggcgcgcttcgaacaggcgacgcaacgggaccacctgcttcaccaggttgaccgggtcgaagtcctcgatgtggttgaagcgcagctcgacgttcagcttgctgtcgtcgccgctgatggtgttgtcgacctgcagggtggcgcggggagagatggaggagaggatctcgttgaagttgtcgcggtcgatgtcgacgaaacgccgttcgaccagcttcgccggcggggtatccggcttgccggagaggtcggcgaggatgccgaccaccaggggcagctccttcttctcgatggcgttgccgatctcgacgtcgtag

SEQ ID NO: 9200 - DNA, 483 bp, Pseudomonas aeruginosa
actcccatgaagcacggatgtttcaccatatgtcggaaactctccctggcgctggcgatcctggcgctggccggctgctcgtatttcttcgcgccgcgggtcgagttgcagcggctgaccctggatgtcgccgcgcgcgccaacgacgactcgccgatcgccgtggatttcgtcgcggtgaaggatgcggagctgttcaaggaactggccggactgccggccagccagtggttcgccaatcgcgagcagtaccgccgcgactaccggcagcagttcgcggtatggagcctggagctggtcccggggcagttcatcgagtcggagtccttccccttgcgcggcgaccgcgcaactggacttttggtcttcgccggctataacacacccggcgcgcaccgcttgcgcctcgaccagcagcagcgcgtctggctgcgtctggatacccgggaaatgcgactggtcaacgatcccgccacgcgttag

SEQ ID NO: 9201 - DNA, 3999 bp, Pseudomonas aeruginosa
gcagcccgccgctgcgccgccacggcgtctgccggtgcgcgcagcgctgccggacggcttccgcctgggcctggcggtgctcgggctggtgctgttgatgagcggtatcggacacctgttctggcgcgacatccagcacgaaatggcggcggtgacccacctggccgatgcggagcaggcgccatgagcggcgcgaccctgttcatgctggttctcctcctggtgctgctggcgctgctgctgggggcgctgggctggtggtggcgaacccgcggtggtacggagatccgcagcttctacgcggcggtccggcagatggagcgcgagcagggctggcagggccgctacgaatcgccctggctgctgatgctcggcaacgagaccgagggcgagcagttgtgcgccacctggcgcctgctgccggtggcgcgtccggcctggttcggccgctggtggtcggacggcgagggggcgatcctgctggtgcccgagtcggtgttcctgcccgacgagggcctgcgccggcaaagcggcgcctggctgcgcctgttgcgtctgttcctgcgcctgcgcggcaggcgcgcgctggacggggtggtctggaacattccgctggcgcggttgcaggatggcgagcaggcggccaacctcggcctcgccgcgcgccgtcgctacgtggaactgacccagcgccttggcctgagcctgccggtttacgtggtgatcactggcctggaagacctgccgggtttccaggaacttctcgcggcgctgcccgaggaggcgcgcgagcgcgccctcggctggtcctcgccgttcgccgccgaagcggcctggcagtcgcgctggtgcgagcaggcgctggaggaaatcaccgccaccctgaccgagtcgatcgtcgaactcggtaccttgcgcggccaggtggacaatgagctgtattgcctgccgccacgcctggaaagcctccgcggttcgttgcaggcgctgctcgaaccggtcttccagggcaacgccaggggcgaggcgccgcgctttcgcggtctctacctgagcggcagcgaggcggcgggcgcggcagccgacgatgtcctgccggcggtcgacgcgccgcgtcggcgcagcagcttcgccagccaactgtgggcacggcggatccttgccgaggaaggcctggcccaggcggtgccgcgcatcctccagctgcgccagcgctggcagcgcgggatcggcctcgccgcgttgtgcctgtgcctgctctggggcggcctgatgacctgggtctggcgcgacgcgctgcgcgacgccggtgaactgtcgcaactgctgcatggcgccagtgagcgctaccagccgctcgacgacgacactcggcgcgccgcccaggtccggcagaacgtccaggcctggtggcaactggtgtcacaggcgccgcgctggcgcttcacttcgctggcgtttcccagttcctggttttcctccctggatgcacgtatcgacaacgcgtatcgccgcgtttccgagtgcctgctggtgcgaccgctgcgcagcctgctggaaggcgaggcgagcgacctgcgggcgatccgcagcgatggccaacccggcctgaaggagggcgacgaccccagccagtggaaggactacctggcggcgaaggacctggtcgcccgcgccactacgctggagcgccacaatcgcttgttcgcccaggccatcgacaaccgcaggacgccgctcgacgaccttctgcaactgagtaacgatgccttgggcagcagctacaacgccggcagcctggcgcgcctggcctattacaaccgcatgctgttcgccgagcgtccggccgatctcgccgccctcgacctgggccgggtcgccgccacggcggcggataacttccatgacctgatggcacgctggctgaacgcctacttcctcaccgacagcctggaacgcaccggcaatgccctgacccaggaactcgcgcagctcggccaggaacgagacgccacggcggcccagttgctggggatcggcgaattgatcaaccacctgcagcaacaggtcaaccgcatcaacctgatctggggcaatggcgtcggccaggatctcgtccctggctaccagaacctgctcaagagcgcccagcaaagcagcttgctgggaaaccgcgtggaggaactgcagaacctcaccgtgcagttgcagcagcagtttcgcagcgaatggatcgcgcctccggaggctgccggcgacggcctgctggtgaaacagggggcgacgctcaagctggccgatgacctgctcggtctgaaacgcgccatcgatgacctgaagaccaaggacttcgtctccgtggccctggcggacaagacactggcggaccactccttgctgagcatcgacgatatcggcgtgactcaggcgttgagcttcttcaacgacttcaccggctactacgagagcaccctgccatcgctcaacccgcgctatcgctattcggtcctgcacgccgccgccagcgcggcgaccgaggccatgtggcaaagcctcgggccgcgcagtcgtagcctggccagtcgcaatgcctcgcgtttcgacgtgcaggtcaagcaggtccaggtgttgcaggcggcgctgctggagttgcaggacctgcaggccggcgcgcgcctgctgctcagcctcaacgcgctggccgtggccgatatcggccaggccctgcgcgacatcgacgagcaggcggtgctgcgcgagccggtcgatttcagccgctggtcgggcgcgccgaatttcggcctgcagatgttccgcgcccaggacagtgccgagctgaagcaaagcctgaacagccagttcaatgccatggcggccgtcgccgaacgccacgccccggcgctggagtggttgcaggcgcagcaatccagcctggccaccgccgactacaacgcgttcgtgcgcttcagcgcgctcaacgccgaactgcagaaattcaaggccgacaacccggcgagcaccgcggcgcagttggcgaagctggtgggtaacgatttcaaccagatggacatcggcagttgcgccgacattctcaacggcgtgctcctgccgtccagccgcagcgacctggcgacgcgcctggtggacctgcgccagggcgcgctcgggcgctgccagtcgttgcaacagcagcaggcggcgcaggcctggaaggacctcgccgactacttcaaccagtacctcgccggacgcttcccgttcgcctacagcctggaagcggccgatgccgagccggggcgggtgcggcacctgctgaaactgatggagacgcgcttgccgcaggtgcgcgaagggctggcccaggttcgctcgccggacctgccggccgccgaggacttcgtccgccgcctggagcaggcgcagcgctggctcggcccgctgttcgagcgcgacaagtcgggcctgctcggcgtcgccctggacatcgactggcgcagcgaccgcagcctggaacgcggcgccgaccaggtgatcgcctggagcctgtactcgggcgaccaggaaagccgtttccccggcgcgcaggacaagggcctgacctggaatgtcggcgatccgctgaaaatcatgctgcgctgggcgaagaacggctcgcagcgtccggcagacgacccgcgccaggccagcctggcggtggccgacctcgaggccggctggagctaccagggctcctgggcgctgttgcgcatgatgcgcgcgcacttctcccggcagcgcccgccgaacgtcgactacacggagtttccgctggtcctgcaactgccggtgtatgcgccctacagcccggaaaacgaggcgcggatgttcctccgcctgtcgttgatgagcctgggcggcaagaccccgctgtccatccagccgctgccggtgcgcgcgccgcaatcgccgttcgcgacgctgttgccggccaccgtcgccagcacgggaggtaccccatga

SEQ ID NO: 9202 - DNA, 1161 bp, Pseudomonas aeruginosa
atacgaattcagaattttttaatctatgggttcctggggcaagatgggcgcacattccccggctcggaacccagcatgtccgtcatcacccatccccacgcccgcgagctgaccaaatcggtgcgcgccaccgtgctggtgttcaacgacccccgttcccgcgagctgctggagcgcatcgagcgcctggcgcccagcgaggccaacgcgctggtcatcggcgagaccggcaccggcaaggagctggtggcgcgccatatccacgccctcagcggacgcaacggcggcccgttcgtcgcggtcaactgcggtgctttcgccgagagcctggtggagagcgagctgttcggccacgagaagggcgcctttaccggtgcgttgcagagcaaggccggctggttcgaggcggccaacggcggcaccctgttcctcgacgagatcggcgacctgccgccgagcatccaggtcaagctgctgcgcgtgctgcaggaacgcgaggtggtgcggctcggttcgcgccggccgatccccatcgacgtgcggctggtggcggcgaccaacgtcgacctggctgacgcggtggtcgccggacacttccgcgaggacctgttctaccgcctgcacgtggcgaccatccaactgccgccgttgcgcgagcgccgcggcgatatcctgccgctggccgagtacttcatcgtcgagcactgccggcgcctcggctacaccagcgcgagcctgagcccggaagccgagcgcaagctgctcgggcattcctgggcgggcaatatccgcgagctggagaacgccatccaccacgcgctgctggtctgccgcaaccgtctgatccagccggccgacctgcacctcatcgacatgcgtgcgcgccaggagccgaacggcttgcgccgcgctcccgaaagcgccgccggctcggcgttggaggcggcgctgcaggcgctgttcgaggaaaaccgcgaggatctctacgagcacatcgaggaaaccgtgttccgtgccgcctatcgcttctgccacggcaaccagttgcagaccggacgcctgctggggatcagccgcaacatcgtgcgcgcccgcctggagaagatcggcgagctggaaacctcgccacggcacaacgtggtctcgctggtgggcaagtga

SEQ ID NO: 9203 - DNA, 990 bp, Pseudomonas aeruginosa
caggccgaggccggaaacccgccgcaactgcccggaaaatgcacatttccccgttggtacggcccttgctccagggcactgcacctagcgcaacagtccacagggaaatcccatgaccagccccttcaaagtcgtcgccgtctccggcggcacctatcgcccgtcccgcaccctggtactcacccaggccctgatcgccgagcttggccagtcgttgccgatcgacagccgggtcatcgagctgaccgacatcgccgcgccgctgggcgctaccctggcgcgcaaccaggcgccggcggaactgcaggcggtgctcgacgagatcgaaagcgccgacctgctgctggtcgcctcgccggtctaccgtggctcctatccgggcctgctcaagcacctgttcgacctgatcgacctcaacgccttgatcgacaccccggtgctgctcgccgccactggcggcaccgagcgccacgcgctggtcctcgaccaccagttgcgcccgctgttcagcttcttccaggcgatcaccctgcccatcggggtttacgccagcgaggccgacttcgacaactaccggatcgtcagcgagccgctgaaggcgcgcatccgcctcgccgccgagcgcgccgcgccgctgttcggcggacgctccgaactgttgaagatcgcctgaggtgcgccgatgaacgtgttctggttcctcccgacccacggcgatggccacttcctcggcaccagccagggcgcgcggccggtctcgctgccttacctgaagcaggtggcacaggcggccgacagccttggctatcacggcgtgctgatccccaccggacgctcctgcgaggactcctgggtggtggcctcggcgctggcgccgctgaccgagcgcctgcgcttcctggtggcgatgccgtccgggaatcgtttcgccgaccgtctcggcgcggatggcggcgaccctcgaccgcctgtccggcgggcgcctgctga

SEQ ID NO: 9204 - DNA, 345 bp, Pseudomonas aeruginosa
tcgaacacatctccgacgagaccatcgccgccgcgcagcagtccttcgcccgtttcgactccgaaggccagcgacgcatggccgcgctgcacggcggccgccgcgatcgcctggagatccagccgaacctctgggccggggtcggcctggtgcgcggcggcgccggcaccgcgctggtcggcgatccgcggcaggtggcggagcgcatcggggaatacgccgagctcggcatcgacagcttcatcttctccggctatccgcacctggaagaggcctaccgcttcgccgaactggtcttcccgctgctgcccgaaccctacgccagcctggccggccgtgggctga

SEQ ID NO: 9205 - DNA, 2379 bp, Pseudomonas aeruginosa
tcgccaacgacgtgctgccggctcgcgccggcgcttgagcagccgggcccccgaggagaaaccccctgtgaatgcgaagacccgccccgaggcgcaaacgccgttgcagatcgcccggcgcctggccgccgatttcgccgagaacgccgccgagcgcgacgtcgccggcggtaccccgaaggccgagcgcgacgcgttgcgccgcagcggcctgttgtcgctgatcatcccgcgcgaatacggcggcctgggggcgagctggagcgaaaccctgcaaaccgtgcgcgaactggcccgggtcgacagctcgatcgcccacgtctatggcttccagcacctgatgctggccaccgtgcgcctgttctcgcggcccgagcaatggcagccgtggttcgagctgaccgcgcgcaaccgctggttctggggcaacgcgctgaacccgctggacaaccgtaccgtggcccggcgcttcgacggctggcgcgagttctccgggaagaagagcttctgctccggcgcccgcgattcggagatgctcatcgcctcggcactggacggcgagggcggggcgctgctgattgccgccatccccaccgcgcgcagcggtatcagcctgggccaggattgggacaacatgggccagcggcagaccgacagcggcagcgcgatcttcgagcgggtgcgggtggaggagagcgagttgctgctcgatcccgggccgctgagcacgccgttcgcctgcctgcggccgctgatcgcccagttgatcttcaccgaggtgttcctcggcatcgccgaaggcgccttcgaggaggctcgccagtacaccctgcgcgaagcgcgaccgtggttccgctccgaggtcgccgaggccaatgccgacccctatgtgctggcgcgctacggcgaattctgggtcggcctggaaagcacccgggcgctggtcgagcgcgccgcgcagcgcctcgacgccgcctggtccaagggcccggcgctggacgccagcgagcgcggccagttggccctggccatcgccgccgccaaggtcgccgcgacgcgcaacggcctcgacctgtgcaaccgcatgttcgaagtcaccggcgcccgctccactcacgccgccctgcgcctggaccgctactggcgcaacctgcgcacccagaccctgcacgacccgctggactacaagatccgcgagctgggcgactgggcgctgaaccagtcaccgccgcaaccgaccttctactcatgaacgcttctacccgtactcccgaccggctgctgacgctgccacgttcgccgaacctggcgacctcgatccgcgccaccgcccaggtcttcgaggatccgaagtcccaggccctgctcgaacacctgcgccaggtggcgccgagcgaggccagcgtgctggtgatcggcgagaccggcaccggcaaggaactggtggcgcggcatatccacaacctcagcgcgcggcgcaacggcccgttcgtggcggtcaactgcggggccttctccgagtcactggtggaagccgagctgttcggccacgagaagggtgccttcaccggcgccctggcggccaaggccggctggttcgaggaggccaacggcggcaccctgttcctcgacgagatcggcgacctgccgatgccgatccaggtcaagttgctgcgcgtgttgcaggagcgcgaggtggtgcgcctggggtcgcgcaagagcatccccatcgacgtgcgcgtgctggcggcgaccaacgtgcaactggagcgggcgatcaatgccgggcacttccgcgaggacctgtactaccggctcaatgtcgtcagtctcgaactgtcgccgttgcgcgagcgacccggcgacatcctgccgctgacccgccacttcatcgccgaatacagccgtcgcctgggctacggccagagccagttgagcccggaggcggcgcagaagttgcgtgcctattcctggccggggaacatccgcgagctggagaacgtcatccaccataccttgctgatctgccgcgacgggctgatccgcgcggatgacctgcacctgtccaacctgcgcctggagcgtggcgaggagctggcgcgcgggggcccggcgagcggcgccgccgagcacttgttgcagcaggctttccagcgtctgttcgaagagcagggcgagaacctccatgggcgggtcgaagatgccctgctgcgcgcggcgtaccgtttctgccacggcaaccaggtgcataccgccaacctgctgggactcagccgcaacgtcacgcgcacgcggctgatcgccatcggcgaactggtggtgaacaagcgcggtggccagcggatcgatggcgagcgggcggtgcggttgtcgatctga

SEQ ID NO: 9206 - DNA, 1326 bp, Pseudomonas aeruginosa
gttcaggcgctcgggatcgcggcgggtaagcgcaagcggttattcggccaacctcccgcgactatccgccgtgccggcgctgcggcattcgcccaaacccagccgggcgcagtagactcggcgctttgcggagcgtctggctccgcgctctgcgccaggtggaactgcccgatgcccgatacctctcccgatctgccggccatgtcgccgctcgccgtctatcgccaggccgtggaacagcgcggtttcgctcccgacgaggcgcagcggcgcgccgccgaggcgctggagcgttgtttccaggccctgcatgaagctcaccgccacggcgcgatccagggcgtctacctgtggggaccggtaggacgcggcaagacctggctgatggatcacttctaccagtgcctgcgcgtgcccgcgcggcgccagcacttccaccacttcatgcaatgggtgcaccagcgccagttcgaactgaccggtacagccgacccgttgcgcgccctggcccgcgagttggcgcgggatgtgcgggtgctgtgcttcgacgagctgttcgtcagcgatatcggcgatgccatcctgctcggcagcctgctgcgcatcatgttcgaggagggcgtggtgctggtggtcacttccaaccagccaccggagcagttgtacgccgacggtttcaaccgcgaacgcttcctcccggcgatcgaggcgatccagcggcacatggcggtggtcgcggtggatggcggccaggaccaccgcctgcatcccggccgggccgagcaacgctactgggtggtggaggcggggcaggcgagcggtttcgccgaactcttcgcgcgcctgagtgccggcgaagcggcatccacgcagcccatcgaactggggcaccgcccgctggcggtgcaccggcacagcgaatcggtgctctggtgcagctatgcgcagctctgcgaggcgccgctgtcggcgctggacttcatcggcctttgcgaccgctaccgggcgatcctgatggacgacctgccgtgcctgagcgccagccagcgcgaaggccgcatagcccgtggcaccgaggacggcgcgcaactggtggaggcgggggatcgcgaattgccgcagttgtcggtgcacgacgacggcgtgcggcgcttcatcgccctggtggacgaatgctacgaccgcaaggtgccgctctacctggaggccagggtgccgttggaggcactttataccgagggctacctggccttcgccttccgtcgcaccctcagccggctgcgcgagatgcagctggcacgcttcggcagcgacagcgccggctag

SEQ ID NO: 9207 - DNA, 618 bp, Pseudomonas aeruginosa
cagttgcaggccgcggccgccattgatcgggtcgttggcgatggccacgctggcgccttccggcaactctgcgaggctggcgtagcgcttcgaatagagcccgacgttgttgatgatccctggcgcgaacggcttcaactggaagccgccttcgcggttggcgttttccaggaagggcacgtgctggaagtagttggcgtcgatgtcgccctgggcgagggtgatgttgggggcgttccagtcgctgaactcgaccagttcgaccttcagtccctgcttgccggcttcgctcacggcgacttccagcggcggggcgaaggcggcggtggtgccgatcttcagcggggcgtcggcggcctgggccgggccgctgccgaggaggacggccaggctcagggttttcaaggtgttcagcatggtgggctcctgaacgaaagggaaagtggggtcaggcctggcgctggcgcgcggccgggggctggcggaaggcggcgccggcgtgttccgcctgcaggcgcgcgcggccgccgccgaagagcttctcccgcagggtgccgggggcataggcggtcttgtagctgccgcgtgcctgcaactcgggcaccaccaggtcgatga

SEQ ID NO: 9208 - DNA, 420 bp, Pseudomonas aeruginosa
tgtcctcggcgcgacggccggcgccgaccaccgccgcgcggatgcgctgcaccaactggcgggtggcctcgcgggtctgtccggagacgaacacgcattcggcgtggcgcgcggcgaaggccaggccacgctccgaggagccggcctggaacagcaccggggtgcgctgtggagagggctcggcgaggtggtagccctcgacctggtagaactcgccatggtggcggatcttgtggatcttctccggccgcgcgtagacccgtcgctggcggtcggcgagcaccgcgtcgtcttcccagctgccctcccagagcttgtagaggacctccaggtactcgtcggcgcggtcgtagcggcggtcgtgctcgatctgcgcggactggcccatggccttggccgcgctttccaggtagccggtga

SEQ ID NO: 9209 - DNA, 1404 bp, Pseudomonas aeruginosa
aggcgtttaggagaatctgcttcttgctcatggcggtcccttcggcgttcagagcgtgccgcggcgtggcggcaggcggccgttgaggtagtagtcgccgaccgcgtggtacttccagcgcaccgggtcgtgcagggtgtgtacgcgggcgttgcgccagtggcggtcgagaccgagttcggcgagacaggcgcggctgccgccaagctcgatcagcttgctgccggccagcagggcgacctcggtggtcagcgcgcgggcttcggcgacggcgatcgaggcggccgccacgctttccgcgtccggctcggcggtggcccggtcgagcacccgcccggcacgctccagcagcgcttcggcggcgtgcaggcggatcgccaggcggccgatctcatggatggtcagtgggtcgtcgctggccttgtcgacgccggagtcgacccagggccgggcgcgctcgcggacgaaacgcagggtgtcctcgaaggcgccgcgggcgatcccggcgtcgatcgccgcgtggaggatctgtgccagcgggccgacggtggtcgggcgctcgaaggcgtcctggaacgagaccacgtcctcggcggccaccgctacccggtcgaacagcgccgaaccgctgccggtggtgcgttgaccgaagccggaccagtcgtcgacgatttccagcccggcgctgtcgcgcgggacgaaggccagttgctggcggccctcgtcgtccaccgccagggtcggcacccgctgcgcgtagagtgcgccggtgcagtagaacttgcgcccgtccaggcggtagccgtcgccgtcggcgcgcaggcgggtacggcgctcgctggcggtacgcgtgccgatctcggccagggcgttgccgaaacgctcgccggccagggcggcgccgaacaggcgacctttctgcgccggcgagccgttcacccgcagcacttcgagggcgtagaaatggttctgcggaatctgccccagggaactgtcggcggcgctgacgatcgccaccaccttcgccagggtcacccgcgagacgccggccccgccgtattcgcggggcaccgcgatgccccacaggccggagcgggagaacagttccagttcttccagcggcaggcgccgctcgcggtcgcgctggatgctttcgcgggcgaacagggcggccagctcgcgggccgtttccagggcttcgtcgtcgctgccgatgcgatgggcagcggccgtgggattgtcgcgcgtagcgtgtgcgaggctcatcgggcgctcctcagatccatgagtgacgcgccggacgggcgccgttcaggtagtagtcgccgaccgcgtggactttccagcgcaccgggtcgtgcagggtatgggtgcgggcgttgcgccagtgccggtcgaggttga

SEQ ID NO: 9210 - DNA, 1203 bp, Pseudomonas aeruginosa
aacaagggccaggtcttcctcgctggccttgatcaggtgcgcatgactggcgaaggcctcgacccggcgccgccagaggtcgatgtccggctgcgggtcgaggcgcacgttgggatccaggctgaccaggcgccggccgctctcgcgccggaccagcgccagcagggtgtcggccaccggtgtcaccaccagggtataggatccgacgtgcaaaccgcgtatccgcccatccagcgtcggcaggtgttccaggcgcacctggcggtcggcgcagccgtcgccgcggaactggtattgcgccgagccgctggcgtccaggccgaccatcgccagggtggtcggggcgtcgctgggcaccaggaagccgcagtccacgccttcttcttcgagcacccggcgcagccgcgtgcccaggtagtcgctggacagcccgccgaacagcgccgcctccacgcccagccggcgcaggccgacggcgacgttgaacggcgagccgccggcgatcgcggtgaagcccagctcgttgctgcgcgcagcgctttccaggctgaagacatcgaaaagggcctcgccacacaccaggtacatgcagatctccaaaacgccagaagaggaaggaaagcgaccattatcgcggaggcaggtgctccaggtaacgccggtaggcctgttcgtaggccgcctgttgtcgcgcctggggctgggtgcgggtcgactcgtcgagcgccacgcagcgccggcacagggcttccaggctttcaccggcgccgctttcgcggcccaggctccaggccgcctggagcgccgcgccaagggcggcggcctcggtctgccgcggacagaccagcggcaggccgagcaggtcggcgagcgtccgccgccacagcgggttcttcgccgcgccgccgaccaggcggatttcctcgcccggcaggccgctggcgcgcagcaggtcgaggccgtagcgcaggccgaaggcggtgccttcgagcaccgcccggcaaagattggcgcggctcaggttggccgcggtcatgccatgcaggctggcgctggcgtgcggtagcgccggaacccgctcgccgtcgaagaacggcagcatcagcagaccctcggcgccgaccggcgcctgggcggccagccgggagaattcgtcgaggtcgaggtgcagcaggtcctgtaccaggccgcaggcgccggtga

SEQ ID NO: 9211 - DNA, 2139 bp, Pseudomonas aeruginosa
ggtagtcgtggggcaggaggatgtgcgcgacgcgggcgaacagctcgggaaagcggcgcctgctccagagcagcttggacagcgtgtagcccggcgcgagcaccagtcccaggcgttccagcgagccggccgggccgccgagggcttccagcagctcgcggttttccgccgcgctctcggtgtcgcaccagagcttggccgggcgcagcgcccggccctcggcgtcgagcaggagcagcccatgctgctgggcggaaaccgccagggcgcggacctcgcggccgtccaccgcggcttcttccagggccatgcgtaccgcgctggccatggcttccagccagtccgccggatcctgctcgcggcgtccgtcacggccttccggcgggcgctgcgcggcgctgcccaggcccagcgtgcggccgctgccggcgtcgagcagcagcgccttgctaccctgggtgccgcaatcgatgccgaggaacaatccgtgcatgcggccctccggcgtcattcgccgagtacctggcgcagggtttcgctgacgccgtgtcggcgcaggctgtcgtagagccgctcgaaggcctcgacgaaggccgccgaggccgggatcgccgggccgaacacggtctccacgccgagcaggcgccggcccaggccgcggcgttcggcaaccagcgcctggcattcggcggcgcgcggatcgggaatcgggtagcgttcgccatgctcgtcgaccccgcccaggtacagcgcccaggccgccaccaccagggccacccgttccagcggccggccggcggcgatcagccgattggcggtggggacgatgaacttgggaaacttcgacgagccgtccgagcagacccgttccagttggtctgcgatggcgcggttggcgaagcgctcgaccaggctgtccttgtagcgttccaggtcgatccccggtaccggtgccagcagcggggccacgtcgcggtccatgaaggcccgcacgtagcggcgcagcagcgggtcgccgagggtctcgtggacgaagcggtagccgcgcaggaagcccaggtaggtgagcgccaggtggctgccgttgagcaggccgatcttcatctcctcgtagggcgtgacgtcgtcggtgaactgcacgccgaccttttcccaggccgggcgcccagcgctgaaacgatcttccagcacccattgcacgaagggttcgcagaccaccggccaggcgtcttccacgtcgtgccgttgggccagttggcggcggtgggcggggctggtcatcggggtgatgcggtcgaccatggcgttgggaaagctgacgtgcgtcgcgatccagcgcgccagccccgggtcgagccgttcggcgaaggccagcagcgccttgcgcgccacctcgccgttatgcgggaggttgtcgcaggacatcacggtgaacgccggcacgcctgtgtcgcggcgccgccgcagagcctcgcagagaaagccgaagaccccgcgcggggtccgcgggttggccaggtcgtggcgcaccagcggcaactcggcgaggaactcgccgctgccatcgtcgatgcagtagccgccttcggtgatggtcagcgagacgatgcggatggccggctcggcaagtttttccagcagcgcctcggcgccgtcctcggcgagcagcatgccgctgatggcgccgatcacgcggacctcggtgtccggttggtcgcccagctcgtagagggtgtagaggtagtcctgggcggccagggcgtcgtgcatggcgcggtcgtcgctgcgcaggccggcgccgcagatcgcccagtcgagggcttcgccgcggttcatcagggcgtcggtgtaggccgcctggtgcgcgcggtggaagccgccgacgccgatgtggacgatgccctggcgcagttgcgcggggtcgtaggacgggcgggcgacagcggtcgccagcagggggaggtgctgccggttgagtttcatcggtgggttcccgctggcggcttcaggccgcctgttgcagtcgtttgtcgagggcctggccgttgctgtcgaacaggtggcagtgctccggatcgaagcccagctccaggggggcgccgtagtccggtgcgaaatcgccgcgcacgcgcagggtga

SEQ ID NO: 9212 - DNA, 420 bp, Pseudomonas aeruginosa
gcaccacgaccttgtccgccagggtcatcgcctcgacctggtcgtgggtcacgtagatcatggtcgccgccagttcctggtgcagccgcgccagttccaggcgcatctgcacgcgcagggcggcgtcgaggttggacagcggttcgtcgaagaggaatatcttcgggttgcgcacgatcgcccggccgatcgccacccgctgccgttggccgccggagagctggcgcggcttgcgctccagcagcgcttgcagttcgaggatgcgtgcggcggcgtcgaccttggcggcgacctcgcgcttgtcgacgccggccaggtcgagggcgaaggagaggttcctgcgcaccgtcatgtgcgggtacagcgcgtaggtctggaagaccatcgccaggtcgcgtttcgccggcggggtgtcggtga

SEQ ID NO: 9213 - DNA, 1506 bp, Pseudomonas aeruginosa
tcggcgggcagcccgctcatcggctccagccagcccttggcgccccacagcgcggcttcgtacatgccgatggtgagcaggtcgagctgtccgccctgggtggcgatgtcggtggtcaggcgctggcgcaggacgttctcttcgagcaccacccatttcagcgcgatgtccgggtggctttcctcgaacaccttggacaggcgttgcatgcggatcatgtcgttgttgttgaccgtggcgatggtcagggtctcggcgccctgggccagcaggggcagggcaaggcaggcggcggccaggcaggccttgatcgagtcgttcatcggtgaactcctcttccgggccggcgggcggcgcggaagacattattgtttttgtgtcgctcgctgccgattacacaggcgcgtcacgcaaccgacaaagcctcgactgcacttcgaccgatacttttttgcaccgccggggtggggcgctggaggctcagagcaggttctgctcggtcagccgctgggtcaccaggcgccggtagccggtgggcgtcatgcccttgagctgctggaagcgccggttgaaattggacaggttgctgaagcccgactcgaagcacacctcggtcaccggcagctcgctgcgggccagcagctcgcaggacttgctgatgcgcaggcggttgacgaactcgacgaagccgcgcccggcggcctgcttgaagaagcgcgagaagtaggtgggggtcatgcccaggtgggcggcgacctgctcctgggtgaggtcctgggcgtagtgctggaagatgtagtccaccgcccggttgatccgttcgacgttgtgctcgtcggccagttgcgaggaagtgacggtagagagcaactggtagtcctcgcattcggcgagctgttccatgaggataaaaaagtatcccaggcgggtcatgccgccgctgtcggcgatgcgttgcaacagtcgccggctttcgccgatcagcgccgggtcgcggaactcgatgccgtagcgcgcccgcgccagcagcggggccaggcggttcagctcggagaatacgccgctgccgtcctccagcacctcgtcggtgaagttcaccagcatgtcgcgccgggccaccacctcgtcgggctcaacctggctgatccagttgtgcggcaggttgggaccggtgaggaacagggtgtcgggggcgaagttgccgatgtagtcgccgatgaataccttgccggagctggcgacgatcaggtgcagctcgtattccttgtggaagtgccagcgcaccagcgggctggggaagccgtgctggcggtagatcagcgaatggccttcgtgatcgtccatcagctcgtaggagggatcggtgactttgctggctctgggcatgggcgcgggccgaccgggggaacgaaggcacatcctagcccgaagcggcggggctgtgcaggggaccacccgcgagcctcgctcccatgcgtggcgccgggtggccgcaggggcgggtag

SEQ ID NO: 9214 - DNA, 627 bp, Pseudomonas aeruginosa
ccctgggcgactacctgcgcgccgcgggagtccgcaccgcgctggtcggcaagacccacgccacggccaacctggaaggcatgcggcggctcggcatcgatccggccagcgcgcgcggcgcggccctcgccgaagccggcttcgagccctacgaccgcaatgacggggtctacccggatgacccggccttcgccgacaagcgcgaaagcgcgccctacacccactacctgcggcgcctcggcttcaccggcgacaacccctggcacgactgggccaactccgccgccagcgccgacggggaaatcctcagcggctggcggatgcgccatgccggattgccgacacgcttgccggaggcgcacagcgagaccgcctataccacccgtcgcgccatggatttcatcgacgagcagggcgagcgtccctggtgcctgcacctgtcctacatcaagccgcactggccctacatcgcgccggcgccgtaccacgcgctgtaccgcgccgaccaggtgctcccggcgctacgcgcggcgcccggcgaagaaagcgaccacccggtgtaccgcgccttccgcgaacatcgcgagagcctcaatttctcccgcgaagacgtgcgccggcaggtga

SEQ ID NO: 9215 - DNA, 435 bp, Pseudomonas aeruginosa
tccgcgatccgcgccccgaggcggacgccacccgcggccgggtggaggaggcgctggtgcagtccatcgacgtactgccgagcatcctcgaagccttcgccgtcgagcccgccagccatcgcatcgagggccgttcgctgctgcccttcgtccatggcgcgccgccggcggactggcgccgctacgccatcgccgagtacgactacgccttccaggcgccggcgcgggagcgcctgggccgacccatcgatgcctgccgcatgtacatggtgcgcagcgagcgctggaagtacatcgcctacgacggcttccgcgcccaactgttcgaccttgccagcgaccccggcgaattgcgcgacctcggcgccgacccggcgcatgcggcggtgcgcgaggcccatgccgggatgctgttcgactggctgcgcgggctga

SEQ ID NO: 9216 - DNA, 519 bp, Pseudomonas aeruginosa
ccaacctgcgcagcggcgatttcgtggtggcggcggcgatcgaacacggggagggcggcaagcccttcgtcctggcgattcccgaaggactcgccggcttgcagcgctcggcggacctgcgcctgctcggcctgcaatgcagcaacaccgccgccctcgatctgcgcgcggtggcggtcgggcgcgactggctgttgcacgacgacgcccggcagttcctgccacgggtgcgcccggccttcctcggcctgcaatgcggcatggccatcggcctggcgcgccgcgcactggacgaagtgcagcggcacctgggcggcagccgttcgctcctggatggcgagctggcggcacagcgcgaaaccctcgacggacacgtggcggcgctgcacgccggactggccagcggcgagttcgccagccagccggcacgcctgttccgcatccgcatcgggctcgccgaagccgccgccaatgccgtgcaactggagttgcaggccagcggcggcaaggcatacctga

SEQ ID NO: 9217 - DNA, 759 bp, Pseudomonas aeruginosa
gcgagcacggcgccggtttcgcccgccgctggcgcgagtcggcgttcgtcccgatcgttacgccgagcctggtgcaactgcgcgccgaactgcaacgccaggccgaggccaaggcatgagcgaggcgctcctcgacgctcgcgggatcgccctcggctatccgcgcggtgccggctggcaggcggtgctcggcgatttcgaattgcgcctgggcgccggcgaggtggtctcgatcctcggtcccagcggcgtcggcaagtccagcctgctgcgcgtgctggccggcctgcaggagccggccgccggcagcgtgcgggtactcggcgagcccctgcgcggaccgcatccgggcgtcgcggtggcgttccaggaccccagcctgctgccctggctgaacctggagaagaacgtcgccttcggcctcgatttcgcccgccagccgcacctcgacgcggccacccgccaggcccgcgtcgaccaggcgatcgccgcggtcggcctggagcacgcccgtgcccgctacccggcgcaactctccggcggcatggcccagcgcaccgcgctggcccgctgcctggcgcggcagccgaaggtgctgctgctcgacgaacctttcggcgcgctggacgaagtgacccgcgccgacatgcagcagctgctgctgcgggcgatccacgagcgcggcaccgccgtggtcctgatcacccacgatatcgacgaggccctgctgctctccgaacgcatcctgctactgggtga

SEQ ID NO: 9218 - DNA, 516 bp, Pseudomonas aeruginosa
gccgtgcggtgggcgcggcgctggccgccgacgaggtcaacctggtggtgctgccgccttcggacatgccaccggcgctggccagcaagcgcatccacggctacatcgtcgccgagccgttcaacgccctggcggagaacctcaaggtcggccgggtacagcgcttcaccggcgatgtctggcgcaaccacgcctgctgcgtggtgttcatgcacgaacacgacctggagcggcggccgcagtggtcgcaaaaggtggtcaacgccatcgtcaaggcccagctatggactcgcgagcaccgcgccgaggccgcacagttgctgtccaaggccggagccaaccgctacacgccgcacgcaccggaggtcctcggccgggtgctggcgccgggcgccgaggagcagcaggcctatctcgccagcggcgcgatccgccacgccgactggcaggagcgacgcatcgacttccagccctatccctatccgagctataccgaggaactggtgcggcggctga

SEQ ID NO: 9219 - DNA, 720 bp, Pseudomonas aeruginosa
actgctggaacgccgcgaactctacgagcacgtgctggtgagcctgaaacgggtcctgctgggcttgttcctggcgctgctggtgggagtgccgctggggctgctggtgggcgcctcgcgcaacctggaagcggcgaccactccggcgtttcagttcctgcggatgatctcgccgctgtcgtggatgcccatcgcggtgatgctgatgggcgtgggcgaccagccgatctatttcctgctggccttcgccgcgctctggccgatcctgctgaataccgccgccggcgtgcgccagctcgacccgcgctggctgcaactgagccgcagcctcgccgccacgccctgggaaaccctgcgccgggtgatcctgccgggcatcctcggccatgtgctgaccggcgtgcgcctggccatcggcatcctctggatcgtcctggtgccctgcgagatgcttggcgtcagcgccgggctcggctactacatcctcgacacccgcgaccgcctggcgtactccgagctgatggcgatggtgctgctgatcggcctgctcggctacctgctcgacgcggcggcgcgcggactctaccggcgctgggcgcacggggcgctcgggtagggcgaatagccgctcgcggctatccgccggacggggtaccggtgcgctggcggatagcgctggggcgctattcgccctacgggtcaatggggatgctcgggtag

SEQ ID NO: 9220 - DNA, 1566 bp, Pseudomonas aeruginosa
tccaccaacacttgcccagcagttgcgcccgcacagcgacaggggcttgccacccaggccttgtccggcgcggccccgcggcccggcacgggctgtgcacggggtgccggatgcacaggcaagccaaggagtccccatgccgcgcgaaatccgtctcaacgccttcgaaatgaactgtgtcggccaccagtcgcccggcctctgggcgcatccgcgcgaccgctcctcgcagtacaaggacctggagtactggaccgacctggcgcggttgctcgaacgcggccgtttcgacggactgttcatcgccgacgtgctgggcatctacgatgtgctcgacggcaatggcgacgcggcgatccgccaggccgcccaggtaccggtgaacgacccgctggcgctgatcacgccgatggccgcggtgactcgccacctgggcttcggcctgaccgcctcgctgtccttcgagcatccctatcccttcgcccgccgactctcgaccctggaccacctgaccaagggccggatcggctggaacgtagtgacctcctacctggaaagcggcgcgcgcaacctcggtcagcaggcccagctcgaccacgaccgccgctacgactatgccgacgaatacctacaggtgctctacaaactcttcgaaggcagttgggaggacggcgcggtgctccgcgaccgtcgccgaaggatcttcagcgacccgggcaagattcacgagatccgccatgtcggcgagcacttccaggtacccggcatccatctctgcgaaccgtcgccgcagcgcacgccggtgctctaccaggccggcgcgtcgagtcgtggcaagcgcttcgccgccgagcacgccgagtgcgtgttcgtcgccgcgccatcgaagaccgtgctcaagcaggcggtcgccgacatccgccagcgcgtcgccgaggccggccgcgatccgcgcaaggtactggtgttcaacctgcagacggtggtgctgggcgaaaccgacgccaaggccagggccaagttcgacgaataccgcgccttcgtcagctacgaaggggccctggcgctgatctccggctggaccgggatcgacttcggccagtatcggccggaccaggtgctgcggcacatccacaccaatgcgatccaatcggcggtggaagcgttttccagcgccgatccgacgcgcacctggacggtccgcgagctggccgactgggtcggtatcggcggcttcggaccgctgttcgtcggcagcccggcgaccgtcgccgacctgttgcaggagtgggtggaggacaccgacgtggatggcttcaacctggcctatgcgctggcccacgaaaccttcagcgacgtggtcgaattgctggtgccggagttgcagaagcgcggggtgtacaagaccgaatatgcgccgggaaccctgcgcgagaagttgttcggcgacggcccgcggctgccggattcccatccggcggccggctatcgcgacctgcgggccctctgggagaaggaggccgggcgcaacgcgctgccggcctgacctgggcggacggcggatga

SEQ ID NO: 9221 - DNA, 768 bp, Pseudomonas aeruginosa
cgccagtggcgatatccgccccagggcccgggacggctcctagagccaggcgtgccgcggtggcttcaccccattcaactggtagttgccgatggcatggtatttccagcgcaccgggtcatgcagggtgtgggtgcgggcgttgcgccagtggcggtcgagattgagttcctccagggtcgagcgcgtgccggccagttcgaacagccggttggcggcgagcagggcggcttcggtggtgagcaccttggcctcggccaccgcgatcgaggcggcggccacgctctcctcgtcgggggcggcgagcgccgcttcgatggcgtcggccgccaggtcgagcacggcttccgcggcgcgcacgcggatgcgcaggtcgccgacctgctggatggtgtaggggtcttcccaggcatgctgctggttggcgtctatccatggccgcgcgtggcggcgcacctgctgcacggtctcggcgaggatgccacgggcgatgccggcgtcgatggcggcctggatgaactgcgatacggcgccggcggcggtggggcggtcgaaggcgcggtgcaccgggatgacgtgctcggccggcacccgcacgttgtccaggatgacggtgccgctggcggggtgcgccggctgaagccggaccagtcgtcgatcaccgtcagccccggcgcgtcgcgcgggatgaacgccaggtgcgcgcgctgctcggcgtcgaggccgacggccggtacccagtgggcgagcagggcgccgctcgaatag

SEQ ID NO: 9222 - DNA, 2079 bp, Pseudomonas aeruginosa
tcggcgccttcggagagactggtggcggtggcttcgggatggacgcgggcgttcatgcggactcctggtaggcagcggggccgtccggtcgacggctaccctggagtccgggccgttgcacagcctgtgccgacccgcgcaggccactggttgcgcgggttcgcgcgagcaggaggtgttgccggggcggcagcctgttgcgcggctgctgcctggcggacagtgggggaggtggcggcaggtccctctcccggcgggagagggacaggcgcttcagaagatgtagtcggtggtgaggaagttcgacgcgcggttgcggatgatctcgctgaccagggtcttgttcgcctcggtgtcgcgggtcgccaccagggtgcggatggagaacacccgcagcgcgtcatggaccgacatggtgccttccgccgaattcttccggccgttgaacgggtagctgtccgggccgcgctggcactgggcgttgacgttgatccggccgacctggttggcgaaggcgtcgaccagccggccgatctgcgccgggtcgttgccgaacaggctcaactgctggccgtagtcggagcgcaggacgtagtcgatcacctcgtccagctcgcgatagggcaccaccggcaccagcggaccgaactgctcctcgtggtagaggcgcatgtccgggctcaccggactcagcagagcggggtagaagaaactttgccgatgctcgccgccgcccgcattgaccactcgtgcgcccttggccagggcgtcgttcagcaggccttcgaggtagtcgaccttgcccggctccggcagcggcgtcagcgccactcccggttcccacggcatgcccggcttgaggctggccaggcgcgcgctgaacttgtcgaggaacggtcgcagcacgctttcgtggacgaacaggatcttcagcgcggtgcagcgctggccgttgaaggacagcgcgccggtgaccgcctcgttcaccgcgttgtccaggtcgacctgcggcaggacgatacccgggttcttcgcgtccaggccgagggcggcgcgcaggcggtgcgggcgggggtgcagcttcttcaggtcgctggcgccggaatgggtgccgatgaaggcgaacacgtcgaccttgccgctggccatcagcgccgacacggtttcccggccgcgcccgtagatgacgttgatcactcctggcgggaagctgtcgcggaaggcttccagcaacgggcggatcagcagcacgccgaacttggccggcttgaacaccaccgtattgcccatgatcagcgccgggatcagggtggtgaaggtttcgttcagcgggtagttgtacggccccatgcacagcgccacgcccagcggaacccggcggatctggccgagggtgccctgttccagttcgaaacggctggagcggcggtcgagttccttcagcgcttcgatggtatcgacgatgtagtcgcaggtgcggtcgaactctttctcggagtccttgaggttcttgccgatttcccacatcagcagcttgaccaccgcctcgcgttgctcgcgcatccgcgccaggaagcgttcgacgtgctggatgcgctcggccacccgcaggttcggccacaggccctggccgtggtcgtaggcccgcaccgcggcgtcgagcgcggcgagcgcggcgtcggcgtcgagcagcggggtgctgccgaggatcacctggcgctcgccgtcggcctcggcgaggaataccgggctgcgtaccggcgccagcgggccgtcccaatatcgcagttggccgtcgaccaggtagtcgcgctgctcgatgggggcgtcggggcggtactgctcgggaatggcgtcgaggctgggaaacagcgaatcgaggtggagcggggcggtcatggcgggtcctcgaatgacgtggatgaaaggcgtgggactgttgtagcgcggtccggatcgaaggtaaatcgtttcagcaggaaaaccgtcgcgcccttgccggaaatcagcctttgctcccgcttcgtggggggcgggagcaaaggcatggcgccggctggcttcaggcgtcggcggtag

SEQ ID NO: 9223 - DNA, 651 bp, Pseudomonas aeruginosa
gctcttcgcggggccgcgccggcggtggctcaagcagttcctgctgctcggcatagcgctggcggatatcgaagtcgcgcggccagcgcgaggcttcgtggtcggggcgttgcattggttcggtcatggctgaactccggtcgggctggtgctcagagcaccagcgacagcaacaggatgaagaccaggccgaccacggagaggatggtctccatcgcggtccaggtcttgaaagtctcgctgacgctcatgttgaagtactgcttgaccagccagaacccggcgtcgttgacatgggagaggatcagcgagccggcgccggtggcgagcaccagcaactcgcggttgacgccgggaatcaggtcgatcaccggcaccacgatgccggccccggtgatggtggcgacggtggccgagccggtggcgatgcggatcaccgcggccaccagccaggccagcaggatcggcgagatctgcgcgttcaccgcgagatggccgatgacgtcgccgaccccgctggccaccagcatctgcttgaagccgccgccggcgccgatgatcatcacgatggcggcggccggtgccaggctctggtccagcagcctgaggatcttctccagttcaaacccacgggcgtacccgaaggtatag

SEQ ID NO: 9224 - DNA, 1362 bp, Pseudomonas aeruginosa
gcgcgcttgagggcggaacaggtcagtaccggcagcttgccggcggccaccgcctggcgcagctgctcggcgagggtgtccagccagccggcgcggtcgtcgtcggtgaggggaatgccggcgctcatcttgcggatgttggcggcgggatggaagctgtcgccttcgatgccgtgggcgccgctgcgctggcaaagggcctggctgacgctggacttgccgcaaccggcgacacccatgatgaccagggcttggaggggtggatgcatggaacacctcaagcgtgagacagcgctatctttgcgacctggaaaaaatcgcgcgagcctggctccgccttcttgtcgttgtggtctgtcgaatcccgcgcgggcagtggcggacaggccgcctcaggcgattgcccaggtcgcgagacagcgctaccttagtgcctggaattttgtttggcaagcaggccacgatgagcatcaccaagaacgacaagaacacgcgaaccaccggacgtcccaccctcaacgaagtcgcgcgccgcgccggggtcagcccgatcaccgcgtcgcgcgcgttgcgcggcgtcgccagcgtcgccgaagaactggcgcagaaggtccgcgacgccgcccgcgaactcggctacgtggccaaccccgcggcgcgcgcgctggcctcggcgcaaagccacagcgtggcggtgctggtgccgtcgctggccaacctgctgttcatcgagaccctcgaggcgatccacgcggtactgcggccgcagggcctggaagtgctgatcggcaacttccactactcgcgcaacgaggaagaggacctgatccgcaactacctggcctaccagccgcgcggcctgctgctgaccggcttcgagcgcaccgagagcgcccggcggatgatcgaggccagcggcattccctgcgtgtacatgatggacctggactccggctccgggctcaattgcgtcggcttctcccagttgcgcgccggcgaggccgccgccgagcacctgcctggcacgcggccgcaggcgcctggcctacatcggcgcccagctcgaccagcgcaccctgctgcgcggcgaggggttccgccgcgccttgcaaaaggccggctgctacgacccggggctggaaatccttacgccgcggccgtcctcggtggccctcggcggcgaactcttcgtgcagttgctggccagccagccgcaggtcgacggggtgttcttctgcaacgacgacctggcccagggcgcgctgctggaggccctgcgccgtggggtcaaggtgccggaacagatcgccgtgctcggtttcaacgacctgccgggttcggactgcacggtcccgcgcctga

SEQ ID NO: 9225 - DNA, 1254 bp, Pseudomonas aeruginosa
aacggaactctatccgtctttttccgcttttgcagcgctcttatcctgtccgcatccttcatctgcggagagtcccgcatgtccagtttcgaacgagagccaggctgcggcctggcggaaaatgtcgatcaggtgatcgaggcggcattcgccgaccagcgcctggtgggggcggtggtgctggtggcacaccgggggcagtggctctatcgacgggctgccggcctggccgaccgcaaatccggccggataatgggcgaggacagcctgttccgcctggcctcggtgagcaagccgatcgtcagcgtcgcggccctgagcctggtggacgagggccggctggccctccatgagccgatcgccgactggttgccggcgttccgtccgcgcctggccgacggccgcgaggcgcgcatcacgccgcggcagttgctgagccacagcgccggcctcggctatcgcttcctcgaagccgacgcagacggcccctatgcccgcgccgggatttccgatggcatggacctgccgggtttcgacctggccgagaatctccgtcgcctggcctccgtgcccttgctctacgaacccggccgcgcctggggctattcgctggccaccgacgtgctcggcgcgctggtggagcgggtcgacgggcggccgctggcggaagcgctgcggcagcgggtcgggattccagccggcatgcgcgacagcggcttcctctgcgccgacgcgtgccgactggcggcggtctacgtcagcgaccggccacgcccgcgccgaatggccgggcgggagaccgtggcgccgttcgaggacagcgtcggcattcgcttcgagccgagtcgggccttcgaaccgtctgcctatgcgtccggcggggcggggatgatcggcagcgccggcgacgtgctgcgccttttggaaatccttcgccagggcggcgcgccgttgctgacgcctggcctggcggaggagatgggccgcgaccaggtacccggcctggaactgccggccaatcccggtttcggcttcggcctgggtttctccgtgctgcgcgacccggctatcgcgcaatcgccggaggctcccggcacctggcgctggggcggcgcctacgggcattcctggttcgtcgaccgggcccgcgaactgtcggtggtggcgcttaccaacaccctgttcgagggcatgtcgggacgcttcgtcaacgacctgcgcgacgccgtctaccgttccgcggagctgcgctga

SEQ ID NO: 9226 - DNA, 765 bp, Pseudomonas aeruginosa
gtccgtttcgaatatccatcgcgtcgaaataccggctgtgacgatgcgttcctccgccatgcagcggaatccgctgtcattgcgccgaacatcttcgctgtctcgccgctagccaccatgcagcgcccggctcggctgttgcaccggcatcttgccggtgcgtcggcgctgcctagaatcggccccattcgcacctacccccgcttcgcctacaggagttaccgccatgatgaatgccatgcagatgccgatgaacatgaatgccgccatgccgatgatgcccatgatgggcatgccgatgatgatggcgaccatgcagtgcgaaacgatggacgacggcatgctgtgcaagatgatgccggcgatgggcatggacatgggccagttccgcaacagcgccgagatgatggcgatgatgatgaactgcggcatgcccatgataatgcagtgcggcaacctggcgatgatgggcatgtcccaggcctgcatggcgatgatgccgacgatgggcatggggatgggcatgccgatgatgggcatggctccgatgaagtgcatgatggagtgctccatgcagggcgacgccatgcactgcaggatgatgccgatgcagggcatggacatggagatgttcaagaactgctgcatgctgatggcgaagatgatggagtgcggcatgccgatgatgatgagttgcaacggcatgccgatgatgtgctgcacctgctgatccgtcgccggatggaaaaggcccgcccgggatga

SEQ ID NO: 9227 - DNA, 1014 bp, Pseudomonas aeruginosa
ttttcttattccaataaattaaagactctcgcgtacctgccgaccaatcggcgcgccgcaccgaatccatgccgccttgcgcggtatctcgtgcctggcgtgtccgggcttgcgtgggagtcagcgatgtccgtttcccttccggcgccagcgcgcgccgacgttcctttgcagatccgtgccctcgatgccgcattcggcgccgaggtgctcggcctcgacctcgggttgcccctggccgccgaggacttccgccgtatccaccgggcgcacctggaccaccatgtgctggtgttccgcgagcagcgcatcaccccggcgcagcagatcgccttcagccggcgcttcggtgagttgcagatccatgtgctgaagcagttcctgctcccagggcatccggagatcctcatcgtttccaacatcgtcgagaacggccagcccatcggtctcggcgatgccggcaagttctggcactccgacctttcctataaggagctgccgagcctcggctcgatgctgcatgcccaggagctgccggaggagggcggcgatactctgttcgccgacatgcacaaggcctgggacagcctgccggaagccctgcgcaaggccatcgagggacgcacggcggcgcattcctataccgcccgctacagcgaaccgcgcttcgagggcaactggcggccgaccctgagcgccgcccagctcgccgaggtgcgcgaagtggtccatccgatcgtgcgcacccacccggaaagtgggcgcaaggggctgttcgtcagcgaaggtttcaccacccgcatcgtcggcctgccggccgacgagagcgcccaactgctcgccgagctgtatgcgcacagcgtgcgccccgagcacatctaccggcatcgctggcaggcgcatgacctggtgttctgggacaaccgctcgctgatccatctcgccggcggttgcccggcccacctgcggcgcaagctctaccgcaccaccatccagggcgacgcgccgttctga

SEQ ID NO: 9228 - DNA, 1011 bp, Pseudomonas aeruginosa
agatcatcgccaatccgcaggtggagttcagcgtcacgccgaagaacacctatccgctggcggagtttctctaccgggtcggtgcgatccgcaacaagccggcctcctggcaggactatttcttccaggacggcgcgccgttgcaggggagttgagacgccgatgaacgccgcctcccgccaaccttccacgctccccgccgacgccctgctggcggtggacggagtcagcctcgaataccgcacccgctcgcgcgtggtgcgggccacccagcgggtcagcttcgaagtcgacccggccgatcgcttcgtcctgctcggcccgtccggttgcggcaagtcgaccctgctcaaggcggtggccggcttcatcacgcccagcgagggcgagatccgccttcagggacaggcggtcagggcgcccggccccgaccgtatcgtggtgttccaggagttcgaccagttgccgccatggaagaccgtacggcagaacgtgctgttccccttgcgggtgtccggccaggtgacgcgcgacgaggccgagcgacgcgccgacgaatgcctcgagaaggtcggcctggcgggcttcgccgaggcctacccgcacacgctgtccgggggcatgaaggcgcgggtggcgatcgcccgggcgctggcgatgcagccgaagatcctgctgatggacgagccgttcgccgcgctggacgcgctgacccggcgaaagatgcaggaagaactgctgcgcctgtgggaagaggtgcgtttcaccctgctgttcgtcacccactccatcgaggaggcgttggtggtgggcaaccgcatcctgctgctctcgccgcacccggggcgggtccgggccgaagtgcacggccacccgttcgggctgcacagccttggcggcgagccgctgcaagccgcggcgcgacgcatccaccgcttgctgttcgacgagggcggcgaaccgacggcggccgcgaccctcgacttcgccgatatccggctggcccattga

SEQ ID NO: 9229 - DNA, 957 bp, Pseudomonas aeruginosa
gcagaggaatcgatcgatgagtcgagtcacgcgcgttcgcgaagaatacgaagtccagctcgaacccctgctggaggtctccctggagcggcgcctgcccctgagccagcgtctctggcaacagggctggctgcgcaaggggctgatcctggcgctgctggcgctggcctgggagctggcggcgcgggtccagggcaacgacctgctgctgccaggcttcctgcagacggccagggccctcggcgagggcctggccagcggcgaactgccggccaaggcggggatctccctgctggtgctgttcaagggctacctgctggggatcgtcctggccttcgttctgaccagcctggcggtctccacgcagttgggccgcgacctgctcgggaccctcacggcgatgttcaacccgctgccggcgatcgcgctgctgccgctggcgctgctctggttcggcctgggccagaacagcctgatcttcgtgctggtgcattcggtgctctgggcgctggcgctgaacacctatgccggtttcctcggtgtctcggagaccctgcgtatggcagggcgcaactacggcctgcgtggcctgcgcttcgtcctcctgatcctggtgccggcggcgctgccgtcgattctcgccgggctgaagatcggctgggccttcgcctggcgcacgctgatcgccgcggaactggtgttcggcgcgagcagcggcaagggcgggctcggctggtacattttccagaaccgcaacgagctgtacaccgacaaggtattcgccggcctggccgtggtggtgctgatcggcctgctggtggagaacctggtgttcggcagcatcgagcgcctcacggtgaagcgctggggagtgcaacgctagggcggcggacgggtggagtgttacggcaactttctcggcaactgttgcgctggcgcggcggcaaagcggagtaa

SEQ ID NO: 9230 - DNA, 1965 bp, Pseudomonas aeruginosa
cctcagatatgccgagctggagcgcgaaagcgccgcgctcgccgtgcgcctgcgcgccgccggggtggctccggagcagcgggtcggggtctgcatgcggcgcgacagcggcctgctggtcggcctgcttggcgtgctccgcgccggcggttgatacgtcccgctggacccggcctatccggaggagcgggtggcatacatgctcgacgacgccgactgcctgctggtgctggtcgacgcgagcacccgcgagcgggtcgccgcgctgggccggccatgcctgacgctggaggagggcggcgaccaggcgaacgacctggcgctgcccgcgagcgaggtcggcgccgaccacctcgcctacatcatctacacctccggttccaccggacgccccaagggcgtcgccatcgagcacggcagcgcccatgccttcctgcgctgggccggccagcactatgccgccgaagaatggagcggggtactggcggcgacctcggtgtgcttcgacctgtcggtctacgagctgttcggtaccctggccgaaggcggcacgctgcacctggtggaaaacctgttcagcctgccggactacccgcgccgcgacgagatcagcctgctcaataccgtgccctcggtgtgtgccgcgctgctcgccctcggcgacctgccgggcggggtgcgcacgctgaacctggccggcgaaccgctgcgcggccacctggtgcgacagattcgtggccaaccccaggtacggcgcctggtcaatctctacgggccgaccgaggacaccacctattcgacggcgcacgaactggacctgcacgccgaagcgctcgacgagccgcccatcggccgaccgctgcccggcaccacggtggaggtgctcgacggcttcgaggcgccgctgccgctgggcgtggccggggagctgtacctcggcggcatcggcctggcgcgtggctatttcggcaagccggagcagaccgccgagcgtttccgcgtcgatccgggcagcggcgagcgccgctatcgcaccggcgaccgcgtacgcatgcgcgaggacggcgtgctggaacacctcggccggctcgacgaccaggtcaagttcaacggcttccgcatcgagctgggcgagatcgcctcgtgcctggcgagttttcccggggtgagcgaagcctgcgccatgctcaccgaggacagcgccggcctgcgtcggctggtcggctacctggcggcgccgttcgccccgccgctccaggcgctgaacgagcaccttgggcaaagtctgccgcactacatgttgccgtcagcgttcgtggtcctggcggagctgcccaagacgctcaacggcaagatcgaccgcaaggccctgccgcgtccccaggcgagcggcgccgagccgcaggcgctgcccagcgatccgctggagcaggcgctacaccaggcctggcaggcgcagcttggtgcgccgccgcgcgccggacagggcttctacgccgccggcggcgattccctgcgggcggtgcacctgctcgcgacgctgcgccagcgactgtcccgacgcgtaccgttgcaggcgttcgccggtggcccggcgacccccgaggccctgctggaactgctgcgccaggccgcgcccgagggcgacgagccggagccgagcgccggcgccgccgggctgagcctcgccgaacggcgcctgtgggtggcccagcaactggcgccggaggacacctcctacaacctgctggcccacctgcgcatagtcggcgccacggccgacgccatcgaacaggccttgcgccagttgctggaacggcatgtggcgctgcgccggcgtgtcgaaacgggcgtcgacgggccgcagccgcatgcgctggcggcgcatgcggtgcccctgcaacgcctgctggcgagcgacgccgtccacgccgagcggttgctggaggatggcgtgcgccgtga

SEQ ID NO: 9231 - DNA, 1488 bp, Pseudomonas aeruginosa
tctgctggaactgctcgaacaccaggacgtgcccctcgaatgcgtgacccaggccctgcgccagcgcggcgccagcggcctgccgatccgcatcgcctgcggcgcgcacaacggtcgggcggccccggcggtggatgccggggtgcgcgtcgaagccgacttcatcccggtgcctggcgcgcgcctggacctgacgctgtggctggaagaccagccgcagggttggctggccgtctggaccggggccagcgcgatcttcgacctgcaccgcatcgagcgcctgcaccaggcctgggagcggcgcctgctggcgaatgccggcgaacctatttcgaaacgcatgtcgccggagggctgcaacgcttcctgacgaccccgagcctcccacggagaacagcgatggaacgaacagctcccagtctcaccggtcgcggcttcgcccggccgcgcaatctcagcccgcgcagcagcgaggcgctggtgcggcgcccggcggcggagcgcgacggcctgccgctgctgatcgaggcacaggctcccggcctgtccctggccgactggattcgcgagcagggccagtccctgcacgacgacctgaacctggctggcggcctgttgctgagaggcttcgaggtcgactcggcagagcgcttccgcgcagccgccgctgccttcgccccgcaactgctcgactacaaggagcgttcctcgccgcgtagccaggtcagcggcgaggtctacacctccaccgagcatccggtggaccagccgatcttcctgcataacgagcagtcctataccgccgactggccgctgtacatcatgttccattgccaggtcgcgccgctcgagggcggcgccaccccggtggcggccaaccggctggtgctccgccacctgccggacgaattgctggaacgcttcgggcgcctgggcatcctctacgtgcgcaactaccgcgccggcctcggcctgtcctggcgcgaagcgttccagaccgacagccgagccgaggtcgaggcgttctgcgctgagcaccggatcgcccatgcctggatcggcgacgagcacctgcgcacctggcagaggcgcgcggcgttccaacgccacccgtataccggcgagcgcctgtggttcaaccacggcatgttcttccatgccaccagtctcgagccgggcctgcgcgatgcgctgctgcgcagcgtcgccgaggaagacctgccgtaccagacctactacggcgatggcagcccgatcgaggcgcagaccctggcgaccatccgcagcgccatagaccgcgagacgcggcgcttcgactggcgcgtgggcgacgtgctgatcctcgacaacatgctcgcccagcacggccgcgagccgttccgcgggccgcgacggatcctcaccatcatgtccacgccgtattccagcctggcgcccgccgatgtcccgccgacaccttcgcgcctggcgctcggaggtaccgcatga

SEQ ID NO: 9232 - DNA, 1227 bp, Pseudomonas aeruginosa
ccgacctgcatgtccaccaaccctgaacccgtgcgagggatagccatgagtgcgtcagaagacctgcaatccgctgtgcaaccggccgcgagcgaagcgctcgaaggattcccgctgtctcccttgcagacccgcgcctggcgccgccatgccgagcggccggaaaatacggttgtcggcgtgcgcctgcacgccccggccgataccgtggcgacgctggagcggctgcgccgggcgctggacggcgaggcgcaactgcgcgtggcctaccggacgatgccgggcatgagcctgccggtgcaggtactggatgggcgcgcggccgatctgctggtcgagcgcctgccgggagatggcgactgggccggacgcttcgcgcgcgaaagcgcgcgtctcgccgcttcgcccctgggcggggaaggccagccggtactggcgctcggcctgctgctggacgccgccggagagacgctccaggggctgttgctggcggcgccggcgttcgtcgtcgatgcggccagcctggtggcgctgctgcgccgcggcctggggccggccggccaggcgagcgcggacgagggagacgaggcgctgctgttccagcatttctccgagtgggccaacgaggcgctggccggcgaagacggcgaaagcgccagcggttactggcgagagcaggcggccgttgcggcggaaagtccgctggcgctggcggacgacctgggcgaaggcgattggacgggcgcggcgcctgctgccgcgcgcgctgctcgaacgcctggccgccaacggcttgccggaggcggccgccctgctggcctggacccaggtcgccgggcagttccagggcgacgagggactccctctggaaatggcgcgactggtctcggggcgcctgttcaacgagttcgccgagctggccggaccgttcgccggggtcgcgccgctgtgcctggagaatgtccgcgcgggcagcgtcggcgagcggctcgacgccctccaggcggcgatcctcgcccaggaggaggcagcggccctgcgcgatccctttgcccccgactggccgctcgccgagttgggcttcgcctggctggcgggcgaactggatggcgccggggtggccgagctggattgccgtcagccgccgctgggcgggttcctcgagttgcaggtgctgccccacggcgaaggccggctggccagcctgcgggtccgccgcgaccatga

SEQ ID NO: 9233 - DNA, 1356 bp, Pseudomonas aeruginosa
cggaacgctggccgggcgcttgctcgacgcctgggtcgaatgcctggaaagcatcgccgccgacaggcaactgccattggccgggctgccgttgatcggcgcggccgagcgcgagcgctaccaggcctggcagggcgagcgcgtggagcccgcgccggtggaatccctggtggccgcgttcgatctgcgggccgccctgcagccgcaggcgccggcgttgctggatgcccacggcagcctggatttcgccacgctgtgcgcgcgcagcgaagcggtcgccgaagcgctgctggctgccggcgtgcggcccggccaggcggtggcggtgatgaccgggcgcaaccgcgaggcgatcgtcgccctgctcggggtgatgcgcgcggcggcggtgtacaccccggtcaatccggagtttccggcggcgcgggtggagcggatgcgcgaagcgggcgggatcgtcttcgctcttgccgatgccgagtgcgccgggcgcgcccgcgaggccttcgccggggcctgcctggacctgtcgacgctgccgctggccggcagcggcatgagcctgccggcgccgggcgggcgcgatgcggcctacatgatcttcacctcgggcaccagcggccagcccaaaggcgtggtggtcgagcacgccagcgcgctcaacctgtcccaggccctggcgcgcacggtatacgcgaacgtggtgggcgagggcctgcgggtgacggtcaacgcgccgttctccttcgactcctcgatcaagcagattctccagttgctctccggccattgcctggtcctggtgccgcaggaggtgcgcagcgatccgcagcggatgctggggttcctcgaagaacggcgcatcgacgtgctcgactgcaccccgtcgctgttccgcctgctgctccaggccggcctcgacgatgcccacccggcgctgcccgggcgcatcctggtagggggcgagcgcttcgacgaagcgtcctgggaggtcgccgccggctggcgccgctgccaggtgttcaatctctacggtcctaccgaagccacggtgaacgccagcctggcgcgggtcgccgagcatgcgcggccgaccatcggccgcgccctggccaacgtcgatctgcatgtggtcgatggcctcggtcgtcgcaagacccgtggcgccagcggcgaactgtggatcggcggcgccggggtggcgcgcggctatgccggcgacgccggcgaggcgggccgggcgcttcctcgacgagggctggccgggcagcggccgcctgtaccgcagcggcgacctggtgcgctggcgcgccgacggttgcctggagttcctcgggcggatcgacgaacaggtga

SEQ ID NO: 9234 - DNA, 369 bp, Pseudomonas aeruginosa
acctcaacgaaaccgagtacgtctaccaggaaatcttcgtcgacgaggtctacagccgcgacggcatcgtcctgccgccggacgcggtggtcctcgacgtcggtgccaacatcggcctgttctcgctgtacatcgccagccgcgcgccgcgcgcgcgagtggtcgccttcgagccgctggcaccgatccgccggcgcctggaggccaacctcggacgctacgcaccgcaggtcgaggtattcggcatcggcctgtccgacgccgagcgcgaagaaaccttcacctactatccgggctactcgaccttctccgggatcgccgagtacgccgacgccagcggcgaacgcgacgtcatccgacgctacctga

SEQ ID NO: 9235 - DNA, 336 bp, Pseudomonas aeruginosa
tcagcagccgcgctccggggccggacctggaatacccgcgcttccatgcgatgggcgacgccgagttgctgcgaaccctgcgcgagtacgacgtgctgccgctggaagtgctcgacgacccggagctgcgcgagatcagcctggccaccctgcgcgccgattcgcgcctggccgccgactatcgctaccgcccgcgcgagccgctggccataccgatcaccgcgatcctcggcgagcaggacccgggcgtctccagggtggccatcgacggctggcggcggcacgccagccgctacgagctggagaccctggccggcggccacggcctggtggtga

SEQ ID NO: 9236 - DNA, 696 bp, Pseudomonas aeruginosa
cggcggcggaggaggtttgcgcgatcctgcggcagcgcctggcgcccgatgtgcctggcggcgtgccggcgaacctggcaacctgaaccgccggcccctgccgcccgcctggcggcaggggccggtgccgtccgtcttcattcgaggttgcccatggttgtgcgcgaatacacccaacgccaccggcttgacgccgtcgccccggccgactaccaccgccatctgccggagcaggtcgcgcgcggcctgccttccgccgagctggtggtgttccgcgtcgccgacgagcattccgacaccgcggcgttcagcgcacgctacggctttggcctggaggactgcgccaacaccctggtcctgcgctacaagcgcgacggcgccgaaggctatgccgcggtggtcaacctgggctcgcggcggctcgacgtgaacggcgcggtcaaggcgctgctcggggcccgccggctgtccttcgccgcccgcgaggtcgccaccgagctgaccggcatgcagttcggcggcatcaccgcgttcggcttgcccgaaggcatgccgctgctggtcgacgcggcggtcttcgaacggccgttggtggtgatgggcgccggggtccgcgagaccaagctgctgctgtccccggcactgctgaaagaccttcccggagtggtggtcgccgaactcagcgaagccggttga

SEQ ID NO: 9237 - DNA, 1452 bp, Pseudomonas aeruginosa
atgatcaggatcgacttttcccagttgcaccaggcccgcgaagatgccgcggcggccatgccgagcatcgccggcaagaagattctcatgggcttctggcacaactggccggccggcgccgccgacggctaccagcagggctcgttcgccaacatcgcgctggaagacgtgccgagcgagtacaacgtggtcgccgtggccttcatgaaagggcgcggcatcccgaccttccagccatacaacctgtccgacgcggagtttcgccgccaggtcggcgtgctcaacgcccagggccgcgcggtgctgatttcgctggggggcgccgacgcgcacatcgagttgcacgccgggcaggagcaggcgctggccgccgagatcgtccgtctggtggaaacctacggtttcgacggcctggacatcgacctcgagcagagcgccatcgacctggccgacaaccagcgggtgctgccggcggccctcaagctggtgcgcgagcactacgccgggcagggcaagcacttcatcgtcagcatggccccggagtttccctatctgcacaagaacggcaagtacgtgccttatctgcaggccctggaaggcgtctacgacttcatcgcgccgcagtactacaaccagggcggcgacggcctgtgggtccaggaggcgaacggcggcaagggcgcctggatcgcgcagaacaacgacgcgatgaaagaagacttcctctactacctcaccgagagcctggccaccggcagccgcgacttcgtgcggatcccggcgcagcgcctggccatcggcctgccgagcaacgtcgatgcggcggctaccggctacgtgatcgatcccgccgcggtgagcaacgcgtttcgccgcctggaagccgccggtcacgcgatcaagggcctgatgacctggtcggtgaactgggacgatggcctgaacaagcgcggcgagcgctacaactgggagttccgcaagcgctacgccagcctcatccatgacggcgagggcggcgaccagcgcccggcggcgccgcagggcctgcgtctgctggagcgcggcgagaccagcctggtgctggcctggaacgcctccagcgggcagcgtccgatcgattactacagcctctatcgcgacggcgccatggttggccagagcgctgcgctgggttccaccgacagcggcctgacggcggacacccgctacagctatttcgtcaccgccaccgatacccagggcaaccagtcgctgcccagcgaaggcctggaggtcagcaccagcggcggggcggtggatccgcaattcccgcaatggcgggagaaccaggcctatcgggtcgacgatggggtgacctacgaggggctgcgctatctctgcctgcaggcgcacacctccaacagcggctggacgccgccggtagccttcaccctctggcggccgctgcgctga

SEQ ID NO: 9238 - DNA, 2517 bp, Pseudomonas aeruginosa
cttgttataacaagtgtccgagccactccgacaagcgaatccgaccatgggcaaactgctcccgctttctcccgtgccgctgtacagccagctcaaggagctgctgcgcgggcgcatcctcgacggcgtctacccgccgctcagccgcatgccctcggagaacgagctgggcaaggccttcgacgtcagccgcatcaccgtgcgccaggcgctcggcgacctgcagaaggaagggctgatcttcaagatccacggcaagggcaccttcgtcgcccggccgaaggcgttccagaacgtcagcaccctgcaaggcctgggcgagtccatgacgcagatgggctacgaggtcatcaaccgcctgcacggcctgcgctacgtgccggccggcgcgcgggtggccgagcgcctgcgggtggaagagggcagccctgtgtgcgagatcaagcgggtgcggctggtcaaccgcgagccggtttcgctggaagtcacctacctgccgcaggcgctcggcgagcgcctggagaaggccgacctggtgacccgcgacatcttcctgatcctcgagaacgattgcggcattcccctcggccatgccgacctggccatcgacgcggtgctcgccgatgccgacctgacccgcgccctggcggtcgaggagggcgcgccgatcatgcgtatcgagcgcctgacccatgccgccgacggcgcgccgctggacttcgaatacctctactaccgcggcgacgctttccagtatcgcctgcgcatcgatcggcagaagggagagcgggcatgaacaccctggagcaggaatacgacatcgtggtgatcggcggcggcaccgccgggccgatggcggcgatcaaggccaaggagcacgaccgcgaactgcgcgtgctgctggtggacaaggccaacgtcaagcgcagcggcgccatcagcatgggcatggacgggttgaacaacgccatcgtccccggccacgccacggccgagcagtacacccgggaaatcaccgtggccaacgacggcatcgtcaaccaggcggcggtctacgcctatgccagccacagcttcgagaccctgcggcagctggatcgctggggcgtcaggttcgaaaaggacgagaccggcgactatgcggtgaagaaggtccaccacatgggcgcctatgtgctgccgatgccggaagggcacgacatcaagaaggtgctctaccgccagctcaagcgtgcgcggatccccatcgccaaccgcctggtctgcacccgcctgctcaccgatgccgagggcgcggtgaacggcgtactcggtttcgactgccgcagcggcgacttccatgtgatccgcgccaaggcggtgatcctttgctgcggcgcggcgggccgcctgggcctgccgtcctcgggctacctgatgggtacctacgagaacccgaccaacgccggcgacggctacgccatggcctatcatgccggcgccgagctggccaacctggaatgcttccagatcaacccgctgatcaaggactacaacggcccggcctgtgcctacgtcaccggcccgctgggtggctataccgccaacgccaggggtgagcgcttcatcgaatgcgactactggagcgggcagatgatgtgggagttccaccaggaactcgaaggcggcaatggcccggtgttcctcaagctcgaccacctggcggaggaaaccatccagaccatcgaggacatcctccatggcaacgaacgccccagtcgcgggcagttccacgccgggcgcggcaccgactaccgccagcagatggtcgagatgcacatttccgagatcggcttctgctccggccactcggcctccggcgtgtgggtcaacgagaaggccgagaccagcgtgaagggcctctacgctgccggcgacatggccgcggtgccgcacaactacatgctcggcgccttcacctatggctggttcgccgggcgcaacgccgccgaatacgtcgccgggcgcgccttcagcgcggtcgaccgcgcccaggtcgagcgcgagcgtgcgcggatcgaggcgccgctgctgcgcgagcatggcctgccggcggcgcaggtggagtacaagctgcgccggctggtcaacgactacctgcaaccgcccaaggtgacccgcaagatggaattgggcctgcaacgcatccaggccatcgccgaggacctggagcggatcaaggcggacaacccccacgagctgatgcgcgccctggaagtcagcgttatccgcgattgcgcggagatgcccgcgcgcgcctcgctgttccgcaccgagagccgctggggcctgtaccaccaccgggtggactatccgcggcgcgacgacgctgcctggttctgccacgcgcacctgaagaaggacgagcagggacgcatggccagcttcaggaaaccggtcgaaacctacctgttcgccatcgacgagggcgaacagcaggcctaccagcgcctgcggctgaggaacgacgccgcctag

SEQ ID NO: 9239 - DNA, 1872 bp, Pseudomonas aeruginosa
ggccccacgccccggcgtagtaccgctagacaccgagcccgccgccacgaaagcgggccagatcgaaccacgaggaccgcgtgccatggcctaccgaccccaggacatcttcttccgcagcagcgccccggtgaccatcgacgaagaccgctgcatcgccgacaagggctgcaccgtctgcgtcgaggtctgcccgatggacctgctggccatcgatccgacgacccgcaaggcctacatggcctacgacgagtgctggtactgcatgccttgcgaaaaggactgcccgaccggcgcggtgaaggtcgagattccctacctgctgcgctgacgcccgctcccggcaagcgaggcagaacccgccatccggccactcccggacgccactctgaaacacccctcgtttcccaccaccgtccgggtggcggagacgattcccatgaccatgattcgaggggaatccccatgcgactgcgtgcaatcctggccagcctggcgctggccctgacttccctgggtgcccaggcggaaaccatccgcgtggccatcggcactcaggacaccaccatcaactgcgccgccggcgggctgctgatccgcgagctgggcctgctggagaaatacctgccgcgcgacggccgctacaaggatgcggactaccgggtggagtggaagaacttcaccagtggcgcaccgctgaccaacgagatggtcgccggcaagctcgacttcggcgccatggccgactttcccggcaccttcaacggcgtggccttcgccgccgccggcaagcgcagcctgttcatcagcgtgctgtccggcagcacccgtggcagcggcaacggcatcgtggtaccgagcggctcgccggtgcagtcgctggccgaactgaaaggccagaccatctccgtaccgttcgcctccactgcccatggcatgctgctgcgcgcggtggcggcgcaaggctgggacccgcagcgcgacgtgaccatcatcgcccagccgccggaaatcgccggttcggccttgcaggcgaacaagattgccgcccatgccgacttcgtacccttcgccgagctgttccccaatcgcggcttcgcccgcaagatctacgacggttcccaggccaacgcgccgaccttccatggcgcgctggtggacgccgcctacgccgagcgctatccggaggtggtggtggcctacctgcgggcgagcatcgaagccaatcgactgctggccgccgaaccggagaaatacagcgagctgatcgagaaggtcaccggcatcgaggccgaggtcaattacctgttccacggtccgctcggcctgcagacccgcgaccaggcctggaaacccgaataccgccaggcgctggcgacctccatcgacaccctgaagctgctgaagaaggccgaccgtgggctggacgtcgagcgtttcgtcgacgaccgctacatccgcgaggcctaccgtcaggccgggctggactaccaggcggcgctggcagactacgcaccgtcgccgctgcgcgccagcgacgcgcgcagcggccggccgatcgaggagttcgaacgggtagcgcagatctgggtgaagggcgaggccagggtgcgccattacgcttcgccggagtcggccctggccgatcttgccgagctgaaggcgcagggcaaggcgattcgtgcgatctacgcccaggatcgtgacagcgggatcaagctgctggccaaccaggcgtggttcgtccgcgacggcgagggtcgcctcaacgccttcctgctccgcgagcaggcccaggactatgcccgccgccatggcggcgaggtacgcgactttgccgccgccagccagcaggcgctggcgctccgctga

SEQ ID NO: 9240 - DNA, 822 bp, Pseudomonas aeruginosa
ggcgggcgtcttcggagtccgcccatgagttcgcttccgatctcccgaccctggcgctgggccacccgcgccgcttcgctggcggcctgcctggcgttctggcagctcgccgccggtctgcaactgaatctgggcctggtgaccttcgccaacgtgccgacgcccggtgcggtgttgctggcggcctgcaacctggcccagtccagcgtgctcctggcgcaccttggcgccagtctggcgcgggtcttcgccggctatctgctggccgccgcgctgggcatcgccctcggcctggcgatcggccgctcggcctgggccgaggccttgctgctgccgccgctggaagtgctgcggccgatcccggcggtggcctggattcccctggcgatcctgatgttcccttcgtcggaggcctcgatgatcttcattaccttcaccggcgcgctgttcccgatcctgctcaataccgtgcatggcgtggaggcgctcgatccgcgcctgctggcttcggcgcgcagcctgggggcggggcgccgggcactgctgcgcgaggtgctgctgcccggcgccggaccgggcatcttcaccggcctggcgatcggcatgggcacctcctggttctgcctggtgaccgccgagatgatctccgggcaatggggactgggttactacacctgggcttcctacaacatccagaactacgacgaggtggtggtcggcatgctgctcatcggcctcttcggcatgggcagcagtgggttggtgaagcgcgtcggcgcgtcgctgacgccctggtacgcggcgggaggcaaggtccgatga

SEQ ID NO: 9241 - DNA, 1233 bp, Pseudomonas aeruginosa
aaacgccaccctgcccgaaatcctcgaactgtcgccgcgcctggaggacgccgaccccggcgtacgccgcctggcgctgatcgaactggccgacctggagctgccggaggcgctgccgttgctgattgcggccctgcgcggcgatcccgaccccggcgtgcgcggcgaggccgcgcgcctgctggaggcctgggaggaagacgcagtggtcgatgcgctctgtgcggccctggccgatccggtgccggcggtggccgatgccgccgcgcagagccttggcgaactcaaggaaccggccgccgggcggcgcctgctgccgtggctcgggcatgccgatgccttcgtccgcgccagcgtattgcgtgcgttgcgcgaactgcgcctggaggagagcgccgcgccggccctggccgccctcggcgatccgcaggcggcggtgcgccgcgaggcggtggcggtgctcggctggctccgccaccagccggccctggccgaactggccaggctggccagcgccgatgtcgacccggaggtacgccgggcggccaccggcgccctcggcctgagccgcgaggcgacggtgctgccggcgctctgcgcggcgctggcggacgctcaatggcaggttcgcgaagaggcggcgacgacccttggcaagctgggccgggaggaggccggcgagccgctgctgaaggccctggcggacgactactggcaggtccgcctgcgcgccgcgcgggcgctcgggcgcttgcgccaccggccggcgcgggaggcgctggaagcattgctcggccatcccatcggcaacctgcgcaaggaggccgccctggccctcggcgaactggcggacccggcctcggcccaggccttgcgggtcgccgaaggcgacggcgatcccgaggtgcgcaaggcggtgcgtatcgccctggcgcaactgcgggtgccggcatgacccagccgccgctgcgcctgcgcaattccgccagggacggctggctgatgctcgaatgggcggacggcgcggtcagccggatcgaccatgctcgcctgcgcgccgcctgtccctgtgcgcaatgccgggcgcagcgcctgcgcggacggatcgtcgcggcggagcagggcgtgcgcctgcgcgatatccgcctgcagggctacggcgtgcagttgctgttcgacgatggccacgagcgcggtatctacccctggtcctatctgcgcgacgaactctga

SEQ ID NO: 9242 - DNA, 432 bp, Pseudomonas aeruginosa
aatcccatcttctccgcccggccctgcgccccgtggccggcggcctattgtccgcctccctgctgtgcaacgcggtgcacgccgccgaggcgttctcgccgaactcgaaatggatgctcggcgactggggcggcaagcgcaccgagctgctggagaagggctacgacttcaagctggagtacgtcggcgaggcggcggccaacctcgacggcggctatgacgacgacaagaccgggcgctacaccgaccagttcgccctgggcgtgcacatggacctggagaagatcctcggctggaaggctaccgagttccagttcaccgtcaccgagcgcaacggcaagaacctttccaacgaccgcatcggcgacccgcgtgccgggcacatcagctcggtgcaggaggtctggggccgcgggcagacctggcggctga

SEQ ID NO: 9243 - DNA, 732 bp, Pseudomonas aeruginosa
ccgagcgcgacatgtggggcagcagcccgttcgaccagatgctctgccgcatccagttccgctcgctgcgctacgagggccagtacaccccgccgtcggagccagggcagcctgatctatccgggcaacgtcggagtgttcaactggggcggggtgtcggtcgacccggtgcgccagatcctcttcaccagccccaactacatggccttcgtctcgcagatggtgccgcgcgacaaggtgcccagcggaagcaagcgcgagggcgagaccagcggcgtgcagccgaacaccggcgcgccctacgcggtgatcatgcatccgttcatgtcgcccatcggcctgccgtgccaggcgccgtcctggggtgacgtggcgggtatcgacctgaccaccgccaaggtcgtctggcagcacaagaacggcaccagccgcgacaacaccccggtgccgatcggcctcaccgtcggcgtaccgagcatgggcggctcgatcaccaccgccggcggcgtggccttcctcagcggcacgctcgaccagtacctgcgcgcctacgacgtgaaggacggcaagcagctctggcaggcgcgcctgccggccggcggccaggccacgccgatgagctacaccggcaaggacggtcgccagtacgtgctgatcgtcgctggcggacacggctccttcggtacccgcatgggcgactacatcatcgcctacgccctgcccaggcaatga

SEQ ID NO: 9244 - DNA, 1788 bp, Pseudomonas aeruginosa
agctggtccccggacggcatcccggccagtacgccggatggccagggccaggccgcgaccctcaacctagacgtcgccgagcgcatcgaggtactgcgcgggccggcctcgacgatctacggcagcaacgccggcggggtgatccagatgttctcccgcgacggccagggcgccccgcgggtcggcgcggaagccaccgtcggcagcgatggcctgagccgcaaccacctgtacacggaaggcgagggcgacggggtcggtttcctggtggatgcctcgcggatggacaccgacggctaccgcgaccacagcgccgcgcgccgcgaccagaccttcgccaagctgaacttcaggcccgacgccgacagccgcctggcgctgatctacagcagcctggaacagaacgacactgaagatccgctggggcagacctgggacgcctacaagcacgacccgcgctccgtcaccgccaacgccgagctgtacgacacgcgcaagagcatcgaccaccagcaggccgggatgaactacgagcgctacttcggcgaggcgaccttgcaggtcaacgcctacgtgggcaagcgcagtgtcgtgcagtatcaggcgatacccaagcagataggatgcgagagtaatccgcgttgccagagaaacggcgcggtgatcgacttcgaccgcgacttccacggtggcaccgtgcgctggctgcaaccggtaagccaggcgccgggcgagctgaacctgaccgtcggcctcgactacgaccagagccgcgacgaccgtcgcggctaccagaacttcaacggcgaccagctcggcgtgaagggcgagttgcgccgcgacgaggtggacaccgccaccagcctcgatccctacctgcaggcgagctgggccatcgacgcctggaccctgcaggccggggtgcgccacagcaccatgaagatggaggtcgacgaccgctacctgagcaacggcgatgccagcggctcgcggcgctaccggaagaacaccccgtcgttctcggtgatgtacgccttcacccccgacctgcacggctacctcagcgccggcaagggcttcgagactccgacccaggcggagatggcctatgcgccggtggcggcgaacgcgccggacgtcttcaacttcggcctcaagccagccaccagcagccagtacgaagccgggctgaaggcgcgcctgtggggcaatacgcgggtcaacgcggcgatcttccagatccgcaccgaggacgagatcgtcgtcgccagctccctcggcggtcgcaccagctaccagaacgccggcaagaccctgcgtcgcggcttcgaactgggcctggagagcgaactgagcgagcactggaacgccaacctggcctatacccggctatccgccacctacgattcggatttcgaggccggcggcaagaccatcggcaagggcaagcacctgccgggcgtgccggaaagcagcctgttcggcgaactggtgtggaagcccgcggagggcatcagcatgggctgggaaggcatgtaccgcagccaggtctacgtcgaggacagcaacagcgaaaaggccgcgccgagctatgcggtattcaactggcgcacccgcttcgagcagcgcctgggaacctgggccttccaccagctggtgcgcctggacaacctgttcgaccgccagtacgtcggctcggtcatcgtcggcgacggcaaccggcgttactacgaagcggcccccgggctgtcctggtacgcgggagccggggtcgaataccagttctga

SEQ ID NO: 9245 - DNA, 408 bp, Pseudomonas aeruginosa
agtgccggatgcgcttgttcgcgctacccggccagcccttgtcagcgtcgtcaattccgattactgtatgaatgtacagtaatcggaaatcgcctgcttgcgcgacaaggagcaccgatcatgagccacaaccttgccgaactgccgctgtcccgacgccgcgccctggagcgcgagaaacaggcctgcctgcgcctccacctgtcccgcaatcgtgccagcgaacgcctggagcgcgccgtgcgcgacgaagtcgagcgcctgctgggggctcgcgagcgccaggggaccggctggccggagtgggtcagcgcggagctctgcgtggcggacgacccgctcttcgtgcgcaaggtggtggcgcgcctgaaagccgcggtggactggcaacgccagcgcgcagcctga

SEQ ID NO: 9246 - DNA, 663 bp, Pseudomonas aeruginosa
ccggaacctggccgacccgccacagcccgaggatctcgaacgttccggcacaggccagggccagggcgagcaggccgatctgggcgaggagcaggcagggcagcaggcgtcggcccagctcgaaccacaggagcaggcagcgacgcgagcgcagtgcgctgcgtgcggcgccggcgatgccggccagggagacggctcccaatacggcgaccagcgccgccaggcaggctccgctatcggcgaggacggcggcgaagcgattcaggcgctgtgcgcttcgtgtgtcggcgagtcgctcgtcgagccgcgccagggccaggtcgcgcacataggcccggccgtccacccggacgctggccctcggcggcagcgcccgcgcttcggcgagcgcgcgctcgacccgctgctgcgcggcgcccagtcgctcggcctgctgctcggcgcgccaggactgccaggcgccgagccccgccagcagcgctggaaccagcaccaggcaaagcagcagccttcgcggatggaccgtgcccttcactcagccctggctgcgcagttgttgcaggtagcgctgggcgtgggcggcctggatgtaggcgtcgaggatcgccgccatgtcgtcgcagtccagcttcttgccatcgctctgcaggccggccgacatga

SEQ ID NO: 9247 - DNA, 1359 bp, Pseudomonas aeruginosa
cagtgctcgatgccggtgacgacatggtccggtagcggcgctccggcgcggtcggcgatctgtcccagccattgccagaggccgggcgcggcgacccggtcgagttcgcggccgagcaggtggagcaccggttcctccagcggcagcagttcgccgcgcaggcgccgcagcatgagcaggccgccgaggaacagcagccacagcggcagcgagaagagccagggcgacgaagccgtggctgtgccagtggctgtagctccacagcgcttcgtagagcaactggctggccagggcggcgaccagcaggccagcgtgcagcgggaccagtcgaccgaggcgccgccaggccggcgcgaggtggccgagcaggtaggcttgcgagcgcatcgagcggcgcccgtcgtattccagtctcgccagcaaggcggccgcgaccagcgccgacgccagcgcgcagagcttgccgatagcggccagccagccgcgcagagccagccaaggatggtcgcggcggatggcctcggcgtcttcggcgaactggtgaagatgaccttcgacgccataggccggacggaacaggtgacggggaatggcaccggcggcgtccgggtcgttgcgcaccgaggcgctccagtcgcgcatgaactgttcgtcgcgcagggtcgagtcgacccggaaggcctgcacggcggaccaggcgtagagcgccaggggaatcaggaagaggaatgcgagcagccttacccgcagcgtatcgtggctcatccgcgtttatttctgctcgaggtagtcggtcaggaatgcctggggctcgcctgcggacgacagcgactcgctataggcgacctgccgcgtctgctgttcgccgggcaggtagagctcgccccagccgtcgcgcacgatcaggatcacatacttgctgccgttcagttcggtggagtagcgactgtccctggcgctcttttccacctttaccttgtggatcaggcggtcccagtcgtggtccagaccttcgacctgcaacagcgcttcgccggccgccgcttcgccgatacgcagggtccagaccttgagcccctgctggccctggtaggccaccaccttgtcggcgactggcggccgcgcctcttcggcctgcgccgtgcaggatccccacgccagtgcgcccatcagcagtgccgcagtccactttgctatcattctcgccccctttggcaacgcgatgtaaaaggggcgcatctattaatacaggcgcgagccacgaacaaccgaggcggccgccgctcacaggaaaagcgtcgtcgcccacaggttcggttcgatcagcgcacggaaccatcctggaaagccgctgcctga

SEQ ID NO: 9248 - DNA, 1500 bp, Pseudomonas aeruginosa
tcggccgagacgatgttcaccaggttcgagaccaccagcggcaggctggcgctgtcggcgatgaagcccgccgccatgacgaaggccagggtcgccgccgggctgaagcgcagggccagcagcatcgacatcacgatgggcgtgaggatcagcgccgcgccgtcgttggcgaacagcgccgagaccgccgcgccgagcagcacgcagaaggcgaacaggcgccggccgtcgccgccagcccagcgcgcgacgtgcagcgcggcccattcgaagaagccggcctcgtccagcagcaggctgatgacgatcaccgcgatgaaggtggcggtggcattccagacgatgttccagacggtcgggatgtcgcccggcgcgacgctgcccagcgccagggcgagcagggcaccgatgctggcgctccagccgatgccgaggcccctgggctgccagatgaccaggaccagggtgaacaggaagatggcgaaggcgatcagcatggggcggctcgcgctattggcagcaggcggaggcgcgctgcgggcggccgtccatgtcgcgcaggcgcgctgcgtcggcttgcagccagtcgccgttggcccgcagggtcacttgcaggacttcgtggatccaggccggcagcgtagggttcaggcggtaatacacccactggccctggcgacggtcgaggagcagcccggcactgcgcaactgggccaggtggcggctgatcttcggctggctgtcggcgagggcgcacatcagttcgcagacgcacagttcgccctggtcgacgatcagcagggtggcgcgaacgcgcgtctcgtcggccaggcacttgaacacttcggcggggctgggcatcgctgggccttcctggatatatggaaagctgaatatacggatatccgtatgtattgcaagcgcccccgctcccgccggctagcggcgggcggcctggatttcctcgctcggcgtgcgcccgaagtagcgcttgaactcgcggctgaactgcgagggactttcgtagccgacctggttggcggcggtactggcgttcagcccgtcctgcaccatcaggctccaggccttgtacaggcgcacgctcttcaggtactggaggggcgaggtgaaggtcatcgccttgaagttgtggtggaaggtcgacacgctcatgttcgcctcgcgagccagggtgtcgatgtccagcgcactggcgtagtcggtgtggatgcgccgcagggccctggccatgcgcccgtagccgctgtgccggccggccaccgcacgcagggcgttgccctgctcgctgcgcagggcgcggaagatgatctcgcggaccagttgcgggccgaggatatggctgtccagcgggctctgcaggcagcccagcaggcgcatcaccgcatcggccatccccgcgtccagcggtaccgaagccatcggcgcgctgggtgccagctcattgtcgtcgtcgctgccgggagcctcttccatctgtag

SEQ ID NO: 9249 - DNA, 1293 bp, Pseudomonas aeruginosa
cagcagttccttcaaggtgccgatatccacgtcgacgctcactcccagcaagggttcggcggcggaggcgtgggtttcgcattcgaacggcaggggcaccgacatcaccaggtagcgttcggcgtcgtagcggtaggtttcgccgccgaggaaaccgatcttctggccctgggcgaggatgcagatgcgcggctcatagaacaccgggctgcgcggataggcctgttcggcgcgcatcaggcgaaccccggggatgcgggtggcgtcgaaacccggttcgtcttgcagggtggcgatcagcgacgccatgtcggtggaagtagtgctcatgccttggctgtttctccaggaggggaggcaaacgtagcaaccccgtgcgcgcctgggcagtggcggcacgcaacatcggcacgaatgggcaaggcttcgacaggaatggacattctgcggcggcgcccatccggcgaacaattgccccccgaacggaccgccgccagcaagccgtcgcggcccgccatcctgcgcagaggacacaccgatgaccctacagatccgcggctacgccgcccagtccgccagcaccccgctgaccgcccatcgcttcgaacgccgcgcgccgcgcgccgacgacctggtgatcgacatcctctactgcggcgtctgccactcggacctccatcaggcgcgcaacgaatggcacaacagcctgtacccgctggtgccgggccacgagatcatcggccgggtcgccagcgtcggcgaggcggtgagcggtttcgcggtcggcgaactggtcggcgtcggctgcatggtcgactcctgccggcactgcgccgcctgctccgagggcctggagcagtattgcgcggaatacccgaccctgacctacaacggccgcgaccgccacgacggcctgccgaccttcggcggctactcggagcgcatcgtggtctcggccaggttcgtcctgcgcattccccaggggctcgatccgaagacggcggcgccgctgctgtgcgccgggatcacgtcctactcgccactgcgtcactggaaggtcggtcccggcagccgggtggcggtggtcggcctgggcggcctcggtcacatgggcctgaagttcgccagggcgctcggtgccgaggtggccctgttcacccgctcgccgggcaaggaagaggaagcgcggcggctcggcgccgaccaggtgatcctttccaccgacccacagcggatggccgccgtcgccggacgcttcgacctgatcctggacaccgtgccgcaccagcatga

SEQ ID NO: 9250 - DNA, 552 bp, Pseudomonas aeruginosa
gcatggcgggttactccgggtgacttgtgtcgagggccggcccagggtaaaacctcaagcaaacttgaggtcaagccaatcatgaagaattcctgcgcatctcgtgaactgagcgtcggcgaactggccaggcgtgccggcgtggcggtctccgccctgcatttctacgaaaccaaggggctgatcagcagccagcgcaacgccggcaaccagcggcgcttcagtcgcgagacgctacgccgggtggtggtgatcaaggtcgcccagcgggtcggcattcccctcgcggagatcgctcgcgccctgcagaccctgccggcggggcgtagccctagcgcggcggactgggcgcgcctgtcggcgcagtggaaggaggatctcaccgagcgtatcgacaagctgctgctgttgcgcgaccaactggacggctgcatcggttgcggctgcctgtcgctccaggcctgcccgttgcgcaaccccggcgaccagctttccgccgaggggccgggagcgcactggctggacgccgagggccgcgagcacgacggctag

SEQ ID NO: 9251 - DNA, 501 bp, Pseudomonas aeruginosa
agcaccaggcgcatcgcgcagcggctgtcggcgggccgaagccgatctcctgctcgtggccgaggatcgcgcgcaagcgctcgccggcttcctgccaggtcagccgctggaagcccaggcgtgcgtagaacggcgcgttccagggcacgtcgcagaaggtcgtcagggtcagcgcccggcagtggctggcgtgggcgtaggtcaccgcgcgctccagcaggcggcggcccaggccctgttgctggtgggcctgggcgatggacaactcggcgatgtgcaactcgtcggcgcagcgttcggcggcgaggaaaccgaccggctggccatcggcgtcttccgccagccagtggctgccgcgctcgatcaggcggcgatggaagtccaccccggcgaccccggcgtcggcgatccaggccagctcgggcagcaggcggaagctttccccggctgagcgctcgatggccgggagcagcgcggcgtcctcgtcgcggctggttctga

SEQ ID NO: 9252 - DNA, 2379 bp, Pseudomonas aeruginosa
tttttgacatacgcagcgtatgtgaatttcgtcttctcccgtcgtcgccggttccgctggagccggccagccgaggctttccatgagcaacccctatctcgaactgttcgccgcgcccggcgccaagggcttttcagccgccggcctgctggcgcggatgcccctgtcgatgaccggcctgggcatcgtcaccatgctttcccaggtgcatgccgactactggctggccggtaccgtggcggccaccttcgtgttctgcaatgccttgctcgcgccgcaggtatcgcgcctggtggaccgcttcggccagggccgggtgctgctcccggccgcgctggccagcgccctggcgatgagcgcgctgttgctgtgtacgcactatcgagcgccgaatgcctggctctacctgttcgccttgctcgccggggcgatgccgagcatgccggccatggtacgggcgcgctggaccgagctgtaccggggctcgccgaagctgcacacggcgttttccttcgaatcggtgatggacgaggtgtgctacatcatcgggccggtgctggcggtgagcctcagcgtcggctggttcgccgaggcggggccgctgctggcgacgctgttcctggtcgccggggtgagcctgttcagcctgcaacgcggcaccgaaccgccgctgcatgcccatccgcggcgccgcgccggcagcgcgctggcctatccggcggtacgcgtgctggcgctggtgctggccgccatcggggtgatcttcggcgcggtggaagtggtcagcgtggccttcgccgaggcgcacggcaacaaggctgcggcaagcctggtgttgtcggtctatgccgtcggctcatgtctcgcgggattgctgttcgggctgctgcgctggcgcctggcgctttcccggcaactgctctgcatggttacgctgatggccctgagcctgatgccgctgctaggggtggagagcatccttgcgcttgccctgaccgtgctggtggccggcttcagcgtggcgccgacgatgatcctggccatgggcctggtcgagcgcgcggtggacccggcgcgcctcaccgaaggcctgacctgggccatcaccgggctgggcatcggcatggccttgggctcggcgctggccggttgggtggtggagggctacggcgccgccagcggtttcctcgtcgcggtcggcgccggctggctggcctggctgctggccctggcctgcttccgggtgctggctcaggacgaggccggagactgcgcggtgtccggctgagccgggaaggcgtattcgcgttcgacccgggcgatccgcgcgctgaaaccggcgtaccagtcgcgccggccgcgcgcctgggcgtcgcggtgctccgcgtggcggctccaggcacggatcgccgcctcgttgtcccagtaggagacggtgatgccgaaaccgtcggcgccgcggaccgactccacgccgagatagcccggctggcggctggccagttccagcatgcgctcggccgcttcggcgtagccgtcgtcgacggcgctgcgatgggagctgaagatcactgcgtaataaggtgtcgggccgcgccgggggtggtcgcggcgctgcgtccggcacgcctcgacgaatgccttcggcagtggcggcaggacgccggccacggctgcccgctcgggttggaacagggtggcgacgaagaacggatgctgttccagctccaccgcgcggatcgctccgtcggcgctccaggcgctggcccgcagtgcgccgccggtaagttccgcggcgaagcgcggggcgattgcgtagcggcaatggtagtccgcctcgatccagtcggcggcatacgccagggccaggcgcgagccgcgcagcaggcggacatcctcgcgggcttcgagcagagcgcagggcagggcggcgatcaccgcctggtcgctgtgcggatgctcctcaccatgggtcgccgcctgccagccgagggcgttgcgggcgaactcgaggatcgtgtgctggaagccggcgcaggtaccgaggaacggccggcgccggccccgggcatgggcgatcaggcgcagcaccgcgtcggcgtcgcgataggggctgcccggcacgcaccagaacccgtcatagcgctccagcgccggctcggcgggcaggcggtcgctggccagccagtcgaatgcgatctccaggccgagtgcctcgccggccaggcgcagggccaggggaatcgcccggtgggcggtgatgtgcgggtcgtggtcgccgaccagggcaatgcgcagcggcgccgcgggaggggtggacatccgttttcgctccagtttcgccacgccggttggcgggccctggcgctcactctatag

SEQ ID NO: 9253 - DNA, 1221 bp, Pseudomonas aeruginosa
gcttgtcttgttcttgtcgcaacaggtgccgcgtgggcggcgggttcaggcgctcttgcggcgctcgcggtcgagcagttggctgcgtttcggcagcccctccatgtcgccgcggacctgtaccgcgcggctgccgatccagttgccgcgcgccaccgcgtcgggcagcggcaggccttccagcagcgcgctgaccaccccgaccgcgaagccgtcgccggcgcccacggtgtccaccacggtcgccaccggcacgccggggaccagcccttcgccgtgggcatcgcgatagtaggcgccgctcgggccgagcttgatcgccaccgcgtcgacgcccatgtccaggtagaacgcggcgatatccgcgggttcctgccagccgctgagcaggcggccttcctccaggcccggcaggacccagtgggcatgcgcggcgagggcgttgatctcggcgatcatgcggcgctcgctgggccacagcgagggccgcaggttggggtcgaaggacaggctggcgcccttgccgcgcatgcgccgcatcagttcgtgggacagttcgcaggcactcgccgagagtgccggcggaatgccggtggcgtgcaggtggcgggcgccgagcatttcttcgcggatatgggcgaggcccagccggctggccgccgagccgcggcggaagtactcgacccgcgggtcggcaccatcgacctcgcgggacttcatctggaacccggtgggcgcttgcgcgtcgacctcgacgaagcggcagtcgaggccctcgcgggtcaggctgtcgagtacgaagcggccgagcgagtcgtcgccgacccggctcagccaggccaccgtgaagccgaggcgggcgaggccgatggcgacgttgctgtcggcgccggcgatgcgcttgccgaactgctcgacccggtccagttcgccgggctgttcggcgacgaacatggccatggtctcgccgaagcagaggatctcgaagtcagccatgctggcgttcctcctggggctggccgacggcgggcgagggcggcgatgtgccggcggctgagactgagcaggtcgtcgccctgcagcgggtattcgatggcccgcgccacgccttccgggaaatgctgcagcaggcgctgccagtactgcaggtcggcggccgacggcggcaccgcgaccagcttgccgtcgcggttgcggatcaccgccttgcagtgcacgtag

SEQ ID NO: 9254 - DNA, 2667 bp, Pseudomonas aeruginosa
ctgcggttcggtcgtggcccgccgttgccgtcgtcgtcgtggcagcgcgagcacatcttctgcgccatcgccttgccgcgcgccaggtcggcgggcgcgtccgggcccggcacggcggcggccagcggcagggaaagcagggccgagaggcagccggccagccagcgtttacgctcagtcatgctgccagggcccccgcagccagccgtggatgtcgtagtcggccatgcagcgctggaccatcgcctcgcagtaggccaggtgcccgcgacggctggcccaggccagcgagtcgaggcggatctgctcggcattgccggaataatggctctcatagaccgcgtggcgcgcgccgaactcgctgccggtggcgtcccagatcagcttgaacagcttcaggcgctgctccggctccagctcggcaccgcggtagtagctgtccaccagccgccgtgcctcgccgtcgcgcaggtcggcggcgcccgagacggtgaccagcggggcgccgccgagggcgccttccagcaactcgcggacacgcttccagatctgcggcacctggatgcgcagggcattggcgtactccaggcgcggcaccgccgacccggcggcgttgcgctccgggtcgcgggccatggcggtggtcagcgcctgcagcaggtgctgcagggcgatcagctcgccgagggccgcctgtatcccgcggaagccctgggtgccattggcgcgcacgccgagggaaagcaggccgatcatcagttccagcttcaccccgaggcggatgccggactggaagttgtacaggttggcgaagcccgactcggcatagaagccggtggcgcggcgcaggtcgcggtagaccaggacgtcctcccagggaatcagcgccttgtcgaacagcagcacgctgtcgttctcgtcgaaacgactggacagcgggtagtcgaaggggctgctcgcgcgctcctcgtaggatggccggcacatcaggcgcaggccggggttgtccatgcgggcgaagaacaccagggcgaagtcctcggccttgccggcctccatctgcgccgaggcgaccggggcgacgaaggtggcgttggtgatggcgctgccggtggcgagcatcttcgccccgctgacgacgataccctggtcggtctcgcgttcgacgtggacgaacacgtcgcgcatctcgtggatcgccttgctgcggtccagcggcggattgatgatcgcgtggttgaggaacagcccgcggtcggcgaaggcgcggtgccaggcgcaggcgttctgccggtagtcgccgtagaagccggcgccggcctccagcccggacatgaacgccgccttgtagtccggggtacgccccatgaagccgtaggtcatgcgcgaccagcagccgatcgcctcgcgcgcgccgagcaggtcctcggcgttctgcgcgggggtgaagaagcggtggctgcggcggccctgggcatcgacccgggtgaggacgtcgcgctgctcgccgtggaggccgtcgtagagcccggcgatgctgcggcaggcgttgcggaacgccctgtgccgggtgacgtcggcgacccgttcgccgttgaggtagacctggcgaccgtcgcgcaggctgtcgagatagtcggcgccggtcatcagcgcgttggggacggaatggctcatgctggttccttgtcgggacgccggccgtggcgcgcacggccggcggggcggtcagtcgcgctgcaggtgcgggttgcgcagcgccggctcggcgtggatatgcacccgccgcaggtggcgcggcgcgcggtggacgaaggcctcgcgaccgtgcagcagggtcaggttgtcggcgatcaccaggtcgtcgctgcgccagcggtgggcgtagtgcgcctgtgggtggtacaggcagcggcgcaggctggcgagcagttcgccgcgctgttccggggcgatgccgtcgtagtggaactcggaggggttgatgaagctggcgtcgccctcgaccggcggttcgcagaaacgcaggatggggaattctcggcgcgggtggcgctcgactatcggtgccgccgagcggctgctgtagtgcgccgcgctgcgctggtaccggccgctggcgcgacgccagagttccagctcgctactgtcggccagttgcagcgccgccggggtcgagctgaaggtggtgcggccgccgtcgctgtcgccgggcgcgtcgacacagtggaacagctggaattccgggaccgtctccaggtacatgccgtcccagtgcagcggcacgtagttgttggcgaagatgtggtcctcggcgccttcctgttccaccagctcgagcaccgcgccgaacggccacagcatgacttcgccgaagtcgtggcagtagcgggtcaggctctcggcgtcggcgaaggcggcgaagccgcgcaggagcagcaggtggtggctgcgagccaggcccttgagccactgcgccggcagctcgccgacgtgcatgccggggcggccgggctccagcagcaggccgaagcgcggctggttgccctgttcgtcgcgcagcggcgagagacgtaccggttgatcgctgagataggcgttcatcgtctggctcctcgggctcaggccacggcggcgcgccgggcggccctggccggcaggcggtag

SEQ ID NO: 9255 - DNA, 255 bp, Pseudomonas aeruginosa
tggttgccggagctgcgcgggacttacgtgctattcctgcgccttccggccacggttggcagctccaagtgcgctacagtcccgacggtcaatattacccgctacgttctcgacgtgaacttgtgcgcatatttggatcactggactcgcttaatcggtacgcaaatcgtttgggcatccacacgtatagcgtggagttataactgtgacacgaatttccccatgtggggagtcgacaggtttctagaaaaatag

SEQ ID NO: 9256 - DNA, 768 bp, Pseudomonas aeruginosa
tcgataccatctcgcatcttagagaaccctcccatgcccctgcctgccctacccctgcctgccctacccctggatgcccttctcaccggccgcgcccagcccttcacccgccccggctcgcgcagcggcatcgccaagtctccgcgcgacggtgcgctcagggtcacccccgtcggcctggagggcgacgaacagggcgacctgcgcgtccatggcggcgtcaagaaagcgatccaccattacccacgcgaacactacgccgcctggatcgccgaactgggcgaacaccccctgctgatgcaggcgggcgccttcggcgagaacttcagcaccagcggctggagcgaagccgacgtctgcctcggcgaccgcgtgcgggccggcaccgcgctgctggaggtgtcccaggggcgcatgccctgctggaagctcaacgaccgcttcgaggtcgccgggatgtccctgagggtgcaggagtccgggcgcaccggctggtactaccgggtgctggaggaaggcgtggtggcggctggcgatatcctgcaactggtcgaacggcgccatccggactggtcgttgttgcgcctgtccgaggtgctgttcgacaggcgggccgacgccgagctgctgcgccagtgcctggcgctgccgctgacgccatcctggcggcgcaccctggagcggcgcctggaaaaaggccaggtcgaggactgggggccgcgcctggagggagcccccggccaggccgagacgcccaggccgacctga

SEQ ID NO: 9257 - DNA, 630 bp, Pseudomonas aeruginosa
gcgacccagacgtctgccaaaggaccccttttcatgctgcggctctcgatgccggccctgctcctggctcttgccggctgcgccaccaagccccccgccaatcccgacaacctctgcgagatcttccgcgaaaaaccgaaatggcacgaggcggcgctgaagatgcagcagcgctggggcgcgccggtccaggtgccgatggcgatgatgtaccaggaatcgtccttcaagcacgacgccctgccgccgcgctactacttcctcggtttcatcccctggggccgggtcagctccgcctacggctacgcccaggccaaggacgagacctgggccgactacaagcgcgaggccggcggctggggcgccagccgcgacgacttcgccgacgccctggacttcatgggctggtacatccagaagagccaacgggtcaatggcgtctccaagtgggacgcctacggccagtacctgaactaccacgagggctggggcggctaccgcaaccgcagctacgacgccaagccatggctgaagaacgtctcgcagaaggtccagtcccgcgcctcgctgttcggcgcccagtaccgcagttgccagcaggaactgtcgcgcggcggctggttctggtag

SEQ ID NO: 9258 - DNA, 426 bp, Pseudomonas aeruginosa
tctgggtcttcaagttccgctcgatgtacacggaaaggaccgacgccaacgccgaacgccagaccacccgcgacgacgaccgcatcacccgggtcggccgcttcatccgcaagaccagcatcgacgagctgccgcagctgttcaacgtgctcgccggcagcatgtcgatggtcggcccgcgcccccacgccaccgcgaccaaggccgccggcattcccttcgaggaggcggtcagcgaatacagctcgcgccaccgggtcaagcccggcatcaccggctgggcgcagatcaacggctaccggggtgagaccgacaccctgcacaagatcaagaaacgcgtggaatacgacctcgaatacatcgccaagtggtcggtgtggttcgacctctacatcctgttccgtacggtgccagccgtactcctga

SEQ ID NO: 9259 - DNA, 1215 bp, Pseudomonas aeruginosa
ccagagcctgttgcagaagaccttcctgcgtatcgccgggctgccggacgtcgcccgcctgctcacggtgaccaaccgcgacctgctgttccgtaccctggacgactaccgcgcggtcaaccgcagcggcctggcccaggacctgctgctggagccgatgggacgcaataccgcgccggccatcgccgccgccgcgctgcatgtgcaggagcacttcggcgaccaggcgcagttgctgatccttcccgccgaccacctgatccgcgacgagcaggccttcgccgcggcggtggccgaggctcgcggactcgcggcccaagggtacctggtgaccttcggcatcaccccggagcgcgccgagaccggcttcggctatatcgaacagggcgccccgctgggcaacggcttccgggtcgcacgcttcgtcgagaaacccgaccaggccaccgcccagtcctacctggacagcggcaagtacctgtggaacgccggcatgttctgcttccaggccgccaccgtgttgcaggaactggagcgccacgcgccggaggtgctgatcgccgcccgcgccgccctggccgacggcagcagcctggagaacggccagtgccgccagcgcgagctggccgccggggccttcgccgaggcgccggacatctccgtcgactacgcgctgatggagcgctcggacaaggtcgccgtggtgccctgctccatcggctggagcgacatcggctcctggcaggcgctgcgcgaactcagcgcggcggacgagaacggcaaccaggtacgcggcgagagcgtgctgcacgacgtcagcaactgctacatcgattcgccgaagcgcctggtcggcgccgtcggcgtgcacgacctgatcatcgtcgacacccccgacgccctgctggtggccgacgcggcgcgcagccaggacgtcaagttcgtcgcccaggaactcaagcgtcgcggccacgacgccttccgcctgcaccgcacggtcagccggccctggggcacctacaccgtgctcgaggaaggccgccgcttcaagatcaagcgcatcgtggtgcgccccaaggcttcgctgtcgttgcagatgcaccaccatcgcagcgagcactggatcgtgctcagcggcatggcgctggtggaaaacggcgagcgcgagtttctcctcaacaccaacgaatccacgttcatccccgccgggcatag

SEQ ID NO: 9260 - DNA, 1050 bp, Pseudomonas aeruginosa
ccaccgcctgagcaatccggggatcatcgacctggtgatgatcgaggtacagagcggcgagtacctcggcgaggacgacatcgtccgcttcaacgacatctacggtcgcgcccccgccagcgacgagaagaaagcctgatgcgctgcgccctggtcattcccacgcgcaacgccggcgcgcacctggaccggctgctgccggccctggtcgcgcaacggcggcagccggacagcatcctggtggtggacagccgctccagcgacgacacggtggagcgcttccgcgccttcggcgcgcgggtcgaggtcatcgagccggccagcttcaaccacggcgggacgcggcgctgggccagccagcaggtcgaggccgacgcgctgatctacctgacccaggacgccattcccgcctcgcccgacagtttcgccaacctgctcgacgaactctatgccgaggccgacatcggcgtggcctacggccgccagttgccgcaccccggcgccggcctgctcggtgcccaggcgcggcgcttcaactacccgccggaaagccgcagcaagcgcctggccgacgcctcggaactggggatcaagacctgcttcagttccgactcgttctccgcctaccgcagcgacgccctggcggccgtcggcggcttccccgaagacgtcatcggcagcgaggacgcctacgtcgccgcgcgcctgctgcaggccggctacgcggtgcgctacgcggccagcgccgaggtctaccattcccacgattaccgcttgctggaagagttccgccgctatttcgacatcggcgtgttctacggccgcgagcgttggatacgtgccgccttcggcggcgcgggtggcgagggcaagcgctatgtcctcgccgagatacaggccttgcgtgccgccggtgccctgtatcgcgtacctgaaatagcgctgcgtagcgcgttcaagctgctcggctaccgccttggccagctggaacgccacctgccggtcgccctcaagcgccgcatcagcatgtttccaggctactggaagtga

SEQ ID NO: 9261 - DNA, 1128 bp, Pseudomonas aeruginosa
ctcgaccctgccgatcgagatcagcaaccgccaggcgctggtgatgccgagcacccagcgcgaccctatcgtcgacgaagaacgcctgctcaccggccgaccgatcgtccgccaggtggccgagcgctacctcgaggtgctggccaaccggccgccgccggagggcctgtggaagcgcaccaagttctatgtgaagaaggccatcggcgcggtgttcgacgggattcgcgtgaccctggaaaccttcggcgtgatcgaggaaaccaccgcggtcgagcgcctggccaaggacctcgagaagaaattcgaggtcacccatgcggccggctcgacggtgatggagatcagcttcacctggagcgagccggaagtcgcccaggaagtggtcaaggcctggatcgagatctacatggaagagcgcacccaggcgctcggccgcaagagcctgtacgccttctacgaggcgcagactgccgacagcgcggcgcagatcaagagctacaaggcgcagatcctcaagcacctcaacgagatcggcgcatccagcatcgaggaccgcctgcaggacctgtccgagcggatcaacgtgctgcgcggcgagcgtttcaactcgatccgcctgatcgcctcctccgacagcgccctggaatccacccgccagcaactcaaggggctgcccagggagatcgtcacggtgcggcagatcgcgctgaacccggcgcagcaggacctgcgccggctgctcaaccagaagcgcctggaacgcgccgacatgatgcgcacctacaccgacgatgcgccgccggtgaaggccctggacgcctcgatccgtgccctggagaaggaagtccaggacgaaggcgccaccgtgcagagttccgaggaccgcgcgccgaacaccctgaccactcacctggaacgggtcctgctggacgagaccagcaacaacgcggccctgcgcacccagctcgcggagcaggaaaagcagctcgccgaactcgaggcgcaacggcgcgaagcgctggacatcgagccgaccctggcgcgcctgcagcgcgagctgaacgccaccgagcgcaactacgcgctgtacgtcgacagcctggagaaatcgcggatcgaccgtga

SEQ ID NO: 9262 - DNA, 1395 bp, Pseudomonas aeruginosa
ccatcctcaccacggcgttcggcaaggtcgacgggatcatcatcaaccggcgccgcttcgaggtgccgagcaaggtcctgcagaccatcgcccgctaccggagcgcgttctgatgcggatcgccctcctcgcgcccctgccgccggaaaagaatggcatcgccgactacgccagtcatttccgcaacgccctgcagggtctcggcatcgaagtagccacgccgctcgccggcgtggcggccgacagcgcgaatatcgccagccggctggacagcgtcgactggaacgccttcgacctggtccatgccgaactcggcggcggccgcctgggcgagttcatcgccctgcgcgagctgcgcaagcgcttcccgcgcctgccgctgagcgccacggtgcacgatccggagcgcatggtctggcgccgcgagcgcctgccctggccgctgaacctgctggaacgcctgccctctcccctgccccaggccgccgtggtgctcgccgacccgctgaccctgcgcgaagagcgtgccgtggcccagggcctgacgcgcctggtgaccctcaccggcctgggcggcgagtgcctggcccggcggatgcgcctgccgcccgggcgggtcgaggtgatcaaccacggcaacctggagatcgccacggtgccgctgccgtcgctggacaccctgcgcctgctgtacttcggattcatctatcgcggcaaaggcatcgaggacctgctcgaggccctcgccgacctgttcgccagcgcgccggagatgcgccagcgcgtgcgcctgaccctggccggcggcaccgccgcggaaatggccttcggcgccggcggcaactacctcgaccagttgaaggcacagatcgccgagcttggcctggccgacgccatcgactggaacctgaacctggccgccgcggacatcccgcgtaccatccaggcccaccacgtgatggtcctgccgtaccgcgagtcgaagaaactcggtctgctcggccagcagcgcggcaccagcggcgccctgtcctgggcggcagcctgcgggcgcggcgcgatcacctcggacgctcgcgccttcgccgaggaagtcgccagcggcaacggcgccatctaccctcagggagacgtggcagccctctccgaacagttgttgaacctcgctcgcgaaccccgcctggcacaggcctgggccgagcgcgccggagcgatcggccatgcgcggacctggccgcgcaccgcgctgcgcttccaggcactgttcaacgacatggtgggaaccgttcatggcacgtaagggactctatctgggcggcagcgcgctgctgctcgccgtggtactgctgctggtgttctgggggcgtcccgccgacgccgagatccaggtactga

SEQ ID NO: 9263 - DNA, 417 bp, Pseudomonas aeruginosa
tcggcttctggcggcccaaggccgatccggaaggctacgccaagctgctccaggccagcaccatcgccctgcgcatggtcgacccggagaagccggtggtttccgccggcatggccttcttcagcgagatgcccgacggccgcaccatgttcgatgccctcggccacctgggcgtggagagcctcggcaccatcgccacctaccacccctatacccagttgccggaaggcaactacccgtggaacctggacttcgtctcccacgccaaccagatcaaccgcgccctgcgcaacgccggcgtgccggcgatctggagcaccgagtggggctggtcggcctacaaggggccgaaggagttgcaggacatcattggcgtcgaaggccaggccgactacgtgctgcgtcgcctggcgctga

SEQ ID NO: 9264 - DNA, 1395 bp, Pseudomonas aeruginosa
cttccagccctacgagcgaccgctgcgcgacgccggccagccgttcgtgctcaccgagcacaacgtcgagtcgtccctcggtgccgccacctacgaccgcctgccgggctgggcgctgcccttcgtgcgctacgaccagtggcgttaccgccgctgggaacgccgggtgatgagccaggcggcagcggtcgtcgccgtgaccgagaaagatgcgcggcagctcagcgcgatgctcgggcgcccggtgccagtggtggtcaacggggtcgactgcgagcacttcgccgccgcccggccgacgcccgaagcgcagcgcgtgctgttcctcggcaactacgaatacgcaccgaacgtcgatgccgtggaatggatgctcgacgagatcctgccgcgggtctgggcacactgccccgaggcgcgcatgagcgtctgcggctatgcgctgccggcggagtgggcgcaacgctggagcgatccgcgcatcgaatggcaaggcttcgttcccgacctgctgcaactgcaatcgagcagttcggtgttcctcgccgcgctgcgccatggcggcggttcgaagctgaaggtgctcgaggccctggccgccgggctgccgctggcgagtaccgcgcagggcgtttccggcctggaactgcgggacggcgaggactacctcggcggcgaatccgccgagcagctcgccaacgccgtggtgcgcctgttgcacgacccggcgcatgcccgcgcgctgggcgagaacggccgcgcctacgtacgtcgcgcgcacgactggagcgtcgccgccagccaactggaacaggtctacgccggcctcgccgaagggagcgccggcatgcgcataggactcgactaccgcaccgtcggcagctcgccgcactcgggcatcagccgccaggtctatgccatggagcaggccctggaaagcctgcccggcacgcaggtgacccgcttcaccgtggcccctctcgacgacccgctgcgccagcgggcggtctgcccgccgtggggctgcccgcgcaccgcgatgcaccagccgcaccagcgcctgcgcttcgaagccgggttcctcccacgcgccttgcgcgaacaggacatcgacctgtacatcagcaccttcaacatgggcctgccgctaccgccgcgtccgccgggcgtgcgctatgcgctgctgatccacgatctgttccagatcaccctgaagaactaccacgccaaccgcctcaaggcactggtctatcggatcagcgagtacctgtcgatcgcctatgcgctgcgtgtcgccgaccgtgtctggaccccttcgcagtacagcgccgacgaggctgtgcggctgtttcccggggtcgccgggaaagtccgggtgctgcccaaccaggttga

SEQ ID NO: 9265 - DNA, 1995 bp, Pseudomonas aeruginosa
cggcttctccggcgaacccgccgacctttcggcacgcggcctgccgccacgatactggctgctggtgggtacccgcgaactgcgcaagaacgtgccctggttcgtcagtgcctgggcccgggcgcgcgcccaggcgcccggcgtgccgccgctggtgctggtcggcagcctcgaccacctgcccgaggaacaacgcggcttgcccggcctgcacgcgctcggcgggctcgacgacgccgaactgcacgcgctgtaccgccaggccgagcggctctggcaaccgtcctacgcggaaggcttcggcctgccggtggtcgaggcgctgagcgtcggcacgccggtggcggtggccagcggcacctcgctggacgaagtcaccccgccgtcggcgccgcgcttctcgcccagcgacggcgccgccctggaacgcctgatgctgcgcctggccgatgcgccgcgcgaagcctcggcggaagaactcatcgcctgggccgcgcgcttcaaccgcgaagcctaccggcaacggctggccgcactgatcgaggaactgagttgagaatgtcgttgggaaacctcgtcgctgtcgtcttcggcctggccttcggcggagcgctgctgatgctcagcccggccaaggccggcgccgccatggtcggcctggcggccgcggtcaccatcctgcgcttcccgttctgggggctgctgctgttcgccctggtggcgaccttcatgccctactccacggtcaacgtggggatccgttcgacggtcagcgaagcgatcctcgccctgacctggggcgcggtgctctggcacatcttcctctcgcgcctgccgccggcgccggcggtgcgctaccgctccaccgagcgcatgctgctgtggctgatgctgttcaccgtgctgccgttcgtggtcggccaggtcagcatcaaggccgaggccagcggcctgtcgaactggctgcgctggttgctcaacctgtccatcgtgttcctcgccggacgcctgctggtggagcgcaagaaccgcgagacactggtcatcgccctgctgctgggcaccctggcgatgctgctgatgtccatcgcggtgttcatccgctaccgctcggcgtcggggatggcgccgatcctggcgatgttcaactacgccaacctggacaccctcaagttcggcctggaggcgctttcctcgcggatgggctcgccatggatgcaccccaacgccaccggcgggatcatggccctgctgctgcccctggcgttctgctacggggtcgccaaccagggctggcggcgcggcctgggcctcgccgtggcggtcctcggcgccgccgcgatcctcctcgccagttcccgcggggcgatgctcagcctggcggtggtgctgttctggatgtccctgcgcaaggtgccctacaccggccgcctgctgttgctcggggtcggcctggtggtggtcctggtgctcagctacccgccgttgcaggaacgcctggcgaccatcttctcgccgcagaacgccagtaccgaggtgcgcttcgacgagtatcggatgttccccaaggccgtcgcccgctatccgctgggaatcggcttcaaggtcgacccgccggtgccgggtaccgacctcctgggcatctccaacctgtggctgaacttcatgtacaaggtcggcctcggcggcatgctgctgttcatcgcggtgacctggcgctggtggcgcgaagcccgtccggagaaaggcccgatccgcctgacccgcgacaacgcgatctggctgggcagtacgggcggcatcctggcggcgctggtcagcggcctgttcgaccactacttcagcttcgccgtggtgatgatcggcctgttctggctgctggtcgggatcaacctgctggaagcccgccggctgttcccggaacgccagccgcaaccgcgggcggtgggttatcgcaagctcaagcgacagctcgagcgcggggccgaagcctga

SEQ ID NO: 9266 - DNA, 1428 bp, Pseudomonas aeruginosa
gatgctcggctccgccttctggctgacccttgccaccctgctcggcctgtgcctgggcttcgcccgcgaatggctgctggtggcctcctggggcgccggcgagcgcagcgacgccttcctcatcgccctgttcctgcccgaggccctgcgcatgtcgctggccggcggcgtgctcagcgcggcggccctgccactgttcctcgaacgccagggcgaacgtcgcctcgactggctggcggcaatcctcccggcgctgctcggtatcgccgtggcgctcagcctcctgctgctggcggcggcgccctggctggtgcgcttgctcggcccgggcctggccgagacggccagcgcccaggccgcggccaacttgcgggtcctcgcctggtgcgtgccggggctgatgctccatgcgctattcagcatccccctgcaggccgccgagcgcttcgtcctggccgggctcggctcgctgctgttcaatctaccgccggtgctctacctggccttgcacggccaggccagccagcccgaacaactggccctggcctgcctgctcggcagcctgctgatgccgctggtgctgctgccttcgctatggatcgagggctggcggccctggcactggcgcctgtccggcaccgaactgggcgagcttggcgggcgcatcggtccgctgttgctgagcaacgccgccagccagggcctggcgctggtcgagcggctggtggcctcgctgctcggcgaaggcgcggtgacctgggtcaacctggcgcgcaagctgatgaacctgccgctgatcgccctgatgagcctcaaccaggtgttgctcggcatgatgagccgacgccagggtggcgagcgcctggccctgcttcgccgcggcctggagaccgccagcctgctgaccctgccggccggggtcgggctggtcgctgccgcacccggcctggtggccctgttgctgccgcagcagaccgccggctcgccgttgccggcgctgctggcctggttcgccgtgccactggtgttcggcgcctggaatgccttgctggcgcgttacgcctacgccgccggcgatactcgcctgccactgcgctgcgagctgctcggcagcgcgctgaacgccgcgctgctggcggtcctgccgttgattttcggactgccggggattcccctcgcggcccttggcggggtgctctgcaccgcgctgctgctgatgcgtcgccaggccctgctcggcgccctgccctgggcccggctgtggctgctgagcgccctggccatggcactggccgccggcctgctgttccgcatcgacggcatctggctgcaactgggcctgggcaccgtcgccggctgcctggcgctgctcggcatggcgctctggctgcggccctggcgcaccgattgacccatggctccgggtag

SEQ ID NO: 9267 - DNA, 765 bp, Pseudomonas aeruginosa
  unsure (679),(709),(730),(742): Identity of nucleotide at the above locations are unknown.
aatatggaacatcgttccgaaatcttgaaaaagggagaagccatgacctctgcggccgtcgagaccaccccgctaacctgtgacgtgctggtcgtcggctccggcgccgccgggctggcggcggcggtgaccgcggcctggcacgggcgccgggtagtcctggtggagaaggacccggtgttcggcggcgccagcgcctggtccggcggctgggcctggttgccgcgcaacccgctggcgcgtcgcgccggtatcgaggaggacatcgagcaaccgcgtacctacctgcgccacgaactgggcgagcgttacgacgccgcgcggatcgacgccttcctcgaagcctgcccgcacatggtggccttcttcgagcgccacacccacctgcggttcgtcgacggcaacggcatcccggacatgcatggcgacacgccgggcgccgccgagggcggccaccagttggtcgccgcgccctatgacgcacggcaactgggcccgctgctgccgcgcctgcgcaagaccctgcgggagacctcgttcatgggcatgccgatcatggccggcgccgacctcgccgccttcctggacctgacccgctcgctgccggccttcctgcatgtcgcccggcgcttttccagccacctctggcacctgttgcgctacggtcgcgccatgcacntggtcaatggcgtggccctggtagcgcgcntggtcaagtccggggcagccntgggtgcgtgcntatgtggccttccgaaggggtca

SEQ ID NO: 9268 - DNA, 1380 bp, Pseudomonas aeruginosa
cggacgttacgtgtaaatcaccagtccggagctaagcgcattttccggactggtgactctcccctcggtcgggctgcgcctaacgtaacgtctgcacattatgcgaatccatggtgttacggccaaatagcaatggcgtctagggtttccctcctgcatcacaggaggcacgccatgactgcggcaacttgcggatgggtcaccatgagcatgcgggagctggatcgcctcaaggtcatcgaggcaatcatcgagggtcggttgaaacctgccgctgcggcgcagcgtctgcgcctgacgacacgtcaggtgcaccggctggttctgcgttatcgcgaggacggcccagccggcctaacatctcgtcgacgtggtcagccgagtaaccggcagttgtcgccaggtctggagaatcccgccattagcttgattcgacggaactatagcgactttggtccaactctggcccaggaaaaactggtcgagtgccacggccttaagctggccaaagaaacggtacgacggatcatggttgatgccggcatgtgggtaccgcgcaagcaacggccgcccaaggtctatcagccacgcaaccggcgcgcctgttgcggcgaactgatccagatcgatgatggaaagccgctggccttctacagcgacaaagccagcgtgttccgcagtaaccacaaggcgcctcagggcggcgacggctatacccagttcggccaagcgatgtacgagttgaacatcgagagctgcgccaacagcagccaggccaaaggtcgtgtggagcgtgcgaacctcactctgcaggatcgcctggtcaaggagctgcggcttcgcggaatcagcaacatggccgacgccaatgcctttgcagcccactttatggccagctacaacgcgcgttttgccaagccgccgcgctctgagcatgactgccatcgcccgctgcacagtgatgaagatttggagctgatcttcgcctggcgagaagcgcggcgggtttcgcagcggttgaccgtgcagtacgacaaggtgctgtatctgctagcggacactccgcagtcccgtcgcctggcgggtgatcacgtcgatgatctaccactacccgaatggccgcatcgagcccagggtggacggcaccgccctcccctttaccacctacgacaaactctgcgagatagaccagggtgccatcgtcgagaacaagcgcttgggtcatgtgctgcaagtcgcccagctcgtccaagcgcagcgcgacaatcggcgctcgcaatcggtaccgggaaatccgcggcagtcaacgcaaggcaagatgctgtcgaagaaggcgcagcgagaactgatgccggaagatatcgccgctgccctggataa

SEQ ID NO: 9269 - DNA, 1278 bp, Pseudomonas aeruginosa
cctgtcgctgacacgggctggattcatcgagtacttcctggtcgcgaccaaactggtacacgcgctcaccgccatcgccccggcgctgttcctgctgtactaccccggcctggttcccgtggagctgcgcagcaacatgctcgggctactgctgttcttcggcgcgctcacggtgatcatgttccaggcactggacgtctactccgacgatatcttcagcaaccgcctgcgcttccgcatcatgttcttcgcctgggcctcggcgttctgcctgctgttgttcatgtaccagggcctgggcctgtttccctacctcagcagcaagctggtgatcttctggttcaccggcagcctgctgctgttcggcgtgcagcgcctgctggtgctgcgcctgtaccgggcctggatgaaacgcggcatgtacctgcaacggacggtgatcctcggcttcaccgagagcggcatgcacctggccgaatacctggtacgcaaccacgacatccgctccggcatcatcggcttcatcgacgaccgctccgagcgggtcccggagaactacaactcgctgccgctgctgggcaacaccaaggacctggagaagctgatccgccaggaacaggtcgaccaggtgctggtcgccctgccctggttcgccgaggggcgcatcggcgccatcgtccatcgcctgcggcaattgccggtgaacgtcctgctggtgccggacatggctgccttccggcatgcccacaaccgcatcgtcgatgtctccgggatccccatgttcaacgcgtccgagctgccgctgcgcggctggtcgccgctgatcaagcgctgcgaggatctggtcctggggagcatcgcgctggtcctcttcgccccgctgatggccctggtggccctggcgatcaggctcgactccaaggggccggtgctgttccggcagaaacgctacggctacaacaaccggttgatctgggtcttcaagttccgctcgatgtacacggaaaggaccgacgccaacgccgaacgccagaccacccgcgacgacgaccgcatcacccgggtcggccgcttcatccgcaagaccagcatcgacgagctgccgcagctgttcaacgtgctcgccggcagcatgtcgatggtcggcccgcgcccccacgccaccgcgaccaaggccgccggcattcccttcgaggaggcggtcagcgaatacagctcgcgccaccgggtcaagcccggcatcaccggctgggcgcagatcaacggctaccggggtga

SEQ ID NO: 9270 - DNA, 1602 bp, Pseudomonas aeruginosa
gaccgacaccctgcacaagatcaagaaacgcgtggaatacgacctcgaatacatcgccaagtggtcggtgtggttcgacctctacatcctgttccgtacggtgccagccgtactcctgaccaaggaagtctactgatgaacgccgtcgccccgctgatcccctgcatcgtttccggcggttccgggacccgcctgtggccggtttcccgggagagcatgccgaaacccttcatgcgcctggccgatgaccagagcctgttgcagaagaccttcctgcgtatcgccgggctgccggacgtcgcccgcctgctcacggtgaccaaccgcgacctgctgttccgtaccctggacgactaccgcgcggtcaaccgcagcggcctggcccaggacctgctgctggagccgatgggacgcaataccgcgccggccatcgccgccgccgcgctgcatgtgcaggagcacttcggcgaccaggcgcagttgctgatccttcccgccgaccacctgatccgcgacgagcaggccttcgccgcggcggtggccgaggctcgcggactcgcggcccaagggtacctggtgaccttcggcatcaccccggagcgcgccgagaccggcttcggctatatcgaacagggcgccccgctgggcaacggcttccgggtcgcacgcttcgtcgagaaacccgaccaggccaccgcccagtcctacctggacagcggcaagtacctgtggaacgccggcatgttctgcttccaggccgccaccgtgttgcaggaactggagcgccacgcgccggaggtgctgatcgccgcccgcgccgccctggccgacggcagcagcctggagaacggccagtgccgccagcgcgagctggccgccggggccttcgccgaggcgccggacatctccgtcgactacgcgctgatggagcgctcggacaaggtcgccgtggtgccctgctccatcggctggagcgacatcggctcctggcaggcgctgcgcgaactcagcgcggcggacgagaacggcaaccaggtacgcggcgagagcgtgctgcacgacgtcagcaactgctacatcgattcgccgaagcgcctggtcggcgccgtcggcgtgcacgacctgatcatcgtcgacacccccgacgccctgctggtggccgacgcggcgcgcagccaggacgtcaagttcgtcgcccaggaactcaagcgtcgcggccacgacgccttccgcctgcaccgcacggtcagccggccctggggcacctacaccgtgctcgaggaaggccgccgcttcaagatcaagcgcatcgtggtgcgccccaaggcttcgctgtcgttgcagatgcaccaccatcgcagcgagcactggatcgtgctcagcggcatggcgctggtggaaaacggcgagcgcgagtttctcctcaacaccaacgaatccacgttcatccccgccgggcatagccaccgcctgagcaatccggggatcatcgacctggtgatgatcgaggtacagagcggcgagtacctcggcgaggacgacatcgtccgcttcaacgacatctacggtcgcgcccccgccagcgacgagaagaaagcctga

SEQ ID NO: 9271 - DNA, 549 bp, Pseudomonas aeruginosa
cccaggacgccattcccgcctcgcccgacagtttcgccaacctgctcgacgaactctatgccgaggccgacatcggcgtggcctacggccgccagttgccgcaccccggcgccggcctgctcggtgcccaggcgcggcgcttcaactacccgccggaaagccgcagcaagcgcctggccgacgcctcggaactggggatcaagacctgcttcagttccgactcgttctccgcctaccgcagcgacgccctggcggccgtcggcggcttccccgaagacgtcatcggcagcgaggacgcctacgtcgccgcgcgcctgctgcaggccggctacgcggtgcgctacgcggccagcgccgaggtctaccattcccacgattaccgcttgctggaagagttccgccgctatttcgacatcggcgtgttctacggccgcgagcgttggatacgtgccgccttcggcggcgcgggtggcgagggcaagcgctatgtcctcgccgagatacaggccttgcgtgccgccggtgccctgtatcgcgtacctgaaatag

SEQ ID NO: 9272 - DNA, 3729 bp, Pseudomonas aeruginosa
actgacgctgtacaccgtgctcaacgacggcagcatctactatccgttcatcggtcgcatccaggccgcgcaccgcacgccgcaggaaatcgccaacgagctgaccaccaagctcgcgccgatctaccgcgagccgcgggtcacggtgaacatcaaccaggcgccgggcaatacggtgttcgtcggcggcgcggtgcgcaacccgtcggccgtgccgatccccgccgccaacaacatggagcaggcgatcctcggcgccggcggcatcctgccggtgggcgacgcccgccgcgtggcgctcatgcgcgaggactcggaaggccgctatcacgcctacttcctcgacttcagccagttgatgaagatcgggccggaaggccgcaagcccctggccatgcagcgtggcgacatcgtcttcgtgcccaagtcgatggtcggcgaccgtatcgagggcgtcgacgtctacctgaaccagttgctgcccttcgccaagtccatcggcgtcggcgtcagctacaccgtcaacaacgatcgctgaggagcgacatcgccatgatagaaattcgttccttgcgtgatctgttgcgcctgctgttcatctaccagcgcgagttcaagctggcggccctcagcgcggtggtgatcatcgtcctcggcgccttcctgctgccggccaagtacgagtccaacgcacgcctgctggtcaagccgggccgtgactcgaccctgccgatcgagatcagcaaccgccaggcgctggtgatgccgagcacccagcgcgaccctatcgtcgacgaagaacgcctgctcaccggccgaccgatcgtccgccaggtggccgagcgctacctcgaggtgctggccaaccggccgccgccggagggcctgtggaagcgcaccaagttctatgtgaagaaggccatcggcgcggtgttcgacgggattcgcgtgaccctggaaaccttcggcgtgatcgaggaaaccaccgcggtcgagcgcctggccaaggacctcgagaagaaattcgaggtcacccatgcggccggctcgacggtgatggagatcagcttcacctggagcgagccggaagtcgcccaggaagtggtcaaggcctggatcgagatctacatggaagagcgcacccaggcgctcggccgcaagagcctgtacgccttctacgaggcgcagactgccgacagcgcggcgcagatcaagagctacaaggcgcagatcctcaagcacctcaacgagatcggcgcatccagcatcgaggaccgcctgcaggacctgtccgagcggatcaacgtgctgcgcggcgagcgtttcaactcgatccgcctgatcgcctcctccgacagcgccctggaatccacccgccagcaactcaaggggctgcccagggagatcgtcacggtgcggcagatcgcgctgaacccggcgcagcaggacctgcgccggctgctcaaccagaagcgcctggaacgcgccgacatgatgcgcacctacaccgacgatgcgccgccggtgaaggccctggacgcctcgatccgtgccctggagaaggaagtccaggacgaaggcgccaccgtgcagagttccgaggaccgcgcgccgaacaccctgaccactcacctggaacgggtcctgctggacgagaccagcaacaacgcggccctgcgcacccagctcgcggagcaggaaaagcagctcgccgaactcgaggcgcaacggcgcgaagcgctggacatcgagccgaccctggcgcgcctgcagcgcgagctgaacgccaccgagcgcaactacgcgctgtacgtcgacagcctggagaaatcgcggatcgaccgtgaactggacaagagccagatcagcaacatctcggtgatcgaggaagccacctacaaccccgggcggatcttcccgaaaaccctgctgatgctgttcctcgccgtgcccttcggcctcgccgtcggcctgctggtggtctatctctgctacctgctcgaccagcgcatccacgacggcggcctggtcgaggagaaattcggcctgccgctgtggaccaccctgccggagctgagcaacagcaccgcggagagcagcaacgccttcaccgccagcatctaccggctgtacgggctgctgccctacgcgcgcatcgaggaaaagggcctgaccctgggcctgacctcggcgcgccacggtgaaggcgtgaccttcatcatcgagcaactgccccgcctgctggaggaaaacggcgtgcgcgtgcggatcggcggcgaaccggcccagccggggcgaagtggtattgctcgacgcgccggccctgctggacagccgcgaggccttcatcgccctgcgccgcgccgacctgatcgccctggtggtagaggcgcagaagagcaccgtgccggtggtcgagcatgcgctgaccatcctcaccacggcgttcggcaaggtcgacgggatcatcatcaaccggcgccgcttcgaggtgccgagcaaggtcctgcagaccatcgcccgctaccggagcgcgttctgatgcggatcgccctcctcgcgcccctgccgccggaaaagaatggcatcgccgactacgccagtcatttccgcaacgccctgcagggtctcggcatcgaagtagccacgccgctcgccggcgtggcggccgacagcgcgaatatcgccagccggctggacagcgtcgactggaacgccttcgacctggtccatgccgaactcggcggcggccgcctgggcgagttcatcgccctgcgcgagctgcgcaagcgcttcccgcgcctgccgctgagcgccacggtgcacgatccggagcgcatggtctggcgccgcgagcgcctgccctggccgctgaacctgctggaacgcctgccctctcccctgccccaggccgccgtggtgctcgccgacccgctgaccctgcgcgaagagcgtgccgtggcccagggcctgacgcgcctggtgaccctcaccggcctgggcggcgagtgcctggcccggcggatgcgcctgccgcccgggcgggtcgaggtgatcaaccacggcaacctggagatcgccacggtgccgctgccgtcgctggacaccctgcgcctgctgtacttcggattcatctatcgcggcaaaggcatcgaggacctgctcgaggccctcgccgacctgttcgccagcgcgccggagatgcgccagcgcgtgcgcctgaccctggccggcggcaccgccgcggaaatggccttcggcgccggcggcaactacctcgaccagttgaaggcacagatcgccgagcttggcctggccgacgccatcgactggaacctgaacctggccgccgcggacatcccgcgtaccatccaggcccaccacgtgatggtcctgccgtaccgcgagtcgaagaaactcggtctgctcggccagcagcgcggcaccagcggcgccctgtcctgggcggcagcctgcgggcgcggcgcgatcacctcggacgctcgcgccttcgccgaggaagtcgccagcggcaacggcgccatctaccctcagggagacgtggcagccctctccgaacagttgttgaacctcgctcgcgaaccccgcctggcacaggcctgggccgagcgcgccggagcgatcggccatgcgcggacctggccgcgcaccgcgctgcgcttccaggcactgttcaacgacatggtgggaaccgttcatggcacgtaa

SEQ ID NO: 9273 - DNA, 3630 bp, Pseudomonas aeruginosa
gggactctatctgggcggcagcgcgctgctgctcgccgtggtactgctgctggtgttctgggggcgtcccgccgacgccgagatccaggtactgaaggcgcctcgcgcggtggtctggaaagacttcctcggggtcaacgcgcagttcctctggttcagcccggagcgttacaacaagcagatcgaccgcctgcaggacctggggctggagtgggtgcgcctggacctgcactgggaccgcctggaaaccgccgaggaccagtaccagctggcctccctcgaccagttggtcaaggatctcgaggcgcgccagctgaagtcggtgttctacctggtcggctcggcccgcttcatcaccaccgcgccgttctactcgcccttccaggaccagtatccgccgcgcgacccggaagtcttcgcccggcgcatggcgatgctctcgcagcgctacccgagcgtggccgcctggcaggtatggaacgagcccaacctgatcggcttctggcggcccaaggccgatccggaaggctacgccaagctgctccaggccagcaccatcgccctgcgcatggtcgacccggagaagccggtggtttccgccggcatggccttcttcagcgagatgcccgacggccgcaccatgttcgatgccctcggccacctgggcgtggagagcctcggcaccatcgccacctaccacccctatacccagttgccggaaggcaactacccgtggaacctggacttcgtctcccacgccaaccagatcaaccgcgccctgcgcaacgccggcgtgccggcgatctggagcaccgagtggggctggtcggcctacaaggggccgaaggagttgcaggacatcattggcgtcgaaggccaggccgactacgtgctgcgtcgcctggcgctgatgagtgcgctggactacgaccggatcttcctcttcaccctcagcgatctcgaccagcgcgccagcgtgcgcgaccgcgactacggcctgctcgacctggacgccaaccccaagccggtctacctggccctgcaacgcttcctcaaggtcaccgggccgaagctgcgcccggccgacccgccggtcaccgaggacctgcccgacggttccttcagcatcggctggacccgcgaggacggtcgcaacgtctggctgttctggtcggcccgcggcggcaacgtgcgcctaccgaagctcaaggaggccaccctgcacgatccactcagcggcaaggtcacgcccttgagcggcagcgacggcctggaagtcccggtgaagtccagcctgcagatgctggtctgggagtgaagccacccatgcgtattctctggatcctgccctactcgccctggcccaccaccagcggcggcaagacccgccagtaccacctgctgcgcagcctcgcggcacgcggccaccggatcaccgtgctgctgcacagcaagcagccggtgagcgccgaggaccgccaggccctggagcccttcctcgaacgcctggtcgtgctgccgcgccgaccgctgcgcagcctctccacgctgctcgccgcgctgttcgcgccctacccgctgctggccagcgtcaacggcctgtcggcggagctgcaacgcaccgccacggagttgctgcgcgagccctgggacgtggtccaggtcgagcacagctatagcttccagccctacgagcgaccgctgcgcgacgccggccagccgttcgtgctcaccgagcacaacgtcgagtcgtccctcggtgccgccacctacgaccgcctgccgggctgggcgctgcccttcgtgcgctacgaccagtggcgttaccgccgctgggaacgccgggtgatgagccaggcggcagcggtcgtcgccgtgaccgagaaagatgcgcggcagctcagcgcgatgctcgggcgcccggtgccagtggtggtcaacggggtcgactgcgagcacttcgccgccgcccggccgacgcccgaagcgcagcgcgtgctgttcctcggcaactacgaatacgcaccgaacgtcgatgccgtggaatggatgctcgacgagatcctgccgcgggtctgggcacactgccccgaggcgcgcatgagcgtctgcggctatgcgctgccggcggagtgggcgcaacgctggagcgatccgcgcatcgaatggcaaggcttcgttcccgacctgctgcaactgcaatcgagcagttcggtgttcctcgccgcgctgcgccatggcggcggttcgaagctgaaggtgctcgaggccctggccgccgggctgccgctggcgagtaccgcgcagggcgtttccggcctggaactgcgggacggcgaggactacctcggcggcgaatccgccgagcagctcgccaacgccgtggtgcgcctgttgcacgacccggcgcatgcccgcgcgctgggcgagaacggccgcgcctacgtacgtcgcgcgcacgactggagcgtcgccgccagccaactggaacaggtctacgccggcctcgccgaagggagcgccggcatgcgcataggactcgactaccgcaccgtcggcagctcgccgcactcgggcatcagccgccaggtctatgccatggagcaggccctggaaagcctgcccggcacgcaggtgacccgcttcaccgtggcccctctcgacgacccgctgcgccagcgggcggtctgcccgccgtggggctgcccgcgcaccgcgatgcaccagccgcaccagcgcctgcgcttcgaagccgggttcctcccacgcgccttgcgcgaacaggacatcgacctgtacatcagcaccttcaacatgggcctgccgctaccgccgcgtccgccgggcgtgcgctatgcgctgctgatccacgatctgttccagatcaccctgaagaactaccacgccaaccgcctcaaggcactggtctatcggatcagcgagtacctgtcgatcgcctatgcgctgcgtgtcgccgaccgtgtctggaccccttcgcagtacagcgccgacgaggctgtgcggctgtttcccggggtcgccgggaaagtccgggtgctgcccaaccaggttgacggcttctccggcgaacccgccgacctttcggcacgcggcctgccgccacgatactggctgctggtgggtacccgcgaactgcgcaagaacgtgccctggttcgtcagtgcctgggcccgggcgcgcgcccaggcgcccggcgtgccgccgctggtgctggtcggcagcctcgaccacctgcccgaggaacaacgcggcttgcccggcctgcacgcgctcggcgggctcgacgacgccgaactgcacgcgctgtaccgccaggccgagcggctctggcaaccgtcctacgcggaaggcttcggcctgccggtggtcgaggcgctgagcgtcggcacgccggtggcggtggccagcggcacctcgctggacgaagtcaccccgccgtcggcgccgcgcttctcgcccagcgacggcgccgccctggaacgcctgatgctgcgcctggccgatgcgccgcgcgaagcctcggcggaagaactcatcgcctgggccgcgcgcttcaaccgcgaagcctaccggcaacggctggccgcactgatcgaggaactgagttga

SEQ ID NO: 9274 - DNA, 1545 bp, Pseudomonas aeruginosa
tcggcctgttctggctgctggtcgggatcaacctgctggaagcccgccggctgttcccggaacgccagccgcaaccgcgggcggtgggttatcgcaagctcaagcgacagctcgagcgcggggccgaagcctgagatgctcggctccgccttctggctgacccttgccaccctgctcggcctgtgcctgggcttcgcccgcgaatggctgctggtggcctcctggggcgccggcgagcgcagcgacgccttcctcatcgccctgttcctgcccgaggccctgcgcatgtcgctggccggcggcgtgctcagcgcggcggccctgccactgttcctcgaacgccagggcgaacgtcgcctcgactggctggcggcaatcctcccggcgctgctcggtatcgccgtggcgctcagcctcctgctgctggcggcggcgccctggctggtgcgcttgctcggcccgggcctggccgagacggccagcgcccaggccgcggccaacttgcgggtcctcgcctggtgcgtgccggggctgatgctccatgcgctattcagcatccccctgcaggccgccgagcgcttcgtcctggccgggctcggctcgctgctgttcaatctaccgccggtgctctacctggccttgcacggccaggccagccagcccgaacaactggccctggcctgcctgctcggcagcctgctgatgccgctggtgctgctgccttcgctatggatcgagggctggcggccctggcactggcgcctgtccggcaccgaactgggcgagcttggcgggcgcatcggtccgctgttgctgagcaacgccgccagccagggcctggcgctggtcgagcggctggtggcctcgctgctcggcgaaggcgcggtgacctgggtcaacctggcgcgcaagctgatgaacctgccgctgatcgccctgatgagcctcaaccaggtgttgctcggcatgatgagccgacgccagggtggcgagcgcctggccctgcttcgccgcggcctggagaccgccagcctgctgaccctgccggccggggtcgggctggtcgctgccgcacccggcctggtggccctgttgctgccgcagcagaccgccggctcgccgttgccggcgctgctggcctggttcgccgtgccactggtgttcggcgcctggaatgccttgctggcgcgttacgcctacgccgccggcgatactcgcctgccactgcgctgcgagctgctcggcagcgcgctgaacgccgcgctgctggcggtcctgccgttgattttcggactgccggggattcccctcgcggcccttggcggggtgctctgcaccgcgctgctgctgatgcgtcgccaggccctgctcggcgccctgccctgggcccggctgtggctgctgagcgccctggccatggcactggccgccggcctgctgttccgcatcgacggcatctggctgcaactgggcctgggcaccgtcgccggctgcctggcgctgctcggcatggcgctctggctgcggccctggcgcaccgattga

SEQ ID NO: 9275 - DNA, 1263 bp, Pseudomonas aeruginosa
cgcgtcaagcgggagttgcaaagtgaaaaaacgctggattcagatggatgtgacccgcggcgtgggcatcctgatcatcgtcttcgggcacagctggttcgtcgccagttcgccgaccgtgctctatccgttgctctctccgttcatcctgccactgttcttcttcatttccgggggttcttcaggaccgagcaacccttcggcgagatggccctgcgcaaggccgacgccctgctcaagccgttcttcgtgaccatgctcggctacgtcatcctccgcgacctgctgcgcggccagccgctgctgccggacatcggcggaatgctgtacgcctcggtcgacaccctgccctggcaggcgctctggtacctgccgcacttctgggtagcgaccctgttcgcctggttcatgctgcgcgtcatccatcgtctcggcctgtccctcgccgccagttgcgtgctgctggccgtgcaactgggcctgggcatcctgttcctcaagacgttctggcagatcccggtggagttcggcggcgaacagtacctgctgccgggcctgccgttcagcctggacatcaccctgatcagcagcgcccacttcatgttcggctatgtcctgcgcgacgtcctgcgtcgccaccagagttcgttgctgaccctgtgcatcgcccttgccgtgaccaccgccagcttcctctactacccgacggtggtggacatggcgcagcgccgctacgaccactggttctgggccaccgtccaggcagtgagcggcgtctacctgtgctgggcgctgtccgggctgatgatgaagatctactggctggggcaaggcgatgacctacatcggccagtcgaccctgatcctgctgatcttccacggggagatccagcacaagaccttcaacctgctggcccacctgggcctgtcggaaccggccgctgccagcgtcgccctggtgatctcggtgatcgtctcgctgctgatcggcgaagtgatcaagcgcgtcgcgctgctgcgcgccctctacttccccttcccgggtgcgcaagaagaccgccgcggtccagggcggcggcgaagcgcgctgacgccctcggcccggtgcgcctgcgccgggcctttcccctcccgtctcccttttccctaacgggcggccgacctcgcttcgacctggccgatgatcgcccgctcctttcgccgagcgggttggtacgcgggcattgcctccctagaatatggaacatcgttccgaaatcttga

SEQ ID NO: 9276 - DNA, 435 bp, Pseudomonas aeruginosa
tcctggtggagaaggacccggtgttcggcggcgccagcgcctggtccggcggctgggcctggttgccgcgcaacccgctggcgcgtcgcgccggtatcgaggaggacatcgagcaaccgcgtacctacctgcgccacgaactgggcgagcgttacgacgccgcgcggatcgacgccttcctcgaagcctgcccgcacatggtggccttcttcgagcgccacacccacctgcggttcgtcgacggcaacggcatcccggacatgcatggcgacacgccgggcgccgccgagggcggccaccagttggtcgccgcgccctatgacgcacggcaactgggcccgctgctgccgcgcctgcgcaagaccctgcgggagacctcgttcatgggcatgccgatcatggccggcgccgacctcgccgccttcctggacctga

SEQ ID NO: 9277 - DNA, 204 bp, Pseudomonas aeruginosa
gagctggaagccgaattagcgtcacgcgtcacgaaaaaagaagaagccgaggcgaaaacttgggcaattcaagagcgcaagggcaaagcgcgctggcagaccatcagcaagggcctgacccggaaggccggcgagcgccagttcgacaagctgctgtcgggcctgacagatccgcgctacacctaccgcatgattgaagaataa

SEQ ID NO: 9278 - DNA, 360 bp, Pseudomonas aeruginosa
cggacactccgcagtcccgtcgcctggcgggtgatcacgtcgatgatctaccactacccgaatggccgcatcgagcccagggtggacggcaccgccctcccctttaccacctacgacaaactctgcgagatagaccagggtgccatcgtcgagaacaagcgcttgggtcatgtgctgcaagtcgcccagctcgtccaagcgcagcgcgacaatcggcgctcgcaatcggtaccgggaaatccgcggcagtcaacgcaaggcaagatgctgtcgaagaaggcgcagcgagaactgatgccggaagatatcgccgctgccctggataacacgccaccatcgaggcgaagtcgccatgcgtga

SEQ ID NO: 9279 - DNA, 375 bp, Pseudomonas aeruginosa
tatcttcttgcattggtggtttttggcagacaaggagagatgtgccgtatgaaaaacacgagagagataaccaaaaccttcaaacatatccctacactctgttatcagttttcgagaaatccagtaggccttctctgtctcgttattcttcagtgctttcttcacttgcttgtcgttgaattttatagaggcgggctcgcagattggggaaggcttccaatacgtaccagtaaaacctgctgccgccccgcagaagccctgacagtccctgcttgcggctcctttctctatggtaattctgtcatcattcagtttgaaaacgacatcgcacgacatatcgccgatgccacggacgtcgacctgcacatgacctga

SEQ ID NO: 9280 - DNA, 1641 bp, Pseudomonas aeruginosa
gtcctggggacgaacccccgcccaccgaggctatcgacgcatccggatgggtctggcggcttgacagcgggcgaaggcttggcggactctatattgtatttagtcgataccatctcgcatcttagagaaccctcccatgcccctgcctgccctacccctgcctgccctacccctggatgcccttctcaccggccgcgcccagcccttcacccgccccggctcgcgcagcggcatcgccaagtctccgcgcgacggtgcgctcagggtcacccccgtcggcctggagggcgacgaacagggcgacctgcgcgtccatggcggcgtcaagaaagcgatccaccattacccacgcgaacactacgccgcctggatcgccgaactgggcgaacaccccctgctgatgcaggcgggcgccttcggcgagaacttcagcaccagcggctggagcgaagccgacgtctgcctcggcgaccgcgtgcgggccggcaccgcgctgctggaggtgtcccaggggcgcatgccctgctggaagctcaacgaccgcttcgaggtcgccgggatgtccctgagggtgcaggagtccgggcgcaccggctggtactaccgggtgctggaggaaggcgtggtggcggctggcgatatcctgcaactggtcgaacggcgccatccggactggtcgttgttgcgcctgtccgaggtgctgttcgacaggcgggccgacgccgagctgctgcgccagtgcctggcgctgccgctgacgccatcctggcggcgcaccctggagcggcgcctggaaaaaggccaggtcgaggactgggggccgcgcctggagggagcccccggccaggccgagacgcccaggccgacctgaggaagcgccgaccgcccccccgcaggcagggaatcggcctggggatgcatggagtgccggaaagcgggtataaagcgccagcgttaagcgacccagacgtctgccaaaggaccccttttcatgctgcggctctcgatgccggccctgctcctggctcttgccggctgcgccaccaagccccccgccaatcccgacaacctctgcgagatcttccgcgaaaaaccgaaatggcacgaggcggcgctgaagatgcagcagcgctggggcgcgccggtccaggtgccgatggcgatgatgtaccaggaatcgtccttcaagcacgacgccctgccgccgcgctactacttcctcggtttcatcccctggggccgggtcagctccgcctacggctacgcccaggccaaggacgagacctgggccgactacaagcgcgaggccggcggctggggcgccagccgcgacgacttcgccgacgccctggacttcatgggctggtacatccagaagagccaacgggtcaatggcgtctccaagtgggacgcctacggccagtacctgaactaccacgagggctggggcggctaccgcaaccgcagctacgacgccaagccatggctgaagaacgtctcgcagaaggtccagtcccgcgcctcgctgttcggcgcccagtaccgcagttgccagcaggaactgtcgcgcggcggctggttctggtagcccggtccgcgcacgccgcgggctcgaacctcttccgccttcgacgagggtag

SEQ ID NO: 9281 - DNA, 1521 bp, Pseudomonas aeruginosa
aaaatagtcactaaattgacgcttcaccgccttgctcttccctatccactcaatggactgcccgtgatcggcagagcaaacaacatgcattcgaagtcggtagatagcctgtcgctgacacgggctggattcatcgagtacttcctggtcgcgaccaaactggtacacgcgctcaccgccatcgccccggcgctgttcctgctgtactaccccggcctggttcccgtggagctgcgcagcaacatgctcgggctactgctgttcttcggcgcgctcacggtgatcatgttccaggcactggacgtctactccgacgatatcttcagcaaccgcctgcgcttccgcatcatgttcttcgcctgggcctcggcgttctgcctgctgttgttcatgtaccagggcctgggcctgtttccctacctcagcagcaagctggtgatcttctggttcaccggcagcctgctgctgttcggcgtgcagcgcctgctggtgctgcgcctgtaccgggcctggatgaaacgcggcatgtacctgcaacggacggtgatcctcggcttcaccgagagcggcatgcacctggccgaatacctggtacgcaaccacgacatccgctccggcatcatcggcttcatcgacgaccgctccgagcgggtcccggagaactacaactcgctgccgctgctgggcaacaccaaggacctggagaagctgatccgccaggaacaggtcgaccaggtgctggtcgccctgccctggttcgccgaggggcgcatcggcgccatcgtccatcgcctgcggcaattgccggtgaacgtcctgctggtgccggacatggctgccttccggcatgcccacaaccgcatcgtcgatgtctccgggatccccatgttcaacgcgtccgagctgccgctgcgcggctggtcgccgctgatcaagcgctgcgaggatctggtcctggggagcatcgcgctggtcctcttcgccccgctgatggccctggtggccctggcgatcaggctcgactccaaggggccggtgctgttccggcagaaacgctacggctacaacaaccggttgatctgggtcttcaagttccgctcgatgtacacggaaaggaccgacgccaacgccgaacgccagaccacccgcgacgacgaccgcatcacccgggtcggccgcttcatccgcaagaccagcatcgacgagctgccgcagctgttcaacgtgctcgccggcagcatgtcgatggtcggcccgcgcccccacgccaccgcgaccaaggccgccggcattcccttcgaggaggcggtcagcgaatacagctcgcgccaccgggtcaagcccggcatcaccggctgggcgcagatcaacggctaccggggtgagaccgacaccctgcacaagatcaagaaacgcgtggaatacgacctcgaatacatcgccaagtggtcggtgtggttcgacctctacatcctgttccgtacggtgccagccgtactcctgaccaaggaagtctactga

SEQ ID NO: 9282 - DNA, 900 bp, Pseudomonas aeruginosa
cgcgttcaagctgctcggctaccgccttggccagctggaacgccacctgccggtcgccctcaagcgccgcatcagcatgtttccaggctactggaagtgaacatcatgacctacaggaagtgctccctcatgaaacgcaccctcctcatgctcgccatgctcgccctggccgcatgcaacacccccgcacggattcccgcaccggacagcgacaccgtggacagcggcaagcgtgccctggaagaactcgccaggctaccgccggcgatggagcgggtgcgcgtcggggacaccctgcggatcgtccgcgatgccggggagatgccgaccctctcggcgttcaacgtcgccaccatctatgaactgacgctgtacaccgtgctcaacgacggcagcatctactatccgttcatcggtcgcatccaggccgcgcaccgcacgccgcaggaaatcgccaacgagctgaccaccaagctcgcgccgatctaccgcgagccgcgggtcacggtgaacatcaaccaggcgccgggcaatacggtgttcgtcggcggcgcggtgcgcaacccgtcggccgtgccgatccccgccgccaacaacatggagcaggcgatcctcggcgccggcggcatcctgccggtgggcgacgcccgccgcgtggcgctcatgcgcgaggactcggaaggccgctatcacgcctacttcctcgacttcagccagttgatgaagatcgggccggaaggccgcaagcccctggccatgcagcgtggcgacatcgtcttcgtgcccaagtcgatggtcggcgaccgtatcgagggcgtcgacgtctacctgaaccagttgctgcccttcgccaagtccatcggcgtcggcgtcagctacaccgtcaacaacgatcgctga

SEQ ID NO: 9283 - DNA, 330 bp, Pseudomonas aeruginosa
ccttcatcatcgagcaactgccccgcctgctggaggaaaacggcgtgcgcgtgcggatcggcggcgaaccggcccagccggggcgaagtggtattgctcgacgcgccggccctgctggacagccgcgaggccttcatcgccctgcgccgcgccgacctgatcgccctggtggtagaggcgcagaagagcaccgtgccggtggtcgagcatgcgctgaccatcctcaccacggcgttcggcaaggtcgacgggatcatcatcaaccggcgccgcttcgaggtgccgagcaaggtcctgcagaccatcgcccgctaccggagcgcgttctga

SEQ ID NO: 9284 - DNA, 1458 bp, Pseudomonas aeruginosa
acctcgctcgcgaaccccgcctggcacaggcctgggccgagcgcgccggagcgatcggccatgcgcggacctggccgcgcaccgcgctgcgcttccaggcactgttcaacgacatggtgggaaccgttcatggcacgtaagggactctatctgggcggcagcgcgctgctgctcgccgtggtactgctgctggtgttctgggggcgtcccgccgacgccgagatccaggtactgaaggcgcctcgcgcggtggtctggaaagacttcctcggggtcaacgcgcagttcctctggttcagcccggagcgttacaacaagcagatcgaccgcctgcaggacctggggctggagtgggtgcgcctggacctgcactgggaccgcctggaaaccgccgaggaccagtaccagctggcctccctcgaccagttggtcaaggatctcgaggcgcgccagctgaagtcggtgttctacctggtcggctcggcccgcttcatcaccaccgcgccgttctactcgcccttccaggaccagtatccgccgcgcgacccggaagtcttcgcccggcgcatggcgatgctctcgcagcgctacccgagcgtggccgcctggcaggtatggaacgagcccaacctgatcggcttctggcggcccaaggccgatccggaaggctacgccaagctgctccaggccagcaccatcgccctgcgcatggtcgacccggagaagccggtggtttccgccggcatggccttcttcagcgagatgcccgacggccgcaccatgttcgatgccctcggccacctgggcgtggagagcctcggcaccatcgccacctaccacccctatacccagttgccggaaggcaactacccgtggaacctggacttcgtctcccacgccaaccagatcaaccgcgccctgcgcaacgccggcgtgccggcgatctggagcaccgagtggggctggtcggcctacaaggggccgaaggagttgcaggacatcattggcgtcgaaggccaggccgactacgtgctgcgtcgcctggcgctgatgagtgcgctggactacgaccggatcttcctcttcaccctcagcgatctcgaccagcgcgccagcgtgcgcgaccgcgactacggcctgctcgacctggacgccaaccccaagccggtctacctggccctgcaacgcttcctcaaggtcaccgggccgaagctgcgcccggccgacccgccggtcaccgaggacctgcccgacggttccttcagcatcggctggacccgcgaggacggtcgcaacgtctggctgttctggtcggcccgcggcggcaacgtgcgcctaccgaagctcaaggaggccaccctgcacgatccactcagcggcaaggtcacgcccttgagcggcagcgacggcctggaagtcccggtgaagtccagcctgcagatgctggtctgggagtga

SEQ ID NO: 9285 - DNA, 384 bp, Pseudomonas aeruginosa
gcgccgaggaccgccaggccctggagcccttcctcgaacgcctggtcgtgctgccgcgccgaccgctgcgcagcctctccacgctgctcgccgcgctgttcgcgccctacccgctgctggccagcgtcaacggcctgtcggcggagctgcaacgcaccgccacggagttgctgcgcgagccctgggacgtggtccaggtcgagcacagctatagcttccagccctacgagcgaccgctgcgcgacgccggccagccgttcgtgctcaccgagcacaacgtcgagtcgtccctcggtgccgccacctacgaccgcctgccgggctgggcgctgcccttcgtgcgctacgaccagtggcgttaccgccgctgggaacgccgggtga

SEQ ID NO: 9286 - DNA, 1470 bp, Pseudomonas aeruginosa
gttgagaatgtcgttgggaaacctcgtcgctgtcgtcttcggcctggccttcggcggagcgctgctgatgctcagcccggccaaggccggcgccgccatggtcggcctggcggccgcggtcaccatcctgcgcttcccgttctgggggctgctgctgttcgccctggtggcgaccttcatgccctactccacggtcaacgtggggatccgttcgacggtcagcgaagcgatcctcgccctgacctggggcgcggtgctctggcacatcttcctctcgcgcctgccgccggcgccggcggtgcgctaccgctccaccgagcgcatgctgctgtggctgatgctgttcaccgtgctgccgttcgtggtcggccaggtcagcatcaaggccgaggccagcggcctgtcgaactggctgcgctggttgctcaacctgtccatcgtgttcctcgccggacgcctgctggtggagcgcaagaaccgcgagacactggtcatcgccctgctgctgggcaccctggcgatgctgctgatgtccatcgcggtgttcatccgctaccgctcggcgtcggggatggcgccgatcctggcgatgttcaactacgccaacctggacaccctcaagttcggcctggaggcgctttcctcgcggatgggctcgccatggatgcaccccaacgccaccggcgggatcatggccctgctgctgcccctggcgttctgctacggggtcgccaaccagggctggcggcgcggcctgggcctcgccgtggcggtcctcggcgccgccgcgatcctcctcgccagttcccgcggggcgatgctcagcctggcggtggtgctgttctggatgtccctgcgcaaggtgccctacaccggccgcctgctgttgctcggggtcggcctggtggtggtcctggtgctcagctacccgccgttgcaggaacgcctggcgaccatcttctcgccgcagaacgccagtaccgaggtgcgcttcgacgagtatcggatgttccccaaggccgtcgcccgctatccgctgggaatcggcttcaaggtcgacccgccggtgccgggtaccgacctcctgggcatctccaacctgtggctgaacttcatgtacaaggtcggcctcggcggcatgctgctgttcatcgcggtgacctggcgctggtggcgcgaagcccgtccggagaaaggcccgatccgcctgacccgcgacaacgcgatctggctgggcagtacgggcggcatcctggcggcgctggtcagcggcctgttcgaccactacttcagcttcgccgtggtgatgatcggcctgttctggctgctggtcgggatcaacctgctggaagcccgccggctgttcccggaacgccagccgcaaccgcgggcggtgggttatcgcaagctcaagcgacagctcgagcgcggggccgaagcctgagatgctcggctccgccttctggctga

SEQ ID NO: 9287 - DNA, 258 bp, Pseudomonas aeruginosa
gttagcgcgtcaagcgggagttgcaaagtgaaaaaacgctggattcagatggatgtgacccgcggcgtgggcatcctgatcatcgtcttcgggcacagctggttcgtcgccagttcgccgaccgtgctctatccgttgctctctccgttcatcctgccactgttcttcttcatttccgggggttcttcaggaccgagcaacccttcggcgagatggccctgcgcaaggccgacgccctgctcaagccgttcttcgtga

SEQ ID NO: 9288 - DNA, 339 bp, Pseudomonas aeruginosa
agatctactggctggggcaaggcgatgacctacatcggccagtcgaccctgatcctgctgatcttccacggggagatccagcacaagaccttcaacctgctggcccacctgggcctgtcggaaccggccgctgccagcgtcgccctggtgatctcggtgatcgtctcgctgctgatcggcgaagtgatcaagcgcgtcgcgctgctgcgcgccctctacttccccttcccgggtgcgcaagaagaccgccgcggtccagggcggcggcgaagcgcgctgacgccctcggcccggtgcgcctgcgccgggcctttcccctcccgtctcccttttccctaa

SEQ ID NO: 9289 - DNA, 669 bp, Pseudomonas aeruginosa
  unsure (12),(33),(63): Identity of nucleotide at the above locations are unknown.
gcacgcacccanggctgccccggacttgaccangcgcgctaccagggccacgccattgaccangtgcatggcgcgaccgtagcgcaacaggtgccagaggtggctggaaaagcgccgggcgacatgcaggaaggccggcagcgagcgggtcaggtccaggaaggcggcgaggtcggcgccggccatgatcggcatgcccatgaacgaggtctcccgcagggtcttgcgcaggcgcggcagcagcgggcccagttgccgtgcgtcatagggcgcggcgaccaactggtggccgccctcggcggcgcccggcgtgtcgccatgcatgtccgggatgccgttgccgtcgacgaaccgcaggtgggtgtggcgctcgaagaaggccaccatgtgcgggcaggcttcgaggaaggcgtcgatccgcgcggcgtcgtaacgctcgcccagttcgtggcgcaggtaggtacgcggttgctcgatgtcctcctcgataccggcgcgacgcgccagcgggttgcgcggcaaccaggcccagccgccggaccaggcgctggcgccgccgaacaccgggtccttctccaccaggactacccggcgcccgtgccaggccgcggtcaccgccgccgccagcccggcggcgccggagccgacgaccagcacgtcacaggttag

SEQ ID NO: 9290 - DNA, 1977 bp, Pseudomonas aeruginosa
agcaccggcggtagattgaacagcagcgagccgagcccggccaggacgaagcgctcggcggcctgcagggggatgctgaatagcgcatggagcatcagccccggcacgcaccaggcgaggacccgcaagttggccgcggcctgggcgctggccgtctcggccaggcccgggccgagcaagcgcaccagccagggcgccgccgccagcagcaggaggctgagcgccacggcgataccgagcagcgccgggaggattgccgccagccagtcgaggcgacgttcgccctggcgttcgaggaacagtggcagggccgccgcgctgagcacgccgccggccagcgacatgcgcagggcctcgggcaggaacagggcgatgaggaaggcgtcgctgcgctcgccggcgccccaggaggccaccagcagccattcgcgggcgaagcccaggcacaggccgagcagggtggcaagggtcagccagaaggcggagccgagcatctcaggcttcggccccgcgctcgagctgtcgcttgagcttgcgataacccaccgcccgcggttgcggctggcgttccgggaacagccggcgggcttccagcaggttgatcccgaccagcagccagaacaggccgatcatcaccacggcgaagctgaagtagtggtcgaacaggccgctgaccagcgccgccaggatgccgcccgtactgcccagccagatcgcgttgtcgcgggtcaggcggatcgggcctttctccggacgggcttcgcgccaccagcgccaggtcaccgcgatgaacagcagcatgccgccgaggccgaccttgtacatgaagttcagccacaggttggagatgcccaggaggtcggtacccggcaccggcgggtcgaccttgaagccgattcccagcggatagcgggcgacggccttggggaacatccgatactcgtcgaagcgcacctcggtactggcgttctgcggcgagaagatggtcgccaggcgttcctgcaacggcgggtagctgagcaccaggaccaccaccaggccgaccccgagcaacagcaggcggccggtgtagggcaccttgcgcagggacatccagaacagcaccaccgccaggctgagcatcgccccgcgggaactggcgaggaggatcgcggcggcgccgaggaccgccacggcgaggcccaggccgcgccgccagccctggttggcgaccccgtagcagaacgccaggggcagcagcagggccatgatcccgccggtggcgttggggtgcatccatggcgagcccatccgcgaggaaagcgcctccaggccgaacttgagggtgtccaggttggcgtagttgaacatcgccaggatcggcgccatccccgacgccgagcggtagcggatgaacaccgcgatggacatcagcagcatcgccagggtgcccagcagcagggcgatgaccagtgtctcgcggttcttgcgctccaccagcaggcgtccggcgaggaacacgatggacaggttgagcaaccagcgcagccagttcgacaggccgctggcctcggccttgatgctgacctggccgaccacgaacggcagcacggtgaacagcatcagccacagcagcatgcgctcggtggagcggtagcgcaccgccggcgccggcggcaggcgcgagaggaagatgtgccagagcaccgcgccccaggtcagggcgaggatcgcttcgctgaccgtcgaacggatccccacgttgaccgtggagtagggcatgaaggtcgccaccagggcgaacagcagcagcccccagaacgggaagcgcaggatggtgaccgcggccgccaggccgaccatggcggcgccggccttggccgggctgagcatcagcagcgctccgccgaaggccaggccgaagacgacagcgacgaggtttcccaacgacattctcaactcagttcctcgatcagtgcggccagccgttgccggtag

SEQ ID NO: 9291 - DNA, 1629 bp, Pseudomonas aeruginosa
gggcaggtcgctcggccaggtggccagccgacggttcgacgacccgcctgttcactggcgctgcgggctgcctgggcaggatgcgcctgcggttccatgacgcaggatggccgttcgagcgtgccgatccggcttggggccgtcttggcggacgctaccctcgtcgaaggcggaagaggttcgagcccgcggcgtgcgcggaccgggctaccagaaccagccgccgcgcgacagttcctgctggcaactgcggtactgggcgccgaacagcgaggcgcgggactggaccttctgcgagacgttcttcagccatggcttggcgtcgtagctgcggttgcggtagccgccccagccctcgtggtagttcaggtactggccgtaggcgtcccacttggagacgccattgacccgttggctcttctggatgtaccagcccatgaagtccagggcgtcggcgaagtcgtcgcggctggcgccccagccgccggcctcgcgcttgtagtcggcccaggtctcgtccttggcctgggcgtagccgtaggcggagctgacccggccccaggggatgaaaccgaggaagtagtagcgcggcggcagggcgtcgtgcttgaaggacgattcctggtacatcatcgccatcggcacctggaccggcgcgccccagcgctgctgcatcttcagcgccgcctcgtgccatttcggtttttcgcggaagatctcgcagaggttgtcgggattggcggggggcttggtggcgcagccggcaagagccaggagcagggccggcatcgagagccgcagcatgaaaaggggtcctttggcagacgtctgggtcgcttaacgctggcgctttatacccgctttccggcactccatgcatccccaggccgattccctgcctgcgggggggcggtcggcgcttcctcaggtcggcctgggcgtctcggcctggccgggggctccctccaggcgcggcccccagtcctcgacctggcctttttccaggcgccgctccagggtgcgccgccaggatggcgtcagcggcagcgccaggcactggcgcagcagctcggcgtcggcccgcctgtcgaacagcacctcggacaggcgcaacaacgaccagtccggatggcgccgttcgaccagttgcaggatatcgccagccgccaccacgccttcctccagcacccggtagtaccagccggtgcgcccggactcctgcaccctcagggacatcccggcgacctcgaagcggtcgttgagcttccagcagggcatgcgcccctgggacacctccagcagcgcggtgccggcccgcacgcggtcgccgaggcagacgtcggcttcgctccagccgctggtgctgaagttctcgccgaaggcgcccgcctgcatcagcagggggtgttcgcccagttcggcgatccaggcggcgtagtgttcgcgtgggtaatggtggatcgctttcttgacgccgccatggacgcgcaggtcgccctgttcgtcgccctccaggccgacgggggtgaccctgagcgcaccgtcgcgcggagacttggcgatgccgctgcgcgagccggggcgggtgaagggctgggcgcggccggtgagaagggcatccaggggtag

SEQ ID NO: 9292 - DNA, 1035 bp, Pseudomonas aeruginosa
ggcacttgcagcgttcagggctatatcaagaacagtaggggtgaggtgaatatagacatggtgaccgaacacatatttgattttgaatggcgccctctgcagaactatcttcgtgatcgtgatatcgcaataccaccctttgcggcagaacaagagtcaagaagtgacgcactttacaactggatagtcagcaaggggtattcaggaaaagaaggactgaatcttggaacttattaccatatatctgattatggcgtgataggattggcgttgctatgtgccgagaacgtaggtgatattttgaaagtcatcagggcctatgtcaagttgttcaatcgtgatatagctaatgttggcgtcaagcctagggagaattacgaagtagaaatccatatttcagttaactttaagccagagtggaatgacgcatcccgtcagtttcatgtaaatgttatagcctctgcaacctacaagctcattatggatctgttaggtaatgactttcccatctctgcattgacagtgcctgtgcacggcgcagataaaacaatatatgaaggtttcttttctttgcctgtgaagcatgaaggaaatgacataatatttagctttccagctcatcagttgaatagaacactggcgactgccaatccggcggtatttcagtcggccctgactatggcaggtgagagtttcaatgctctgttggaagtagagatgggagggctccgtcagcgaatcgagttattccttgattccataccagatcaataccctagcttggtgactaccgcaaagtatttacgcatgaatgagcggacggtaagacgtcgcttggcggacgagggctgcacttatcgccagattgtagataaggcccgcaaagaacgagcaattgcactgctactgaattcatcgataccagttgatcgtattagcgatattctggggtgctcggaaacagcgagttttagacatgcattcagacgttggaccgggcagtctactacagaattcagaaacagtttccactga

SEQ ID NO: 9293 - DNA, 1035 bp, Pseudomonas aeruginosa
gcagaggagactaaggtggatagagaattggatcagacccttcagcgcaatctggagcggctatacaattacctagaaaatccagaacgagaggaggcacagcgtgttctgctcgcagcggaaccagagcctatccgaattactcacggaattcctgacctctataccgactggctgtcatcccccagctactcagcacaaggtgggttgacggggcaactgacgcaggtcataagccagactgccgggcggcccgttctagtcttcgacgactacttcaaggttcatgaggtcactattcgtacggtcgccgaaaccggaggagccaacagtatttcggtgagcgacctccaggtgcaattgaaccagcagatcaatacctttatccaagaccgcatcgatggtgacaaagccgataaggtcagccgcctccagtccaatatttcctatctgattgaaatgggtattaatatcgatttcaccgcccgtcatgagcttccacctggtgggcgaggcaacagagctactattccgacctctgaccccaacggtgaatcaggtgtaacgattggctatggcttcgatgtcggccagcacgatgaatccggcattcaggctctgaacattgctgaatccacgcgcaaaaaaattcgccccgccctcggcttgaaaggagcgaacaccgcgaccttccaggcattagcccaactcatcccggtactcacagatgaagacgggctgtccctctttaccgccaagatgatcaaggtcactgatcggatgaaggtgaagttccagcagtggagcaccttacctccggcggtcaaaaccatagtgacagacctgtattaccactatggtgagtattcctcgttcccaaactttgagactgctatttcccagaacgactggccagccgccattagggagttgagtaactggaatggtactcccaacagtaccgatccgagcgatggcatagccaggcgattgaacaatcgcgcggactatctccaacgatccctgggactctag

SEQ ID NO: 9294 - DNA, 663 bp, Pseudomonas aeruginosa
cgcgctaactcacagtggttgttcgaaggcccccagggccaggctccctacccggagccatgggtcaatcggtgcgccagggccgcagccagagcgccatgccgagcagcgccaggcagccggcgacggtgcccaggcccagttgcagccagatgccgtcgatgcggaacagcaggccggcggccagtgccatggccagggcgctcagcagccacagccgggcccagggcagggcgccgagcagggcctggcgacgcatcagcagcagcgcggtgcagagcaccccgccaagggccgcgaggggaatccccggcagtccgaaaatcaacggcaggaccgccagcagcgcggcgttcagcgcgctgccgagcagctcgcagcgcagtggcaggcgagtatcgccggcggcgtaggcgtaacgcgccagcaaggcattccaggcgccgaacaccagtggcacggcgaaccaggccagcagcgccggcaacggcgagccggcggtctgctgcggcagcaacagggccaccaggccgggtgcggcagcgaccagcccgaccccggccggcagggtcagcaggctggcggtctccaggccgcggcgaagcagggccaggcgctcgccaccctggcgtcggctcatcatgccgagcaacacctggttga

SEQ ID NO: 9295 - DNA, 642 bp, Pseudomonas aeruginosa
tgcccgagtgcggcgagctgccgacggtgcggtagtcgagtcctatgcgcatgccggcgctcccttcggcgaggccggcgtagacctgttccagttggctggcggcgacgctccagtcgtgcgcgcgacgtacgtaggcgcggccgttctcgcccagcgcgcgggcatgcgccgggtcgtgcaacaggcgcaccacggcgttggcgagctgctcggcggattcgccgccgaggtagtcctcgccgtcccgcagttccaggccggaaacgccctgcgcggtactcgccagcggcagcccggcggccagggcctcgagcaccttcagcttcgaaccgccgccatggcgcagcgcggcgaggaacaccgaactgctcgattgcagttgcagcaggtcgggaacgaagccttgccattcgatgcgcggatcgctccagcgttgcgcccactccgccggcagcgcatagccgcagacgctcatgcgcgcctcggggcagtgtgcccagacccgcggcaggatctcgtcgagcatccattccacggcatcgacgttcggtgcgtattcgtagttgccgaggaacagcacgcgctgcgcttcgggcgtcggccgggcggcggcgaagtgctcgcagtcgaccccgttga

SEQ ID NO: 9296 - DNA, 1230 bp, Pseudomonas aeruginosa
gcgcacgttgccgccgcgggccgaccagaacagccagacgttgcgaccgtcctcgcgggtccagccgatgctgaaggaaccgtcgggcaggtcctcggtgaccggcgggtcggccgggcgcagcttcggcccggtgaccttgaggaagcgttgcagggccaggtagaccggcttggggttggcgtccaggtcgagcaggccgtagtcgcggtcgcgcacgctggcgcgctggtcgagatcgctgagggtgaagaggaagatccggtcgtagtccagcgcactcatcagcgccaggcgacgcagcacgtagtcggcctggccttcgacgccaatgatgtcctgcaactccttcggccccttgtaggccgaccagccccactcggtgctccagatcgccggcacgccggcgttgcgcagggcgcggttgatctggttggcgtgggagacgaagtccaggttccacgggtagttgccttccggcaactgggtataggggtggtaggtggcgatggtgccgaggctctccacgcccaggtggccgagggcatcgaacatggtgcggccgtcgggcatctcgctgaagaaggccatgccggcggaaaccaccggcttctccgggtcgaccatgcgcagggcgatggtgctggcctggagcagcttggcgtagccttccggatcggccttgggccgccagaagccgatcaggttgggctcgttccatacctgccaggcggccacgctcgggtagcgctgcgagagcatcgccatgcgccgggcgaagacttccgggtcgcgcggcggatactggtcctggaagggcgagtagaacggcgcggtggtgatgaagcgggccgagccgaccaggtagaacaccgacttcagctggcgcgcctcgagatccttgaccaactggtcgagggaggccagctggtactggtcctcggcggtttccaggcggtcccagtgcaggtccaggcgcacccactccagccccaggtcctgcaggcggtcgatctgcttgttgtaacgctccgggctgaaccagaggaactgcgcgttgaccccgaggaagtctttccagaccaccgcgcgaggcgccttcagtacctggatctcggcgtcggcgggacgcccccagaacaccagcagcagtaccacggcgagcagcagcgcgctgccgcccagatagagtcccttacgtgccatgaacggttcccaccatgtcgttga

SEQ ID NO: 9297 - DNA, 417 bp, Pseudomonas aeruginosa
gttcgcgcagcgcctgccaggagccgatgtcgctccagccgatggagcagggcaccacggcgaccttgtccgagcgctccatcagcgcgtagtcgacggagatgtccggcgcctcggcgaaggccccggcggccagctcgcgctggcggcactggccgttctccaggctgctgccgtcggccagggcggcgcgggcggcgatcagcacctccggcgcgtggcgctccagttcctgcaacacggtggcggcctggaagcagaacatgccggcgttccacaggtacttgccgctgtccaggtaggactgggcggtggcctggtcgggtttctcgacgaagcgtgcgacccggaagccgttgcccagcggggcgccctgttcgatatagccgaagccggtctcggcgcgctccggggtga

SEQ ID NO: 9298 - DNA, 1362 bp, Pseudomonas aeruginosa
agggtttcggcatgctctcccgggaaaccggccacaggcgggtcccggaaccgccggaaacgatgcaggggatcagcggggcgacggcgttcatcagtagacttccttggtcaggagtacggctggcaccgtacggaacaggatgtagaggtcgaaccacaccgaccacttggcgatgtattcgaggtcgtattccacgcgtttcttgatcttgtgcagggtgtcggtctcaccccggtagccgttgatctgcgcccagccggtgatgccgggcttgacccggtggcgcgagctgtattcgctgaccgcctcctcgaagggaatgccggcggccttggtcgcggtggcgtgggggcgcgggccgaccatcgacatgctgccggcgagcacgttgaacagctgcggcagctcgtcgatgctggtcttgcggatgaagcggccgacccgggtgatgcggtcgtcgtcgcgggtggtctggcgttcggcgttggcgtcggtcctttccgtgtacatcgagcggaacttgaagacccagatcaaccggttgttgtagccgtagcgtttctgccggaacagcaccggccccttggagtcgagcctgatcgccagggccaccagggccatcagcggggcgaagaggaccagcgcgatgctccccaggaccagatcctcgcagcgcttgatcagcggcgaccagccgcgcagcggcagctcggacgcgttgaacatggggatcccggagacatcgacgatgcggttgtgggcatgccggaaggcagccatgtccggcaccagcaggacgttcaccggcaattgccgcaggcgatggacgatggcgccgatgcgcccctcggcgaaccagggcagggcgaccagcacctggtcgacctgttcctggcggatcagcttctccaggtccttggtgttgcccagcagcggcagcgagttgtagttctccgggacccgctcggagcggtcgtcgatgaagccgatgatgccggagcggatgtcgtggttgcgtaccaggtattcggccaggtgcatgccgctctcggtgaagccgaggatcaccgtccgttgcaggtacatgccgcgtttcatccaggcccggtacaggcgcagcaccagcaggcgctgcacgccgaacagcagcaggctgccggtgaaccagaagatcaccagcttgctgctgaggtagggaaacaggcccaggccctggtacatgaacaacagcaggcagaacgccgaggcccaggcgaagaacatgatgcggaagcgcaggcggttgctgaagatatcgtcggagtagacgtccagtgcctggaacatgatcaccgtgagcgcgccgaagaacagcagtag

SEQ ID NO: 9299 - DNA, 1254 bp, Pseudomonas aeruginosa
ctgggtcgagacgagctagcacaaactgagagatcgacaagaatgataaataagagaaatgctattttcctctcaatgattctcatcttttttagcatcgcctgcattggtagtgcaggtgtgagagtgtggaatttttacactttgtttgactcggggaaaattgctgaaaattttcgagcaatgccgagactgtttaactcggtcccagtaaagaagagcggagcggctcatttttttgaaaaaaacctcagggatatgcctggctcatttagctttcaaggtcacgaggttggctttaaagactggttggcgagcagcaataccaccggccttatagttctcagtgacgatcgcattgcctttgaggaatactacctgggcaatagtgcgaaaagccttgctattggctggtcgctaagcaaatcactaatgtccctcttgattggaatggcagttgatgaaggatcaatacacagtctgctagatcctgtgaacctgtacgccccacagctttctgctggcggatatgcgggtgtttctttgagagatgtgcttgagatgtcatcaggaatagttttcagtgaggactacgggaattcggactccgatatcaaccagctaggtaggactatagcgcttggcggatcagtaaatgaaaaagtgagttcattgagaagagaagatgccccggggagagtgcaccactacgttagcgtagatacccaggtgcttggtatggtcttattgggcgcgactggtatgggcccctcacagtttatgaatcaaagactttggccccaactgggtgccgaatgtgaaggtgcttggttaacagacgatcggggcacagagctagcattcggtggggtgaacctttgcctaagagactttgcacgcattggtctattatttcttcatggcggtcgcagcctgactggaagtcaaattgtaagtgctgagtgggtcaaggcatcaaccaaacctcggagtgctcacttgcgtcctggacgttacatagaggatggtgagccaaatcttgggtatggttaccagtggtggattccagaaggcaaagaaggggagttcttggctatcggagtgtacgggcagtttatttatgtaaatccacttaggcgtgtggtgattgcaaagacctccgcgtatgtcgactacaacgttgacggcatccgtatggagcatgaggcacttgcagcgttcagggctatatcaagaacagtaggggtgaggtga

SEQ ID NO: 9300 - DNA, 813 bp, Pseudomonas aeruginosa
atcagtcgatctgaccagcaaaaaaaccatcctatatgggatcacccagcgccccacctagctgctttcatgcagggcataaacatgaagctcaaaagcattagcatttttgccatactcaccctttactacaatatcactctttgtgtcgctgaagaaccaaagagctacttccctcctggggattactataggactggaaatagtgggctgctgacgatatctccgttattcgaaggacttcaaaagtttcggatacgaagcactggacacaatgcacatgcttgcggattgaatggaactatagagtcaggtcatgtgcaggtcgacgtccgtggcatcggcgatatgtcgtgcgatgtcgttttcaaactgaatgatgacagaattaccatagagaaaggagccgcaagcagggactgtcagggcttctgcggggcggcagcaggttttactggtacgtattggaagccttccccaatctgcgagcccgcctctataaaattcaacgacaagcaagtgaagaaagcactgaagaataacgagacagagaaggcctactggatttctcgaaaactgataacagagtgtagggatatgtttgaaggttttggttatctctctcgtgtttttcatacggcacatctctccttgtctgccaaaaaccaccaatgcaagaagatactagagaagggcagcttcttcagagacctgaagcgagagtatttgccggaaaaaatgcaaaatgaatatgataagtattctactgagttcaatcgtctagaaagcgagtgcgaacagtcaatgaaataa

SEQ ID NO: 9301 - DNA, 489 bp, Pseudomonas aeruginosa; identical to SEQ ID NO: 8316

SEQ ID NO: 9302 - DNA, 627 bp, Pseudomonas aeruginosa
acgaggtctcccgcagggtcttgcgcaggcgcggcagcagcgggcccagttgccgtgcgtcatagggcgcggcgaccaactggtggccgccctcggcggcgcccggcgtgtcgccatgcatgtccgggatgccgttgccgtcgacgaaccgcaggtgggtgtggcgctcgaagaaggccaccatgtgcgggcaggcttcgaggaaggcgtcgatccgcgcggcgtcgtaacgctcgcccagttcgtggcgcaggtaggtacgcggttgctcgatgtcctcctcgataccggcgcgacgcgccagcgggttgcgcggcaaccaggcccagccgccggaccaggcgctggcgccgccgaacaccgggtccttctccaccaggactacccggcgcccgtgccaggccgcggtcaccgccgccgccagcccggcggcgccggagccgacgaccagcacgtcacaggttagcggggtggtctcgacggccgcagaggtcatggcttctccctttttcaagatttcggaacgatgttccatattctagggaggcaatgcccgcgtaccaacccgctcggcgaaaggagcgggcgatcatcggccaggtcgaagcgaggtcggccgcccgttag

SEQ ID NO: 9303 - DNA, 918 bp, Pseudomonas aeruginosa
atccagcgttttttcactttgcaactcccgcttgacgcgctaactcacagtggttgttcgaaggcccccagggccaggctccctacccggagccatgggtcaatcggtgcgccagggccgcagccagagcgccatgccgagcagcgccaggcagccggcgacggtgcccaggcccagttgcagccagatgccgtcgatgcggaacagcaggccggcggccagtgccatggccagggcgctcagcagccacagccgggcccagggcagggcgccgagcagggcctggcgacgcatcagcagcagcgcggtgcagagcaccccgccaagggccgcgaggggaatccccggcagtccgaaaatcaacggcaggaccgccagcagcgcggcgttcagcgcgctgccgagcagctcgcagcgcagtggcaggcgagtatcgccggcggcgtaggcgtaacgcgccagcaaggcattccaggcgccgaacaccagtggcacggcgaaccaggccagcagcgccggcaacggcgagccggcggtctgctgcggcagcaacagggccaccaggccgggtgcggcagcgaccagcccgaccccggccggcagggtcagcaggctggcggtctccaggccgcggcgaagcagggccaggcgctcgccaccctggcgtcggctcatcatgccgagcaacacctggttgaggctcatcagggcgatcagcggcaggttcatcagcttgcgcgccaggttgacccaggtcaccgcgccttcgccgagcagcgaggccaccagccgctcgaccagcgccaggccctggctggcggcgttgctcagcaacagcggaccgatgcgcccgccaagctcgcccagttcggtgccggacaggcgccagtgccagggccgccagccctcgatccatag

SEQ ID NO: 9304 - DNA, 1797 bp, Pseudomonas aeruginosa
cggcaggcccatgttgaaggtgctgatgtacaggtcgatgtcctgttcgcgcaaggcgcgtgggaggaacccggcttcgaagcgcaggcgctggtgcggctggtgcatcgcggtgcgcgggcagccccacggcgggcagaccgcccgctggcgcagcgggtcgtcgagaggggccacggtgaagcgggtcacctgcgtgccgggcaggctttccagggcctgctccatggcatagacctggcggctgatgcccgagtgcggcgagctgccgacggtgcggtagtcgagtcctatgcgcatgccggcgctcccttcggcgaggccggcgtagacctgttccagttggctggcggcgacgctccagtcgtgcgcgcgacgtacgtaggcgcggccgttctcgcccagcgcgcgggcatgcgccgggtcgtgcaacaggcgcaccacggcgttggcgagctgctcggcggattcgccgccgaggtagtcctcgccgtcccgcagttccaggccggaaacgccctgcgcggtactcgccagcggcagcccggcggccagggcctcgagcaccttcagcttcgaaccgccgccatggcgcagcgcggcgaggaacaccgaactgctcgattgcagttgcagcaggtcgggaacgaagccttgccattcgatgcgcggatcgctccagcgttgcgcccactccgccggcagcgcatagccgcagacgctcatgcgcgcctcggggcagtgtgcccagacccgcggcaggatctcgtcgagcatccattccacggcatcgacgttcggtgcgtattcgtagttgccgaggaacagcacgcgctgcgcttcgggcgtcggccgggcggcggcgaagtgctcgcagtcgaccccgttgaccaccactggcaccgggcgcccgagcatcgcgctgagctgccgcgcatctttctcggtcacggcgacgaccgctgccgcctggctcatcacccggcgttcccagcggcggtaacgccactggtcgtagcgcacgaagggcagcgcccagcccggcaggcggtcgtaggtggcggcaccgagggacgactcgacgttgtgctcggtgagcacgaacggctggccggcgtcgcgcagcggtcgctcgtagggctggaagctatagctgtgctcgacctggaccacgtcccagggctcgcgcagcaactccgtggcggtgcgttgcagctccgccgacaggccgttgacgctggccagcagcgggtagggcgcgaacagcgcggcgagcagcgtggagaggctgcgcagcggtcggcgcggcagcacgaccaggcgttcgaggaagggctccagggcctggcggtcctcggcgctcaccggctgcttgctgtgcagcagcacggtgatccggtggccgcgtgccgcgaggctgcgcagcaggtggtactggcgggtcttgccgccgctggtggtgggccagggcgagtagggcaggatccagagaatacgcatgggtggcttcactcccagaccagcatctgcaggctggacttcaccgggacttccaggccgtcgctgccgctcaagggcgtgaccttgccgctgagtggatcgtgcagggtggcctccttgagcttcggtaggcgcacgttgccgccgcgggccgaccagaacagccagacgttgcgaccgtcctcgcgggtccagccgatgctgaaggaaccgtcgggcaggtcctcggtgaccggcgggtcggccgggcgcagcttcggcccggtgaccttgaggaagcgttgcagggccaggtag

SEQ ID NO: 9305 - DNA, 1212 bp, Pseudomonas aeruginosa
agtcccttacgtgccatgaacggttcccaccatgtcgttgaacagtgcctggaagcgcagcgcggtgcgcggccaggtccgcgcatggccgatcgctccggcgcgctcggcccaggcctgtgccaggcggggttcgcgagcgaggttcaacaactgttcggagagggctgccacgtctccctgagggtagatggcgccgttgccgctggcgacttcctcggcgaaggcgcgagcgtccgaggtgatcgcgccgcgcccgcaggctgccgcccaggacagggcgccgctggtgccgcgctgctggccgagcagaccgagtttcttcgactcgcggtacggcaggaccatcacgtggtgggcctggatggtacgcgggatgtccgcggcggccaggttcaggttccagtcgatggcgtcggccaggccaagctcggcgatctgtgccttcaactggtcgaggtagttgccgccggcgccgaaggccatttccgcggcggtgccgccggccagggtcaggcgcacgcgctggcgcatctccggcgcgctggcgaacaggtcggcgagggcctcgagcaggtcctcgatgcctttgccgcgatagatgaatccgaagtacagcaggcgcagggtgtccagcgacggcagcggcaccgtggcgatctccaggttgccgtggttgatcacctcgacccgcccgggcggcaggcgcatccgccgggccaggcactcgccgcccaggccggtgagggtcaccaggcgcgtcaggccctgggccacggcacgctcttcgcgcagggtcagcgggtcggcgagcaccacggcggcctggggcaggggagagggcaggcgttccagcaggttcagcggccagggcaggcgctcgcggcgccagaccatgcgctccggatcgtgcaccgtggcgctcagcggcaggcgcgggaagcgcttgcgcagctcgcgcagggcgatgaactcgcccaggcggccgccgccgagttcggcatggaccaggtcgaaggcgttccagtcgacgctgtccagccggctggcgatattcgcgctgtcggccgccacgccggcgagcggcgtggctacttcgatgccgagaccctgcagggcgttgcggaaatgactggcgtagtcggcgatgccattcttttccggcggcaggggcgcgaggagggcgatccgcatcagaacgcgctccggtag

SEQ ID NO: 9306 - DNA, 2010 bp, Pseudomonas aeruginosa
cgggcgatggtctgcaggaccttgctcggcacctcgaagcggcgccggttgatgatgatcccgtcgaccttgccgaacgccgtggtgaggatggtcagcgcatgctcgaccaccggcacggtgctcttctgcgcctctaccaccagggcgatcaggtcggcgcggcgcagggcgatgaaggcctcgcggctgtccagcagggccggcgcgtcgagcaataccacttcgccccggctgggccggttcgccgccgatccgcacgcgcacgccgttttcctccagcaggcggggcagttgctcgatgatgaaggtcacgccttcaccgtggcgcgccgaggtcaggcccagggtcaggcccttttcctcgatgcgcgcgtagggcagcagcccgtacagccggtagatgctggcggtgaaggcgttgctgctctccgcggtgctgttgctcagctccggcagggtggtccacagcggcaggccgaatttctcctcgaccaggccgccgtcgtggatgcgctggtcgagcaggtagcagagatagaccaccagcaggccgacggcgaggccgaagggcacggcgaggaacagcatcagcagggttttcgggaagatccgcccggggttgtaggtggcttcctcgatcaccgagatgttgctgatctggctcttgtccagttcacggtcgatccgcgatttctccaggctgtcgacgtacagcgcgtagttgcgctcggtggcgttcagctcgcgctgcaggcgcgccagggtcggctcgatgtccagcgcttcgcgccgttgcgcctcgagttcggcgagctgcttttcctgctccgcgagctgggtgcgcagggccgcgttgttgctggtctcgtccagcaggacccgttccaggtgagtggtcagggtgttcggcgcgcggtcctcggaactctgcacggtggcgccttcgtcctggacttccttctccagggcacggatcgaggcgtccagggccttcaccggcggcgcatcgtcggtgtaggtgcgcatcatgtcggcgcgttccaggcgcttctggttgagcagccggcgcaggtcctgctgcgccgggttcagcgcgatctgccgcaccgtgacgatctccctgggcagccccttgagttgctggcgggtggattccagggcgctgtcggaggaggcgatcaggcggatcgagttgaaacgctcgccgcgcagcacgttgatccgctcggacaggtcctgcaggcggtcctcgatgctggatgcgccgatctcgttgaggtgcttgaggatctgcgccttgtagctcttgatctgcgccgcgctgtcggcagtctgcgcctcgtagaaggcgtacaggctcttgcggccgagcgcctgggtgcgctcttccatgtagatctcgatccaggccttgaccacttcctgggcgacttccggctcgctccaggtgaagctgatctccatcaccgtcgagccggccgcatgggtgacctcgaatttcttctcgaggtccttggccaggcgctcgaccgcggtggtttcctcgatcacgccgaaggtttccagggtcacgcgaatcccgtcgaacaccgcgccgatggccttcttcacatagaacttggtgcgcttccacaggccctccggcggcggccggttggccagcacctcgaggtagcgctcggccacctggcggacgatcggtcggccggtgagcaggcgttcttcgtcgacgatagggtcgcgctgggtgctcggcatcaccagcgcctggcggttgctgatctcgatcggcagggtcgagtcacggcccggcttgaccagcaggcgtgcgttggactcgtacttggccggcagcaggaaggcgccgaggacgatgatcaccaccgcgctgagggccgccagcttgaactcgcgctggtagatgaacagcaggcgcaacagatcacgcaaggaacgaatttctatcatggcgatgtcgctcctcagcgatcgttgttgacggtgtag

SEQ ID NO: 9307 - DNA, 1488 bp, Pseudomonas aeruginosa
ccagggcgcagcgcatcaggctttcttctcgtcgctggcgggggcgcgaccgtagatgtcgttgaagcggacgatgtcgtcctcgccgaggtactcgccgctctgtacctcgatcatcaccaggtcgatgatccccggattgctcaggcggtggctatgcccggcggggatgaacgtggattcgttggtgttgaggagaaactcgcgctcgccgttttccaccagcgccatgccgctgagcacgatccagtgctcgctgcgatggtggtgcatctgcaacgacagcgaagccttggggcgcaccacgatgcgcttgatcttgaagcggcggccttcctcgagcacggtgtaggtgccccagggccggctgaccgtgcggtgcaggcggaaggcgtcgtggccgcgacgcttgagttcctgggcgacgaacttgacgtcctggctgcgcgccgcgtcggccaccagcagggcgtcgggggtgtcgacgatgatcaggtcgtgcacgccgacggcgccgaccaggcgcttcggcgaatcgatgtagcagttgctgacgtcgtgcagcacgctctcgccgcgtacctggttgccgttctcgtccgccgcgctgagttcgcgcagcgcctgccaggagccgatgtcgctccagccgatggagcagggcaccacggcgaccttgtccgagcgctccatcagcgcgtagtcgacggagatgtccggcgcctcggcgaaggccccggcggccagctcgcgctggcggcactggccgttctccaggctgctgccgtcggccagggcggcgcgggcggcgatcagcacctccggcgcgtggcgctccagttcctgcaacacggtggcggcctggaagcagaacatgccggcgttccacaggtacttgccgctgtccaggtaggactgggcggtggcctggtcgggtttctcgacgaagcgtgcgacccggaagccgttgcccagcggggcgccctgttcgatatagccgaagccggtctcggcgcgctccggggtgatgccgaaggtcaccaggtacccttgggccgcgagtccgcgagcctcggccaccgccgcggcgaaggcctgctcgtcgcggatcaggtggtcggcgggaaggatcagcaactgcgcctggtcgccgaagtgctcctgcacatgcagcgcggcggcggcgatggccggcgcggtattgcgtcccatcggctccagcagcaggtcctgggccaggccgctgcggttgaccgcgcggtagtcgtccagggtacggaacagcaggtcgcggttggtcaccgtgagcaggcgggcgacgtccggcagcccggcgatacgcaggaaggtcttctgcaacaggctctggtcatcggccaggcgcatgaagggtttcggcatgctctcccgggaaaccggccacaggcgggtcccggaaccgccggaaacgatgcaggggatcagcggggcgacggcgttcatcagtag

SEQ ID NO: 9308 - DNA, 456 bp, Pseudomonas aeruginosa
aaaggggtcctttggcagacgtctgggtcgcttaacgctggcgctttatacccgctttccggcactccatgcatccccaggccgattccctgcctgcgggggggcggtcggcgcttcctcaggtcggcctgggcgtctcggcctggccgggggctccctccaggcgcggcccccagtcctcgacctggcctttttccaggcgccgctccagggtgcgccgccaggatggcgtcagcggcagcgccaggcactggcgcagcagctcggcgtcggcccgcctgtcgaacagcacctcggacaggcgcaacaacgaccagtccggatggcgccgttcgaccagttgcaggatatcgccagccgccaccacgccttcctccagcacccggtagtaccagccggtgcgcccggactcctgcaccctcagggacatcccggcgacctcgaagcggtcgttga

SEQ ID NO: 9309 - DNA, 453 bp, Pseudomonas aeruginosa
aataaaagactgcctctttttcaaggaggaagagcgttgaggatagtttgcctattggtattgctgagtctgatcggcggctgctcccattcagtcactttgcaggagcgagcagagcaagaggccatttttatccaggaattccgccaggaattcgccaagaggcttcgttacccgctgttcgcaccgggagatgagatccccgaggccgatgttatggtgtttttccgcttcgcaagctcgtcggggcgcataagcagttgccgggtacagtacggcgcggggaatgataagagccgcagtacgctcgatgaagtcttcgccaagcgcgtgatagccacctgccgcgagcccgatctaccggttgctccgccggcgctgctggatggtggcggaggtttcagcttcaagcagagagtgatgtttcgcaaggtagtggaacgcctcaggtga

SEQ ID NO: 9310 - DNA, 756 bp, Pseudomonas aeruginosa
ctggaatggtactcccaacagtaccgatccgagcgatggcatagccaggcgattgaacaatcgcgcggactatctccaacgatccctgggactctagaggtggcgacgatggccgagatcaatatctaccagaatcctggtcaatccctggctaatatctataagggttttgcccgtcaatgcaatcctggctttgtcttccccgaagcacagactatagaggcatgggacattccgctgaggctacacccggaattcattccgggcggagacatcagcaaagcggaccagcaatactcgacgttgcttgcccaggaaatagccaacggcgtaaccattggtttcaggatggttaatgaaaaggaacgtgtttgcaacgttgagatacttcctttgctcacctccatggcgcagaatcttgatcgaataaaagcccgtttcggcagtggatatcttgaccgcttcaagggcagtccgaacgtctatccaaccgacgttggtttctctacggatgcatccggaggcatttcgcaggaatccggactactggtttcctacggtgtgaatctgaggacactgactcctggtacttggcaggcaatgacgctccctgaggatatcaaagcgttagtcggacctggtgttggtttacgtctggacgctcccaacttcagcgacgtattcaatacgatcaaatcgggtctccgctatacgaccgcagtagccttgctgctggcctattttgcagcgatctag

SEQ ID NO: 9311 - DNA, 696 bp, Pseudomonas aeruginosa
cagatacagcaccttgtcgtactgcacggtcaaccgctgcgaaacccgccgcgcttctcgccaggcgaagatcagctccaaatcttcatcactgtgcagcgggcgatggcagtcatgctcagagcgcggcggcttggcaaaacgcgcgttgtagctggccataaagtgggctgcaaaggcattggcgtcggccatgttgctgattccgcgaagccgcagctccttgaccaggcgatcctgcagagtgaggttcgcacgctccacacgacctttggcctggctgctgttggcgcagctctcgatgttcaactcgtacatcgcttggccgaactgggtatagccgtcgccgccctgaggcgccttgtggttactgcggaacacgctggctttgtcgctgtagaaggccagcggctttccatcatcgatctggatcagttcgccgcaacaggcgcgccggttgcgtggctgatagaccttgggcggccgttgcttgcgcggtacccacatgccggcatcaaccatgatccgtcgtaccgtttctttggccagcttaaggccgtggcactcgaccagtttttcctgggccagagttggaccaaagtcgctatagttccgtcgaatcaagctaatggcgggattctccagacctggcgacaactgccggttactcggctgaccacgtcgacgagatgttag

SEQ ID NO: 9312 - DNA, 345 bp, Pseudomonas aeruginosa
tggaccagccagagcggctgcgggcagtggcggatcaattgccagtcgctgttgcccagtagcaggcggcgcagcaggttgtgcttgcgggtgctcttgaggaccttcacgctcaagagtttcgccggcggcacgctgcagggccagcttctggaactggagcgccagtactggttgcaactgaccgacagcaagggcttcgccgacgggcaggtctcagccgtcaagggttggcgctaccgcgtggagggtctgagtccggataccgctcccgcgccccagctacccaaggcatcgccggtgaataaaagcaagccggccaagccctcgtcgcccaagtgctga

SEQ ID NO: 9313 - DNA, 441 bp, Pseudomonas aeruginosa
agtggggggcccgatggggggacgagggacgacaggggaaatccaatgggtaagctgaatccgaaacaagtcgaaaacctgaccgaacccggcacctatgaagatggtgatgggcttcgcttggtcgtcaaacctaccgggcgtaaatcttggttgcttcgctaccaactggcaggtcggcgaagggagatgggattgggctcatttcctgaggtaagtctcaagaaagctaggcttgaagccagtgccaagcgcagcctactaagcaacggaatagatccgctagctgcccgtgacatcgaacgagcagcacagcgcgaagctcagaaagcaagtgaggcgaaacagctaaaatttgaggccatcgcgaaagaatactgcgatgcacacagcgcctcttggtcggataagtggcgcaaaggctggttaacgcaagcttga

SEQ ID NO: 9314 - DNA, 294 bp, Pseudomonas aeruginosa
agtagcgcttccttcacgagccctcggctcgtcgatgcagaattcctaaggcaggcgcggcttatcagaagtaagccaaccccaccccagaaaagccggccacaagccggctttttaattgtccgaaataatcctatcccatccgaacatcctgccgatagcctagctatcatgcgcgtttcagacgctaccgtgtccgatggtgttcaacgccatttgacctcatccgacgatgaagtggggggcccgatggggggacgagggacgacaggggaaatccaatgggtaagctga

SEQ ID NO: 9315 - DNA, 357 bp, Pseudomonas aeruginosa
cgccaacccttgacggctgagacctgcccgtcggcgaagcccttgctgtcggtcagttgcaaccagtactggcgctccagttccagaagctggccctgcagcgtgccgccggcgaaactcttgagcgtgaaggtcctcaagagcacccgcaagcacaacctgctgcgccgcctgctactgggcaacagcgactggcaattgatccgccactgcccgcagccgctctggctggtccatcacgacgcctggcgcggccagcgcctgtgcgcggcgctcgacccgctgcatgccagcgacaagccggccgccctcgatcaccggctgatcgccgccgacgctgtcccaccacgggaataa

SEQ ID NO: 9316 - DNA, 2454 bp, Pseudomonas aeruginosa
acatgtgcagatcctctcttcagtcccaggccctcgcccgacggcgaaggccgttgttcatgccaggccgacggcggtcagcagcaggtcgatcgccttgatcccgaggaacggcgccaccaggccgccgacgccatagatcagcaggttgcgctgcagcagttgcgaagcgtccgccgcctgcacccgcacgccgcgcaaggccagtgggatcaacgcgacgatgatcagcgcgttgaacacgatggccgacaggatcgcgctctgcgggctttgcaagcgcatcacgttgagcacgtcgagctgcgggtagatgccgacgaacagcgccggcaggatggcgaagtacttggccacgtcgttggcgatggagaaggtggtcagcgcgccgcgggtgaccagcaactccttgcccacctggaccacgtcgagcagcttggtcgggtcgctgtccaggtcgaccaggttggccgcctcgcgggcggcctgggtgccgtcgttcatggccatgccgacgtcggcctgggccagcgccggggcgtcgttggcaccgtcgccgcacatcgccaccaggcgaccttcgccctgctcctggcgaatccgcgccagtttcttctccggggtagcctcggcgatcacgtcgtcgaccccagcctcggcggcgatggcagcggcggtcagcgggttgtcgccggtcaccattacggtgcggatgcccagccggcgcagttcggcgaagcgctcgcgaatgcccggcttgaccacgtccttcaggtgaatggcaccgagcagccggccgttggctaccaccagcagcggggtgccgccgctctgggcgatcttgtccacctcccgcgaaagcacctcgggcatcttctcccgcggcaggtcgatgaagcgcagcgccgcatccaccgcccccttgcggtacacctggccgttccagtcgaccccggacaggcgggtttccgcgctgaaagcgatcggcgtcagttcctcgcggcgcggctcctcgatcggatgcaggatgcgcaggtattcgacgatcgacttgccttccggggtgtcgtcggccagcgagcccagcaacgcgccctcggccagttccttgccgctcacccccggcgcggcgtacagcgcgctgcaacggcggttgccgaaggtgatggtgccggtcttgtcgagcgccagcacgtggaaggtcccccggccgccttccaccggcgggacccggaattggcgatcacgttcaggcgcaccaggcggtccatgcccggcgatgccgatgcccgagagcagcccgccgatggtggtcgggatcagcgtcaccagcagcgccaccaggaacaccagcggcaggttgccgccggcgaacagggcgaacggcttgagggtcaccactaccagcaggaagatcagggtcaggccgatcagcaggatgtccagcgccacttcgttgggggtcttctgccgcttggcgccttccaccagggcgatcatccggtccagggtcgactcgcccgggttggcgccgatccgtaccagcagccagtcggacaccacctgggtgttgccggtcaccgccgagcgatcgccgccggactcgcggatcaccggcgccgattcgccggtgatggcggcctcgttgaccgccgccaccccttcgatgacttcgccgtcgccgggaatcatctcgccggcctggacccgtaccacgtcgcccttgcgcaggctgctggcagcgacgctctcgaaactgccgtcggcgcgccgcttattggcggagaggccctggctgccggccttgagactgtccgcgcgggccttgccacgcccctcggcgagcgcttcggcgaaattcgcgaagagcacggtgaaccacagccagagggcgatctgcagcgccaccgaggtcggcaccgcctggtcggggacgaagcacagcaaggtggtgagcacggcggtcagttcgaccaccagcatcaccggcgagcgcagcaactggcgcgggtcgagcttgacgaaggcttgcagcagcgccggccgccacaaggcggcgaggctggtggacgcgttgtggcgacgttcgagcgatttgtgcaaggcgttcttggacgcctgagtctgagcgttcatgtgcgattccttcagaagccgaggctcagttgttcagcgatcgggccgagggccagggtcggcaggaaagtcaggccgccgaccagcaggatggtcacggtgagcaggctgacgaacagcggaccatgggtcgggaaactgttcggccccaccgggctggccttcttcgccgccaggctgccggcgatggcgaggatcggcaggatgtatccgaagcggccgatgagcatggccaggccgatcatcaggttgtggaatggcgtgttggcaccgaaaccggcaaacgccgagccgttgttggcgctccccgaggtgtag

SEQ ID NO: 9317 - DNA, 231 bp, Pseudomonas aeruginosa
agcagttggctgaatccgtgcgggccgggattggtcaccgccgaggccggccccggcaggctggcggcgatggcgccgagcaccaacacgccgacaggcatcaccagcagggtgaataccagcaggcggacctccttcgcctcgagcttcttgcccaggtactccggcgtcctcccgaccatcaggccggcgaggaacaccgcgatcaggacgaacagcagcatgccgtag

SEQ ID NO: 9318 - DNA, 513 bp, Pseudomonas aeruginosa
cagcgccaccagcaaatagacgaacagtcccgtggccagggccagggacaaccaatccagaacggtcatgtgtgcgatctctccttcgagcggcctctgccgcttgagggaaagtctccgcaaagggggcgtaaagaagcgattcagggccgcgtcggacggcataaagaaagcgtaaagagtggcgcggacagcgcctgggagagcaaccggccggggactgcgccacggccggtgacaaggcgaaggatcgacgctagccctgggcggcgcggatcatgttgcgggcgatcagcagttgctggatctgcgtggtgccctcgtagatgcggaacagccgcacgtcgcgatagaagcgctcgatcccgtagtcgccgatatagccggcgccgccgaatatctgcaccgcgcggtcggcgacgcggccgcacatttccgaggcgaacagcttggcgcaggacgcctcggtaccgacatcgcggccttcgtcgcgctgccgcgcggcgtcgatga

SEQ ID NO: 9319 - DNA, 2196 bp, Pseudomonas aeruginosa
gctgacgcatcggcgacctggcggcgcagcgtcatgcgtctcgccgccaggccaacgctttttccccgagcgacgctttccgggcttgcagctgccgaggtatcctgcgcgcaaattcatccgatgattggatgtttcttccgtgaccattcccctcaagcgctccctggtggacatcgccctggagcagatccgccagcgcatcgacgccggccattggccgctcggccagcgcctgccgccggagccggaactcgccgagctgctcggcatgagccgcaacaccgtgcgcgaagcggtgcgggtgctgaccttctccggcgtgctggaagtccgccagggcgacggcacctacgtgcgcgcctgcgccgatccgctggaaaccatgctggtgctggcgcgcagcgcggtgcagcactccctggaggcacgcgggatgatcgagatcgaggcggcgcgcctggcagccgttcgccgcgacgacagcgacctgagcgcattgcgcgaacatctcgacgcttcgcgccagcgctacggcagcgccgacctgcaggactacatagagcacgacgtccgcttccaccaacggatggtcgatgccgcccacaatccggtgctcagcgaactctaccgctatttctcgcaggtcatccggacctcgctggaacgcaccatggccgacccacaaagggcccagccctgcttcgagctgcaccagcaactgctcgacgccatagaacgcggagacccggacgctgccgccgcggccaaccgcgcactgctgatctgaacccgggacagacccatgactcacgccttgaatgcccggccgggagcgcaccccggccatcctccggaagaactgctgatcgatgccgaagtcgacgacgaaccagttccgccggcgccgccactacgcccctggctgctcctgctgggcctggtgctggtggcgctgaacctgcgcccggcgctgtccagcctcgcccccctgctcaaccaggtgcgcgacgataccggcctctcggccgctgccgccggcctgctgaccaccgcgccggtactctgcctggggttgttcgcgccgctcgcgccgcgcctggcccggcgtatcggcgccgagcgcagcgtgctgctgatcctcttctgcctggccggcggcatcgtcctgcgcagcctgttcccggtgttcggcctgttcgccggcagcgtcctggccggcgccagcatcggcatcatcggcgtgctcctgccgggcatcgtcaaacgcgacttcccgcgccaggccggggtgatgaccggggtctacaccatggccctgtgcctgggcgcagcgctcgccgccggcgctaccgcgccgctggagaagctcttcggcaactgggaactggcgctggcgttctggtcgctgccggcgatcctcgccgccgccttctggctgccgcagacccgccagggccagcacgcccatcgccaggccttccgtgtcatcggcctgtggcgcgacccgctggcctggcaggtcacgctgtacatgggcctgcaatcgtccctggcctacatcgtcttcggttggctgccgtcgatcctgatcgaccgcggcatgactgcggtggaagccggcctggtgctgtccggctcggtgatgctgcaactgatcaccgccctgctcgcgccctggctcgccgctcgcgccagggaccagcgcctggcggtggtgctggtgatggcgaccaccctcgccggcctgctcggcttcctctatgcgccgctgcagaccatctggggctgggcggtcctgctcggcctcggccagggcggtaccttcagcatcgccctggcgctgatcgtcctgcgctcgcgcgacgcccacgtcgcctcgcatctgtcgggcatggcccagggcgtcggctacaccctggcggccatggggccgttcatggtcggcgtggtccacgacctgaccggcggctggaacgcggtcggctatatcttcatcggcgtcgccatcgccgccaccctgttcggcctcggcgccgggcgcagccagtacgtgggggcccgcagcgaacacctgtagccccgcagacgcaaaaagccccgcatcgcggggctttttctccttcgtcactcaggcatccgggccgcgcccttcggcgggcggcgtccgcggcgtgctggcgatccagtcgctga

SEQ ID NO: 9320 - DNA, 447 bp, Pseudomonas aeruginosa
aaacgcccaggggatagcaacaggaaccctcgcataccggccctcaacgggtcagcatcgactgggcggtacggatggcgtcgtcgccctccttctcccgccgcggcaccagcagtccgcgctgcaccgcgggacgcgcctcgatggcggcgatccagcgctgcaggttgtccagcccgtcgacggcgacaccggaccagtcgtggatgcgcacccagggataggtggcgatatcggcaatgctgtagtcgccggcgaggtactcggcctcgcccaggcgaccgtcgagaacttcgtagaggcgccgggtctcatgctggtagcggtcgatggcgccctgcaacttctccgggaaataacggaagaacacgttggcctgcccctgcatcgggccgaccccgcccatctggaacatcagccactggatcacccgcgagcggcccttga

SEQ ID NO: 9321 - DNA, 408 bp, Pseudomonas aeruginosa
cccggccgctgcgcaggccacgcaggtggttggcgttcacttccaggccgacgcagtagtactggctggtatcgacgcacaggtagctggccatcgagcccaggctttccgcgaggaccaccgaggcgccgccatgcagcaggccgaacggctggtgggtacgcgagtcgaccggcatgctggcggtcagcgactcgtcgtcgaaggcttcgaagcggatgccaagcaggtcgccgatgctgttcttctgcgaggcgttcagttgctccaggtcgggcatttgtcgccagaggctcatgggaattccttgcgcaagggggaagccaagggcttcccgtcggtgggagtcattcgtgccagagcacggcctcgcggcgttccacccattcgtggaagcgcgagccatag

SEQ ID NO: 9322 - DNA, 471 bp, Pseudomonas aeruginosa
agtacacggcgggccagcgcggcatccgcgactggtacgccagccagagcatcgccctggaagacagcgacttccgcctgtcgctgtccggccaggaagacgacggcttcgaccgcgaccacgacggtcacgccctgcgcgacggccgccggctcagccgcttcaacctcaacgccagccacagcctggcgccgaaccagagcctggagtggcaactggcggccaaggaaggctcgaaccagcacccctacgcctaccgctcgccgtttccccaggttcccgacgacatcgacaactccgatacgctcgcccacgactatgccggttcgctgcgctggaatgtcgacctcgacccgcgccacagcttctatatacaaggctacgcacagcactgggagcgccggcaggaatggaacgcctgcgaggcggccattgccttcagcccgcaactggcgcagctctgggaactga

SEQ ID NO: 9323 - DNA, 423 bp, Pseudomonas aeruginosa
tcctgccgggcatccagcgcatcggcgtgctctacggcaaggacagcgaattcctcctcgacgagcttcgccgcgaggcccgcagccaggggctccagctgttcgtcgccagcagcagcggcaacgacgacccgcgcccgctgcagttcctgctcggcaatagtgacctgctgctcggcatcgacgacaaacagctgtacaactcgcagagcatcaagagcctgctgctcggcagctacgccaagaaccgcgcgctgctcggccccaccgcagccttcgtcaaggccggcagcctggcgagcagctacagcgaccaggaggattggctggacaccctcgacgaattgctcggccaggcgcccaggcactggcccctcagcctctatccagggcatttcaaggtgctcggcaatcggcaggtag

SEQ ID NO: 9324 - DNA, 1068 bp, Pseudomonas aeruginosa
cccgttccctgggtatcgacctggccagcgacgccgacctcggccggcgcctcgccgaaggagaagaaccatgagccagcgccacggctgggacatccgtacccgcatgctggcgatcagcctgggcccggcgctgctgctgaccctgttgctcaccgcctacttcacctactcgcgcctgcaggacctgcgccaggaactgacccataccggccagttgatcgccgaccagctggcgccggccgccgaatacggcgtgatcgccggcaacacgcccgtgctgcagaagctgctgcaggccaccctcgacaccccgcatgtgcgcttcatcgaggtacgcgaccgcaacgacaatatcctggtgtacgtcgaacagttgcccggcgcgttgcagaacgccgcgccgatcgacatcttccactccaccatccagcgccagcgtatcgccctggccagcgacccgctgctggatggcgccagcgaaggcgacggccagtccggcgaggactacctcggccgggtggtggtcggcatgtccaacgacgccttcagccagcggcaacaggaaatcctcctgaaggccgccctgctggccgccttcgccctgatcctcaccttcctcgtcgcgcgccgcctggcgcagcgcctgtcggcgccgatcagcaccatgggccaggcggtcgaggcgatccagagcggcgactacaagaccagcctgccgatcctcgacgacggcgagatcggcgacctggcccgtcacatcaacaatctcgccagcgggctggaccgcgcgagccgggaacaggaacaggcgatcagccaattgatcagcgcccgcgaggaagcggagcaggcgaaccgggcgaagtccgacttcctggcgatgatgagccacgagcttcgcaccccgatgaatggcgtgctgggcatgctgcaactgctggaaaccaccgagcagacccgcgaacaggccgagtacacggcgctggccaccgagtccaccgaacacctgctgaaggtcatcaacgacattctcgatttctcaaggatcgaacgcggcgcgcttga

SEQ ID NO: 9325 - DNA, 813 bp, Pseudomonas aeruginosa
tgcgctgaagttcaccgaggaaggcgccatccatctcagcctggagtggcaggctctcgatcacgacgtactgtggctgacctgcgcggtgcacgacagcggcatcggcatctcgccggaacgcctggaacatatgttcgacgccttccagcaggcggattcgtcgatttcccgacgctacggcggcaccgggctcggcctggcgatcgccaggaccctggcggaacggatgggcggcaccctgcaggcagagagcaaggaaggctcgggatcgaccttcaccctggagattccgctgcccttccagcagtcgccggcgcaccggcagcaggccgccggcgacgccgccccggtcgccgccggtcaggaaatcctcctggtcgaggacaatccggtgaaccagacagtcatagaagccatgttgcgcagcctcggctatcgcgtcaccctggtcgccgacggtatccaggcggtacgcagcgccgagcgccagcgctacgacgcgatcctgatggactgccgcctgccggtgctcgacggctactcggcgacacgggaaatcagggcccaggagaacggccggcaggtaccgatcatcgccctgaccgccaacgccctgcagggcgatcgggagaactgcctgcaggcgggaatgaacgattacctggccaagccattcaaacgggcggaattgcaacgcatactgcaacgctggatcggctcgcagccggaactccccgtgacgtcgaacgaaaccggacgaggggagccggaatgatctacgacaagggcggcaagcggacgcgggaataa

SEQ ID NO: 9326 - DNA, 525 bp, Pseudomonas aeruginosa
ggagctcgcatgaccaaacaacacgccttcacccgagaagacctgctgcgctgcagtcgcggcgagctgttcggcccgggtaacgcgcaacttcccgcccccaacatgctgatgatcgatcgcatcgttcacatcagcgatgtcggcggcaagtatggcaagggcgagctggtcgccgagctggatatcaacccggacctgtggttcttcgcctgtcacttcgaaggcgatccggtcatgcccggttgcctgggcctggatgccatgtggcagctggtcggtttctacctcggctggcagggcaaccccggccgcggccgcgccctgggttcgggcgaagtgaagttcttcggtcaggttctgccgacagcgaagaaggtcacgtataacattcatatcaagcgcacgatcaatcgttcgctggtcctggccatcgccgacggcaccgtcagcgtcgatggccgcgaaatctacagtgccgaaggcctccgcgtcggcctgttcacctccactgacagcttctaa

SEQ ID NO: 9327 - DNA, 483 bp, Pseudomonas aeruginosa
cccgcaccatgggcagcaccgtatcggcctgcctggccacaccgttccagatcaagggcgtcaactactcgatctcctccgcctgcgccaccagcgcccattgcatcggccaggccatggaacagatccagttgggcaagcaggacgtggtcttcgccggcggcggcgaagaggaacactggagccagagctgcctgttcgacgccatgggcgccctctccacccagtacaacgacacgccggaaaaggcctcccgcgcctacgacgccaagcgtgacggcttcgtcatcgccggcggcggcggcatggtggtggtcgaggagctggagcatgcgctcaagcgcggcgccaagatctacgccgagatcgtcggctacggcgccacctccgacggctacgacatggtcgccccgagcggcgaaggcgcgatccgctgcatgcagcaggcgctggccaccgtcgacgcgccgatcgactacctga

SEQ ID NO: 9328 - DNA, 1842 bp, Pseudomonas aeruginosa
gcaacagcttcggcttcggcggcaccaacgccaccctggtcctcaagcgctggcagggttgattccctccatcgccgcatgaagcgccctccggggcgcttttttgtacccagcgtttctttacccggactgcatgaacgggctaaacctcccgccctgcctgccgatagtactggtcagccccgtccctcttcctgccccctggaatccgccatcatgtctttgcgcagtatgcccatcgcgacccgtgccgccctgagtttcgccctgatcaccgctctgctggtcatcaccggcatcttttccctgaaccggatgggttcgctcaacgaagcctcttcggacatcagcgacaactggctgcctagcgtccgcgaaagcgccgagttgaacgttctgctcgccgaactgcggcaggtgcaactggcccatgtgctggcggcggacgatagcagcaagcgcttcctggaaagccgcatgacggaaatcggcaaggaactgaccgatcgcgagggcgcctaccaacggctgatcagtggtgccgacgagcgctcgatctacgagcgctacctggctacccggcagacgctcctgcaaagccagcagaccctggtgcagatgtcgcgcagcaagccgctggaagagacccgccagtacaccgaaagcaccttgctcgaccagtaccgcgccacccagcagcaactgcaggcgctgatcgacttcaacgtcaagggcgccagccaggccagccacacggccgatgaggtctatgacagcgccttcgccgcagtgatcggcgtactgctggtcgccggcctcgctaccgtggtactggcctggctgttcacccgcagcatcacccaaccgatcggcgaggcgctgcgagtggccgaggtgatcgcttccggtgacctcaccagccgcatcgacacctctggccgcgacgaaccggccaagctgctggtcgccctccagggcatgcaggcacaactgcgccagaccatccagcagatcggcagctcggcgacccaactggcctccgccgcggaggaactcagcgccgtcaccgagcagggcaaccgctcgctgacccagcagaacgacgaaatccagatggccgccaccgcggtcaacgagatgaccgccgccgtcgaggaagtggcgcgcaacgccagctccacctcggacgcctcgtccgcctccgagcaatcggcgcagaacggacgccagcgggtactggagacggtccaggcgatccgcctgatgagcgaagaagtggacaatacctcggcgctggtcggcggcctggcggaaaaggcccaggacatttccaaggtcctcgacgtgatccgcggtatcgccgaacagaccaatctcctggcgctcaacgcggccatcgaggcggctcgcgccggcgagcagggccgcggtttcgccgtggtcgccgacgaggttcgcgccctcgcccatcgcacccaggaatccacccgcgagatcgagcagatgatcgccaacatccaggaaggcaccggcgccgcggtcggcgccatggacagcagcagcgtacgcgcccgcaacatgctggagatcgccgaagccgccggcctggcgctcaacgagatcgcggagcgggtcggccagatcaacgagcgtaccctggtgatcgccagcgcctccgagcagcaggcccaggtggcccgcgaggtcgaccgcaacctggtgaacatccgcgacatctcgctgcagacgtccgccggctccaaccagaccgccgccgccagccaggaactgtcgcaactggccatcgacctgaacaacatggtcacccgcttcgtcgtctga

SEQ ID NO: 9329 - DNA, 474 bp, Pseudomonas aeruginosa
aacccgatcctctccccctccggagccgcccagatggtcaagcgcaccagccacaagcaagccagttgtccagtcgcccgcccgctggacgtgatcggcgacggctggtcgatgctcatcgtgcgcgatgccttcgaaggactgacgcgcttcggcgaattccagaagagcctcggcctggccaagaacatcctggcggcgcgcctgcgcaacctggtggagcacggcgtgatggtggcggtcccggccgaaagcggcagtcaccaggaataccgtctgactgacaagggacgcgcgctcttccccctgctggtggcgattcggcagtggggcgaggactatttcttcgccccggacgaatcccatgtccgcctggtcgagcgcgacagcggccagccggtgccgcgcctgcaggtacgcgccggcgacggcagtccgctcgccgcggaagatacccgggtcagcagggactga

SEQ ID NO: 9330 - DNA, 984 bp, Pseudomonas aeruginosa
tccctggcatgggtcaaggatgtcaccagggacagggcgaacaatgtcgaaaacagggcacgcgtacgggggccagccatggcattcctcctgataggcctgagtgaacatagaccgctgccgctcggccagggttcgccgctccgctggctggccctgctgttcggcctgctggcctggcatgccggggctggcgaacgggtgatctatccgcgccactccgaagggcgcaaccccgaaccctacgtcgtcgagctgctgcaactggcgctggccaggagcggcggcgactaccgcctggagcccagcgcgcagcccatgccgcagtcccgtgcgcaactgcgcctggagcaggacgatccgggcctgcaggtgatgtgggcgcagtcccgcgacgacctggaagagaccctgctgccgatccgcattccgatctatcgcggcctgatcggctggcgcatccccctggtcagcgccgccaacaaggatctcctggcctcggcgcggaccctcgacgatctccgccgcctgcgcttcggccagcgccaggactgggccgacacaccgatcctgcgcgccaacggcctggaggtgaagaccagccagaactacgagagcctgttccgcatgctcgatgccggccgcttcgaggtcttcccccgcgaggtcgtagtgatcgacggagaactggaggacgcctcccgcgccgggctgcacctggcgatcgaccagcacgtggccctgcactaccccgcggccttctatttcttcgtttcgcgtcaacgcccggaactggccgaggccattcgccagggcctggagaaggcgattgccgacggtagcttcgaacggctgttcgagcgacatttcaagacgcggctgggcaagcttgcccttcggcagcggagaataatcgagctgaaaaacccctatcttccaggaaaaactccttttcagcgcgaggcgctctggtaccggccgtga

SEQ ID NO: 9331 - DNA, 2787 bp, Pseudomonas aeruginosa
cgggatatccgcctgatgaacagccatgccgccggcatggggagaaaccgccatgagcgatgcccttgccctgaccgtcaacggtcagtccctgcgcctcgatgtcgcccccgatacccccctgctctatgtcctgcgcaacgacctgcaactgaacggtcccaagttcggctgcggcctcggcgagtgcggcgcctgcaccgtgctgatggatggcgtcgccacccgctcctgcatcaccccggtggaggccgccgtaggccgccgggtggttaccctcgaaggactcggcgatgccacccatccccatccgctgcaacaggccttcatcgacgaacaggccgcccaatgcggctactgcatcaacggcatggtgatgaccgccaaggcgttgctggatcgcaacccgaaccccagcgacgacgagatccgccaggaactggcctacaacctgtgtcgctgcggcacccatgtggagattctcaaggccgtgcggcgtgccgccgagagcctgaaggagcatcaggaggagcacccggcatgagcctggccaatccctcgcgacgcggcttcctcaaggccggcggcctgctgctggtcaccgtcaacctgcccgccccgctgctcgcccttgccgagcagggcgccaccgacctgccgctggaccaggtcgactcgttcatcgccattgccgcggacggcaaggtcaccgccttctgcggccacgtcgaccttggtaccggcatccgcacggcactggcgcagatcgtcgccgaagagttggacgtcgcgttcgagcaggtcgagatgatcctcggcgacacccgtcgcacaccggaccaggggccgaccatcgccagcgccagcatccaggtcagcgccgtgccgctgcgccaggccgccgccgaagcccggcgcttcctcctgcgccaggccggaagccatttcccggtgcatccggacagcctgcgcagcgaaaacggccaggtcttcgccgccgccaatccgcagcgacggatcggctacggcgagttgctgcgaggccagcgcttcaacctgaacatcgacggcaaggcgccgctcaagccgcgcagcgagtaccgtctggtcggcaagccggtgcgtcgggtggacatcccggcgaagctgaccggtcaactgacctatgtccacgacatgcgcttgcccggcatgctgcatggacgagtggtacgcccgccctataccggcgcggatgtcagcgccccgctcggcagcggcctgctggcggtggacgaaagctcggtcgccgggctgccggggctggtcaaggtggtcgtgatcggcgacttcgtcggcgtggtctgcgaacgcgaggagcaggcgatccgcgccgcgcgccagctcaaggtgcgctggaaggactggcagggcctgccgccgctggaacccgaccggctcgaggacacgcttcgccggcatccgaagaagccacgcacgctgcacgactcacccggtctcgagcagcacctcgcgggcatcgcccggccgctgtcggccacctatgtctggccctaccagttgcacgcctccatcggcccttcctgcgccctcgccgaggtcgatgcgcagcgcgctcgcgtctggtccggcacgcagaacccgcacgacctgcgcaacgacctggccaggctgctgcagcgcgagaccggggacatcgaggtgattcgcatggaagccgccggctgctacggacgcaacggcgccgacgacgtcagcgccgacgccgtgctcctggcgcaggcagtgggccggccggtgcgggtacaactgatgcgcgaacaggaacatggctgggaaccgaaaggcaccgcgcaactgatcgaggtccgcggcggtctcgacgagcaaggccgggtggcggcctacgacttcgccacctgctacccctccaacggcgcgccgaccctggccctgctcctcaccgggcggatcccggccaccccgcaggtggccgacatgggcgaccgcaccgcgatcccgcaataccgctacccgcggatgcgggtggtggccaacgacgccgcccctatcgtccgcgcgtcctggatgcgcggcgtctcggcgctgccgaacgtgttcgcccatgagtcctacgtcgacgaactggcgcacctggccggcatcgaccccatcgccttccgccgccgctacctggacgaccagcgcgccctggcgctgatcgacgccctggtcgcccgcgccggctggcagccacgcacctcccccaacccagaggcgcgccgggacggcttgctgaagggacgcggcttcgcctatgcgcgctacttccacagcaagtttcccggtttcggcgccgcctgggccgcctggatcgtcgacgtcgaggtgaacccggagaacggcgcggtgcgcgtcgccaaggtctgggtcgcccatgactgcgggcagatggtcaatcccgatggggtcaggcaccaggtccacggcaacgtcatccagtccaccagccgggtactcaaggagttcgccaccttcgaccgccgtggcgtcaccagcctggaatggggcggatacccgatcctcggcttccccgaactgccggagatcgacgtactgctgttcgaccgccccgagcagccaccgatgggcgctggcgagtcagcctcggtgcccagcgccgcggccatcgccaatgcgatcttcgacgctaccggggcgcgcctgcgacaggtgccgttcactccggaacgcgtactcgcggcgctgcgcagcgcgcaggcctga

SEQ ID NO: 9332 - DNA, 1032 bp, Pseudomonas aeruginosa
ctgacagatgaagaaggcaacacgcatcggcctctgggcctccggcagcctcgtcgcgctcgccgccatcgccctcggctacgcctggcaaccggccatcgggccactggaaggcacacccggtcccttcagcgccgagcagatcgcccgcggcgaacgcctcgccgccctcggcgactgcgcggtctgccacactcgcgaaggcggcccgcgcaacgccggcggacgggccttgccgacgccgttcgggacgatctacagcagcaacctcacgccggatcgcgcgagcggcatcggtggctggtcctaccccgccttcgagcgggccatgcggcatggcgtggcccgcgacggcagctacctgtatccggcgttcccttacaccgccttcaccaggactcgcgacgaagacctgaaggccctgtacgcctacctgatgagccagccggcggtgcacagcgaaacgcctgccaaccagctgccgttccccttcgaccaacgccagctgatggccggctggaacctgctgttcctggagcccggcgcctaccgcgacgagccgacgcgcaaccagcaatggaaccgcggcgcctatctcgccgaaggcctcggccattgcagcgcctgccactcgccgcgcaatgcgctcggcgcggaaaagtccggcagcgcgcacttcgccggcggcgaggcggagggctggaccgcgccagccttgaacgccagttcgccggcgcccatcgcctggagcgaggaggccctctacgcctacctccgccacggctattcggcctaccacggggtcgccagcgggccgatggcgccagtggtcggcgaaggcctggccaagcagtcggacgaggacctgcgggccctggcccattaccttgcgtcctacgccgctgccccggccggggaaaccgatcagcaacaggcgcaacgcctcgaccggcagggctacggccgcgtgcaaccgcccagcggcagcggcgcgcgcctgttcgccggggcctgcctggcctgccaccatga

SEQ ID NO: 9333 - DNA, 423 bp, Pseudomonas aeruginosa
ccaaggtcgctggccacccgcgtcacgctggcgccctcctccagcgcggcgaccgcgttgagcagacgcaggcgctggcgccactcgcgaaacgacaactgggtctgctcgcggaacaaccgcgccagggtccgtcgggacgcccccaccagtcccgcccaatccgagatgccgcgcggatcggcgggatccgcctgtagcgcgtcggtgatccggcgcaagcgcgggtcgccaggcaacggcaggttcagcggcgcctcgcgaaggcgcccgacctcatcggcgaccacctgcatgagacgctcggcctcgccacccggcggatattcacggggaaactccgccgcccgcagcaacagttcgcgcagcaggccggacacctccagtacccggcaaccgccgggcagcgaacgatccaggtag

SEQ ID NO: 9334 - DNA, 552 bp, Pseudomonas aeruginosa
tgttcctggcatgcgccgggtccggcgtatccagggtgccatggaaggacacgaaggccttcagctcggcgccgtcgcgagccagctccagcgcgcagcaaccgccgaagcagaaaccgaaggcagcctggcgggtcgtatcgacagccgcgagcgcctgtccgcgcaaggccgccagcgctgcctgcatgcgcttgcgcagcagggcccggtcgttcttcagcggcatcatcgccgcgcccgcctcgtcgccgttctgcggacgcacgtccctgccgtagaggtccgccaccagcaccacgtgcccacggccggcgacctgccgggcgatgtccagcgcggcggcgctcacgcccatccagttcggcgccatcagcaggcccgggcgcggccccgcgtggctggcgtcgtacaccagttgaccttcgtacggctgcccatcgatgtcgtaggcgaccggctctacacgaatctcactcatgggtactgctcctgcgagagttggaaaagacaaagcccgccgaagcgggctttgtcggggctactgcttaa

SEQ ID NO: 9335 - DNA, 258 bp, Pseudomonas aeruginosa
acggcgatggcgaacgccactcccgcgcgccgcccgatcggctgggtcaggcggccaataccgcctccgacccgggccagggcgaccaccgtcagcaacggcaggccgacaccggtaaggaggaagccgaaagccgcgctccatacgtgttcgcccgccgccatgccggcactgggaggaaagatgatgttacccgcgccgagaaaaagcgcgaacgtcatgaagccaagggcgagcaggtcgaaccctttcaaatga

SEQ ID NO: 9336 - DNA, 1365 bp, Pseudomonas aeruginosa
aacgacgaaggccaccgctgtgaggcggtggccttcgtcctggaactcagaaaacccgggaaatcaggccttcttcacttcccaaccggtcagctcggccagggccttgccgatgtcggccagggaacgcacggtcttcacaccggcgtcctgcagggcggcgaacttctcgtccgcggtgcccttgccgccggagatgatggcgccggcgtggcccatgcgcttgcccggaggggcagtcacaccagcgatgtaggacaccaccggcttggtcacgttggccttgatgaaggccgcggcttcttcttcggcggaaccgccgatctcgccgatcatgacgatggcttcggtctgcggatcttcctggaacagcttcaggatgtcgatgaagttggagcccgggatcgggtcgccgccgatgcccacgcaggtggactggccgaagccggcgtcggtggtctgcttcacggcttcgtaggtcagggtgccggaacgcgacacgatgcctaccttgcccggcaggtggatgtgacccggcatgatgccgatcttgcactcgccgggagtgatcacgcccgggcagttcgggccgatcaggcgtacgcccagctcgtcgcacttgaccttggcgtccagcatgtcgagggtcgggatgccttcggtgatgcagacgatcagcttgatgccgccgaatgccgcttccaggatcgagtccttgcagaacggagccggaacgtagatgaccgaggcttcggcgccggtggcttccacggcttccttgacggtgttgaacaccggcaggccgaggtgggtggtgccgcccttgccgggggtcacgccgccgaccatcttggtgccataggcgatggcctgttcggagtggaaggtgccctggctaccggtgaagccttggcagatgactttggtgtctttgttgatcaggacgctcattacttaccctccgcggccttgacgacttgctgggcagcgtcggtcaggctggttgccgcgatgatgttcaggccgctttcggccaggaccttggcacccagttcagcgttgttgccttccaggcggacgacaaccggaaccttcacgccgacttctttgacggcgccgatgatgccttcggcgatcatgtcgcaacgcacgatgccgccgaagatgttcaccaggacagccttcacgttgctgtcggacaggatgatcttgaacgcttcggtcacgcgctccttggtcgcaccgccgccaacgtcgaggaagttggccggcttgccgccgtgcaggttgacgatgtccatggtacccatggccaggccggcgccgttgaccatgcagccgatgttgccttccagcgcgacgtag

SEQ ID NO: 9337 - DNA, 918 bp, Pseudomonas aeruginosa
accggggcgtcggatcactcagcgcttcttgcggttggcgatgtggatggcatggccattcactgccagggcagcttcgtgcagggcttcggacagcgtcgggtgagagaagaccatcatgcccaggtcttcggcgctggtgccgaattccatgccgatcgcgccttgctgtaccagctcggcggcgctcgggccgatcacgtggacgcccaggacgcggtcggtcttcgcatcggcgatgaccttgaccaggccggtggtgtcgttggcagccatcgcgcgaccgctggcggcgaacgggaaggtgccgacgttgacttcgacgccctcggccttgagggtctgctcggtcttgccgacccaggcgatttccgggtgggtgtagatgaccgacggaatcaggtcgtagttcatctgcgccttgtggccggcgatgcgctcggcgaccatcacgccctcttccgaggccttgtgcgcgagcatcgcgccgcgaaccacgtcaccgatggcgaagacgcccggaacgctggtcttgcagtggtcgtcgacgtagatgaagccacgctcgtccagggtcacgccgctgtcggcggccagcaggtcggtggtcaccgggcgacggccgaccgcgacgatcagcttgtcgaaggtttccttctgctcgccgttggcgtcggtgaaggtcacggtgacctgcttcttcttcacttccgaagcggtcacgcgggcacccaggcgaatgttcaggccttgcttggtcaggaccttcagggcttccttggcaatctgctcgtcggcagccgggaggaacttgtccagggcttccagcacggtcacctcggcacccaggcgggcccataccgaacccagctccaggccgatgacgccggcgccgatcacacccagcttcttcggtag

SEQ ID NO: 9338 - DNA, 843 bp, Pseudomonas aeruginosa
acgatgtcgttgccgtcgatggaagcgttgacccccgggaagcgcttcagcgcctcggtggcggccttgacgaagaaggacatgaagcccaggcgcacgccgttgtgcttcttctcgaacaggtccttgtacttcgaacgcaggtccatgatcggcttcatgttgacctcgttgaaggtggtcagcatggccatggcggactgcgcctcgaccaggcgctcggcgaccttggcccgcaggcgggtcatcggcacgcgcttctcgacacggtcgccggcggcgaagatcggcgcctcggcagccggggcggcaggcttggccggggcggccggggcgttcttcttcgcttcgaccgcagcgaccacgtcttccttggtcacgcgaccgcccttgccggtgccggcgatgctgttcggatcgatgccggcttcctcggccagcttgcgcgcggccggggacaggatggcgtcgtcgccgccagcggcggccggagcggcggcctgtgcagccggagcggcggcgggcgcagcggcagccggagcggccggagcggcggcgccgccttcgttcagcttgccgagcagctcgttgctcagaacggtgtcgccttcgttcttgatgatctcggccagcacgccgtcagcctcggcgagaacctcgatgaccaccttgtcggtctcgatgtcgacgatcagttcgtcgcgcttgactgcttcgcccggcttcttgtgccaggtggcgacggtgccgtcggcgaccgattccgggaaggttggggctttgatttcgatagccattgtgtgcgtttccttaaattcggtttcttcagcgcgtaggcgttaa

SEQ ID NO: 9339 - DNA, 1221 bp, Pseudomonas aeruginosa
atcatcttcgccacgtcggtggcgtactcggtggaacgcgcatcgtcctggcggctggtggtgaaaccgacctggttgttgatcaccaggtggatggtgccaccgcgtcttgtatgcgcgggtctgcgacatctggaaggtttccatgaccacgccctgccccgcgaaggcggcatcgccgtggatggaaatcggtaccaccttgtcgccggagctgtccttgcggcggtcctggcgagcacgaacggaaccctcgaccaccggggaaacgatttccaggtgggacgggttgaacgccagcgccaggtggacttcgccaccgctggtcatcacgttcgaggagaagccctggtggtacttcacgtcaccggagcccagctcgacgatcttcttgccttcgaactcgtcgaacaggtcgcgcgggttcttgcccagggtgttgaccaggacgttcaggcgaccgcggtgggccatgccgatgacgatttccttggcgccgtaggaaccgcagcgctggatgatctcgtcgaccatcgggatcaggctttcgccgccttccaggccgaaacgcttggtgcccgggtacttggtgcccaggtacttctccaggccttcggccgcggtcaggcgctcgagcaggtgcgcacgcgcctcggcggagaagccgggacgaccacgcacgctttccagacgctggaggaaccacttgcgctgctcggaatcgacgatgtgcatgaactcggcgccgaaggtaccgcagtaggtgctcttcaggctgtcgacgatttcacgcagggtcgcctcttccttgccgatgtaaagctcaccggtgcggaaagtggtgtccaggtcggcacccgtcagaccgtagtggtcgatcgacaggtcggcaggcgcgggacgctgccacaggccgagcgggtcgagggtggaagcctggtggccgcggagacggtaagcgtgaatgagacgaaggacttcgacctgcttcttctcgtgctcgctgctcacgctaccggcggaaaccggctgggcacggcgctggttcttggccagcaggacgaaatgatcgcgcactgtggagtgcgagacgtcgggggcgggattgccatcggcgggaagcttctggaaatacgtgcgccactcttctggcacagcgttagggtcgtgcaggtagagctcgtagagctcttcgacgtaggcagcgttaccaccggatag

SEQ ID NO: 9340 - DNA, 2583 bp, Pseudomonas aeruginosa
tcagcgccagcacgtcgaggaccatcacgtccttgccgttggtgtcgacctggaaatcctgcatgtacggcgcagcatctttgtcggggttgtaacgataaacactcacttgcaacatggcgggcacccttagtaagtccgaaccttgggttcgaatgccggaacggtcttcggcgcgaagttgacggaacgcttggatacgcgcttctcacccgggaagtacagggtgtggcacagccagttctcgtcgtcgcgctcctcgaagtcttcacgggcgtgggcgccacgggactccttgcggtgctcggccgcgatcgcggtggcctcggccacctcgaggaggttttgcagttccagcgcttcgatgcgcgcggtgttgaatgcctggctcttgtcgttgatcttgacgttggcgatacgctcgcgcaggtcggccagctgggcgatgcccttctgcatgtactcgccggtgcggaacacaccgaagtagttctgcatgcagctttgcagctcgcgcttgagcggagcgacttcttcgccgctggtgcgctcgttcacgccgttcaggcgcttgaaggaggcttccaggtcgctctcggaagcgccgcgggcgtcgatgccctctttcagcgctttttccaggtgcagaccggcggcacggccgaataccaccaggtcgagcagcgagttgccgcccaggcggttggcgccgtgtaccgatacgcaggccacttcgcccacggcgaacaggccttcgacgatctggtcgttgccgttggcgtcctgggtgatggcctggccatggatgttggtggcaacgccgcccatcatgtagtggcaggtcgggatcaccgggatcggcgcaacgaccgggtcgacgtgggcgaaggtcttggacagctcgcagatgccgggcagacggctgtgcaggacttcctcgccgaggtggtcgagtttcagcagcacgtggtccttgttcggacccacgccgttgccggccagaacttccttgaccatggaacgggcgaccacgtcgcgaccggccaggtccttcgcgttcggcgcataacgctccatgaagcgctcgccgtgggcgttgatcaggtaaccgccttcgccgcggcaaccttcggtgaccagtacaccggcgccggcgatgccggtcgggtggaactgccacatctcgatgtcctgcaccggcacgccggcacgcagggccatgcccacgccgtcaccggtgttgatcagcgcgttggtggtggaggcgtagatacggccggcaccaccagtggccaggaccacggccttggaacggatgtagacggtctcgccggtctcgatgcagatggcgatgatgccgaccaccgcgccgtcctggttcttcaccaggtcgaccgcgtaccactcgttgaggaacgaggtgccattcttcaggttggcctggtacagggtgtgcagcagcgcgtggccggtacggtcggcggcggcgcaggtacgggcggcctggccacccttgccgaagtccttggactggccgccgaacggacgctggtagatgcggccggtttcggtacgggagaacggcaggcccatgtgctcgagctcgaacacggcctcgggaccgacggaacacatgtattcgatcgcgtcctggtcaccgatgtagtcggaacccttgacggtgtcgtacatgtgccaacgccaatcgtcgttcgggtcggccgaagcgatcgcgcaggtgatgccaccctgtgcggatacggtgtgggaacgggtcgggaagaccttggtcaccacggcggtcttgtggccgccctgggccagttgcagcgcggcacgcatgccggcgccaccgccaccgacgatgatggcgtcaaaggaaagtgtacgaatgctagccatggatcacataccccaaagaatctgcacaccccagacgaagaatgcgaacatcgccatgccgcaaaccgcctggaagaggaaacgcacgactgtcgccgccttgccgagagccatcgaagtcaggtagtcggtggagatggtccacataccgacccacgcatggacgctcagggcaaccagggtcaacaggctgaagatgcgcatccaaccctgcgagaacaggccgtgccagtccgcgtaggaaatgttggggtgagcaatgaggtagcccagcaggaaaatgacataagccgcgagaacgaccgcggaaacgcgctgggccatccagtcgtagaggccggagcgcgagaagtttgtgacgttagttaccatacccatacccccgccagaacgatcagcaccaccgcgatggcgatgacgattttggagccacgcttaccgccttccagcgtctcgccgacgccagcgtccatgaccaggtggcgaacaccggccaccaggtggtacagcagcgcagacagcaggccccagatcaccatcttggccaggggactggtcaggcacgccttcacctgctcgaagccttcttccgaactcagcgacttgtcgagcgcgaacagcagcacggcaataccgaggaacaggatgacgccagagatacggtggagaatggacgtgtaa

SEQ ID NO: 9341 - DNA, 459 bp, Pseudomonas aeruginosa
gccggccatcggcgcagcgcaggtgccccttcagggacaagcgtcgaccgaccagttcgaagctctccaggctctgctcctggcagcgcaactgcaggcgaccggcgctttcccgcccggccccgagaaaaccgccctcgctctcccacaacggcggccgagcgctacccgccactgacagggcgaggctcttgccgccccagctcaagcggtgttcgcccaggtcgaaatcgcgcgggatggcaaacgccggcggcacccgcagctcgctccacagagccggctcccgcgacgcctggctcgcccaccaggcggccgccagcacgacggccagcccgctcaaggcgagcccccagaccagcgagcgtttgtgcaaccgcatacctttcatccttttccgagcaccagcccctaccggtcgatgcctgcccacttggatttatcgccgcagccaattag

SEQ ID NO: 9342 - DNA, 345 bp, Pseudomonas aeruginosa
aaggcctcctcgccaccgaccatcaccgtcagggcgccgttgaccgcgcctgcctggccgccggagaccggcgcgtcgagaaagcccagctcacgctcggcagccagcagcgacagctcgcgggcgacttccgccgaagcggtggtgtggtcgacgaacaggctgcccggcgccattccggcgaaggcgccctgctcgcccagcgccacggcacgcaggtcgtcgtcgttaccgacgcaacagaacaccagctcggcgccagcacaggcctcgcgcggcgtatcggcgcgccgtccggcgtactcctcgacccagcgcagcgccttggccgacgagcgattgtag

SEQ ID NO: 9343 - DNA, 693 bp, Pseudomonas aeruginosa
cccatcgtgcccaggccgagaaatgcgaccgcagtcattccgtcatctcctcgaaatccgatcccgcagcctagcacagcggtttgccgaggtccggaagccccgccatactcagcgcggaccctggtatggatagctccgatgcctcactggctggtaatcgatctggaggccaccaccgcggaaggcggctggcccctggaggaaatggaaatcatcgagatcggcgccaccctggtcgccgccgcggacgcccgcgaactggaccacttccagcgtttcgtacggccggtcaggcggccgctgctgacccacttctgccgcgacctcacgcatatcagccaggccaacgtcgatggcgcagcccatctcaatacggtctgggaagccttcgagcgctggctcgcccagcatcgtccgcgactggccggctgggccagttggggcgactacgaccgccgccagttggagcaggaatggcgccagcacgggctgaccagccagctcagcgaagtgccgcacgtcaatctcaagcaacgcttcggcgaagtccgccagttgccccgcccagtcggcctgaacgcggccctgcaactggccgggatgagtttccagggccagcagcaccgcgccctggaggatgcccgcaataccgcacggctgctgccgctggtattgccggtggagcattga

SEQ ID NO: 9344 - DNA, 465 bp, Pseudomonas aeruginosa
atgccgacgaacagcgccggcaggatggcgaagtacttggccacgtcgttggcgatggagaaggtggtcagcgcgccgcgggtgaccagcaactccttgcccacctggaccacgtcgagcagcttggtcgggtcgctgtccaggtcgaccaggttggccgcctcgcgggcggcctgggtgccgtcgttcatggccatgccgacgtcggcctgggccagcgccggggcgtcgttggcaccgtcgccgcacatcgccaccaggcgaccttcgccctgctcctggcgaatccgcgccagtttcttctccggggtagcctcggcgatcacgtcgtcgaccccagcctcggcggcgatggcagcggcggtcagcgggttgtcgccggtcaccattacggtgcggatgcccagccggcgcagttcggcgaagcgctcgcgaatgcccggcttgaccacgtccttcaggtga

SEQ ID NO: 9345 - DNA, 1344 bp, Pseudomonas aeruginosa
atggcaccgagcagccggccgttggctaccaccagcagcggggtgccgccgctctgggcgatcttgtccacctcccgcgaaagcacctcgggcatcttctcccgcggcaggtcgatgaagcgcagcgccgcatccaccgcccccttgcggtacacctggccgttccagtcgaccccggacaggcgggtttccgcgctgaaagcgatcggcgtcagttcctcgcggcgcggctcctcgatcggatgcaggatgcgcaggtattcgacgatcgacttgccttccggggtgtcgtcggccagcgagcccagcaacgcgccctcggccagttccttgccgctcacccccggcgcggcgtacagcgcgctgcaacggcggttgccgaaggtgatggtgccggtcttgtcgagcgccagcacgtggaaggtcccccggccgccttccaccggcgggacccggaattggcgatcacgttcaggcgcaccaggcggtccatgcccggcgatgccgatgcccgagagcagcccgccgatggtggtcgggatcagcgtcaccagcagcgccaccaggaacaccagcggcaggttgccgccggcgaacagggcgaacggcttgagggtcaccactaccagcaggaagatcagggtcaggccgatcagcaggatgtccagcgccacttcgttgggggtcttctgccgcttggcgccttccaccagggcgatcatccggtccagggtcgactcgcccgggttggcgccgatccgtaccagcagccagtcggacaccacctgggtgttgccggtcaccgccgagcgatcgccgccggactcgcggatcaccggcgccgattcgccggtgatggcggcctcgttgaccgccgccaccccttcgatgacttcgccgtcgccgggaatcatctcgccggcctggacccgtaccacgtcgcccttgcgcaggctgctggcagcgacgctctcgaaactgccgtcggcgcgccgcttattggcggagaggccctggctgccggccttgagactgtccgcgcgggccttgccacgcccctcggcgagcgcttcggcgaaattcgcgaagagcacggtgaaccacagccagagggcgatctgcagcgccaccgaggtcggcaccgcctggtcggggacgaagcacagcaaggtggtgagcacggcggtcagttcgaccaccagcatcaccggcgagcgcagcaactggcgcgggtcgagcttgacgaaggcttgcagcagcgccggccgccacaaggcggcgaggctggtggacgcgttgtggcgacgttcgagcgatttgtgcaaggcgttcttggacgcctga

SEQ ID NO: 9346 - DNA, 1209 bp, Pseudomonas aeruginosa
caaggcgaaggatcgacgctagccctgggcggcgcggatcatgttgcgggcgatcagcagttgctggatctgcgtggtgccctcgtagatgcggaacagccgcacgtcgcgatagaagcgctcgatcccgtagtcgccgatatagccggcgccgccgaatatctgcaccgcgcggtcggcgacgcggccgcacatttccgaggcgaacagcttggcgcaggacgcctcggtaccgacatcgcggccttcgtcgcgctgccgcgcggcgtcgatgaccatgcagcgcgccgcgtaggcttcggccttgctgtcggcaagcatcgcctggatcaactggaactcggcgatcggctggccgaactgcttgcgttccagggcatagcgcaacgcatcctcaagcatccgctcggcgacccccacacagactgcggcgatgtgcaggcggcccttgtcgagcaccttcatcgcggtcttgaagccgacgccctcgaccccgccgatcaactgactggcaggcacccggcagtcgtcgaagatcacgtcacaggtatgcgcgcccttctgtcccatcttgcgatccggcttgcccagggacagcccgggcgtaccgcgctcgacgacgaaagcggagattccgccggcgccacggatcgccgggtcggtgcgcgccatcacggtgtagatgccggcctgcggggcgttggtgatgaagcgcttggtaccgttgagcacgtagtgctcgccgtcacgcaccgccgtggtcttcagcgaggcggcgtcggaaccggagtccggttcggtgaggcagaacgaactgagcagttcgcccgacgccaggcgcggcaggtagcgccgcttctgttcttcggtgccgtcgatgacgatgccctgggagccgatgccgttgttggtgcccagcagcgaacggaacgccggcgaggtccgccccagctcgaaggcgatgctcacctcttcctccatggtcaccccgaggccgccgtaggcctccgggatcgacaggccgaacaggcccatctcgcgcatgcgggcgatgatcgcctcggggatgcggtcggtttccgccacttcctgctcatgaggcaccaggctttcgcggacgaactggcggatgctgtccagcagcaggttcagggtttccggatcacgaatcatgctcactccaataggccactaggccggttgccatga

SEQ ID NO: 9347 - DNA, 2274 bp, Pseudomonas aeruginosa
aactatatttcgcatagcgaaatatcaattcatcggagcttccatgtccgccgatccttcgcccgtggtcctgctcgaatttcccgcagccgatatagccctgcttcgcctcaatcgtccgcaagccaggaacgcgctgaacgacgaagtgcgccagcgcctcgccagccacttccagacgctcggcgcggatccggcgatccgcgtcatcgtgctcaccggcgactcgcgctgctttgcagctggcgccgatctccgcgatctctcgacgagcacggcgatcggcctgtacggccgccacggcgagcgctactgggaagccatcgcgcgctgcccgaagccggtgatcgccgcggtcaacggcttcgccctgggcggcggctgcgaactggcgatgcactgcgacctgatcgtcgccggcgagtcggcacagttcgcccagccggagatcaaggtcggggtgatgccgggtgccggcggcacccagcgcctggtacgggcggtgggcaagttccaggcgctgcgcatgctgttcaccggctgcctggtgaaggctccgcaagcgctggccatgggcctggtcagcgaagtggtggcggacgagtcgacgctggcgcgcgccctggaactggccatggagatcgcccgcctgccccctctggcgctggcgcagatcaaggaggtggtcctggccggtgccgacctgccgctggacagtgccctggccctggaacgcaaggcgttccagttgctgttcgactcgcaggaccagaaggaaggcatgcaggccttcctggagaaacgcccgccgaactaccaggggaaatagacgatgcccgatattcgttgtatcgccgtggtcggtaccggtgcgatgggcaccgggatcgcccagatcgccgcccaggccggcctgaccgtatggctgttcgacagccgcgccgaggccgccgccgaggcacgccagcgcctgcggcagaccttcgagagcctgtgcggcaaaggcaagctgagcgccgccgacgccgaggccgcgcaaaaccggctgcgggtggcggaacgcctggaacaactgggcgactgcgaactggtggtggaggccatcgtcgagcgcctggaggccaagcaggaattgctgcgccggctggaagccatagtcgcgccggagaccatcctcgccagcaatacctcgtcgctgtcgatcaccgccatcgccgccgcctgcgagcggccgcagcgggtcgccggctttcacttcttcaacccggtgccgctgatgcgcgtggtcgaggtggtcgacggcctggccagcgctccggaagtcggcgacgccctgctcgccctcgccgcgcgcctgggccaccgcggcgtacggaccaaggacagccccggcttcatcgtcaaccatgccggccgcgcctatggcaccgaggccctgcgcatcctcggcgaaggcgtcgccgaatgcgccgagatcgaccgtgtgctgcgcgagtgcgccggcttccgcatggggccgttcgaactgctcgatcttaccggcctcgacgtgtcgcacccggtaatggaatcgatctaccagcagtactaccaggaaccgcgctaccgcccgcacccgctgacccgccagttgctcgccgccggccgtctcgggcgcaagagcggccagggcttctatcgctacgtcgacggccagccgcaggacaagcccggtccgcaaccggtgccgcaggccgccatccggcccccggtgtggctgggctgcgaaaacgaggacgaccgccgcacgctcgccgaactgctgcatcgcctcggcgtcgagccggaaaccggcgaacgcccttccgccgcagcgctctgcctgctggccgcctggggcgaggacctgagcagcgccgtgcagcgcttcgcctgtcccgccgagcgcagcgtcggcatcgacctgctctgcgacctcgagcgccggcgctgcctgatgctctcgccactgactaccccggccatgcgcgacgccgcccacgcgctactggctggcgacggcgtcggggtcacggtgctgcgcgacagtcccggcttcgtcgtccagcgggtactggcgatgatcgtcaacctcgcctgcgacatcgcccagcagggcattgccagcgtcgaggatatcgaccaggcggtgcacctcggcctcggctatccccacggcccgctggaatggggcgaccgcctcggcccgcggcgcctgctgagcattctccagcgcttgcagacgcttaccggtga

SEQ ID NO: 9348 - DNA, 663 bp, Pseudomonas aeruginosa
ttggatgtttcttccgtgaccattcccctcaagcgctccctggtggacatcgccctggagcagatccgccagcgcatcgacgccggccattggccgctcggccagcgcctgccgccggagccggaactcgccgagctgctcggcatgagccgcaacaccgtgcgcgaagcggtgcgggtgctgaccttctccggcgtgctggaagtccgccagggcgacggcacctacgtgcgcgcctgcgccgatccgctggaaaccatgctggtgctggcgcgcagcgcggtgcagcactccctggaggcacgcgggatgatcgagatcgaggcggcgcgcctggcagccgttcgccgcgacgacagcgacctgagcgcattgcgcgaacatctcgacgcttcgcgccagcgctacggcagcgccgacctgcaggactacatagagcacgacgtccgcttccaccaacggatggtcgatgccgcccacaatccggtgctcagcgaactctaccgctatttctcgcaggtcatccggacctcgctggaacgcaccatggccgacccacaaagggcccagccctgcttcgagctgcaccagcaactgctcgacgccatagaacgcggagacccggacgctgccgccgcggccaaccgcgcactgctgatctga

SEQ ID NO: 9349 - DNA, 1290 bp, Pseudomonas aeruginosa
acccgggacagacccatgactcacgccttgaatgcccggccgggagcgcaccccggccatcctccggaagaactgctgatcgatgccgaagtcgacgacgaaccagttccgccggcgccgccactacgcccctggctgctcctgctgggcctggtgctggtggcgctgaacctgcgcccggcgctgtccagcctcgcccccctgctcaaccaggtgcgcgacgataccggcctctcggccgctgccgccggcctgctgaccaccgcgccggtactctgcctggggttgttcgcgccgctcgcgccgcgcctggcccggcgtatcggcgccgagcgcagcgtgctgctgatcctcttctgcctggccggcggcatcgtcctgcgcagcctgttcccggtgttcggcctgttcgccggcagcgtcctggccggcgccagcatcggcatcatcggcgtgctcctgccgggcatcgtcaaacgcgacttcccgcgccaggccggggtgatgaccggggtctacaccatggccctgtgcctgggcgcagcgctcgccgccggcgctaccgcgccgctggagaagctcttcggcaactgggaactggcgctggcgttctggtcgctgccggcgatcctcgccgccgccttctggctgccgcagacccgccagggccagcacgcccatcgccaggccttccgtgtcatcggcctgtggcgcgacccgctggcctggcaggtcacgctgtacatgggcctgcaatcgtccctggcctacatcgtcttcggttggctgccgtcgatcctgatcgaccgcggcatgactgcggtggaagccggcctggtgctgtccggctcggtgatgctgcaactgatcaccgccctgctcgcgccctggctcgccgctcgcgccagggaccagcgcctggcggtggtgctggtgatggcgaccaccctcgccggcctgctcggcttcctctatgcgccgctgcagaccatctggggctgggcggtcctgctcggcctcggccagggcggtaccttcagcatcgccctggcgctgatcgtcctgcgctcgcgcgacgcccacgtcgcctcgcatctgtcgggcatggcccagggcgtcggctacaccctggcggccatggggccgttcatggtcggcgtggtccacgacctgaccggcggctggaacgcggtcggctatatcttcatcggcgtcgccatcgccgccaccctgttcggcctcggcgccgggcgcagccagtacgtgggggcccgcagcgaacacctgtag

SEQ ID NO: 9350 - DNA, 1554 bp, Pseudomonas aeruginosa
gctgcaggcgaaggtcagcaggccgagcagcatggctcccggtacgccggcgatcatgaagccgatccaggccagcagggcttgcgccgcggcggtaccgatcaccccgttgaccacccgctgtacggtgccggcgacaaggtcgcgatagtgctccgcgcggttgccgatcaggcgctccagggcacggtggacgatggactccaggcgcggcccgtcgcggtagaagaagaagatcaggatcaggctgaggaccagttccaggatccctccgccgatcttcgcgctgcgcgccagcagccagttgccgacctcgccgacatagggcttgagcacgtagaagaacgccacgccctgttggtcgatggagtcccaccagccgatcaggcggtcgccgatcagcggtacgccggccatccacgaaggcggcggcggcaggccctcgacctggagattcttcagcagctccatcagcgagcgaacgttgtccgccaggccgaagccgagccagatcagcggcaatgccaccaggacgatccagcccagggtcagcaggcccgccgccagcgactcgcggccaccgagcaggcgcgtgagcatgcgcatcagcggccaactggcgaaagccagcaccgcggcccagaacagcgccgaccagaatggcgccagcacccagagactggcaccgagcagaccgaacagcagcacgcgaagcaacagccgatcgttatcgaacatcaaggcaggccttcctcaaagggggatacaccgatagacagcgctcggcgtgcgccgtttccagccggagcgtggggcgcgggggaaaggcagtctactctggcgggcggccttgccgaaggcattttcgccatcgcccgggcccgcaggcccgggcgaacgcgttcaacgcagccagttgaggtgcaggccctcgacctccgactggcccagctccatgcggctgttcagcacgccctgcccgcgcagggcgtcgcgccactcctgggcgtgcttgccggacagctcgacccgcaccccggtatccaggcgcagggtccgcaccagcagctccaaccagtagccggccggctccgccggcacatggctgagggtcagttcgccgttggccttgagcaggcgcagcagggtcgccgggctcggcagcagttccgccagcggcgcatcggccttgagttcctcggcctgcaggtaggcgcggcgattgccacgggtgatcgagtagaccgccaccaggctgttctcctgcggcgccgccagacgcaccagcaggtaggcctgctgctcgtccgggccgtacagcttggcattgccgaacacggcgttggccagcaggctgctggagccgcagtcgcgtcgctcgcaccagaacaacggcgtggcgtcggccttgagcagcgcggtgcgcgccgcggcgaacgcctcctggctgctgtgctcgggcggcaagcggtaggtcagtgcggtcagctcgccttcggcgcgcacctcgccctccatgcgcaggcgaccgctgatgcgactgatcgcccctag

SEQ ID NO: 9351 - DNA, 657 bp, Pseudomonas aeruginosa
ccgggcattccacgctgcgcacgaagttcagcgcgtgggcctgggtcaggcgcagcggcgacggtagggtcaggcgcgcgtcggtgcgccaggtatagccaccgggcaccggttccaggccgcgctgggcgagcagttcggcggcctcccgggagatctcgccaaccccgcgcatccgcgcttccacggctttttccagctcggcatagaccggcttgcgcttgtggcgtagcgccagttgcgccttcagcgcttcgccgagcttctgcggcgccttgtcggcttcgccagtgtagggaatcaggccatcgatcaacgccagccgctcgatgcgctcgggcaaggccccggcgagcagcaccgagacgatggcgcccatcgagtgccccaacagggaaaaacgctcccagcccagttgctcggccaccatcagcacgtccagcgcgtagtcccagagcaggtagctggcgccctcggcacgatgcgcggaatgcccgtggccggcgaagtcgagggcgacgatacgcagcccggcgagcttcggcgccaggcgcgagaagctcatggcgttgtccagccagccatgcagggcgatcaccggcttgccgtccggcggaccgaacagatgcgcggccagttcgatgtgcggcaggctga

SEQ ID NO: 9352 - DNA, 1650 bp, Pseudomonas aeruginosa
tgcgtacttcctcgacctgcaggctcatgccgaacgctcctcggtcgcccgcgaccagcgatcgaacacgcctttcagcagttcggcggtttcccgcgggcgctccagcgggaacatgtggccgccgggcagcgacatgaactcgccgcgcggcatcgcccggatcagccgggtgtggtgcggcaacaccaccttgctgtgccgcccgcgcaccatcgccagcggcacctgcaactgtcgtggacgccccggactgctgtgcggcacgctacggtagatgctgatctcggtggccggatcgaagcgcaggcgcaggccggaaccgccgccgctgtcggccagcccgtggcgtacgtaggcctccaggcaatcggggtcgaagcggcggaacagcgccttgccggagaagtacgcccgcgcctcttccaggtcggggaacgcctcgcgacgccccagggtgcgcccggccggagtgatccggtcgatgaagccgaagcgcttggcggcacggatcaccaggcggtcggcgagggtcagcaccggcgaatcgagcatcaccacgccgcggtagagttccggccggcgcagcgccgcgtggtagtgcagcacgccgccgagggaatggccgacgccccagaccggctgttccaggctggcgaggtggtgcagcagttcgtccaccaggttgtcccagttgtcgttcaccgggaaacgcgggtcgtgcccgtgcatttccaggtgatccacccggtactccggcgccaacgcctcgaacagcttggcgtaggtagccgacgggaagccgttggcgtgggcgaagaaaaccgattgcgacatgcgcgacgtctcgacagggctgatgccagggattctccggcagcctcgccgaggcggcaatggctttgccggctgccttgcacggcgaagcggccaaaacctcaggcagagcggacgagatgctcgaggatcgccgccgccaccagcaggaacaccaccccgcaggccgcgtccagccagggcaccgcgcgcaacaggcgggcctgcagggccgggcgggtaagggtcaggctgagcaggccgaaccagcaggcgcccatgccgaacagcagcgccgccaccgccagtttgccgccgagcgacatctgcgcgggaatcaggctgccgagcaaggcgatgaataacaccagcgccttgggattgaacagattggtcgccactccgcgcagccagggccccaggggcgacggcggcagtgccccgtcgagccggcccggctggccgtcgccgcgccgcagccaggcgcgcagcgcgccgacgccgagccaggccaggtacagcgcgccgagcgcctgcaggatggcgaacagcacaggcgtacggctgagcagcagcgacacgccggtcagcaccagggtggtatgcaggagaatcccgcaggccagccccagcgcgctggccaggccggcccgccgcccctggtgcagggacgtgcgcaccaccagggcgacatcgggaccggggctgaccagggctatggcgaacaccgccgccagggtcagcaagacagacaattcctgcatggctactccacgaaaaagggatcggaaaggaaaacgcgaatcagcgctggcgcaggcgcgccggcggtaa

SEQ ID NO: 9353 - DNA, 1425 bp, Pseudomonas aeruginosa
cccataggtgcgccggaacagacggctgaagtgcgcctggtcgtagaaaccgaactgctgggccacctggctcaatggctgctcgccgcgcagaaccagcggcaaggcgcgctccaggcgcagttgggtcagccactggtggggcggcaggccgcagtgacggcggaagcgccgcagcacctgccaggggctcaggccgcagaaggcggccagttcctccaggttcggcgggtactccaggcgcgactccagccagtcgcgcagccgcgtccagtcgcgctggccgaagccttcccggtcgccctcctccaggcgcaggctgctgcccaggctgagcaggcaggccagcgcctgccagaggtgctcttccagggccagacggttctccagcgccgccgctccgccgagcatgcccaggtgcaactgacgcaggcgctgctgcagacgctcgtcgcggaccaggctactggtcagacgcggcgccccccgacggccgtcgctgaagtcacggctggcgcgctccagccagtcggcatcgagcgccaggacgcggatacggtagccctcctcgccggcgctgctgccgtcgtggatgctttccggcgccatcagcaacgcgtcgccggccccggccaggcgccgttcgccgccggcggcatagcgatgccggccctgcaacagcaagccgatgtggtactccaggtggaagtgccggggaaaggaaaagcggttgtgctcggcgtctatcaggcgtacgccgggaatcccgctgctgagatgggtgatctgttccatcccgctactctaccgcccgcgggacggaacgatcttggacaaaattgcggaccgcgctcagcccgccctgcccgccaatggcaccaccgccatggtcaggcgggcgatgcagctcggcttgccgtcgtcgccactgaggcggatgtcccagacatgggtggtgcgccccaggtggatcgccctggccaccgcggtgacccggccgctgcgcaggccacgcaggtggttggcgttcacttccaggccgacgcagtagtactggctggtatcgacgcacaggtagctggccatcgagcccaggctttccgcgaggaccaccgaggcgccgccatgcagcaggccgaacggctggtgggtacgcgagtcgaccggcatgctggcggtcagcgactcgtcgtcgaaggcttcgaagcggatgccaagcaggtcgccgatgctgttcttctgcgaggcgttcagttgctccaggtcgggcatttgtcgccagaggctcatgggaattccttgcgcaagggggaagccaagggcttcccgtcggtgggagtcattcgtgccagagcacggcctcgcggcgttccacccattcgtggaagcgcgagccataggcaccttccaccatattgcgcttga

SEQ ID NO: 9354 - DNA, 540 bp, Pseudomonas aeruginosa
tgcgtacctcgacgccggggctgttctggccgatccagccggtcttctgccggccgggccggcagacgtgggagtaaccgctgttctcggtcatcccgtagacctcgagcacatccaggcccaggcggcgataccagagcagcagcgcctcgggtaccggcgccgcgccgcagagcgcgtagcgcaccgcgtccaggcctagcccggcgagcaccttgcgaccgacgatgcggccgaggatcggcagcttcagcaggcggtcgagcttctgcgccggcatcttcgaatacacccccatctggaacttggtccagatgcgcggcacgccgaacagcagggtcggccgcgcacgcttcatgtcctcgacgaaggtgtccaggctttcggcgaagaacaccgtggttcccccgtagagcgaccccatctcgacgaacatccgttccgccacgtggcacagcggcaggtaggagagcatccggtcgtcttcgcgggtgccgaacagttccacgccgcggctggcggcgaaggcgaaactgctga

SEQ ID NO: 9355 - DNA, 675 bp, Pseudomonas aeruginosa
ccagcaggagattgcgctcgctgcgctcgtcgaggaaaccgagcacctcgcgcggatcgtcgtcgggggtcaaccagggcgcggtgccgaccggctcgaccaggcccagtgcctcgcgcaccagctcggcggtctgctgggcgcgcacgtaggggctggcgagaatcccgtccagcggcaacccggccagccgcgcggcgctctgcagcacctccttgcgtccatgggcggtcaggcgccgctcggaatcccggctggcgtgcggttcggcctcgccgtggcgcaacagccagagtttcacaacttcggctcttcgtcgcgcgccgggtgcgcggcgggcggcacgctgtgggcggcctcgccctcggcggcgcgggcgctcggccagtcggcgaacggccagggtttctcgtcgctgtggaaggtaccgaaacggccgatctgcgccaggtactggctgaggctgtcgccgaaagccatcaggctgccgttcggcgcgccgtagatcagtcggtagaccagttggatcaccaccaccgccccgaggagcagttcggcgacctgccagaccaggacgaacagcagcatccagaggatgcggatggcgatcgattcgcgtgcttgcgggtctgcggacatggcggtctcctcgtcagaagccggtggtgggaatga

SEQ ID NO: 9356 - DNA, 2853 bp, Pseudomonas aeruginosa
ttcatccatttctggccgccacgcggcaatcacgccattatacggtcggccagccggccgaccagtcttgacgccggcgctggcaaaagcccgcgcctcgtttaccatgcccgggccagacaatacctatcgagaacaaggtcgttccgtgcccatcgcttcacgtgctcccgcctccctgaccctgctggccctgctgttcggcggcaagctcgcggccgccgacctgttcaacgatcccagcggcgttcccgaagtattgaccgcgacacgcctgaaacaatccccggcggaagttcccggcagcatcagcgtgctcgaccgcgagctgatcgtcgccagcggcgcccgcgacattcccgaactgatgcgcctggtcccgggcatgatggtcggctacctgtccggcaaccagcccacggtcaactaccacggcaccagcatgtcgggggcgcggcgcctgcaggtgctgatcgacggccgctcggtgtaccgcccgggccttgccagcgtcgactggagcgacctgccgctggccctcgaggatgtcgagcggatcgaagtgttccgtgggccgaataccgtcagctacggcgccaacgcattgatgggggtgatcaacatcatcacccgcgcccccggcgagtcgcccggcacgcgcctgaagtacacggcgggccagcgcggcatccgcgactggtacgccagccagagcatcgccctggaagacagcgacttccgcctgtcgctgtccggccaggaagacgacggcttcgaccgcgaccacgacggtcacgccctgcgcgacggccgccggctcagccgcttcaacctcaacgccagccacagcctggcgccgaaccagagcctggagtggcaactggcggccaaggaaggctcgaaccagcacccctacgcctaccgctcgccgtttccccaggttcccgacgacatcgacaactccgatacgctcgcccacgactatgccggttcgctgcgctggaatgtcgacctcgacccgcgccacagcttctatatacaaggctacgcacagcactgggagcgccggcaggaatggaacgcctgcgaggcggccattgccttcagcccgcaactggcgcagctctgggaactgaacccggactacctgcgcaggttcgccgacgatccgacccggctgccgcccggcagcgcccaggagttgcaactggcgacccaggtcctcgaccagctacgcaacggcggactgcgcccggtctgcggacgggtcgaccgcaacatccgggaaagccgctacgacctggagatgcaggacaccctcagcctgggcgacaacctgcgcctgctgaacggcctgagctaccgctacgaccaggcaaactccgagaccttctacggcggcagggtcagcagccagatctggcggctgttcagccaattggagtggcatgccggcgaacactggctgctgcagggcggggggatgctcgaagacgtcgagggctccggcagttcgttcagcccgcggctggcggtgaactacctgttcaacccccagcacagcctgcgcgcggtctattcggaggcagtgcggtcaccgggcatgtacgaaaacgacgtcgactggcgctaccgggtccgccacctgacaccggcgccctatgggcagagcgaagcctactacttcgccagcgcccacggccccggcgacctgggcaaggaacacacccgttcgcgcgagatcggctacaacggttttttccgcgagaccgggctggccgtggatgtacgcctgttctacgaggaaatcaccggactgatcagcgatccgctcagcgtcgtcgacttcagtccggacaacggcgatcgcatccgcttctccggcgcggaaggccagctcgactggcgcctgggcctacgcgaccgcctgcgcgccacctacgcctatctcgactacgacgccaccagtcgctacgaccggcgcctgaccgcccgccacggcggctcggccggctggatgcacgactggggccaaggctggtccagcgccctcttctattatggcgacgactcgctcaatggacatcgtttcgaacgcgtcgacctgcgcctggccaagcgcattcccctgggcaaggccgccctggaactggccggcgtgctccagcagcgtctcgacgacgaaccgctgacgtttcccgacaaccgctacgacagccgccacctgctctacttcagcgccgaggtgacgttctagatgcgtcgcttgcgccccgcccgccgggctttccaggcgctgctcgcgctcgtcttctgctgtctcccgcatgtcggcgaggccgcgcaactggtcttggtcagcgccaaccagggggccgcggtgaacgcctttcgcgatgccctggcgcagcgacggccgcaggaccaggtggaactgcgcacgcccgcggccctggcggaggggatggtcttcgccgacgacacccgcctgctcctgctcggccccgaggccctggcctggcgcctgcgccagcaccgggcgccgccgaccctggcgctgctgctcaaccgggtcgatggccagcgcctgctgccaggcgccaacggacatggcggacacggcgtcggaggtctctgcgtactctggagcgacccgccggcgtcccgccagctccgcctggcgcgcctgatcctgccgggcatccagcgcatcggcgtgctctacggcaaggacagcgaattcctcctcgacgagcttcgccgcgaggcccgcagccaggggctccagctgttcgtcgccagcagcagcggcaacgacgacccgcgcccgctgcagttcctgctcggcaatag

SEQ ID NO: 9357 - DNA, 2283 bp, Pseudomonas aeruginosa
cctgctgctcggcatcgacgacaaacagctgtacaactcgcagagcatcaagagcctgctgctcggcagctacgccaagaaccgcgcgctgctcggccccaccgcagccttcgtcaaggccggcagcctggcgagcagctacagcgaccaggaggattggctggacaccctcgacgaattgctcggccaggcgcccaggcactggcccctcagcctctatccagggcatttcaaggtgctcggcaatcggcaggtagcccgttccctgggtatcgacctggccagcgacgccgacctcggccggcgcctcgccgaaggagaagaaccatgagccagcgccacggctgggacatccgtacccgcatgctggcgatcagcctgggcccggcgctgctgctgaccctgttgctcaccgcctacttcacctactcgcgcctgcaggacctgcgccaggaactgacccataccggccagttgatcgccgaccagctggcgccggccgccgaatacggcgtgatcgccggcaacacgcccgtgctgcagaagctgctgcaggccaccctcgacaccccgcatgtgcgcttcatcgaggtacgcgaccgcaacgacaatatcctggtgtacgtcgaacagttgcccggcgcgttgcagaacgccgcgccgatcgacatcttccactccaccatccagcgccagcgtatcgccctggccagcgacccgctgctggatggcgccagcgaaggcgacggccagtccggcgaggactacctcggccgggtggtggtcggcatgtccaacgacgccttcagccagcggcaacaggaaatcctcctgaaggccgccctgctggccgccttcgccctgatcctcaccttcctcgtcgcgcgccgcctggcgcagcgcctgtcggcgccgatcagcaccatgggccaggcggtcgaggcgatccagagcggcgactacaagaccagcctgccgatcctcgacgacggcgagatcggcgacctggcccgtcacatcaacaatctcgccagcgggctggaccgcgcgagccgggaacaggaacaggcgatcagccaattgatcagcgcccgcgaggaagcggagcaggcgaaccgggcgaagtccgacttcctggcgatgatgagccacgagcttcgcaccccgatgaatggcgtgctgggcatgctgcaactgctggaaaccaccgagcagacccgcgaacaggccgagtacacggcgctggccaccgagtccaccgaacacctgctgaaggtcatcaacgacattctcgatttctcaaggatcgaacgcggcgcgcttgaactggagtgcatccccttcaacctgctggaactggtgcaaggctccgccctggtgttccagcacagcgcccagcaacgcggactggcgctggaattgcagatccaggccggcctggagaatatcgaggtctgcggcgatccgacgcggatccgacagatcctggtgaatctgctgggtaatgcgctgaagttcaccgaggaaggcgccatccatctcagcctggagtggcaggctctcgatcacgacgtactgtggctgacctgcgcggtgcacgacagcggcatcggcatctcgccggaacgcctggaacatatgttcgacgccttccagcaggcggattcgtcgatttcccgacgctacggcggcaccgggctcggcctggcgatcgccaggaccctggcggaacggatgggcggcaccctgcaggcagagagcaaggaaggctcgggatcgaccttcaccctggagattccgctgcccttccagcagtcgccggcgcaccggcagcaggccgccggcgacgccgccccggtcgccgccggtcaggaaatcctcctggtcgaggacaatccggtgaaccagacagtcatagaagccatgttgcgcagcctcggctatcgcgtcaccctggtcgccgacggtatccaggcggtacgcagcgccgagcgccagcgctacgacgcgatcctgatggactgccgcctgccggtgctcgacggctactcggcgacacgggaaatcagggcccaggagaacggccggcaggtaccgatcatcgccctgaccgccaacgccctgcagggcgatcgggagaactgcctgcaggcgggaatgaacgattacctggccaagccattcaaacgggcggaattgcaacgcatactgcaacgctggatcggctcgcagccggaactccccgtgacgtcgaacgaaaccggacgaggggagccggaatga

SEQ ID NO: 9358 - DNA, 525 bp, Pseudomonas aeruginosa
acagccatgccgccggcatggggagaaaccgccatgagcgatgcccttgccctgaccgtcaacggtcagtccctgcgcctcgatgtcgcccccgatacccccctgctctatgtcctgcgcaacgacctgcaactgaacggtcccaagttcggctgcggcctcggcgagtgcggcgcctgcaccgtgctgatggatggcgtcgccacccgctcctgcatcaccccggtggaggccgccgtaggccgccgggtggttaccctcgaaggactcggcgatgccacccatccccatccgctgcaacaggccttcatcgacgaacaggccgcccaatgcggctactgcatcaacggcatggtgatgaccgccaaggcgttgctggatcgcaacccgaaccccagcgacgacgagatccgccaggaactggcctacaacctgtgtcgctgcggcacccatgtggagattctcaaggccgtgcggcgtgccgccgagagcctgaaggagcatcaggaggagcacccggcatga

SEQ ID NO: 9359 - DNA, 441 bp, Pseudomonas aeruginosa
acccggagaacggcgcggtgcgcgtcgccaaggtctgggtcgcccatgactgcgggcagatggtcaatcccgatggggtcaggcaccaggtccacggcaacgtcatccagtccaccagccgggtactcaaggagttcgccaccttcgaccgccgtggcgtcaccagcctggaatggggcggatacccgatcctcggcttccccgaactgccggagatcgacgtactgctgttcgaccgccccgagcagccaccgatgggcgctggcgagtcagcctcggtgcccagcgccgcggccatcgccaatgcgatcttcgacgctaccggggcgcgcctgcgacaggtgccgttcactccggaacgcgtactcgcggcgctgcgcagcgcgcaggcctgatccttttccccggggcgccgcggcgccccgcgcagtggatgactga

SEQ ID NO: 9360 - DNA, 1305 bp, Pseudomonas aeruginosa
cagatgaagaaggcaacacgcatcggcctctgggcctccggcagcctcgtcgcgctcgccgccatcgccctcggctacgcctggcaaccggccatcgggccactggaaggcacacccggtcccttcagcgccgagcagatcgcccgcggcgaacgcctcgccgccctcggcgactgcgcggtctgccacactcgcgaaggcggcccgcgcaacgccggcggacgggccttgccgacgccgttcgggacgatctacagcagcaacctcacgccggatcgcgcgagcggcatcggtggctggtcctaccccgccttcgagcgggccatgcggcatggcgtggcccgcgacggcagctacctgtatccggcgttcccttacaccgccttcaccaggactcgcgacgaagacctgaaggccctgtacgcctacctgatgagccagccggcggtgcacagcgaaacgcctgccaaccagctgccgttccccttcgaccaacgccagctgatggccggctggaacctgctgttcctggagcccggcgcctaccgcgacgagccgacgcgcaaccagcaatggaaccgcggcgcctatctcgccgaaggcctcggccattgcagcgcctgccactcgccgcgcaatgcgctcggcgcggaaaagtccggcagcgcgcacttcgccggcggcgaggcggagggctggaccgcgccagccttgaacgccagttcgccggcgcccatcgcctggagcgaggaggccctctacgcctacctccgccacggctattcggcctaccacggggtcgccagcgggccgatggcgccagtggtcggcgaaggcctggccaagcagtcggacgaggacctgcgggccctggcccattaccttgcgtcctacgccgctgccccggccggggaaaccgatcagcaacaggcgcaacgcctcgaccggcagggctacggccgcgtgcaaccgcccagcggcagcggcgcgcgcctgttcgccggggcctgcctggcctgccaccatgacggcgacggaccgcgcttcttcggcgtgcgtccatccctggcgctgaacagcaatgtgcatgcggacagcccggacaacctgctgcggatcatcctcgacggcatccacagcccggccaccggcgacctcggctatatgcccggcttccgccatagcctccacgaccggcaagtcgccgccctggccaactacctgcgcgagcgtttcgccggcaagcccgcctggccggacctcgcggccaaggcggcaagcctgcgccgacaggcggcgccctga

SEQ ID NO: 9361 - DNA, 453 bp, Pseudomonas aeruginosa
gacgctcggcctcgccacccggcggatattcacggggaaactccgccgcccgcagcaacagttcgcgcagcaggccggacacctccagtacccggcaaccgccgggcagcgaacgatccaggtagagactgcggaacagcacagggttgcaagcctccgcggcgtgccggacgcccggcggaatccacagcgcccgctgcgccggcaccagatagctgtgccgctcggtgctggcgcgcaaggtgccgctggcggcgtacatcagttggccccaggggtgctcgtgcatctccacccggtgcccggcgggcatctcgaaggcgcgcaggtacaccgcgcagggcaggctgcggaatcgcggcaggtcgcgttcttgtcccgtttgcggcatcggttgtccccatccgtcgagtgagcggtgcgcggccgatggtatcgtgtggctccccatag

SEQ ID NO: 9362 - DNA, 387 bp, Pseudomonas aeruginosa
acaaaccggagccacgccatgagcagtcatcgcccgcaacatcgcctgtccgttcccgatatccagcgccgcaagggtgccggcagcctggtggcgctgaccgcctacagcacgcccatggcccgcctcctcgatccgcatgccgacctgctgctagtcggcgattcgctgggcatggtgctctatggcatgcccagcaccctggggagtgagcctggagatgatggtcgcccacaccctggcggtgatgcgcggcagtcggcgcgcctgcgtggtggccgacttgccgttcgccagctaccaggaatcgccccgacaggcgttccgcaacgccgcacgcctgctggccgacagcggcgcccaggcggtgaagctggaaggcggtga

SEQ ID NO: 9363 - DNA, 996 bp, Pseudomonas aeruginosa
gccggccgggaatcgccccgccgttgtttcgcgccgttgggacgccgctcgccgcggccaggacacgactttcgtcggctcatgaaaaaggccgcccggaggcggccttcctggggttcgcctgacgtctcaggcgaccgcttcgcgcggcttgcccagcagccgatcgcaaacgactgccaggaccagcgcaatggataccggcagcagccagccaaggctctgatcggcgagcggaagcttggcgaagacgtccggcacccacccgttcagcttggccgcccccagcccgtcgacgatgccgaagagcagcgcgacgatcatcaccggcacgaacacccgcggggccgacacccagagccggtcgaacaggctcagggcgatcagcacgatggcgagcggatagagtcccaccagaaccggtaccgaaaggctgatcaactgggtcagtccctggttggcgaccagcaggctgaacagcgagaacacgatcaccaccgtcttgtacgaaaccggcagcaggtcgctgaagaactcgccgcacgccgtgatcagccctaccgccgtggtcaggcaggccagggtgatgaccaccgccagcaacaggctgccggaaacgccaaaggtctgctgcacataggcggtgaggatctgtacgccattctgggcgtcgccggcgatgccctggctggtggcgcccagatagaacagcgccaggtagaccagggacaggccggtggcggcgatgaccccggcgatcatggaatagcgcgtgaccagccggctgtcgctgatgccgcggtcgcgaatggcggtggcgatgacgataccgaagaccagcgcaccgagggtatccatggtcaggtagcccctgcaggaagccctgcaccaggggcgcgctctggtactcgccggaactgctgccgatctctcccgccggcgcgaagatcgccgcgccgccaaggaccagcagggccgacagcagcaccggcgtga

SEQ ID NO: 9364 - DNA, 711 bp, Pseudomonas aeruginosa
atgaagccacgctcgtccagggtcacgccgctgtcggcggccagcaggtcggtggtcaccgggcgacggccgaccgcgacgatcagcttgtcgaaggtttccttctgctcgccgttggcgtcggtgaaggtcacggtgacctgcttcttcttcacttccgaagcggtcacgcgggcacccaggcgaatgttcaggccttgcttggtcaggaccttcagggcttccttggcaatctgctcgtcggcagccgggaggaacttgtccagggcttccagcacggtcacctcggcacccaggcgggcccataccgaacccagctccaggccgatgacgccggcgccgatcacacccagcttcttcggtagggcctggaattccagggcgccggtggagtcgacgatgatgtcgtcggtcagcggggccggcgggatctccaccgggcgggagccggaagcgatgatcacgttctcggcttccaggacctgggtcttgccgtccagaccggtcacttccacctgcttgttggccagcagcttgccgtggccttcgaaggaggtcacgccgttggccttgaacagggtagcgatgccgccggtcaggttcttgacgatgttggccttgcgcgcaaccatcgccggaacgtcgatggtgacgcccttggcttcgataccatggactttgaaggcctctttggcctcatggtacttgtag

SEQ ID NO: 9365 - DNA, 444 bp, Pseudomonas aeruginosa
aggtggtcagcatggccatggcggactgcgcctcgaccaggcgctcggcgaccttggcccgcaggcgggtcatcggcacgcgcttctcgacacggtcgccggcggcgaagatcggcgcctcggcagccggggcggcaggcttggccggggcggccggggcgttcttcttcgcttcgaccgcagcgaccacgtcttccttggtcacgcgaccgcccttgccggtgccggcgatgctgttcggatcgatgccggcttcctcggccagcttgcgcgcggccggggacaggatggcgtcgtcgccgccagcggcggccggagcggcggcctgtgcagccggagcggcggcgggcgcagcggcagccggagcggccggagcggcggcgccgccttcgttcagcttgccgagcagctcgttgctcagaacggtgtcgccttcgttcttga

SEQ ID NO: 9366 - DNA, 495 bp, Pseudomonas aeruginosa
ggttcttgtacggagccagaacttccgccaggtcgtcttccgggaacggatacagctgctcgatacggacgatcgcggtatcttcgcggccttccgcgcgacgcttctccagcaggtcgtagtacaccttgccgctgcacagcacgacgcggtcgaccttcttcggatccaggctgtcgatttccgggatcacggtctggaaggaaccgttggccagatcttccagggtcgagatggcgagcttgtgacgcagcagggacttcggcgtcatcaccaccagcggcttgcgcagcgggcggatcacctgacggcggagcatgtggtagacctgagccggggtggtcggcacgcagacctggatgttctgctcggcacagagctgcaggtagcgctccaggcgcgcggaggagtgctccgggccctgcccctcatagccgtgcggcagcagcatggtcaggccgcagagtcggccccatttgctttcgccactggtga

SEQ ID NO: 9367 - DNA, 315 bp, Pseudomonas aeruginosa
ccacctgggcgccgttggcgaagtcgccgaactgggcttcccagatcaccagcgagttcggcgtggtggtggcgaaaccgtattcgaacgccagcacggcctcttccgaaaggaaggaatcgtagatatccaggcgcggctggccgtcgaacagattggccagcggtacgtagaccgagtcgtccttctggttgtgcagcaccgcgtgacggtgcgagaaggtgccacggccgacgtcctggccggtcatccgtaccggatggccttcgaacagcagggtcgcgtaggccagggtctcggcgaagccccagttga

SEQ ID NO: 9368 - DNA, 420 bp, Pseudomonas aeruginosa
tcaccaggtggatggtgccaccgcgtcttgtatgcgcgggtctgcgacatctggaaggtttccatgaccacgccctgccccgcgaaggcggcatcgccgtggatggaaatcggtaccaccttgtcgccggagctgtccttgcggcggtcctggcgagcacgaacggaaccctcgaccaccggggaaacgatttccaggtgggacgggttgaacgccagcgccaggtggacttcgccaccgctggtcatcacgttcgaggagaagccctggtggtacttcacgtcaccggagcccagctcgacgatcttcttgccttcgaactcgtcgaacaggtcgcgcgggttcttgcccagggtgttgaccaggacgttcaggcgaccgcggtgggccatgccgatgacgatttccttggcgccgtag

SEQ ID NO: 9369 - DNA, 933 bp, Pseudomonas aeruginosa
aggctccgaagtcctcaggcagcgacatcggtatggccactacagatcccgcagatagtccgggtaccagcccggatgcccctgctggtcatatttttcaaatctgggccatggctttgtgagcttggcccgcttagttgctgcgacgccggaagaactccggcgccacaggtgttgctaggtacaactcatataacaactgcgagaggatcaggttccgctctgcagcagcatattacgcacgtggccgatcgccttggtcgggttcagacccttcgggcaaacgttcacgcagttcatgattccgcggcagcggaacacactgaatgggtcgtccagcgaagccaggcgctcttcggtcttggtgtcacggctgtcggccaggaaacgataggcttgcagcagtgcggccggaccgaggaacttgtcggggttccaccagaaggacgggcaggaggtcgagcagcaggcgcacaggatgcactcgtacagaccgtccagcttctcgcgctcttccggggtctgcagacgctcgatggccggggccggcgtatcgttctgcaggaacggcttcaccttctcgtattgcttgtagaagatgctcatgtccacgaccaggtcacgaatgaccggcaggcccggcagcggacggatcaccagcttgccgcccttcaggccggcggccgacagcggggtgatgcaggccaggccgttcttgccgttgatgttcatgccatcggagccgcagacgccttcacggcaggaacgacggtaggagaagccctcgtcctgttccttgatcagcgccagcacgtcgaggaccatcacgtccttgccgttggtgtcgacctggaaatcctgcatgtacggcgcagcatctttgtcggggttgtaacgataaacactcacttgcaacatggcgggcacccttag

SEQ ID NO: 9370 - DNA, 345 bp, Pseudomonas aeruginosa
ttctgcatgcagctttgcagctcgcgcttgagcggagcgacttcttcgccgctggtgcgctcgttcacgccgttcaggcgcttgaaggaggcttccaggtcgctctcggaagcgccgcgggcgtcgatgccctctttcagcgctttttccaggtgcagaccggcggcacggccgaataccaccaggtcgagcagcgagttgccgcccaggcggttggcgccgtgtaccgatacgcaggccacttcgcccacggcgaacaggccttcgacgatctggtcgttgccgttggcgtcctgggtgatggcctggccatggatgttggtggcaacgccgcccatcatgtag

SEQ ID NO: 9371 - DNA, 867 bp, Pseudomonas aeruginosa
cgacctgaactacgcggaaaacttcctgcacatgatgttcaacaccccctgcgagaccaagccgatcagccccgtgctggccaaggccatggaccgcatcttcattctccacgccgaccacgagcagaacgcctccacctccacggtgcgtctggccggctcctccggcgccaatccgttcgcctgcatcgcctccggcatcgccgccctgtggggaccggcccatggcggcgcgaacgaagcggtgctgcgcatgctcgacgagatcggcgacgtgtccaacatcgacaagttcgtcgagaaggccaaggacaagaacgatccgttcaagctgatgggcttcggccatcgtgtctacaagaacttcgacccgcgcgccaaggtcatgaagcagacctgcgacgaggtcctccaggagctgggcatcaacgacccgcaactggaactggcgatgaagctagaagaaatcgcccgccacgacccctacttcgtggaacgcaacctgtacccgaacgtcgacttctactcggggatcatcctcaaggcgatcggcattccgaccagcatgttcaccgtgatcttcgccctggcgcgtaccgtcggctggatctcgcactggcaggaaatgctctccggcccctacaagatcggccgcccgcgccagctctataccggccacacccagcgcgacttcaccgccctcaaggatcgcggctgaaacccgtcacgtccggcgagaaaggctgcttcggcagccttttttgtgcccgcccctttccgccggacacaaaaaaaccgccccggaggcggtctttttgcagggaaggcgcgctcagcgcttctcggcagcgctacgcaggcccttga

SEQ ID NO: 9372 - DNA, 771 bp, Pseudomonas aeruginosa
ttttcgtccaggtgcaggcagcgtacgcccgcgggcttgccggccggcatgcccggcagcggagaggaaatcgacggtgctatgcagcaggcgccgcagccggctctacattgcatgggaaggatctcgcccgaaagttggcagaggagcggccaggacagccgtccgaaacgggcgcaaagaatacggaccggccaggccgccgccaagcccggcggatcagcggcgcgtttccgcctcgagacgcgcgctgcgaagctgccactgctcgcggttgccggcagcgaacagccaggccctggccgactccgtcgctgcccgccattgcacgcggcccggctcgcgcaggtcgagggattgcgccgccgtcgagtggccgaggaaggcgttgccagcggaactccagtagccggcgaccccggccggcaagacccaggagcgaccttccacctcgtcatcgacgataccggacaagcgctcccccgctccacgccgccaggacagggcgacccggttcagctcgctgtccgccagcgcgacgcgcacctccatgccgccctggcgcggctcgaacgacagctcgtaggcgctgagccggccatcggcgcagcgcaggtgccccttcagggacaagcgtcgaccgaccagttcgaagctctccaggctctgctcctggcagcgcaactgcaggcgaccggcgctttcccgcccggccccgagaaaaccgccctcgctctcccacaacggcggccgagcgctacccgccactga

SEQ ID NO: 9373 - DNA, 486 bp, Pseudomonas aeruginosa
ccgcgcctgcctggccgccggagaccggcgcgtcgagaaagcccagctcacgctcggcagccagcagcgacagctcgcgggcgacttccgccgaagcggtggtgtggtcgacgaacaggctgcccggcgccattccggcgaaggcgccctgctcgcccagcgccacggcacgcaggtcgtcgtcgttaccgacgcaacagaacaccagctcggcgccagcacaggcctcgcgcggcgtatcggcgcgccgtccggcgtactcctcgacccagcgcagcgccttggccgacgagcgattgtagacacagacgtcgtagccctctcgttgcaggtgcccggccatcgggtagcccatcgtgcccaggccgagaaatgcgaccgcagtcattccgtcatctcctcgaaatccgatcccgcagcctagcacagcggtttgccgaggtccggaagccccgccatactcagcgcggaccctggtatggatag

SEQ ID NO: 9374 - DNA, 462 bp, Pseudomonas aeruginosa
gtttccagggccagcagcaccgcgccctggaggatgcccgcaataccgcacggctgctgccgctggtattgccggtggagcattgaacgaggcccgcgccgcctagtgacgcctttccgaggcttgggcatactggcgggccttttcaaacccgcctgttcaccccttcaggagaagcccatgttcaaggtcaacgaatacttcgacggcaccgtcaaatccatcgccttcgacatgaccgccggcccggccaccatcggcgtgatggcggcaggcgaatacgagttcggcaccagccagctggagatcatgcatgtggtcgccggcgcgctgacggtcaagctgccgggcagcgacgagtggcaggaatacgccagcggcagccagttcaccgtcccggcgaacagcaagttccagctcaaggtcgcccaggacaccgcctacctctgcgaatatcgctga

SEQ ID NO: 9375 - DNA, 1218 bp, Pseudomonas aeruginosa
cgaaggcttgcagcagcgccggccgccacaaggcggcgaggctggtggacgcgttgtggcgacgttcgagcgatttgtgcaaggcgttcttggacgcctgagtctgagcgttcatgtgcgattccttcagaagccgaggctcagttgttcagcgatcgggccgagggccagggtcggcaggaaagtcaggccgccgaccagcaggatggtcacggtgagcaggctgacgaacagcggaccatgggtcgggaaactgttcggccccaccgggctggccttcttcgccgccaggctgccggcgatggcgaggatcggcaggatgtatccgaagcggccgatgagcatggccaggccgatcatcaggttgtggaatggcgtgttggcaccgaaaccggcaaacgccgagccgttgttggcgctccccgaggtgtaggcgtagagcagttggctgaatccgtgcgggccgggattggtcaccgccgaggccggccccggcaggctggcggcgatggcgccgagcaccaacacgccgacaggcatcaccagcagggtgaataccagcaggcggacctccttcgcctcgagcttcttgcccaggtactccggcgtcctcccgaccatcaggccggcgaggaacaccgcgatcaggacgaacagcagcatgccgtagaggccggcgccgacgccgccgaagatcacctcgccgagcatcatgttcagcagcggcagcatgccgcccagggggctcaggctgtcgtgcatggcgttcaccgagccgttcgaggcggcggtggtggtgatcgcccagagcatgctggcggcggtgccgaagcgactctccttgccctccatcggcgcgccctgctcgatcggcaactgcgccagcgccggattcggctggtattcggcccacagcgacaagcccaggccgaggcagaacagcagcagcatgcagccgaggatcgcgcggctctggcgcaggtccttcacgtaatggccgaaggtgaataccagcgccgccgggatcaggatgatcgaggccacttcgaacaggttgctccaggcgctcgggttctcgaacggatgggtcgagttgacgccgaagaagccgccgccattggtgcccagctgcttgatggcgatctggctggccgccgggccgagcgggatggtctgctcggcgccttgcaaggtggtggcatggacatagtcgaataa

SEQ ID NO: 9376 - DNA, 741 bp, Pseudomonas aeruginosa
ggtctgcggcacgccctgccagaccagcagcaacgccagcagcaggcacagcggcagcagcacgtagagggtgccgcgggtcaggtcgacccagaagttgcccagctgccgcgtggagcggcggctgatgccgcgcgccagggccaccagcacgcagaggccgaccgccgcgctgacgaagttctgcaccgtgaggccgaccatctggctgaagtagctcagcgaggcctcgccgctgtaggcctgccagttggtgttggtgacgaaactgaccgcggtgttgaacgccagtgtccattccaggcccggcaggtgctgcgggttcagcggcaggctgccctgcagcatgaggatcgaaaacagcaggaccaggccggccaggttgaatgccagcagcgccagggtgtaggtcttccagtcctgctcgctcgccggatcgacgccgaacaggcgatagcagacgcgctccagtggcgccagcggcgcgctgaggagattgcgttggccttccatcaccttgaagcagtagcgcccgaggaacggtgcaggcaccaggaccagggcgaaaaaggccaggatcaagagaatctcgtggctgttcatgtgccctcccctaggcacggtcggcgcgtagcagcgccaccagcaaatagacgaacagtcccgtggccagggccagggacaaccaatccagaacggtcatgtgtgcgatctctccttcgagcggcctctgccgcttga

SEQ ID NO: 9377 - DNA, 849 bp, Pseudomonas aeruginosa
ttattttcgataaatcatgaaactatatttcgcatagcgaaatatcaattcatcggagcttccatgtccgccgatccttcgcccgtggtcctgctcgaatttcccgcagccgatatagccctgcttcgcctcaatcgtccgcaagccaggaacgcgctgaacgacgaagtgcgccagcgcctcgccagccacttccagacgctcggcgcggatccggcgatccgcgtcatcgtgctcaccggcgactcgcgctgctttgcagctggcgccgatctccgcgatctctcgacgagcacggcgatcggcctgtacggccgccacggcgagcgctactgggaagccatcgcgcgctgcccgaagccggtgatcgccgcggtcaacggcttcgccctgggcggcggctgcgaactggcgatgcactgcgacctgatcgtcgccggcgagtcggcacagttcgcccagccggagatcaaggtcggggtgatgccgggtgccggcggcacccagcgcctggtacgggcggtgggcaagttccaggcgctgcgcatgctgttcaccggctgcctggtgaaggctccgcaagcgctggccatgggcctggtcagcgaagtggtggcggacgagtcgacgctggcgcgcgccctggaactggccatggagatcgcccgcctgccccctctggcgctggcgcagatcaaggaggtggtcctggccggtgccgacctgccgctggacagtgccctggccctggaacgcaaggcgttccagttgctgttcgactcgcaggaccagaaggaaggcatgcaggccttcctggagaaacgcccgccgaactaccaggggaaatag

SEQ ID NO: 9378 - DNA, 1533 bp, Pseudomonas aeruginosa
acgatgcccgatattcgttgtatcgccgtggtcggtaccggtgcgatgggcaccgggatcgcccagatcgccgcccaggccggcctgaccgtatggctgttcgacagccgcgccgaggccgccgccgaggcacgccagcgcctgcggcagaccttcgagagcctgtgcggcaaaggcaagctgagcgccgccgacgccgaggccgcgcaaaaccggctgcgggtggcggaacgcctggaacaactgggcgactgcgaactggtggtggaggccatcgtcgagcgcctggaggccaagcaggaattgctgcgccggctggaagccatagtcgcgccggagaccatcctcgccagcaatacctcgtcgctgtcgatcaccgccatcgccgccgcctgcgagcggccgcagcgggtcgccggctttcacttcttcaacccggtgccgctgatgcgcgtggtcgaggtggtcgacggcctggccagcgctccggaagtcggcgacgccctgctcgccctcgccgcgcgcctgggccaccgcggcgtacggaccaaggacagccccggcttcatcgtcaaccatgccggccgcgcctatggcaccgaggccctgcgcatcctcggcgaaggcgtcgccgaatgcgccgagatcgaccgtgtgctgcgcgagtgcgccggcttccgcatggggccgttcgaactgctcgatcttaccggcctcgacgtgtcgcacccggtaatggaatcgatctaccagcagtactaccaggaaccgcgctaccgcccgcacccgctgacccgccagttgctcgccgccggccgtctcgggcgcaagagcggccagggcttctatcgctacgtcgacggccagccgcaggacaagcccggtccgcaaccggtgccgcaggccgccatccggcccccggtgtggctgggctgcgaaaacgaggacgaccgccgcacgctcgccgaactgctgcatcgcctcggcgtcgagccggaaaccggcgaacgcccttccgccgcagcgctctgcctgctggccgcctggggcgaggacctgagcagcgccgtgcagcgcttcgcctgtcccgccgagcgcagcgtcggcatcgacctgctctgcgacctcgagcgccggcgctgcctgatgctctcgccactgactaccccggccatgcgcgacgccgcccacgcgctactggctggcgacggcgtcggggtcacggtgctgcgcgacagtcccggcttcgtcgtccagcgggtactggcgatgatcgtcaacctcgcctgcgacatcgcccagcagggcattgccagcgtcgaggatatcgaccaggcggtgcacctcggcctcggctatccccacggcccgctggaatggggcgaccgcctcggcccgcggcgcctgctgagcattctccagcgcttgcagacgcttaccggtgacccgcgctaccggcccagtccctggctgcgccgacgagcgcaactgggcatgtccctgcgcgccggcgaaaccgccgccgtaggctga

SEQ ID NO: 9379 - DNA, 435 bp, Pseudomonas aeruginosa
aagaacgccacgccctgttggtcgatggagtcccaccagccgatcaggcggtcgccgatcagcggtacgccggccatccacgaaggcggcggcggcaggccctcgacctggagattcttcagcagctccatcagcgagcgaacgttgtccgccaggccgaagccgagccagatcagcggcaatgccaccaggacgatccagcccagggtcagcaggcccgccgccagcgactcgcggccaccgagcaggcgcgtgagcatgcgcatcagcggccaactggcgaaagccagcaccgcggcccagaacagcgccgaccagaatggcgccagcacccagagactggcaccgagcagaccgaacagcagcacgcgaagcaacagccgatcgttatcgaacatcaaggcaggccttcctcaaagggggatacaccgatag

SEQ ID NO: 9380 - DNA, 1695 bp, Pseudomonas aeruginosa
cccggcgagcaccttgcgaccgacgatgcggccgaggatcggcagcttcagcaggcggtcgagcttctgcgccggcatcttcgaatacacccccatctggaacttggtccagatgcgcggcacgccgaacagcagggtcggccgcgcacgcttcatgtcctcgacgaaggtgtccaggctttcggcgaagaacaccgtggttcccccgtagagcgaccccatctcgacgaacatccgttccgccacgtggcacagcggcaggtaggagagcatccggtcgtcttcgcgggtgccgaacagttccacgccgcggctggcggcgaaggcgaaactgctgaagttgtgcatcacccccttgggcacgccggtggttccggaggtgtagatcagggtggcgagttgctcggcggcggtcggcgtgtcgccttcgagcggcgcgcaggcatgcaggtcgatccactggcggtcgaaacgcccttccgggtgcaacggcatggccacggtcggtatgccctcggggactccgggcgccatcgccggccagtcgtcgagcttgccgacgaagaccaccgccgactcggaatgctccagcacctggcgcgccgactcggcggtgagattgggatagagggggacggaaacgtgcccggccatccagatcgccaggtcagtgacgatccagtgcgcacagttcttcgagatgatcgcgatacggctgccggcggggagatccaggctgcgcaaccaggcggctgcacgccgcgcctggtcgcccacctcgccccagctcagctcctcgacccggccgccaccgatgggctgcaccaggtaacgccgttgcggatgacgcttttcgcgctcgaagaagacttcgagcggcagacgatttgcagtgaccacgtaccgcctccgttgttgttgttctgggagatcgaccaagcacttgcttggtcgaatattccatcacagccaaccgcaggcaagccgggaaatgtttcggtttgtagtcgttgtgccaggcgcttcctagccgtgccgcgggtgatgcagcgagaccagggtcatcagcccggcggcggcgaagtcgccttccagctcggccagcgaggcagtgctcatcggcaacggatcgcgccggttgccatgcaccagcagaccgcccagcgccccgaccaggggctggtggctgaccagcaggagattgcgctcgctgcgctcgtcgaggaaaccgagcacctcgcgcggatcgtcgtcgggggtcaaccagggcgcggtgccgaccggctcgaccaggcccagtgcctcgcgcaccagctcggcggtctgctgggcgcgcacgtaggggctggcgagaatcccgtccagcggcaacccggccagccgcgcggcgctctgcagcacctccttgcgtccatgggcggtcaggcgccgctcggaatcccggctggcgtgcggttcggcctcgccgtggcgcaacagccagagtttcacaacttcggctcttcgtcgcgcgccgggtgcgcggcgggcggcacgctgtgggcggcctcgccctcggcggcgcgggcgctcggccagtcggcgaacggccagggtttctcgtcgctgtggaaggtaccgaaacggccgatctgcgccaggtactggctgaggctgtcgccgaaagccatcaggctgccgttcggcgcgccgtag

SEQ ID NO: 9381 - DNA, 3417 bp, Pseudomonas aeruginosa
accagttggatcaccaccaccgccccgaggagcagttcggcgacctgccagaccaggacgaacagcagcatccagaggatgcggatggcgatcgattcgcgtgcttgcgggtctgcggacatggcggtctcctcgtcagaagccggtggtgggaatgaaatcgacgtcggtcttcggctcgccgcgcatcagcagctggatgacctgcgccagggtgcggccttcgaagaggatcgcatggagaccggcgaccagcggcatgtacacctgcatctcgtcggacttttccttgagtaccttgagagtgttcacaccctccgcggtctcgcccatgcgcgataccgcctcctccaggctgagcccctcgccgagggcgtggccgacctggtagttgcggctcttcggcgaggaacaggtgacgatcaggtcgccgacgccggcgaggccgagaaaggtcatcgggttggcaccgagcttgacggcgaaccgggtcatttccgccagcgcgcgggtaatcagcatgctgcgggtgttctcgcccatgtccatcgccgcggccaggccggccatgatcgcgtagacgttcttcagcgcaccgccgagttccactccgaagcggtcgcggctggcgtagacgcggaaggtgcggccgtgcagggccgcctggacgcgggcgcacagctcgtcgtcctcgctggcgaccaccgtggcggtcagctcgtgctctgcgatctcgcgcgccaggttcgggccggaaatcaccccgatgcgggcttgcggggcgatttcctcgaggatctcactcatcagcttgaaggtgtgcgcctcgatgcccttggtcaggctcaccagcagcttgtccgtcaatgccgcctggtgtggttgcagcaccttgcgcagggcgctggagggcaaggcgacgaagatcagttggcaatcggccagggtgcgctccaggtcggtgaccggctcgaccccgggatgcaccttgacccctttcaggtagcgcgggttctcgcgtcggctgcggatcgcctcggcctgctccgggtcgcgcatccactggcggaccgcctggccgttctcggccagcaggttggcgatggcggtgccgaaactgccgccgccgagcacggcaatcggttgctgctctgtcatgattcatccatttctggccgccacgcggcaatcacgccattatacggtcggccagccggccgaccagtcttgacgccggcgctggcaaaagcccgcgcctcgtttaccatgcccgggccagacaatacctatcgagaacaaggtcgttccgtgcccatcgcttcacgtgctcccgcctccctgaccctgctggccctgctgttcggcggcaagctcgcggccgccgacctgttcaacgatcccagcggcgttcccgaagtattgaccgcgacacgcctgaaacaatccccggcggaagttcccggcagcatcagcgtgctcgaccgcgagctgatcgtcgccagcggcgcccgcgacattcccgaactgatgcgcctggtcccgggcatgatggtcggctacctgtccggcaaccagcccacggtcaactaccacggcaccagcatgtcgggggcgcggcgcctgcaggtgctgatcgacggccgctcggtgtaccgcccgggccttgccagcgtcgactggagcgacctgccgctggccctcgaggatgtcgagcggatcgaagtgttccgtgggccgaataccgtcagctacggcgccaacgcattgatgggggtgatcaacatcatcacccgcgcccccggcgagtcgcccggcacgcgcctgaagtacacggcgggccagcgcggcatccgcgactggtacgccagccagagcatcgccctggaagacagcgacttccgcctgtcgctgtccggccaggaagacgacggcttcgaccgcgaccacgacggtcacgccctgcgcgacggccgccggctcagccgcttcaacctcaacgccagccacagcctggcgccgaaccagagcctggagtggcaactggcggccaaggaaggctcgaaccagcacccctacgcctaccgctcgccgtttccccaggttcccgacgacatcgacaactccgatacgctcgcccacgactatgccggttcgctgcgctggaatgtcgacctcgacccgcgccacagcttctatatacaaggctacgcacagcactgggagcgccggcaggaatggaacgcctgcgaggcggccattgccttcagcccgcaactggcgcagctctgggaactgaacccggactacctgcgcaggttcgccgacgatccgacccggctgccgcccggcagcgcccaggagttgcaactggcgacccaggtcctcgaccagctacgcaacggcggactgcgcccggtctgcggacgggtcgaccgcaacatccgggaaagccgctacgacctggagatgcaggacaccctcagcctgggcgacaacctgcgcctgctgaacggcctgagctaccgctacgaccaggcaaactccgagaccttctacggcggcagggtcagcagccagatctggcggctgttcagccaattggagtggcatgccggcgaacactggctgctgcagggcggggggatgctcgaagacgtcgagggctccggcagttcgttcagcccgcggctggcggtgaactacctgttcaacccccagcacagcctgcgcgcggtctattcggaggcagtgcggtcaccgggcatgtacgaaaacgacgtcgactggcgctaccgggtccgccacctgacaccggcgccctatgggcagagcgaagcctactacttcgccagcgcccacggccccggcgacctgggcaaggaacacacccgttcgcgcgagatcggctacaacggttttttccgcgagaccgggctggccgtggatgtacgcctgttctacgaggaaatcaccggactgatcagcgatccgctcagcgtcgtcgacttcagtccggacaacggcgatcgcatccgcttctccggcgcggaaggccagctcgactggcgcctgggcctacgcgaccgcctgcgcgccacctacgcctatctcgactacgacgccaccagtcgctacgaccggcgcctgaccgcccgccacggcggctcggccggctggatgcacgactggggccaaggctggtccagcgccctcttctattatggcgacgactcgctcaatggacatcgtttcgaacgcgtcgacctgcgcctggccaagcgcattcccctgggcaaggccgccctggaactggccggcgtgctccagcagcgtctcgacgacgaaccgctgacgtttcccgacaaccgctacgacagccgccacctgctctacttcagcgccgaggtgacgttctag

SEQ ID NO: 9382 - DNA, 930 bp, Pseudomonas aeruginosa
atgcgtcgcttgcgccccgcccgccgggctttccaggcgctgctcgcgctcgtcttctgctgtctcccgcatgtcggcgaggccgcgcaactggtcttggtcagcgccaaccagggggccgcggtgaacgcctttcgcgatgccctggcgcagcgacggccgcaggaccaggtggaactgcgcacgcccgcggccctggcggaggggatggtcttcgccgacgacacccgcctgctcctgctcggccccgaggccctggcctggcgcctgcgccagcaccgggcgccgccgaccctggcgctgctgctcaaccgggtcgatggccagcgcctgctgccaggcgccaacggacatggcggacacggcgtcggaggtctctgcgtactctggagcgacccgccggcgtcccgccagctccgcctggcgcgcctgatcctgccgggcatccagcgcatcggcgtgctctacggcaaggacagcgaattcctcctcgacgagcttcgccgcgaggcccgcagccaggggctccagctgttcgtcgccagcagcagcggcaacgacgacccgcgcccgctgcagttcctgctcggcaatagtgacctgctgctcggcatcgacgacaaacagctgtacaactcgcagagcatcaagagcctgctgctcggcagctacgccaagaaccgcgcgctgctcggccccaccgcagccttcgtcaaggccggcagcctggcgagcagctacagcgaccaggaggattggctggacaccctcgacgaattgctcggccaggcgcccaggcactggcccctcagcctctatccagggcatttcaaggtgctcggcaatcggcaggtagcccgttccctgggtatcgacctggccagcgacgccgacctcggccggcgcctcgccgaaggagaagaaccatga

SEQ ID NO: 9383 - DNA, 1239 bp, Pseudomonas aeruginosa
cagcttctaagggttatccgcatgcgtcgcgtcgttatcaccggtctgggcatcgtttcctgcctcggcaatgacaaagacaccgtttccgccaacctccgtgcgggtcggcccggcattcgcttcaatccgtcctacgccgagatgggcctgcgcagccacgtttccggttcggtcgacctgaacctcgaagagctgatcgatcgcaaggtcttccgcttcatgggcgatgccgccgcctacgcctacctggcgatggagcaggcgatcaaggactccggcctgactccggaacagatttccaacccccgcaccggcctgatcgccggctccggcggcgcttccaccctgaaccagatggaagccatcgacaccctgcgcgagaaaggcgtcaagcgcatcggcccataccgcgtgacccgcaccatgggcagcaccgtatcggcctgcctggccacaccgttccagatcaagggcgtcaactactcgatctcctccgcctgcgccaccagcgcccattgcatcggccaggccatggaacagatccagttgggcaagcaggacgtggtcttcgccggcggcggcgaagaggaacactggagccagagctgcctgttcgacgccatgggcgccctctccacccagtacaacgacacgccggaaaaggcctcccgcgcctacgacgccaagcgtgacggcttcgtcatcgccggcggcggcggcatggtggtggtcgaggagctggagcatgcgctcaagcgcggcgccaagatctacgccgagatcgtcggctacggcgccacctccgacggctacgacatggtcgccccgagcggcgaaggcgcgatccgctgcatgcagcaggcgctggccaccgtcgacgcgccgatcgactacctgaacacccacggcacctccaccccggtcggcgacgtcgccgagatccgaggcgtgcgcgaagtgttcggtgacaaggcgccggccatcagctcgacgaagagcctgtccggccactcgctgggcgccgccggcgtgcacgaggcgatctattgcctgctgatgatggagggcggcttcatcgccggctccgccaacatcgacgaactcgacccggaagtggccgacctaccgattctccgcgagacccgcgagaacgccaagctcgataccgtcatgagcaacagcttcggcttcggcggcaccaacgccaccctggtcctcaagcgctggcagggttga

SEQ ID NO: 9384 - DNA, 1287 bp, Pseudomonas aeruginosa
cctcaccagccgcatcgacacctctggccgcgacgaaccggccaagctgctggtcgccctccagggcatgcaggcacaactgcgccagaccatccagcagatcggcagctcggcgacccaactggcctccgccgcggaggaactcagcgccgtcaccgagcagggcaaccgctcgctgacccagcagaacgacgaaatccagatggccgccaccgcggtcaacgagatgaccgccgccgtcgaggaagtggcgcgcaacgccagctccacctcggacgcctcgtccgcctccgagcaatcggcgcagaacggacgccagcgggtactggagacggtccaggcgatccgcctgatgagcgaagaagtggacaatacctcggcgctggtcggcggcctggcggaaaaggcccaggacatttccaaggtcctcgacgtgatccgcggtatcgccgaacagaccaatctcctggcgctcaacgcggccatcgaggcggctcgcgccggcgagcagggccgcggtttcgccgtggtcgccgacgaggttcgcgccctcgcccatcgcacccaggaatccacccgcgagatcgagcagatgatcgccaacatccaggaaggcaccggcgccgcggtcggcgccatggacagcagcagcgtacgcgcccgcaacatgctggagatcgccgaagccgccggcctggcgctcaacgagatcgcggagcgggtcggccagatcaacgagcgtaccctggtgatcgccagcgcctccgagcagcaggcccaggtggcccgcgaggtcgaccgcaacctggtgaacatccgcgacatctcgctgcagacgtccgccggctccaaccagaccgccgccgccagccaggaactgtcgcaactggccatcgacctgaacaacatggtcacccgcttcgtcgtctgaccatgccgtgcgccgtctcacggcggcgcacttcctccggttgcccagcgtggagcccgggttttaccatgaaacccgatcctctccccctccggagccgcccagatggtcaagcgcaccagccacaagcaagccagttgtccagtcgcccgcccgctggacgtgatcggcgacggctggtcgatgctcatcgtgcgcgatgccttcgaaggactgacgcgcttcggcgaattccagaagagcctcggcctggccaagaacatcctggcggcgcgcctgcgcaacctggtggagcacggcgtgatggtggcggtcccggccgaaagcggcagtcaccaggaataccgtctgactga

SEQ ID NO: 9385 - DNA, 729 bp, Pseudomonas aeruginosa
accgctgccgctcggccagggttcgccgctccgctggctggccctgctgttcggcctgctggcctggcatgccggggctggcgaacgggtgatctatccgcgccactccgaagggcgcaaccccgaaccctacgtcgtcgagctgctgcaactggcgctggccaggagcggcggcgactaccgcctggagcccagcgcgcagcccatgccgcagtcccgtgcgcaactgcgcctggagcaggacgatccgggcctgcaggtgatgtgggcgcagtcccgcgacgacctggaagagaccctgctgccgatccgcattccgatctatcgcggcctgatcggctggcgcatccccctggtcagcgccgccaacaaggatctcctggcctcggcgcggaccctcgacgatctccgccgcctgcgcttcggccagcgccaggactgggccgacacaccgatcctgcgcgccaacggcctggaggtgaagaccagccagaactacgagagcctgttccgcatgctcgatgccggccgcttcgaggtcttcccccgcgaggtcgtagtgatcgacggagaactggaggacgcctcccgcgccgggctgcacctggcgatcgaccagcacgtggccctgcactaccccgcggccttctatttcttcgtttcgcgtcaacgcccggaactggccgaggccattcgccagggcctggagaaggcgattgccgacggtag

SEQ ID NO: 9386 - DNA, 456 bp, Pseudomonas aeruginosa
aatgaagccctcacgccaccaccgatgtccagcatgtcccgtaacgccccgtaccgcctcgacgaccagatcggcttcatcctgcgccaagccaaccagcgctatgcggcgttgttcgccaatggcatcggcaacggcctgacccccacccagtgggccgccctggtccgcctcggcgagaccggaccctgcccgcagaaccagctcggccgactcaccgccatggacgccgcgaccatcaagggcgtcgtcgaacgcctggacaaacggggactgatccagcgcagcgccgatccggacgacggccggcgcctgctggtcagcctcagtcctgccggacgcgccgaactcgaggccggcctggcggccgcccgcgagatcaaccggcaggccttggcccccctctccccgcaagaacaggaaaccctgcgcgggttgctcgctcgcctgacctga

SEQ ID NO: 9387 - DNA, 1614 bp, Pseudomonas aeruginosa
aggagcatcaggaggagcacccggcatgagcctggccaatccctcgcgacgcggcttcctcaaggccggcggcctgctgctggtcaccgtcaacctgcccgccccgctgctcgcccttgccgagcagggcgccaccgacctgccgctggaccaggtcgactcgttcatcgccattgccgcggacggcaaggtcaccgccttctgcggccacgtcgaccttggtaccggcatccgcacggcactggcgcagatcgtcgccgaagagttggacgtcgcgttcgagcaggtcgagatgatcctcggcgacacccgtcgcacaccggaccaggggccgaccatcgccagcgccagcatccaggtcagcgccgtgccgctgcgccaggccgccgccgaagcccggcgcttcctcctgcgccaggccggaagccatttcccggtgcatccggacagcctgcgcagcgaaaacggccaggtcttcgccgccgccaatccgcagcgacggatcggctacggcgagttgctgcgaggccagcgcttcaacctgaacatcgacggcaaggcgccgctcaagccgcgcagcgagtaccgtctggtcggcaagccggtgcgtcgggtggacatcccggcgaagctgaccggtcaactgacctatgtccacgacatgcgcttgcccggcatgctgcatggacgagtggtacgcccgccctataccggcgcggatgtcagcgccccgctcggcagcggcctgctggcggtggacgaaagctcggtcgccgggctgccggggctggtcaaggtggtcgtgatcggcgacttcgtcggcgtggtctgcgaacgcgaggagcaggcgatccgcgccgcgcgccagctcaaggtgcgctggaaggactggcagggcctgccgccgctggaacccgaccggctcgaggacacgcttcgccggcatccgaagaagccacgcacgctgcacgactcacccggtctcgagcagcacctcgcgggcatcgcccggccgctgtcggccacctatgtctggccctaccagttgcacgcctccatcggcccttcctgcgccctcgccgaggtcgatgcgcagcgcgctcgcgtctggtccggcacgcagaacccgcacgacctgcgcaacgacctggccaggctgctgcagcgcgagaccggggacatcgaggtgattcgcatggaagccgccggctgctacggacgcaacggcgccgacgacgtcagcgccgacgccgtgctcctggcgcaggcagtgggccggccggtgcgggtacaactgatgcgcgaacaggaacatggctgggaaccgaaaggcaccgcgcaactgatcgaggtccgcggcggtctcgacgagcaaggccgggtggcggcctacgacttcgccacctgctacccctccaacggcgcgccgaccctggccctgctcctcaccgggcggatcccggccaccccgcaggtggccgacatgggcgaccgcaccgcgatcccgcaataccgctacccgcggatgcgggtggtggccaacgacgccgcccctatcgtccgcgcgtcctggatgcgcggcgtctcggcgctgccgaacgtgttcgcccatga

SEQ ID NO: 9388 - DNA, 405 bp, Pseudomonas aeruginosa
agaaggcaacacgcatcggcctctgggcctccggcagcctcgtcgcgctcgccgccatcgccctcggctacgcctggcaaccggccatcgggccactggaaggcacacccggtcccttcagcgccgagcagatcgcccgcggcgaacgcctcgccgccctcggcgactgcgcggtctgccacactcgcgaaggcggcccgcgcaacgccggcggacgggccttgccgacgccgttcgggacgatctacagcagcaacctcacgccggatcgcgcgagcggcatcggtggctggtcctaccccgccttcgagcgggccatgcggcatggcgtggcccgcgacggcagctacctgtatccggcgttcccttacaccgccttcaccaggactcgcgacgaagacctga

SEQ ID NO: 9389 - DNA, 534 bp, Pseudomonas aeruginosa
acagcaatgtgcatgcggacagcccggacaacctgctgcggatcatcctcgacggcatccacagcccggccaccggcgacctcggctatatgcccggcttccgccatagcctccacgaccggcaagtcgccgccctggccaactacctgcgcgagcgtttcgccggcaagcccgcctggccggacctcgcggccaaggcggcaagcctgcgccgacaggcggcgccctgaagcatgcggctcagttgggcaagcgcagggagcgggcgaagcaaccgggggtctggccgaaatgacgctggaacaggctgatgaacgccgaggtggagtcgtagccaaggtcgctggccacccgcgtcacgctggcgccctcctccagcgcggcgaccgcgttgagcagacgcaggcgctggcgccactcgcgaaacgacaactgggtctgctcgcggaacaaccgcgccagggtccgtcgggacgcccccaccagtcccgcccaatccgagatgccgcgcggatcggcgggatccgcctgtag

SEQ ID NO: 9390 - DNA, 684 bp, Pseudomonas aeruginosa
tcggcgattcgctgggcatggtgctctatggcatgcccagcaccctggggagtgagcctggagatgatggtcgcccacaccctggcggtgatgcgcggcagtcggcgcgcctgcgtggtggccgacttgccgttcgccagctaccaggaatcgccccgacaggcgttccgcaacgccgcacgcctgctggccgacagcggcgcccaggcggtgaagctggaaggcggtgaggaaatggaagaaaccgtggacttcctggtacgccgtggcataccggtgctcgcccatatcggcctgatgccgcagcaggtcaacgccatgggcggcttcaaggcccaggggcgtgacccggaaagcgcagaacgggtacgccgcgacggcctcgccatgcagcgcggcggcgccttcgcggtggtcatcgaaggcgtaggcgagccgctggcccgtcgccttagcgaagaactggcgatcccctgcatcggtatcggcgcctcgccggcctgcgacggccaggtactggtcagcgaggacctgctcgggctaagcggcgaacaggtaccgcgcttcgtcgaacgctacgcgcgcctcgaccgggaaatcgacgaggcggcccggcgcttcgccgaggacgtgcgcgaacggcgcttccccgaggccaggcattgcttcgccatgcgcgagtga

SEQ ID NO: 9391 - DNA, 2022 bp, Pseudomonas aeruginosa
gcgaccggctctacacgaatctcactcatgggtactgctcctgcgagagttggaaaagacaaagcccgccgaagcgggctttgtcggggctactgcttaagcggacagctccaccagcagcttgttcagtcggcgtacgtaggcgcccggatccttgaggctgtcccccgcggccagggcggcctggtcgaagagaatatgcgacagctcgccgaagcggtcctcatccggctccgcatccagcttctcgatcagcggatgctgcgggttgatctcgaagatcggcttcgagtccggcactttctgcccgctggcctcgaggatctggcgcatctgcaggccaaggtcctgttcgccgatggcgaggatcgccggcgaatcggtcaggcggtgggaaacgcggacttcgctgacctgctcgtcgagcaccttcttcaggcgctcgatcaggccttccttgctcttggcgacttcttcctgggccttcttgtcctcttccgagtccaggctgcccaggtccaggtcgccgcgggcgacatcgacgaactgcttgccgtcgaactccggcaggtagctcatcagccactcgtcgatgcgatcggtgagcagcagcacctcgatgcccttcttgcggaagacttccaggtgcgggctgttcttcacctgcgagtagctctcgccggtgaggtagtagatcttgtcctggccttccttcatccgaccgatgtagtcggccagcgctacgctctgctcgcccgaatcgtcgccggtggaggcgaagcgcagcaggccggcgatcttctccttgttgccgaagtcttccgccgggccttccttgaggacctggccgaagttcttccagaaggtcttgtactgctccggctcgttcttcgccagcttctccagcatgtccagcacgcgcttggtcaacgccgacttcatcgagtcgatcaccggatccttctgcaggatttcccgggagacgttcagcgacaggtcgttggagtcgaccacacccttgatgaagcgcaggtacagcggcaggaactcgtcggcctggtccatgatgaacacgcgctgtacgtacagcttcaggccccgcggcgcttcgcgatggtacaggtcgaacggcgcgcggcccggcacgtagagcagcgaggtgtattccagcttgccttcgaccttgttgtggctccagctcagcgggttctcgaagtcatgggcgacgtgcttgtagaactcctggtattcctcgtccttcacctcggcgcgcggacgggtccacagcgcgctggcgcggttgaccgtttcccattccggctcggccggcttgtccgcctcttcgccgtggaattccttgggcagctcgatcggcaaagcgatgtgatcggagtatttcttgatcacgttgcgcaggcgccagccatcggcgaactcctcctcgccctttttcaggtggaggacgatgcgggtaccgcgctcgggcttgtcgatggtagcgacgtcgaactcgccctcgcccttcgacgaccagtgcaccccttcgctggccggctggccggcgcgacgggagtagacatcgaccttgtcggcgacgatgaaggcgctgtagaaaccgacgccgaactggccgatcaggtgcgaatccttcttctggtcgccagacaagttcttcaggaagtcggcggtcccggacttggcgatggtgcccaggtgagtcaccacatcctcgcggctcatgccgatgccgttgtcttccagggtgacggtgttggcttccttgtcgaagctgacgcggatcttcagctcggcgccgccctcgagcagctcgggattggccagggcttcgaaacgcagcttgtcggcggcgtccgaggcgttggaaatcagttcgcggaggaagatttccttgttcgaatagagagaatgaatcatcaggtgaagcagttgcttcacttcagtctgaaagcccagtgtctctttttgggtttccacgctcatcgctccaagctccatcaatga

SEQ ID NO: 9392 - DNA, 1890 bp, Pseudomonas aeruginosa
gtggggccttcttccggcttttcaagcgcttatgcgaaaaaaccgcgcaccatcgtgcgacgactagcgttcgagcagttcgagacgggcgatctccgccgggcgcaacaggtagctcgcctcccccgcaccgggcatttcccggcggatcaccaggcgcccctcgctgtcgaggccggtgaaacggccctcggcgatacgcccgcgtaccgtagtggccttgaccaggcgctggctgtagcgctgcggttcgacctggaccagctccaggtcgagggtggcgttacccggcgccggcagcgcctgcggctcgggcggcgccgccgccgcggccacggtcgcaggctccgccggcaaggcggggaacgcgtcgccgcgcaccgtccactcccgccgggcgttcttctccagcgtcagctccagcacctgagcctggccggccaccagggcctcgatacgcagcggccgcgcatggctggccgcgcgccaggacggcgcccgcacgaggctgacgtcgcggctggcgaaacgtcgctgcagatagtcgcgcaagaccagggccagggtatcgtcggagtcgtagcccaggtcgaccttgccgtgccgatagcgcagccggtcggtatacagctcgacgtggccgctgagggtggtccggtagtcgctcggcaggctcaggtggaactcgccctccaggcggttcggcgccttgggccgcaggtccaggtgcaaggtatagccacgcaggagacgacgcgcctcgggcaggtcctgatccggttgcagccagctcagctcgacttctggcaacgcgccgccgtcctcgggcagcacgtccaggcgcagcgccccgagcggctgtgccggaaggcggatctgcagctcgcgctgggcgtagaaatcgtgcccctggcgcaggctcagcacgccgccaatcaactcgccgctctgcggcgcgaaaggcttgccgttgaactccccgctgagcgcgatggacagttccgccggcggcctggcctccggtttcagccagcgcaggctgaggatcgcctccagccgcgcagcgtcgtgactggccagcagcgccaggccgaccaccagcgggatgcaacccagcgcggccagcccgacgcccttgcgcgccgtacgccagtgcacgccgatataggccagcgccaccggcgggaaaaggctgccgtaaccccacagcagaccggtaccgaaggccaggacgatgacccagatatagccggcgaccatcagcagcaggccgcccagaatcagcaaggcatccatcgcgatatcctcagcccactttccgcagcgtacggctcacggctcgtccaccttgaaatgcgcccgcgcggtggcgatgggctcgccctgggtggtctgccaggcgttgatcgcgacgttcgccacccgtcgcccctggcgccagacctggcattgcgcgtaggtatcgcggaagtgcccggcacgcaggtagtcgatggagaaatcgatgatcttcggcaggtgcggaatgctcatgaaggtcagcaggtgcaacatcgccgcatgctccatgaagccggcgatcacgccgccatggatggccggcagggtcgggttgccgatgttgtccttgttcgccggcaggcggaagaccatgtcgtcgcccaggcgcaggcattcgatgccgagcagcttggcgtacgggatcagctccaccagcgggctgtagtcgttgttccgacgcgcgtcgcggaccagttgctcgaggctggtcgggctcatgccgcacctccctgcgcggccggcctggccgccccggcgcgggccgaaccgcccatgcgcatgaaagcgccgacgacatgggcgatgggctggcccggatcgtcctggtag

SEQ ID NO: 9393 - DNA, 240 bp, Pseudomonas aeruginosa
acgatgaaaaagaccgtaactcttgccctgctgctcgctgccagccttggcctggccgcttgcgacaagaaagaggaagacaaggcagcggccccggcagctccggctaccgagacccagccgagcgctccggatactccccctgccgagcccagcgccccggcgccgtcgagcgacactccggcaaccccgcagactccggcaccgactccggagcaaccgcaacagaaccagcaataa

SEQ ID NO: 9394 - DNA, 636 bp, Pseudomonas aeruginosa
cccctgcaggaagccctgcaccaggggcgcgctctggtactcgccggaactgctgccgatctctcccgccggcgcgaagatcgccgcgccgccaaggaccagcagggccgacagcagcaccggcgtgatgacctttccgacccggtcgacaaggcgacccgggttcagcaccaggaacagaaccacggagaagtaagcgacggtatagacgagcaacggcacgccgccgtccccggtgaagggtgcgacgcccatctcgaaggacaccacggctgtacgcggggtggcgaacagcgggccgatggcaagatagacggcgatggcgaacgccactcccgcgcgccgcccgatcggctgggtcaggcggccaataccgcctccgacccgggccagggcgaccaccgtcagcaacggcaggccgacaccggtaaggaggaagccgaaagccgcgctccatacgtgttcgcccgccgccatgccggcactgggaggaaagatgatgttacccgcgccgagaaaaagcgcgaacgtcatgaagccaagggcgagcaggtcgaaccctttcaaatgagtcataggaggatgtaccactggcagaagtctcggttgttcggggtttccctttgggggtgttag

SEQ ID NO: 9395 - DNA, 1203 bp, Pseudomonas aeruginosa
tcaggacgctcattacttaccctccgcggccttgacgacttgctgggcagcgtcggtcaggctggttgccgcgatgatgttcaggccgctttcggccaggaccttggcacccagttcagcgttgttgccttccaggcggacgacaaccggaaccttcacgccgacttctttgacggcgccgatgatgccttcggcgatcatgtcgcaacgcacgatgccgccgaagatgttcaccaggacagccttcacgttgctgtcggacaggatgatcttgaacgcttcggtcacgcgctccttggtcgcaccgccgccaacgtcgaggaagttggccggcttgccgccgtgcaggttgacgatgtccatggtacccatggccaggccggcgccgttgaccatgcagccgatgttgccttccagcgcgacgtagttcagctcccacttctgcgcatgggcttcacgggcgtcgtcctgggacgggtcgtgcatggcgcgcagcttcggctgacggtacagggcgttgctgtcgatgttgatcttggcatccaggcagtgcaggttgccgtctttcttgatcaccagcgggttcacttccagcagggccaggtcgtagtcctggaacagcttcgccaggccgacgaagatatgggtgaactgcttgatctggtcgcccttcaggcccagctggaaggccagctcgcggccctggtacggctgcgcgccgaccagcgggtcgatggtagccttgaggatcttctcgggagtgtcgtgggcgaccttctcgatgtccacgccaccttcggtggaagccatgaacacgatgcggcggctggaacgatcgacgacggcgccgaggtacagctccttgtcgatgtcggtgcaggactccaccaggatcttgctgaccggctggccgttggcgtcggtctggtaggtcaccaggttcttgcccagccactgctgggcgaacgccttggcgtcctctttgctcttcaccagcttcacaccgcccgctttaccgcggccgccggcgtgcacctgagctttgacgacccactcgctgccgccgatcttgtcgcaggcttctgcggcctcttcgggggtgtctacggcaaagcccttggatacaggcaggccgtattcagcgaacagctgcttaccctgatattcgtggagattcatgcttgtctaccgttattcgtctag

SEQ ID NO: 9396 - DNA, 1557 bp, Pseudomonas aeruginosa
aggcctctttggcctcatggtacttgtaggagctgtccagcagcgccttggacgggatgcagccaacgttcaggcaggtaccgccgagcgccaccttgccttccttgccgatgtacttctcgatgcaggcggtcttcaggcccagctgggcagcgcggatggcggcaacgtaaccgccggggccggcaccaatcactaccacgtcgaatttctggctcatatctcaatccttattcgggtgaaaccggacggccccacgagggggccgccgtgaagagaaacgctaaatcagacgtccagcagcaggcgagccggatcttccagcaggtccttgatcgccaccaggaagctcaccgcttccttgccgtcgatcagacggtggtcgtaggacagcgccagatacatcatcggcaggatcaccacctggccgttcacggccatcgggcgctcctggatcttgtgcatgccgaggatagcggtctgcggcgggttgacgatcggggtcgacagcagggaaccgaacacgccaccgttggagatggtgaaggtgccgccggtcatgtcttcgatggtcagcttgccttccttcgccttcttgccgaagttggcgatgccgccctcgatctcggccaggctcatgaactcggcgttacgcagtaccggaaccaccaggccgcggtcgctggaaacggcaacaccgatgtcctggtagccgtggtagacgatgtcgttgccgtcgatggaagcgttgacccccgggaagcgcttcagcgcctcggtggcggccttgacgaagaaggacatgaagcccaggcgcacgccgttgtgcttcttctcgaacaggtccttgtacttcgaacgcaggtccatgatcggcttcatgttgacctcgttgaaggtggtcagcatggccatggcggactgcgcctcgaccaggcgctcggcgaccttggcccgcaggcgggtcatcggcacgcgcttctcgacacggtcgccggcggcgaagatcggcgcctcggcagccggggcggcaggcttggccggggcggccggggcgttcttcttcgcttcgaccgcagcgaccacgtcttccttggtcacgcgaccgcccttgccggtgccggcgatgctgttcggatcgatgccggcttcctcggccagcttgcgcgcggccggggacaggatggcgtcgtcgccgccagcggcggccggagcggcggcctgtgcagccggagcggcggcgggcgcagcggcagccggagcggccggagcggcggcgccgccttcgttcagcttgccgagcagctcgttgctcagaacggtgtcgccttcgttcttgatgatctcggccagcacgccgtcagcctcggcgagaacctcgatgaccaccttgtcggtctcgatgtcgacgatcagttcgtcgcgcttgactgcttcgcccggcttcttgtgccaggtggcgacggtgccgtcggcgaccgattccgggaaggttggggctttgatttcgatagccattgtgtgcgtttccttaaattcggtttcttcagcgcgtag

SEQ ID NO: 9397 - DNA, 1722 bp, Pseudomonas aeruginosa
gcgttaaacagtaaaggcgtcttgcagcagtttttcctgctgctcggcgtgcatcgaggcgtagccgcaagccggagcagcggagccttcgcggccggcgtactcgaggttgaggcccttcttgtgcgcggcgatgacacgacgcatgtgatgctggctgcagaaccaggcgccctggttcatcggctcttcctggcaccagacgatgtgcttgaggttcttgtacggagccagaacttccgccaggtcgtcttccgggaacggatacagctgctcgatacggacgatcgcggtatcttcgcggccttccgcgcgacgcttctccagcaggtcgtagtacaccttgccgctgcacagcacgacgcggtcgaccttcttcggatccaggctgtcgatttccgggatcacggtctggaaggaaccgttggccagatcttccagggtcgagatggcgagcttgtgacgcagcagggacttcggcgtcatcaccaccagcggcttgcgcagcgggcggatcacctgacggcggagcatgtggtagacctgagccggggtggtcggcacgcagacctggatgttctgctcggcacagagctgcaggtagcgctccaggcgcgcggaggagtgctccgggccctgcccctcatagccgtgcggcagcagcatggtcaggccgcagagtcggccccatttgctttcgccactggtgatgaactggtcgatgaccacctgggcgccgttggcgaagtcgccgaactgggcttcccagatcaccagcgagttcggcgtggtggtggcgaaaccgtattcgaacgccagcacggcctcttccgaaaggaaggaatcgtagatatccaggcgcggctggccgtcgaacagattggccagcggtacgtagaccgagtcgtccttctggttgtgcagcaccgcgtgacggtgcgagaaggtgccacggccgacgtcctggccggtcatccgtaccggatggccttcgaacagcagggtcgcgtaggccagggtctcggcgaagccccagttgatcggcaggccaccggccgccatcttctggcgatcttcgtagatcttcgaaacctggcgctgaaccacgaagccttccggcacttccagcatcttgctggacagttcctgcagggtcttcaggtcgaagcgggtgtcgtgacgcgcggtccaggcatgacccaggtacggacgccagtcgacgaacagttccttgttgggttccttgaccaggctcttcaccacgtgcaggccgttgtccagggcgtcgcggtagtcgtcgatcttcgactgaacctgctcggcgctgagcacgccggcattcaccagggcatcggcgtacagctcgcgggtagtacgctgcttggcgatctgctggtacatcagcggctgggtgccgctcggctcgtccgcctcgttgtggccgcggcgacggtagcagaccaggtcgatgaccacgtcacgcttgaactgcatgcggtagtcgacggccagttgggtgacgaacagcacggcttcgggatcgtcgccgttgacgtggaagatcggcgcctgaatcatcttcgccacgtcggtggcgtactcggtggaacgcgcatcgtcctggcggctggtggtgaaaccgacctggttgttgatcaccaggtggatggtgccaccgcgtcttgtatgcgcgggtctgcgacatctggaaggtttccatga

SEQ ID NO: 9398 - DNA, 1296 bp, Pseudomonas aeruginosa
gaggccatcatggctgacaaaaaagcgcagttgatcatcgagggctcagcccccgtcgaactgcccgtcctatccggtaccatgggtcccgatgtagtggatgtacggggcctcaccgccacgggccacttcaccttcgatcctggcttcatgtcgaccgcctcctgcgagtcgaagatcacctatatcgacggcgacaaaggcgtcctcctccatcgcggctaccccatcgagcaactggcagagaaatccgactacctggaaacctgctacctgctgctgaacggcgagctgcccaccgccgcgcagaaggaacagttcgtcggcaccatcaagaaccacaccatggttcacgagcagttgaagaccttcttcaacggcttccgccgcgacgcccacccgatggccgtgatgtgcggcgtgatcggcgccctctcggccttctaccacgactccctggacatcaataacccgaagcatcgcgaagtctccgcgcatcgcctgatcgccaagatgccgaccatcgccgccatggtgtacaagtactccaagggcgagccgatgatgtatccgcgtaacgacctgaactacgcggaaaacttcctgcacatgatgttcaacaccccctgcgagaccaagccgatcagccccgtgctggccaaggccatggaccgcatcttcattctccacgccgaccacgagcagaacgcctccacctccacggtgcgtctggccggctcctccggcgccaatccgttcgcctgcatcgcctccggcatcgccgccctgtggggaccggcccatggcggcgcgaacgaagcggtgctgcgcatgctcgacgagatcggcgacgtgtccaacatcgacaagttcgtcgagaaggccaaggacaagaacgatccgttcaagctgatgggcttcggccatcgtgtctacaagaacttcgacccgcgcgccaaggtcatgaagcagacctgcgacgaggtcctccaggagctgggcatcaacgacccgcaactggaactggcgatgaagctagaagaaatcgcccgccacgacccctacttcgtggaacgcaacctgtacccgaacgtcgacttctactcggggatcatcctcaaggcgatcggcattccgaccagcatgttcaccgtgatcttcgccctggcgcgtaccgtcggctggatctcgcactggcaggaaatgctctccggcccctacaagatcggccgcccgcgccagctctataccggccacacccagcgcgacttcaccgccctcaaggatcgcggctga

SEQ ID NO: 9399 - DNA, 846 bp, Pseudomonas aeruginosa
gcgctgagccggccatcggcgcagcgcaggtgccccttcagggacaagcgtcgaccgaccagttcgaagctctccaggctctgctcctggcagcgcaactgcaggcgaccggcgctttcccgcccggccccgagaaaaccgccctcgctctcccacaacggcggccgagcgctacccgccactgacagggcgaggctcttgccgccccagctcaagcggtgttcgcccaggtcgaaatcgcgcgggatggcaaacgccggcggcacccgcagctcgctccacagagccggctcccgcgacgcctggctcgcccaccaggcggccgccagcacgacggccagcccgctcaaggcgagcccccagaccagcgagcgtttgtgcaaccgcatacctttcatccttttccgagcaccagcccctaccggtcgatgcctgcccacttggatttatcgccgcagccaattaggctgcggcgccgtcccaatcccccggagcccacccatcatgcccgtctggctgcaaaccgccttgttgctagcctgttccaacctgttcatgaccttcgcctggtatggtcatctgaagactctcaacagcaagccctggatcatcgccgccctgatcagttggggtatcgcgctgttcgaatacctgctgcaggtaccggccaaccgcatcggctacaccgaactctcggtcggccaactgaagatcatgcaggaagtcatcaccttggcgatcttcgtcccgttcagcgtctacttcatgcagcagccgctgaaactggactacctctgggccggcctgtgcctgctcggcgcggtgtacttcatcttccgcgcctga

SEQ ID NO: 9400 - DNA, 909 bp, Pseudomonas aeruginosa
gctgcgtcacgaacgcagccgggcgatcaggctggaggtatcccaacgaccgccgcccatcgcctgcacttcggcgtagaactggtcgaccagcgccgtgaccggcaactgcgcgccgttgcgccgcgcctcggcgagcaggatcgacaggtccttgcgcatccagtccacggcgaagccgaagtcgaactctccggccagcatgctctggtggcggttttccagttgccaggactgggccgcgcccttgccgatcacctgcatcgccgcctcgccatcgagaccggcgcaccgggcgaagtgcagcgcctcggccaggccctggagcagccccgcgacgcagatctggttgaccatcttggtcaattgcccgctacccacgtcgcccattcgccggaccatccgcgcatagctgcgcaacagcggttcggcgcgtcgatagaaggcctcctcgccaccgaccatcaccgtcagggcgccgttgaccgcgcctgcctggccgccggagaccggcgcgtcgagaaagcccagctcacgctcggcagccagcagcgacagctcgcgggcgacttccgccgaagcggtggtgtggtcgacgaacaggctgcccggcgccattccggcgaaggcgccctgctcgcccagcgccacggcacgcaggtcgtcgtcgttaccgacgcaacagaacaccagctcggcgccagcacaggcctcgcgcggcgtatcggcgcgccgtccggcgtactcctcgacccagcgcagcgccttggccgacgagcgattgtagacacagacgtcgtagccctctcgttgcaggtgcccggccatcgggtagcccatcgtgcccaggccgagaaatgcgaccgcagtcattccgtcatctcctcgaaatccgatcccgcagcctag

SEQ ID NO: 9401 - DNA, 639 bp, Pseudomonas aeruginosa
cacagcggtttgccgaggtccggaagccccgccatactcagcgcggaccctggtatggatagctccgatgcctcactggctggtaatcgatctggaggccaccaccgcggaaggcggctggcccctggaggaaatggaaatcatcgagatcggcgccaccctggtcgccgccgcggacgcccgcgaactggaccacttccagcgtttcgtacggccggtcaggcggccgctgctgacccacttctgccgcgacctcacgcatatcagccaggccaacgtcgatggcgcagcccatctcaatacggtctgggaagccttcgagcgctggctcgcccagcatcgtccgcgactggccggctgggccagttggggcgactacgaccgccgccagttggagcaggaatggcgccagcacgggctgaccagccagctcagcgaagtgccgcacgtcaatctcaagcaacgcttcggcgaagtccgccagttgccccgcccagtcggcctgaacgcggccctgcaactggccgggatgagtttccagggccagcagcaccgcgccctggaggatgcccgcaataccgcacggctgctgccgctggtattgccggtggagcattgaacgaggcccgcgccgcctag

SEQ ID NO: 9402 - DNA, 189 bp, Pseudomonas aeruginosa
gtatccgctgggatacgcgaaggaccaggacgcgcccgcgggcgcttaggaggaaaaggatggacaaggacgtatccggcgcgctgcgccgcctgttgctgctcgccatgctcggactgccgctggtggcggccgctgcggtcgaaccgcagcgactggtggatgcggcgcgtgcccaggtgggcgtga

SEQ ID NO: 9403 - DNA, 273 bp, Pseudomonas aeruginosa
gcggtgtcctgggcgaccttgagctggaacttgctgttcgccgggacggtgaactggctgccgctggcgtattcctgccactcgtcgctgcccggcagcttgaccgtcagcgcgccggcgaccacatgcatgatctccagctggctggtgccgaactcgtattcgcctgccgccatcacgccgatggtggccgggccggcggtcatgtcgaaggcgatggatttgacggtgccgtcgaagtattcgttgaccttgaacatgggcttctcctga

SEQ ID NO: 9404 - DNA, 654 bp, Pseudomonas aeruginosa
accgggtcgccctgtcctggcggcgtggagcgggggagcgcttgtccggtatcgtcgatgacgaggtggaaggtcgctcctgggtcttgccggccggggtcgccggctactggagttccgctggcaacgccttcctcggccactcgacggcggcgcaatccctcgacctgcgcgagccgggccgcgtgcaatggcgggcagcgacggagtcggccagggcctggctgttcgctgccggcaaccgcgagcagtggcagcttcgcagcgcgcgtctcgaggcggaaacgcgccgctgatccgccgggcttggcggcggcctggccggtccgtattctttgcgcccgtttcggacggctgtcctggccgctcctctgccaactttcgggcgagatccttcccatgcaatgtagagccggctgcggcgcctgctgcatagcaccgtcgatttcctctccgctgccgggcatgccggccggcaagcccgcgggcgtacgctgcctgcacctggacgaaaatcatctctgcgggctgttcggccgaccggagcgaccggccgtatgcggccagttcggcgccgatccggaaatctgcggcgacagccgtgagcaggcgctggccctgatcgcggagtgggaagtcatcactgccgcttga

SEQ ID NO: 9405 - DNA, 432 bp, Pseudomonas aeruginosa
gcgtggctccaaaatcgtcatcgccatcgcggtggtgctgatcgttctggcgggggtatgggtatggtaactaacgtcacaaacttctcgcgctccggcctctacgactggatggcccagcgcgtttccgcggtcgttctcgcggcttatgtcattttcctgctgggctacctcattgctcaccccaacatttcctacgcggactggcacggcctgttctcgcagggttggatgcgcatcttcagcctgttgaccctggttgccctgagcgtccatgcgtgggtcggtatgtggaccatctccaccgactacctgacttcgatggctctcggcaaggcggcgacagtcgtgcgtttcctcttccaggcggtttgcggcatggcgatgttcgcattcttcgtctggggtgtgcagattctttggggtatgtga

SEQ ID NO: 9406 - DNA, 1776 bp, Pseudomonas aeruginosa
tccatggctagcattcgtacactttcctttgacgccatcatcgtcggtggcggtggcgccggcatgcgtgccgcgctgcaactggcccagggcggccacaagaccgccgtggtgaccaaggtcttcccgacccgttcccacaccgtatccgcacagggtggcatcacctgcgcgatcgcttcggccgacccgaacgacgattggcgttggcacatgtacgacaccgtcaagggttccgactacatcggtgaccaggacgcgatcgaatacatgtgttccgtcggtcccgaggccgtgttcgagctcgagcacatgggcctgccgttctcccgtaccgaaaccggccgcatctaccagcgtccgttcggcggccagtccaaggacttcggcaagggtggccaggccgcccgtacctgcgccgccgccgaccgtaccggccacgcgctgctgcacaccctgtaccaggccaacctgaagaatggcacctcgttcctcaacgagtggtacgcggtcgacctggtgaagaaccaggacggcgcggtggtcggcatcatcgccatctgcatcgagaccggcgagaccgtctacatccgttccaaggccgtggtcctggccactggtggtgccggccgtatctacgcctccaccaccaacgcgctgatcaacaccggtgacggcgtgggcatggccctgcgtgccggcgtgccggtgcaggacatcgagatgtggcagttccacccgaccggcatcgccggcgccggtgtactggtcaccgaaggttgccgcggcgaaggcggttacctgatcaacgcccacggcgagcgcttcatggagcgttatgcgccgaacgcgaaggacctggccggtcgcgacgtggtcgcccgttccatggtcaaggaagttctggccggcaacggcgtgggtccgaacaaggaccacgtgctgctgaaactcgaccacctcggcgaggaagtcctgcacagccgtctgcccggcatctgcgagctgtccaagaccttcgcccacgtcgacccggtcgttgcgccgatcccggtgatcccgacctgccactacatgatgggcggcgttgccaccaacatccatggccaggccatcacccaggacgccaacggcaacgaccagatcgtcgaaggcctgttcgccgtgggcgaagtggcctgcgtatcggtacacggcgccaaccgcctgggcggcaactcgctgctcgacctggtggtattcggccgtgccgccggtctgcacctggaaaaagcgctgaaagagggcatcgacgcccgcggcgcttccgagagcgacctggaagcctccttcaagcgcctgaacggcgtgaacgagcgcaccagcggcgaagaagtcgctccgctcaagcgcgagctgcaaagctgcatgcagaactacttcggtgtgttccgcaccggcgagtacatgcagaagggcatcgcccagctggccgacctgcgcgagcgtatcgccaacgtcaagatcaacgacaagagccaggcattcaacaccgcgcgcatcgaagcgctggaactgcaaaacctcctcgaggtggccgaggccaccgcgatcgcggccgagcaccgcaaggagtcccgtggcgcccacgcccgtgaagacttcgaggagcgcgacgacgagaactggctgtgccacaccctgtacttcccgggtgagaagcgcgtatccaagcgttccgtcaacttcgcgccgaagaccgttccggcattcgaacccaaggttcggacttactaa

SEQ ID NO: 9407 - DNA, 1365 bp, Pseudomonas aeruginosa
cctagcatgcacgaaagcgtaatgcagcggatgtggaacagtgcccatctatccggtggtaacgctgcctacgtcgaagagctctacgagctctacctgcacgaccctaacgctgtgccagaagagtggcgcacgtatttccagaagcttcccgccgatggcaatcccgcccccgacgtctcgcactccacagtgcgcgatcatttcgtcctgctggccaagaaccagcgccgtgcccagccggtttccgccggtagcgtgagcagcgagcacgagaagaagcaggtcgaagtccttcgtctcattcacgcttaccgtctccgcggccaccaggcttccaccctcgacccgctcggcctgtggcagcgtcccgcgcctgccgacctgtcgatcgaccactacggtctgacgggtgccgacctggacaccactttccgcaccggtgagctttacatcggcaaggaagaggcgaccctgcgtgaaatcgtcgacagcctgaagagcacctactgcggtaccttcggcgccgagttcatgcacatcgtcgattccgagcagcgcaagtggttcctccagcgtctggaaagcgtgcgtggtcgtcccggcttctccgccgaggcgcgtgcgcacctgctcgagcgcctgaccgcggccgaaggcctggagaagtacctgggcaccaagtacccgggcaccaagcgtttcggcctggaaggcggcgaaagcctgatcccgatggtcgacgagatcatccagcgctgcggttcctacggcgccaaggaaatcgtcatcggcatggcccaccgcggtcgcctgaacgtcctggtcaacaccctgggcaagaacccgcgcgacctgttcgacgagttcgaaggcaagaagatcgtcgagctgggctccggtgacgtgaagtaccaccagggcttctcctcgaacgtgatgaccagcggtggcgaagtccacctggcgctggcgttcaacccgtcccacctggaaatcgtttccccggtggtcgagggttccgttcgtgctcgccaggaccgccgcaaggacagctccggcgacaaggtggtaccgatttccatccacggcgatgccgccttcgcggggcagggcgtggtcatggaaaccttccagatgtcgcagacccgcgcatacaagacgcggtggcaccatccacctggtgatcaacaaccaggtcggtttcaccaccagccgccaggacgatgcgcgttccaccgagtacgccaccgacgtggcgaagatgattcaggcgccgatcttccacgtcaacggcgacgatcccgaagccgtgctgttcgtcacccaactggccgtcgactaccgcatgcagttcaagcgtga

SEQ ID NO: 9408 - DNA, 654 bp, Pseudomonas aeruginosa
ggggcagggcccggagcactcctccgcgcgcctggagcgctacctgcagctctgtgccgagcagaacatccaggtctgcgtgccgaccaccccggctcaggtctaccacatgctccgccgtcaggtgatccgcccgctgcgcaagccgctggtggtgatgacgccgaagtccctgctgcgtcacaagctcgccatctcgaccctggaagatctggccaacggttccttccagaccgtgatcccggaaatcgacagcctggatccgaagaaggtcgaccgcgtcgtgctgtgcagcggcaaggtgtactacgacctgctggagaagcgtcgcgcggaaggccgcgaagataccgcgatcgtccgtatcgagcagctgtatccgttcccggaagacgacctggcggaagttctggctccgtacaagaacctcaagcacatcgtctggtgccaggaagagccgatgaaccagggcgcctggttctgcagccagcatcacatgcgtcgtgtcatcgccgcgcacaagaagggcctcaacctcgagtacgccggccgcgaaggctccgctgctccggcttgcggctacgcctcgatgcacgccgagcagcaggaaaaactgctgcaagacgcctttactgtttaacgcctacgcgctga

SEQ ID NO: 9409 - DNA, 711 bp, Pseudomonas aeruginosa
cggcgtgctggccgagatcatcaagaacgaaggcgacaccgttctgagcaacgagctgctcggcaagctgaacgaaggcggcgccgccgctccggccgctccggctgccgctgcgcccgccgccgctccggctgcacaggccgccgctccggccgccgctggcggcgacgacgccatcctgtccccggccgcgcgcaagctggccgaggaagccggcatcgatccgaacagcatcgccggcaccggcaagggcggtcgcgtgaccaaggaagacgtggtcgctgcggtcgaagcgaagaagaacgccccggccgccccggccaagcctgccgccccggctgccgaggcgccgatcttcgccgccggcgaccgtgtcgagaagcgcgtgccgatgacccgcctgcgggccaaggtcgccgagcgcctggtcgaggcgcagtccgccatggccatgctgaccaccttcaacgaggtcaacatgaagccgatcatggacctgcgttcgaagtacaaggacctgttcgagaagaagcacaacggcgtgcgcctgggcttcatgtccttcttcgtcaaggccgccaccgaggcgctgaagcgcttcccgggggtcaacgcttccatcgacggcaacgacatcgtctaccacggctaccaggacatcggtgttgccgtttccagcgaccgcggcctggtggttccggtactgcgtaa

SEQ ID NO: 9410 - DNA, 366 bp, Pseudomonas aeruginosa
cgccgagttcatgagcctggccgagatcgagggcggcatcgccaacttcggcaagaaggcgaaggaaggcaagctgaccatcgaagacatgaccggcggcaccttcaccatctccaacggtggcgtgttcggttccctgctgtcgaccccgatcgtcaacccgccgcagaccgctatcctcggcatgcacaagatccaggagcgcccgatggccgtgaacggccaggtggtgatcctgccgatgatgtatctggcgctgtcctacgaccaccgtctgatcgacggcaaggaagcggtgagcttcctggtggcgatcaaggacctgctggaagatccggctcgcctgctgctggacgtctgatttag

SEQ ID NO: 9411 - DNA, 1440 bp, Pseudomonas aeruginosa
gatatgagccagaaattcgacgtggtagtgattggtgccggccccggcggttacgttgccgccatccgcgctgcccagctgggcctgaagaccgcctgcatcgagaagtacatcggcaaggaaggcaaggtggcgctcggcggtacctgcctgaacgttggctgcatcccgtccaaggcgctgctggacagctcctacaagtaccatgaggccaaagaggccttcaaagtccatggtatcgaagccaagggcgtcaccatcgacgttccggcgatggttgcgcgcaaggccaacatcgtcaagaacctgaccggcggcatcgctaccctgttcaaggccaacggcgtgacctccttcgaaggccacggcaagctgctggccaacaagcaggtggaagtgaccggtctggacggcaagacccaggtcctggaagccgagaacgtgatcatcgcttccggctcccgcccggtggagatcccgccggccccgctgaccgacgacatcatcgtcgactccaccggcgccctggaattccaggccctaccgaagaagctgggtgtgatcggcgccggcgtcatcggcctggagctgggttcggtatgggcccgcctgggtgccgaggtgaccgtgctggaagccctggacaagttcctcccggctgccgacgagcagattgccaaggaagccctgaaggtcctgaccaagcaaggcctgaacattcgcctgggtgcccgcgtgaccgcttcggaagtgaagaagaagcaggtcaccgtgaccttcaccgacgccaacggcgagcagaaggaaaccttcgacaagctgatcgtcgcggtcggccgtcgcccggtgaccaccgacctgctggccgccgacagcggcgtgaccctggacgagcgtggcttcatctacgtcgacgaccactgcaagaccagcgttccgggcgtcttcgccatcggtgacgtggttcgcggcgcgatgctcgcgcacaaggcctcggaagagggcgtgatggtcgccgagcgcatcgccggccacaaggcgcagatgaactacgacctgattccgtcggtcatctacacccacccggaaatcgcctgggtcggcaagaccgagcagaccctcaaggccgagggcgtcgaagtcaacgtcggcaccttcccgttcgccgccagcggtcgcgcgatggctgccaacgacaccaccggcctggtcaaggtcatcgccgatgcgaagaccgaccgcgtcctgggcgtccacgtgatcggcccgagcgccgccgagctggtacagcaaggcgcgatcggcatggaattcggcaccagcgccgaagacctgggcatgatggtcttctctcacccgacgctgtccgaagccctgcacgaagctgccctggcagtgaatggccatgccatccacatcgccaaccgcaagaagcgctga

SEQ ID NO: 9412 - DNA, 891 bp, Pseudomonas aeruginosa
gtaatgagcgtcctgatcaacaaagacaccaaagtcatctgccaaggcttcaccggtagccagggcaccttccactccgaacaggccatcgcctatggcaccaagatggtcggcggcgtgacccccggcaagggcggcaccacccacctcggcctgccggtgttcaacaccgtcaaggaagccgtggaagccaccggcgccgaagcctcggtcatctacgttccggctccgttctgcaaggactcgatcctggaagcggcattcggcggcatcaagctgatcgtctgcatcaccgaaggcatcccgaccctcgacatgctggacgccaaggtcaagtgcgacgagctgggcgtacgcctgatcggcccgaactgcccgggcgtgatcactcccggcgagtgcaagatcggcatcatgccgggtcacatccacctgccgggcaaggtaggcatcgtgtcgcgttccggcaccctgacctacgaagccgtgaagcagaccaccgacgccggcttcggccagtccacctgcgtgggcatcggcggcgacccgatcccgggctccaacttcatcgacatcctgaagctgttccaggaagatccgcagaccgaagccatcgtcatgatcggcgagatcggcggttccgccgaagaagaagccgcggccttcatcaaggccaacgtgaccaagccggtggtgtcctacatcgctggtgtgactgcccctccgggcaagcgcatgggccacgccggcgccatcatctccggcggcaagggcaccgcggacgagaagttcgccgccctgcaggacgccggtgtgaagaccgtgcgttccctggccgacatcggcaaggccctggccgagctgaccggttgggaagtgaagaaggcctga

SEQ ID NO: 9413 - DNA, 1050 bp, Pseudomonas aeruginosa
acgggtgggtgccggacgtcttcgccaagcttccgctcgccgatcagagccttggctggctgctgccggtatccattgcgctggtcctggcagtcgtttgcgatcggctgctgggcaagccgcgcgaagcggtcgcctgagacgtcaggcgaaccccaggaaggccgcctccgggcggcctttttcatgagccgacgaaagtcgtgtcctggccgcggcgagcggcgtcccaacggcgcgaaacaacggcggggcgattcccggccggctcaagagggagttttcatgaccgccgaactcggcattttcaacgggcacctgctgcaacacctgctggcggcgctctggttcctgttctgctgggtgggctacacccgctacgccacctggaagggtcgcgacaccgcctgcctggccagcgtcatgcacctctaccgggaggactggatgcgccggttgctgctgcgcgacaaccgtatcgcggacgccagcgtgatcggtaacctggagcgtaacgcgtcgttcttcgcctccagcacgctgatcatcctcgccggcatcctcaccctgctgggctccaccgatcgcgccgtctcggtactggccgacctgccgttcgtggaggaggccagccggggactgtcggaactgaagctgctgtgcctggcagtggtcttcgtctatgccttcttcaccttcagctggtgcatgcgccaatacaacttcgcggcgatcctggtcggctcggcaccgatgatcggcgagcgcaacgtcggcgagctggagcgcaaatcctttgccgagcgtgccgcccgggtcatctcgctggcggccaaccagttcaacttcggcttgcgctcgtactatttcggcctggccatgctcgcctggttcatcaattcctggttcttcatgctggtgacggccggcgtggtgctggtcctgtatcgccgcgaattccattcggacgtgctggaggtgatggtctacaccgagaccgcaatcgccgaaagcccgcgggaaggcgagggcgaggtgcccaggggctga

SEQ ID NO: 9414 - DNA, 1023 bp, Pseudomonas aeruginosa
ggatatcgcgatggatgccttgctgattctgggcggcctgctgctgatggtcgccggctatatctgggtcatcgtcctggccttcggtaccggtctgctgtggggttacggcagccttttcccgccggtggcgctggcctatatcggcgtgcactggcgtacggcgcgcaagggcgtcgggctggccgcgctgggttgcatcccgctggtggtcggcctggcgctgctggccagtcacgacgctgcgcggctggaggcgatcctcagcctgcgctggctgaaaccggaggccaggccgccggcggaactgtccatcgcgctcagcggggagttcaacggcaagcctttcgcgccgcagagcggcgagttgattggcggcgtgctgagcctgcgccaggggcacgatttctacgcccagcgcgagctgcagatccgccttccggcacagccgctcggggcgctgcgcctggacgtgctgcccgaggacggcggcgcgttgccagaagtcgagctgagctggctgcaaccggatcaggacctgcccgaggcgcgtcgtctcctgcgtggctataccttgcacctggacctgcggcccaaggcgccgaaccgcctggagggcgagttccacctgagcctgccgagcgactaccggaccaccctcagcggccacgtcgagctgtataccgaccggctgcgctatcggcacggcaaggtcgacctgggctacgactccgacgataccctggccctggtcttgcgcgactatctgcagcgacgtttcgccagccgcgacgtcagcctcgtgcgggcgccgtcctggcgcgcggccagccatgcgcggccgctgcgtatcgaggccctggtggccggccaggctcaggtgctggagctgacgctggagaagaacgcccggcgggagtggacggtgcgcggcgacgcgttccccgccttgccggcggagcctgcgaccgtggccgcggcggcggcgccgcccgagccgcaggcgctgccggcgccgggtaa

SEQ ID NO: 9415 - DNA, 993 bp, Pseudomonas aeruginosa
cttcgagaacccgctgagctggagccacaacaaggtcgaaggcaagctggaatacacctcgctgctctacgtgccgggccgcgcgccgttcgacctgtaccatcgcgaagcgccgcggggcctgaagctgtacgtacagcgcgtgttcatcatggaccaggccgacgagttcctgccgctgtacctgcgcttcatcaagggtgtggtcgactccaacgacctgtcgctgaacgtctcccgggaaatcctgcagaaggatccggtgatcgactcgatgaagtcggcgttgaccaagcgcgtgctggacatgctggagaagctggcgaagaacgagccggagcagtacaagaccttctggaagaacttcggccaggtcctcaaggaaggcccggcggaagacttcggcaacaaggagaagatcgccggcctgctgcgcttcgcctccaccggcgacgattcgggcgagcagagcgtagcgctggccgactacatcggtcggatgaaggaaggccaggacaagatctactacctcaccggcgagagctactcgcaggtgaagaacagcccgcacctggaagtcttccgcaagaagggcatcgaggtgctgctgctcaccgatcgcatcgacgagtggctgatgagctacctgccggagttcgacggcaagcagttcgtcgatgtcgcccgcggcgacctggacctgggcagcctggactcggaagaggacaagaaggcccaggaagaagtcgccaagagcaaggaaggcctgatcgagcgcctgaagaaggtgctcgacgagcaggtcagcgaagtccgcgtttcccaccgcctgaccgattcgccggcgatcctcgccatcggcgaacaggaccttggcctgcagatgcgccagatcctcgaggccagcgggcagaaagtgccggactcgaagccgatcttcgagatcaacccgcagcatccgctgatcgagaagctggatgcggagccggatga

SEQ ID NO: 9416 - DNA, 528 bp, Pseudomonas aeruginosa
ggcggcgtacgaacggatgccgacggtagcctgttcgtccttcgatcagtccctgctgacccgggtatcttccgcggcgagcggactgccgtcgccggcgcgtacctgcaggcgcggcaccggctggccgctgtcgcgctcgaccaggcggacatgggattcgtccggggcgaagaaatagtcctcgccccactgccgaatcgccaccagcagggggaagagcgcgcgtcccttgtcagtcagacggtattcctggtgactgccgctttcggccgggaccgccaccatcacgccgtgctccaccaggttgcgcaggcgcgccgccaggatgttcttggccaggccgaggctcttctggaattcgccgaagcgcgtcagtccttcgaaggcatcgcgcacgatgagcatcgaccagccgtcgccgatcacgtccagcgggcgggcgactggacaactggcttgcttgtggctggtgcgcttgaccatctgggcggctccggagggggagaggatcgggtttcatggtaa

SEQ ID NO: 9417 - DNA, 1785 bp, Pseudomonas aeruginosa
aacccgggctccacgctgggcaaccggaggaagtgcgccgccgtgagacggcgcacggcatggtcagacgacgaagcgggtgaccatgttgttcaggtcgatggccagttgcgacagttcctggctggcggcggcggtctggttggagccggcggacgtctgcagcgagatgtcgcggatgttcaccaggttgcggtcgacctcgcgggccacctgggcctgctgctcggaggcgctggcgatcaccagggtacgctcgttgatctggccgacccgctccgcgatctcgttgagcgccaggccggcggcttcggcgatctccagcatgttgcgggcgcgtacgctgctgctgtccatggcgccgaccgcggcgccggtgccttcctggatgttggcgatcatctgctcgatctcgcgggtggattcctgggtgcgatgggcgagggcgcgaacctcgtcggcgaccacggcgaaaccgcggccctgctcgccggcgcgagccgcctcgatggccgcgttgagcgccaggagattggtctgttcggcgataccgcggatcacgtcgaggaccttggaaatgtcctgggccttttccgccaggccgccgaccagcgccgaggtattgtccacttcttcgctcatcaggcggatcgcctggaccgtctccagtacccgctggcgtccgttctgcgccgattgctcggaggcggacgaggcgtccgaggtggagctggcgttgcgcgccacttcctcgacggcggcggtcatctcgttgaccgcggtggcggccatctggatttcgtcgttctgctgggtcagcgagcggttgccctgctcggtgacggcgctgagttcctccgcggcggaggccagttgggtcgccgagctgccgatctgctggatggtctggcgcagttgtgcctgcatgccctggagggcgaccagcagcttggccggttcgtcgcggccagaggtgtcgatgcggctggtgaggtcaccggaagcgatcacctcggccactcgcagcgcctcgccgatcggttgggtgatgctgcgggtgaacagccaggccagtaccacggtagcgaggccggcgaccagcagtacgccgatcactgcggcgaaggcgctgtcatagacctcatcggccgtgtggctggcctggctggcgcccttgacgttgaagtcgatcagcgcctgcagttgctgctgggtggcgcggtactggtcgagcaaggtgctttcggtgtactggcgggtctcttccagcggcttgctgcgcgacatctgcaccagggtctgctggctttgcaggagcgtctgccgggtagccaggtagcgctcgtagatcgagcgctcgtcggcaccactgatcagccgttggtaggcgccctcgcgatcggtcagttccttgccgatttccgtcatgcggctttccaggaagcgcttgctgctatcgtccgccgccagcacatgggccagttgcacctgccgcagttcggcgagcagaacgttcaactcggcgctttcgcggacgctaggcagccagttgtcgctgatgtccgaagaggcttcgttgagcgaacccatccggttcagggaaaagatgccggtgatgaccagcagagcggtgatcagggcgaaactcagggcggcacgggtcgcgatgggcatactgcgcaaagacatgatggcggattccagggggcaggaagagggacggggctgaccagtactatcggcaggcagggcgggaggtttagcccgttcatgcagtccgggtaa

SEQ ID NO: 9418 - DNA, 552 bp, Pseudomonas aeruginosa
tcgagagcctgccactccaggctgagatggatggcgccttcctcggtgaacttcagcgcattacccagcagattcaccaggatctgtcggatccgcgtcggatcgccgcagacctcgatattctccaggccggcctggatctgcaattccagcgccagtccgcgttgctgggcgctgtgctggaacaccagggcggagccttgcaccagttccagcaggttgaaggggatgcactccagttcaagcgcgccgcgttcgatccttgagaaatcgagaatgtcgttgatgaccttcagcaggtgttcggtggactcggtggccagcgccgtgtactcggcctgttcgcgggtctgctcggtggtttccagcagttgcagcatgcccagcacgccattcatcggggtgcgaagctcgtggctcatcatcgccaggaagtcggacttcgcccggttcgcctgctccgcttcctcgcgggcgctgatcaattggctgatcgcctgttcctgttcccggctcgcgcggtccagcccgctggcgagattgttgatgtga

SEQ ID NO: 9419 - DNA, 789 bp, Pseudomonas aeruginosa
gatcctcgaggaaatcgccccgcaagcccgcatcggggtgatttccggcccgaacctggcgcgcgagatcgcagagcacgagctgaccgccacggtggtcgccagcgaggacgacgagctgtgcgcccgcgtccaggcggccctgcacggccgcaccttccgcgtctacgccagccgcgaccgcttcggagtggaactcggcggtgcgctgaagaacgtctacgcgatcatggccggcctggccgcggcgatggacatgggcgagaacacccgcagcatgctgattacccgcgcgctggcggaaatgacccggttcgccgtcaagctcggtgccaacccgatgacctttctcggcctcgccggcgtcggcgacctgatcgtcacctgttcctcgccgaagagccgcaactaccaggtcggccacgccctcggcgaggggctcagcctggaggaggcggtatcgcgcatgggcgagaccgcggagggtgtgaacactctcaaggtactcaaggaaaagtccgacgagatgcaggtgtacatgccgctggtcgccggtctccatgcgatcctcttcgaaggccgcaccctggcgcaggtcatccagctgctgatgcgcggcgagccgaagaccgacgtcgatttcattcccaccaccggcttctgacgaggagaccgccatgtccgcagacccgcaagcacgcgaatcgatcgccatccgcatcctctggatgctgctgttcgtcctggtctggcaggtcgccgaactgctcctcggggcggtggtggtga

SEQ ID NO: 9420 - DNA, 1002 bp, Pseudomonas aeruginosa
tggctttcggcgacagcctcagccagtacctggcgcagatcggccgtttcggtaccttccacagcgacgagaaaccctggccgttcgccgactggccgagcgcccgcgccgccgagggcgaggccgcccacagcgtgccgcccgccgcgcacccggcgcgcgacgaagagccgaagttgtgaaactctggctgttgcgccacggcgaggccgaaccgcacgccagccgggattccgagcggcgcctgaccgcccatggacgcaaggaggtgctgcagagcgccgcgcggctggccgggttgccgctggacgggattctcgccagcccctacgtgcgcgcccagcagaccgccgagctggtgcgcgaggcactgggcctggtcgagccggtcggcaccgcgccctggttgacccccgacgacgatccgcgcgaggtgctcggtttcctcgacgagcgcagcgagcgcaatctcctgctggtcagccaccagcccctggtcggggcgctgggcggtctgctggtgcatggcaaccggcgcgatccgttgccgatgagcactgcctcgctggccgagctggaaggcgacttcgccgccgccgggctgatgaccctggtctcgctgcatcacccgcggcacggctaggaagcgcctggcacaacgactacaaaccgaaacatttcccggcttgcctgcggttggctgtgatggaatattcgaccaagcaagtgcttggtcgatctcccagaacaacaacaacggaggcggtacgtggtcactgcaaatcgtctgccgctcgaagtcttcttcgagcgcgaaaagcgtcatccgcaacggcgttacctggtgcagcccatcggtggcggccgggtcgaggagctgagctggggcgaggtgggcgaccaggcgcggcgtgcagccgcctggttgcgcagcctggatctccccgccggcagccgtatcgcgatcatctcgaagaactgtgcgcactggatcgtcactga

SEQ ID NO: 9421 - DNA, 783 bp, Pseudomonas aeruginosa
gccaggtggcccagcagttcggtttctacgaccaggcgcacttcagccgtctgttccggcgcacctatgggttaccgccggcgcgcctgcgccagcgctgattcgcgttttcctttccgatccctttttcgtggagtagccatgcaggaattgtctgtcttgctgaccctggcggcggtgttcgccatagccctggtcagccccggtcccgatgtcgccctggtggtgcgcacgtccctgcaccaggggcggcgggccggcctggccagcgcgctggggctggcctgcgggattctcctgcataccaccctggtgctgaccggcgtgtcgctgctgctcagccgtacgcctgtgctgttcgccatcctgcaggcgctcggcgcgctgtacctggcctggctcggcgtcggcgcgctgcgcgcctggctgcggcgcggcgacggccagccgggccggctcgacggggcactgccgccgtcgcccctggggccctggctgcgcggagtggcgaccaatctgttcaatcccaaggcgctggtgttattcatcgccttgctcggcagcctgattcccgcgcagatgtcgctcggcggcaaactggcggtggcggcgctgctgttcggcatgggcgcctgctggttcggcctgctcagcctgacccttacccgcccggccctgcaggcccgcctgttgcgcgcggtgccctggctggacgcggcctgcggggtggtgttcctgctggtggcggcggcgatcctcgagcatctcgtccgctctgcctga

SEQ ID NO: 9422 - DNA, 855 bp, Pseudomonas aeruginosa
aaggcgtgttcgatcgctggtcgcgggcgaccgaggagcgttcggcatgagcctgcaggtcgaggaagtacgcatcagcctgccgcacatcgaactggccgcgcatctgttcggtccgccggacggcaagccggtgatcgccctgcatggctggctggacaacgccatgagcttctcgcgcctggcgccgaagctcgccgggctgcgtatcgtcgccctcgacttcgccggccacgggcattccgcgcatcgtgccgagggcgccagctacctgctctgggactacgcgctggacgtgctgatggtggccgagcaactgggctgggagcgtttttccctgttggggcactcgatgggcgccatcgtctcggtgctgctcgccggggccttgcccgagcgcatcgagcggctggcgttgatcgatggcctgattccctacactggcgaagccgacaaggcgccgcagaagctcggcgaagcgctgaaggcgcaactggcgctacgccacaagcgcaagccggtctatgccgagctggaaaaagccgtggaagcgcggatgcgcggggttggcgagatctcccgggaggccgccgaactgctcgcccagcgcggcctggaaccggtgcccggtggctatacctggcgcaccgacgcgcgcctgaccctaccgtcgccgctgcgcctgacccaggcccacgcgctgaacttcgtgcgcagcgtggaatgcccggtcagcctggtactggccgaacagggcatgctggcggtggagccgcgcatgcgggcgctgctggagaccctgccgttcgagcggcaccacctgccgggcgggcatcacctgcatctggacgatga

SEQ ID NO: 9423 - DNA, 495 bp, Pseudomonas aeruginosa
accccggtcatcaccccggcctggcgcgggaagtcgcgtttgacgatgcccggcaggagcacgccgatgatgccgatgctggcgccggccaggacgctgccggcgaacaggccgaacaccgggaacaggctgcgcaggacgatgccgccggccaggcagaagaggatcagcagcacgctgcgctcggcgccgatacgccgggccaggcgcggcgcgagcggcgcgaacaaccccaggcagagtaccggcgcggtggtcagcaggccggcggcagcggccgagaggccggtatcgtcgcgcacctggttgagcaggggggcgaggctggacagcgccgggcgcaggttcagcgccaccagcaccaggcccagcaggagcagccaggggcgtagtggcggcgccggcggaactggttcgtcgtcgacttcggcatcgatcagcagttcttccggaggatggccggggtgcgctcccggccgggcattcaaggcgtga

SEQ ID NO: 9424 - DNA, 456 bp, Pseudomonas aeruginosa
tcagtggcgagagcatcaggcagcgccggcgctcgaggtcgcagagcaggtcgatgccgacgctgcgctcggcgggacaggcgaagcgctgcacggcgctgctcaggtcctcgccccaggcggccagcaggcagagcgctgcggcggaagggcgttcgccggtttccggctcgacgccgaggcgatgcagcagttcggcgagcgtgcggcggtcgtcctcgttttcgcagcccagccacaccgggggccggatggcggcctgcggcaccggttgcggaccgggcttgtcctgcggctggccgtcgacgtagcgatagaagccctggccgctcttgcgcccgagacggccggcggcgagcaactggcgggtcagcgggtgcgggcggtagcgcggttcctggtagtactgctggtagatcgattccattaccgggtgcgacacgtcgaggccggtaa

SEQ ID NO: 9425 - DNA, 393 bp, Pseudomonas aeruginosa
ccatgcgtcgccaggtcggcagccacctctcgctgcaccgcagcgcgatcggccgggcctgcctggcggcgatgccggaggacgagcgggaattcatcgtcgggcacatccgcaagcgccacccggaagactggccggaagtgcgcaaggggctggagcgggccttccgcgactatgccgactacggcttctgcctgtcgctcggcgagtggcaacgcgacgtcaacgcggtgggcgtggccttgcaccatgagagccatgggctgctggcgttcaattgcggcgggccgagtttccatctcaagcgcgagaaactggaggacgacatcggcccgcgcctgctgcacatggtccacaacatcgaggccgccacccgctgaccgaggccggtga

SEQ ID NO: 9426 - DNA, 276 bp, Pseudomonas aeruginosa
tccaggcgatgcttgccgacagcaaggccgaagcctacgcggcgcgctgcatggtcatcgacgccgcgcggcagcgcgacgaaggccgcgatgtcggtaccgaggcgtcctgcgccaagctgttcgcctcggaaatgtgcggccgcgtcgccgaccgcgcggtgcagatattcggcggcgccggctatatcggcgactacgggatcgagcgcttctatcgcgacgtgcggctgttccgcatctacgagggcaccacgcagatccagcaactgctga

SEQ ID NO: 9427 - DNA, 297 bp, Pseudomonas aeruginosa
tccgcgccgcccagggctagcgtcgatccttcgccttgtcaccggccgtggcgcagtccccggccggttgctctcccaggcgctgtccgcgccactctttacgctttctttatgccgtccgacgcggccctgaatcgcttctttacgccccctttgcggagactttccctcaagcggcagaggccgctcgaaggagagatcgcacacatgaccgttctggattggttgtccctggccctggccacgggactgttcgtctatttgctggtggcgctgctacgcgccgaccgtgcctag

SEQ ID NO: 9428 - DNA, 1683 bp, Pseudomonas aeruginosa
gggagggcacatgaacagccacgagattctcttgatcctggcctttttcgccctggtcctggtgcctgcaccgttcctcgggcgctactgcttcaaggtgatggaaggccaacgcaatctcctcagcgcgccgctggcgccactggagcgcgtctgctatcgcctgttcggcgtcgatccggcgagcgagcaggactggaagacctacaccctggcgctgctggcattcaacctggccggcctggtcctgctgttttcgatcctcatgctgcagggcagcctgccgctgaacccgcagcacctgccgggcctggaatggacactggcgttcaacaccgcggtcagtttcgtcaccaacaccaactggcaggcctacagcggcgaggcctcgctgagctacttcagccagatggtcggcctcacggtgcagaacttcgtcagcgcggcggtcggcctctgcgtgctggtggccctggcgcgcggcatcagccgccgctccacgcggcagctgggcaacttctgggtcgacctgacccgcggcaccctctacgtgctgctgccgctgtgcctgctgctggcgttgctgctggtctggcagggcgtgccgcagaccttattcgactatgtccatgccaccaccttgcaaggcgccgagcagaccatcccgctcggcccggcggccagccagatcgccatcaagcagctgggcaccaatggcggcggcttcttcggcgtcaactcgacccatccgttcgagaacccgagcgcctggagcaacctgttcgaagtggcctcgatcatcctgatcccggcggcgctggtattcaccttcggccattacgtgaaggacctgcgccagagccgcgcgatcctcggctgcatgctgctgctgttctgcctcggcctgggcttgtcgctgtgggccgaataccagccgaatccggcgctggcgcagttgccgatcgagcagggcgcgccgatggagggcaaggagagtcgcttcggcaccgccgccagcatgctctgggcgatcaccaccaccgccgcctcgaacggctcggtgaacgccatgcacgacagcctgagccccctgggcggcatgctgccgctgctgaacatgatgctcggcgaggtgatcttcggcggcgtcggcgccggcctctacggcatgctgctgttcgtcctgatcgcggtgttcctcgccggcctgatggtcgggaggacgccggagtacctgggcaagaagctcgaggcgaaggaggtccgcctgctggtattcaccctgctggtgatgcctgtcggcgtgttggtgctcggcgccatcgccgccagcctgccggggccggcctcggcggtgaccaatcccggcccgcacggattcagccaactgctctacgcctacacctcggggagcgccaacaacggctcggcgtttgccggtttcggtgccaacacgccattccacaacctgatgatcggcctggccatgctcatcggccgcttcggatacatcctgccgatcctcgccatcgccggcagcctggcggcgaagaaggccagcccggtggggccgaacagtttcccgacccatggtccgctgttcgtcagcctgctcaccgtgaccatcctgctggtcggcggcctgactttcctgccgaccctggccctcggcccgatcgctga

SEQ ID NO: 9429 - DNA, 2112 bp, Pseudomonas aeruginosa
acaactgagcctcggcttctgaaggaatcgcacatgaacgctcagactcaggcgtccaagaacgccttgcacaaatcgctcgaacgtcgccacaacgcgtccaccagcctcgccgccttgtggcggccggcgctgctgcaagccttcgtcaagctcgacccgcgccagttgctgcgctcgccggtgatgctggtggtcgaactgaccgccgtgctcaccaccttgctgtgcttcgtccccgaccaggcggtgccgacctcggtggcgctgcagatcgccctctggctgtggttcaccgtgctcttcgcgaatttcgccgaagcgctcgccgaggggcgtggcaaggcccgcgcggacagtctcaaggccggcagccagggcctctccgccaataagcggcgcgccgacggcagtttcgagagcgtcgctgccagcagcctgcgcaagggcgacgtggtacgggtccaggccggcgagatgattcccggcgacggcgaagtcatcgaaggggtggcggcggtcaacgaggccgccatcaccggcgaatcggcgccggtgatccgcgagtccggcggcgatcgctcggcggtgaccggcaacacccaggtggtgtccgactggctgctggtacggatcggcgccaacccgggcgagtcgaccctggaccggatgatcgccctggtggaaggcgccaagcggcagaagacccccaacgaagtggcgctggacatcctgctgatcggcctgaccctgatcttcctgctggtagtggtgaccctcaagccgttcgccctgttcgccggcggcaacctgccgctggtgttcctggtggcgctgctggtgacgctgatcccgaccaccatcggcgggctgctctcgggcatcggcatcgccgggcatggaccgcctggtgcgcctgaacgtgatcgccaattccgggtcccgccggtggaaggcggccgggggaccttccacgtgctggcgctcgacaagaccggcaccatcaccttcggcaaccgccgttgcagcgcgctgtacgccgcgccgggggtgagcggcaaggaactggccgagggcgcgttgctgggctcgctggccgacgacaccccggaaggcaagtcgatcgtcgaatacctgcgcatcctgcatccgatcgaggagccgcgccgcgaggaactgacgccgatcgctttcagcgcggaaacccgcctgtccggggtcgactggaacggccaggtgtaccgcaagggggcggtggatgcggcgctgcgcttcatcgacctgccgcgggagaagatgcccgaggtgctttcgcgggaggtggacaagatcgcccagagcggcggcaccccgctgctggtggtagccaacggccggctgctcggtgccattcacctgaaggacgtggtcaagccgggcattcgcgagcgcttcgccgaactgcgccggctgggcatccgcaccgtaatggtgaccggcgacaacccgctgaccgccgctgccatcgccgccgaggctggggtcgacgacgtgatcgccgaggctaccccggagaagaaactggcgcggattcgccaggagcagggcgaaggtcgcctggtggcgatgtgcggcgacggtgccaacgacgccccggcgctggcccaggccgacgtcggcatggccatgaacgacggcacccaggccgcccgcgaggcggccaacctggtcgacctggacagcgacccgaccaagctgctcgacgtggtccaggtgggcaaggagttgctggtcacccgcggcgcgctgaccaccttctccatcgccaacgacgtggccaagtacttcgccatcctgccggcgctgttcgtcggcatctacccgcagctcgacgtgctcaacgtgatgcgcttgcaaagcccgcagagcgcgatcctgtcggccatcgtgttcaacgcgctgatcatcgtcgcgttgatcccactggccttgcgcggcgtgcgggtgcaggcggcggacgcttcgcaactgctgcagcgcaacctgctgatctatggcgtcggcggcctggtggcgccgttcctcgggatcaaggcgatcgacctgctgctgaccgccgtcggcctggcatga

SEQ ID NO: 9430 - DNA, 975 bp, Pseudomonas aeruginosa
ggcatcggagctatccataccagggtccgcgctgagtatggcggggcttccggacctcggcaaaccgctgtgctaggctgcgggatcggatttcgaggagatgacggaatgactgcggtcgcatttctcggcctgggcacgatgggctacccgatggccgggcacctgcaacgagagggctacgacgtctgtgtctacaatcgctcgtcggccaaggcgctgcgctgggtcgaggagtacgccggacggcgcgccgatacgccgcgcgaggcctgtgctggcgccgagctggtgttctgttgcgtcggtaacgacgacgacctgcgtgccgtggcgctgggcgagcagggcgccttcgccggaatggcgccgggcagcctgttcgtcgaccacaccaccgcttcggcggaagtcgcccgcgagctgtcgctgctggctgccgagcgtgagctgggctttctcgacgcgccggtctccggcggccaggcaggcgcggtcaacggcgccctgacggtgatggtcggtggcgaggaggccttctatcgacgcgccgaaccgctgttgcgcagctatgcgcggatggtccggcgaatgggcgacgtgggtagcgggcaattgaccaagatggtcaaccagatctgcgtcgcggggctgctccagggcctggccgaggcgctgcacttcgcccggtgcgccggtctcgatggcgaggcggcgatgcaggtgatcggcaagggcgcggcccagtcctggcaactggaaaaccgccaccagagcatgctggccggagagttcgacttcggcttcgccgtggactggatgcgcaaggacctgtcgatcctgctcgccgaggcgcggcgcaacggcgcgcagttgccggtcacggcgctggtcgaccagttctacgccgaagtgcaggcgatgggcggcggtcgttgggatacctccagcctgatcgcccggctgcgttcgtga

SEQ ID NO: 9431 - DNA, 774 bp, Pseudomonas aeruginosa
tcgcggagtgggaagtcatcactgccgcttgaacgggttggaagtctggctgtctcacgccatactgctgcgcatcctgcgccgaaggctcaggatcgcggcttgcagggcgtcgaccgcccggccggcgaaccgaaaataaccataaagagaggaacaggaacgatgcgtggcattttgcgtatgaccgtgctggctgccgcagtgttcggggtggccggcaatgcgctggccgaagactggaagctggccaaggacgaggatggcgtgaaggtctacctcagcagtgtccagggctccaagtacaaggcttatcgcggcgttaccgacatcaaggccgacgtggcgaccatcgaggcgctgcaggaggacgtcaagggttcctgcaagtggatccatgcctgcgccgagatgaaactcctgaagcaggaaggcgccgacgcctggacctactcgaagatcgacatgccctggccagttaccggtcgcgacgtggtcatccatgtcaccaccgagaagactgcggatggcaccgtgatccgtcaccttaaggccgatccgacctatatccccgaggaaaagggccagatccgcgtgcccaagctggtcggcgagtggaagttgcagccgaaggggcagggcgtgacggaagtgacctaccaggtggaaaccgagccgggtggcagcattccttcctggttggccaacagcttcgtggtcgacgcgccgctgaacaccctcaagggcctgcgtagcgctgccgagaagcgctga

SEQ ID NO: 9432 - DNA, 966 bp, Pseudomonas aeruginosa
cttcatcgccagttccagttgcgggtcgttgatgcccagctcctggaggacctcgtcgcaggtctgcttcatgaccttggcgcgcgggtcgaagttcttgtagacacgatggccgaagcccatcagcttgaacggatcgttcttgtccttggccttctcgacgaacttgtcgatgttggacacgtcgccgatctcgtcgagcatgcgcagcaccgcttcgttcgcgccgccatgggccggtccccacagggcggcgatgccggaggcgatgcaggcgaacggattggcgccggaggagccggccagacgcaccgtggaggtggaggcgttctgctcgtggtcggcgtggagaatgaagatgcggtccatggccttggccagcacggggctgatcggcttggtctcgcagggggtgttgaacatcatgtgcaggaagttttccgcgtagttcaggtcgttacgcggatacatcatcggctcgcccttggagtacttgtacaccatggcggcgatggtcggcatcttggcgatcaggcgatgcgcggagacttcgcgatgcttcgggttattgatgtccagggagtcgtggtagaaggccgagagggcgccgatcacgccgcacatcacggccatcgggtgggcgtcgcggcggaagccgttgaagaaggtcttcaactgctcgtgaaccatggtgtggttcttgatggtgccgacgaactgttccttctgcgcggcggtgggcagctcgccgttcagcagcaggtagcaggtttccaggtagtcggatttctctgccagttgctcgatggggtagccgcgatggaggaggacgcctttgtcgccgtcgatataggtgatcttcgactcgcaggaggcggtcgacatgaagccaggatcgaaggtgaagtggcccgtggcggtgaggccccgtacatccactacatcgggacccatggtaccggatag

SEQ ID NO: 9433 - DNA, 207 bp, Pseudomonas aeruginosa
agggataaattcgaaagtcaatttgcgcgaatccatgccgtagagccttccgtggcggggttttcgcagaaaaagggggctatttacgccttttataaaaggcccgcaatcaaccatttggcgatgggtgttttcgttgtcattagtagcctaactgtctatactcggcgtccgaccgcaaggggtattcctggcccgctttcatag

SEQ ID NO: 9434 - DNA, 444 bp, Pseudomonas aeruginosa
tgggtacctgacaagtgcacttcccgacaactagccctgttcgttagggctctcagtgtgaaaaaagccgtgaatagcaaacgacctgtaaacctagacctaaggaccatcaaactccctgtcaccgcttacacgtccattctccaccgtatctctggcgtcatcctgttcctcggtattgccgtgctgctgttcgcgctcgacaagtcgctgagttcggaagaaggcttcgagcaggtgaaggcgtgcctgaccagtcccctggccaagatggtgatctggggcctgctgtctgcgctgctgtaccacctggtggccggtgttcgccacctggtcatggacgctggcgtcggcgagacgctggaaggcggtaagcgtggctccaaaatcgtcatcgccatcgcggtggtgctgatcgttctggcgggggtatgggtatggtaa

SEQ ID NO: 9435 - DNA, 600 bp, Pseudomonas aeruginosa
acgagcgcaccagcggcgaagaagtcgctccgctcaagcgcgagctgcaaagctgcatgcagaactacttcggtgtgttccgcaccggcgagtacatgcagaagggcatcgcccagctggccgacctgcgcgagcgtatcgccaacgtcaagatcaacgacaagagccaggcattcaacaccgcgcgcatcgaagcgctggaactgcaaaacctcctcgaggtggccgaggccaccgcgatcgcggccgagcaccgcaaggagtcccgtggcgcccacgcccgtgaagacttcgaggagcgcgacgacgagaactggctgtgccacaccctgtacttcccgggtgagaagcgcgtatccaagcgttccgtcaacttcgcgccgaagaccgttccggcattcgaacccaaggttcggacttactaagggtgcccgccatgttgcaagtgagtgtttatcgttacaaccccgacaaagatgctgcgccgtacatgcaggatttccaggtcgacaccaacggcaaggacgtgatggtcctcgacgtgctggcgctgatcaaggaacaggacgagggcttctcctaccgtcgttcctgccgtga

SEQ ID NO: 9436 - DNA, 1896 bp, Pseudomonas aeruginosa
ccagcggtggcgaagtccacctggcgctggcgttcaacccgtcccacctggaaatcgtttccccggtggtcgagggttccgttcgtgctcgccaggaccgccgcaaggacagctccggcgacaaggtggtaccgatttccatccacggcgatgccgccttcgcggggcagggcgtggtcatggaaaccttccagatgtcgcagacccgcgcatacaagacgcggtggcaccatccacctggtgatcaacaaccaggtcggtttcaccaccagccgccaggacgatgcgcgttccaccgagtacgccaccgacgtggcgaagatgattcaggcgccgatcttccacgtcaacggcgacgatcccgaagccgtgctgttcgtcacccaactggccgtcgactaccgcatgcagttcaagcgtgacgtggtcatcgacctggtctgctaccgtcgccgcggccacaacgaggcggacgagccgagcggcacccagccgctgatgtaccagcagatcgccaagcagcgtactacccgcgagctgtacgccgatgccctggtgaatgccggcgtgctcagcgccgagcaggttcagtcgaagatcgacgactaccgcgacgccctggacaacggcctgcacgtggtgaagagcctggtcaaggaacccaacaaggaactgttcgtcgactggcgtccgtacctgggtcatgcctggaccgcgcgtcacgacacccgcttcgacctgaagaccctgcaggaactgtccagcaagatgctggaagtgccggaaggcttcgtggttcagcgccaggtttcgaagatctacgaagatcgccagaagatggcggccggtggcctgccgatcaactggggcttcgccgagaccctggcctacgcgaccctgctgttcgaaggccatccggtacggatgaccggccaggacgtcggccgtggcaccttctcgcaccgtcacgcggtgctgcacaaccagaaggacgactcggtctacgtaccgctggccaatctgttcgacggccagccgcgcctggatatctacgattccttcctttcggaagaggccgtgctggcgttcgaatacggtttcgccaccaccacgccgaactcgctggtgatctgggaagcccagttcggcgacttcgccaacggcgcccaggtggtcatcgaccagttcatcaccagtggcgaaagcaaatggggccgactctgcggcctgaccatgctgctgccgcacggctatgaggggcagggcccggagcactcctccgcgcgcctggagcgctacctgcagctctgtgccgagcagaacatccaggtctgcgtgccgaccaccccggctcaggtctaccacatgctccgccgtcaggtgatccgcccgctgcgcaagccgctggtggtgatgacgccgaagtccctgctgcgtcacaagctcgccatctcgaccctggaagatctggccaacggttccttccagaccgtgatcccggaaatcgacagcctggatccgaagaaggtcgaccgcgtcgtgctgtgcagcggcaaggtgtactacgacctgctggagaagcgtcgcgcggaaggccgcgaagataccgcgatcgtccgtatcgagcagctgtatccgttcccggaagacgacctggcggaagttctggctccgtacaagaacctcaagcacatcgtctggtgccaggaagagccgatgaaccagggcgcctggttctgcagccagcatcacatgcgtcgtgtcatcgccgcgcacaagaagggcctcaacctcgagtacgccggccgcgaaggctccgctgctccggcttgcggctacgcctcgatgcacgccgagcagcaggaaaaactgctgcaagacgcctttactgtttaa

SEQ ID NO: 9437 - DNA, 1272 bp, Pseudomonas aeruginosa
cgcctacgcgctgaagaaaccgaatttaaggaaacgcacacaatggctatcgaaatcaaagccccaaccttcccggaatcggtcgccgacggcaccgtcgccacctggcacaagaagccgggcgaagcagtcaagcgcgacgaactgatcgtcgacatcgagaccgacaaggtggtcatcgaggttctcgccgaggctgacggcgtgctggccgagatcatcaagaacgaaggcgacaccgttctgagcaacgagctgctcggcaagctgaacgaaggcggcgccgccgctccggccgctccggctgccgctgcgcccgccgccgctccggctgcacaggccgccgctccggccgccgctggcggcgacgacgccatcctgtccccggccgcgcgcaagctggccgaggaagccggcatcgatccgaacagcatcgccggcaccggcaagggcggtcgcgtgaccaaggaagacgtggtcgctgcggtcgaagcgaagaagaacgccccggccgccccggccaagcctgccgccccggctgccgaggcgccgatcttcgccgccggcgaccgtgtcgagaagcgcgtgccgatgacccgcctgcgggccaaggtcgccgagcgcctggtcgaggcgcagtccgccatggccatgctgaccaccttcaacgaggtcaacatgaagccgatcatggacctgcgttcgaagtacaaggacctgttcgagaagaagcacaacggcgtgcgcctgggcttcatgtccttcttcgtcaaggccgccaccgaggcgctgaagcgcttcccgggggtcaacgcttccatcgacggcaacgacatcgtctaccacggctaccaggacatcggtgttgccgtttccagcgaccgcggcctggtggttccggtactgcgtaacgccgagttcatgagcctggccgagatcgagggcggcatcgccaacttcggcaagaaggcgaaggaaggcaagctgaccatcgaagacatgaccggcggcaccttcaccatctccaacggtggcgtgttcggttccctgctgtcgaccccgatcgtcaacccgccgcagaccgctatcctcggcatgcacaagatccaggagcgcccgatggccgtgaacggccaggtggtgatcctgccgatgatgtatctggcgctgtcctacgaccaccgtctgatcgacggcaaggaagcggtgagcttcctggtggcgatcaaggacctgctggaagatccggctcgcctgctgctggacgtctga

SEQ ID NO: 9438 - DNA, 1173 bp, Pseudomonas aeruginosa
acaagcatgaatctccacgaatatcagggtaagcagctgttcgctgaatacggcctgcctgtatccaagggctttgccgtagacacccccgaagaggccgcagaagcctgcgacaagatcggcggcagcgagtgggtcgtcaaagctcaggtgcacgccggcggccgcggtaaagcgggcggtgtgaagctggtgaagagcaaagaggacgccaaggcgttcgcccagcagtggctgggcaagaacctggtgacctaccagaccgacgccaacggccagccggtcagcaagatcctggtggagtcctgcaccgacatcgacaaggagctgtacctcggcgccgtcgtcgatcgttccagccgccgcatcgtgttcatggcttccaccgaaggtggcgtggacatcgagaaggtcgcccacgacactcccgagaagatcctcaaggctaccatcgacccgctggtcggcgcgcagccgtaccagggccgcgagctggccttccagctgggcctgaagggcgaccagatcaagcagttcacccatatcttcgtcggcctggcgaagctgttccaggactacgacctggccctgctggaagtgaacccgctggtgatcaagaaagacggcaacctgcactgcctggatgccaagatcaacatcgacagcaacgccctgtaccgtcagccgaagctgcgcgccatgcacgacccgtcccaggacgacgcccgtgaagcccatgcgcagaagtgggagctgaactacgtcgcgctggaaggcaacatcggctgcatggtcaacggcgccggcctggccatgggtaccatggacatcgtcaacctgcacggcggcaagccggccaacttcctcgacgttggcggcggtgcgaccaaggagcgcgtgaccgaagcgttcaagatcatcctgtccgacagcaacgtgaaggctgtcctggtgaacatcttcggcggcatcgtgcgttgcgacatgatcgccgaaggcatcatcggcgccgtcaaagaagtcggcgtgaaggttccggttgtcgtccgcctggaaggcaacaacgctgaactgggtgccaaggtcctggccgaaagcggcctgaacatcatcgcggcaaccagcctgaccgacgctgcccagcaagtcgtcaaggccgcggagggtaagtaa

SEQ ID NO: 9439 - DNA, 1686 bp, Pseudomonas aeruginosa
agaaggcctgatttcccgggttttctgagttccaggacgaaggccaccgcctcacagcggtggccttcgtcgttctatcgcatccgtcaaacgaatgttgccgcgatgcgctatcattgccaacggttcgtgtccgacaaaaccccgggcgcgccacgcatcatcccgcaggccagtgcgcccgcagctataacgccacatggccctcaaaaggggtcgggcggcttgaccggtcctcctcatccggaaggacgttgtttcctaacacccccaaagggaaaccccgaacaaccgagacttctgccagtggtacatcctcctatgactcatttgaaagggttcgacctgctcgcccttggcttcatgacgttcgcgctttttctcggcgcgggtaacatcatctttcctcccagtgccggcatggcggcgggcgaacacgtatggagcgcggctttcggcttcctccttaccggtgtcggcctgccgttgctgacggtggtcgccctggcccgggtcggaggcggtattggccgcctgacccagccgatcgggcggcgcgcgggagtggcgttcgccatcgccgtctatcttgccatcggcccgctgttcgccaccccgcgtacagccgtggtgtccttcgagatgggcgtcgcacccttcaccggggacggcggcgtgccgttgctcgtctataccgtcgcttacttctccgtggttctgttcctggtgctgaacccgggtcgccttgtcgaccgggtcggaaaggtcatcacgccggtgctgctgtcggccctgctggtccttggcggcgcggcgatcttcgcgccggcgggagagatcggcagcagttccggcgagtaccagagcgcgcccctggtgcagggcttcctgcaggggctacctgaccatggataccctcggtgcgctggtcttcggtatcgtcatcgccaccgccattcgcgaccgcggcatcagcgacagccggctggtcacgcgctattccatgatcgccggggtcatcgccgccaccggcctgtccctggtctacctggcgctgttctatctgggcgccaccagccagggcatcgccggcgacgcccagaatggcgtacagatcctcaccgcctatgtgcagcagacctttggcgtttccggcagcctgttgctggcggtggtcatcaccctggcctgcctgaccacggcggtagggctgatcacggcgtgcggcgagttcttcagcgacctgctgccggtttcgtacaagacggtggtgatcgtgttctcgctgttcagcctgctggtcgccaaccagggactgacccagttgatcagcctttcggtaccggttctggtgggactctatccgctcgccatcgtgctgatcgccctgagcctgttcgaccggctctgggtgtcggccccgcgggtgttcgtgccggtgatgatcgtcgcgctgctcttcggcatcgtcgacgggctgggggcggccaagctgaacgggtgggtgccggacgtcttcgccaagcttccgctcgccgatcagagccttggctggctgctgccggtatccattgcgctggtcctggcagtcgtttgcgatcggctgctgggcaagccgcgcgaagcggtcgcctgagacgtcaggcgaaccccaggaaggccgcctccgggcggcctttttcatga

SEQ ID NO: 9440 - DNA, 1371 bp, Pseudomonas aeruginosa
aaaagcccgcttgcgcgggctctttcagggtacgtcaacgagaacttattgctggttctgttgcggttgctccggagtcggtgccggagtctgcggggttgccggagtgtcgctcgacggcgccggggcgctgggctcggcagggggagtatccggagcgctcggctgggtctcggtagccggagctgccggggccgctgccttgtcttcctctttcttgtcgcaagcggccaggccaaggctggcagcgagcagcagggcaagagttacggtctttttcatcgtttagcctccatgtgcggctttcctcgttgtagccctttgaacatttgcgctggcgtgaagttccacacacttcgactatttcgatcgttatgtccaaaaccccggctgccggggctttggcggcagggtatgattcgccctccagaaaactcccagcaaggtcgccgtcatgtcggaaaatcctctcctcgagcgcgcccggcgctttctctcggccttgcgtcattgccaggtgctggggttgacggtcgaggccgccgacgagaaaggactgaccctgcgcctgccctacagccaggcgatcatcggcaacccggaaagcggggtcgtccacggcggcgcgatcaccaccctgatggacaccacctgtggtatttccacggtctgcgtgctgccggacttcgagatctgcccgacgctcgacctgcgcatcgactacatgcatcccgccgaaccgcacaaggatgtctatggcttcgccgagtgctaccgggtcacgccgaacgtgatcttcacccgcggcttcgcctaccaggacgatccgggccagcccatcgcccatgtcgtcggcgctttcatgcgcatgggcggttcggcccgcgccggggcggccaggccggccgcgcagggaggtgcggcatgagcccgaccagcctcgagcaactggtccgcgacgcgcgtcggaacaacgactacagcccgctggtggagctgatcccgtacgccaagctgctcggcatcgaatgcctgcgcctgggcgacgacatggtcttccgcctgccggcgaacaaggacaacatcggcaacccgaccctgccggccatccatggcggcgtgatcgccggcttcatggagcatgcggcgatgttgcacctgctgaccttcatgagcattccgcacctgccgaagatcatcgatttctccatcgactacctgcgtgccgggcacttccgcgatacctacgcgcaatgccaggtctggcgccaggggcgacgggtggcgaacgtcgcgatcaacgcctggcagaccacccagggcgagcccatcgccaccgcgcgggcgcatttcaaggtggacgagccgtga

SEQ ID NO: 9441 - DNA, 1269 bp, Pseudomonas aeruginosa
gccgtacgctgcggaaagtgggctgaggatatcgcgatggatgccttgctgattctgggcggcctgctgctgatggtcgccggctatatctgggtcatcgtcctggccttcggtaccggtctgctgtggggttacggcagccttttcccgccggtggcgctggcctatatcggcgtgcactggcgtacggcgcgcaagggcgtcgggctggccgcgctgggttgcatcccgctggtggtcggcctggcgctgctggccagtcacgacgctgcgcggctggaggcgatcctcagcctgcgctggctgaaaccggaggccaggccgccggcggaactgtccatcgcgctcagcggggagttcaacggcaagcctttcgcgccgcagagcggcgagttgattggcggcgtgctgagcctgcgccaggggcacgatttctacgcccagcgcgagctgcagatccgccttccggcacagccgctcggggcgctgcgcctggacgtgctgcccgaggacggcggcgcgttgccagaagtcgagctgagctggctgcaaccggatcaggacctgcccgaggcgcgtcgtctcctgcgtggctataccttgcacctggacctgcggcccaaggcgccgaaccgcctggagggcgagttccacctgagcctgccgagcgactaccggaccaccctcagcggccacgtcgagctgtataccgaccggctgcgctatcggcacggcaaggtcgacctgggctacgactccgacgataccctggccctggtcttgcgcgactatctgcagcgacgtttcgccagccgcgacgtcagcctcgtgcgggcgccgtcctggcgcgcggccagccatgcgcggccgctgcgtatcgaggccctggtggccggccaggctcaggtgctggagctgacgctggagaagaacgcccggcgggagtggacggtgcgcggcgacgcgttccccgccttgccggcggagcctgcgaccgtggccgcggcggcggcgccgcccgagccgcaggcgctgccggcgccgggtaacgccaccctcgacctggagctggtccaggtcgaaccgcagcgctacagccagcgcctggtcaaggccactacggtacgcgggcgtatcgccgagggccgtttcaccggcctcgacagcgaggggcgcctggtgatccgccgggaaatgcccggtgcgggggaggcgagctacctgttgcgcccggcggagatcgcccgtctcgaactgctcgaacgctag

SEQ ID NO: 9442 - DNA, 1980 bp, Pseudomonas aeruginosa
aaagccggaagaaggccccacctaggggacatccgccgtggtacgcggcttatgtcattgatggagcttggagcgatgagcgtggaaacccaaaaagagacactgggctttcagactgaagtgaagcaactgcttcacctgatgattcattctctctattcgaacaaggaaatcttcctccgcgaactgatttccaacgcctcggacgccgccgacaagctgcgtttcgaagccctggccaatcccgagctgctcgagggcggcgccgagctgaagatccgcgtcagcttcgacaaggaagccaacaccgtcaccctggaagacaacggcatcggcatgagccgcgaggatgtggtgactcacctgggcaccatcgccaagtccgggaccgccgacttcctgaagaacttgtctggcgaccagaagaaggattcgcacctgatcggccagttcggcgtcggtttctacagcgccttcatcgtcgccgacaaggtcgatgtctactcccgtcgcgccggccagccggccagcgaaggggtgcactggtcgtcgaagggcgagggcgagttcgacgtcgctaccatcgacaagcccgagcgcggtacccgcatcgtcctccacctgaaaaagggcgaggaggagttcgccgatggctggcgcctgcgcaacgtgatcaagaaatactccgatcacatcgctttgccgatcgagctgcccaaggaattccacggcgaagaggcggacaagccggccgagccggaatgggaaacggtcaaccgcgccagcgcgctgtggacccgtccgcgcgccgaggtgaaggacgaggaataccaggagttctacaagcacgtcgcccatgacttcgagaacccgctgagctggagccacaacaaggtcgaaggcaagctggaatacacctcgctgctctacgtgccgggccgcgcgccgttcgacctgtaccatcgcgaagcgccgcggggcctgaagctgtacgtacagcgcgtgttcatcatggaccaggccgacgagttcctgccgctgtacctgcgcttcatcaagggtgtggtcgactccaacgacctgtcgctgaacgtctcccgggaaatcctgcagaaggatccggtgatcgactcgatgaagtcggcgttgaccaagcgcgtgctggacatgctggagaagctggcgaagaacgagccggagcagtacaagaccttctggaagaacttcggccaggtcctcaaggaaggcccggcggaagacttcggcaacaaggagaagatcgccggcctgctgcgcttcgcctccaccggcgacgattcgggcgagcagagcgtagcgctggccgactacatcggtcggatgaaggaaggccaggacaagatctactacctcaccggcgagagctactcgcaggtgaagaacagcccgcacctggaagtcttccgcaagaagggcatcgaggtgctgctgctcaccgatcgcatcgacgagtggctgatgagctacctgccggagttcgacggcaagcagttcgtcgatgtcgcccgcggcgacctggacctgggcagcctggactcggaagaggacaagaaggcccaggaagaagtcgccaagagcaaggaaggcctgatcgagcgcctgaagaaggtgctcgacgagcaggtcagcgaagtccgcgtttcccaccgcctgaccgattcgccggcgatcctcgccatcggcgaacaggaccttggcctgcagatgcgccagatcctcgaggccagcgggcagaaagtgccggactcgaagccgatcttcgagatcaacccgcagcatccgctgatcgagaagctggatgcggagccggatgaggaccgcttcggcgagctgtcgcatattctcttcgaccaggccgccctggccgcgggggacagcctcaaggatccgggcgcctacgtacgccgactgaacaagctgctggtggagctgtccgcttaa

SEQ ID NO: 9443 - DNA, 1542 bp, Pseudomonas aeruginosa
cccgagcaggtcctcgctgaccagtacctggccgtcgcaggccggcgaggcgccgataccgatgcaggggatcgccagttcttcgctaaggcgacgggccagcggctcgcctacgccttcgatgaccaccgcgaaggcgccgccgcgctgcatggcgaggccgtcgcggcgtacccgttctgcgctttccgggtcacgcccctgggccttgaagccgcccatggcgttgacctgctgcggcatcaggccgatatgggcgagcaccggtatgccacggcgtaccaggaagtccacggtttcttccatttcctcaccgccttccagcttcaccgcctgggcgccgctgtcggccagcaggcgtgcggcgttgcggaacgcctgtcggggcgattcctggtagctggcgaacggcaagtcggccaccacgcaggcgcgccgactgccgcgcatcaccgccagggtgtgggcgaccatcatctccaggctcactccccagggtgctgggcatgccatagagcaccatgcccagcgaatcgccgactagcagcaggtcggcatgcggatcgaggaggcgggccatgggcgtgctgtaggcggtcagcgccaccaggctgccggcacccttgcggcgctggatatcgggaacggacaggcgatgttgcgggcgatgactgctcatggcgtggctccggtttgtctatggggagccacacgataccatcggccgcgcaccgctcactcgacggatggggacaaccgatgccgcaaacgggacaagaacgcgacctgccgcgattccgcagcctgccctgcgcggtgtacctgcgcgccttcgagatgcccgccgggcaccgggtggagatgcacgagcacccctggggccaactgatgtacgccgccagcggcaccttgcgcgccagcaccgagcggcacagctatctggtgccggcgcagcgggcgctgtggattccgccgggcgtccggcacgccgcggaggcttgcaaccctgtgctgttccgcagtctctacctggatcgttcgctgcccggcggttgccgggtactggaggtgtccggcctgctgcgcgaactgttgctgcgggcggcggagtttccccgtgaatatccgccgggtggcgaggccgagcgtctcatgcaggtggtcgccgatgaggtcgggcgccttcgcgaggcgccgctgaacctgccgttgcctggcgacccgcgcttgcgccggatcaccgacgcgctacaggcggatcccgccgatccgcgcggcatctcggattgggcgggactggtgggggcgtcccgacggaccctggcgcggttgttccgcgagcagacccagttgtcgtttcgcgagtggcgccagcgcctgcgtctgctcaacgcggtcgccgcgctggaggagggcgccagcgtgacgcgggtggccagcgaccttggctacgactccacctcggcgttcatcagcctgttccagcgtcatttcggccagacccccggttgcttcgcccgctccctgcgcttgcccaactga

SEQ ID NO: 9444 - DNA, 732 bp, Pseudomonas aeruginosa
tccgcagcaggttgtccgggctgtccgcatgcacattgctgttcagcgccagggatggacgcacgccgaagaagcgcggtccgtcgccgtcatggtggcaggccaggcaggccccggcgaacaggcgcgcgccgctgccgctgggcggttgcacgcggccgtagccctgccggtcgaggcgttgcgcctgttgctgatcggtttccccggccggggcagcggcgtaggacgcaaggtaatgggccagggcccgcaggtcctcgtccgactgcttggccaggccttcgccgaccactggcgccatcggcccgctggcgaccccgtggtaggccgaatagccgtggcggaggtaggcgtagagggcctcctcgctccaggcgatgggcgccggcgaactggcgttcaaggctggcgcggtccagccctccgcctcgccgccggcgaagtgcgcgctgccggacttttccgcgccgagcgcattgcgcggcgagtggcaggcgctgcaatggccgaggccttcggcgagataggcgccgcggttccattgctggttgcgcgtcggctcgtcgcggtaggcgccgggctccaggaacagcaggttccagccggccatcagctggcgttggtcgaaggggaacggcagctggttggcaggcgtttcgctgtgcaccgccggctggctcatcaggtaggcgtacagggccttcaggtcttcgtcgcgagtcctggtga

SEQ ID NO: 9445 - DNA, 1200 bp, Pseudomonas aeruginosa
atcacccgttcgccagccccggcatgccaggccagcaggccgaacagcagggccagccagcggagcggcgaaccctggccgagcggcagcggtctatgttcactcaggcctatcaggaggaatgccatggctggcccccgtacgcgtgccctgttttcgacattgttcgccctgtccctggtgacatccttgacccatgccagggattatcgctacagcgacgctcacgtgcactatgtggattttttccaggaaagcgaaggcatgccgcggctgctggaggcgatggacaaaggccgggtcgaccatgtgatgctcagcggcgtcgcggtcgccaagaaatggcacgaggacgagccgaagcggccgcgctactacgctggtgacgatgccggagcctattggtacagcgccaccgacgtgatcgtggcggcggcggtgaaatccctgccagccgagcagcggcggcgcgtgcatccgttcctgaccggtttcaacccgaccgacaagaacgccgacgcgcacatccgtcgcatgctggagctggacccgggactctggcagggcatcggcgagatctttacccgtcacgacgacctcaccgcgctgacctacggcgacgtgccgagggccaacaacgaggcgctggcgcgggtctatcacctggccgccgaattcgacctgccggtgttgctgcacgccaacgtcacttccaagcgcgaacgcaacccgctgtacctggcggaaatcgaggagcccctgcgcaatcacccgcatgtgcggttcatctgggcccatgccgggaccagcatggagatccatcgccaccagaagaaactggacttcctcctgccgacccttcgggcgtctgctacagcgctacccgaacctctacatcgacctgtcctggtcggtgttgcgcccgtacctgctggacgagcagggcaagcccgatccgcagtggctggcactggtcgagcggtttccgcaacgcttcatgctcggttccgatgtggtcggccagttcgacagcctgcccgagttgatggcgagcttcgatccgttcctcgacgccttgcccgagcaggtcgctcgccaggtggcgcgggacaactttctggcggtgctgccgcgccagcccgccgatccgcgaggcgaataacccggattcgtcatcagtctgtcatgccggcgtcatag

SEQ ID NO: 9446 - DNA, 480 bp, Pseudomonas aeruginosa
gtcatgtccttcatccgttcttgcatcagtcgttccgtcttcctgctcggcgccggcgtcgccgtggcggcgcaggccgaggtgcgtatcgacggccccatcgaatatggcgtgttcgaaagccgctaccaggatttccagcccggcgaacgggtattgacccgtagcgagcagaacatccagcagaccaccgaagtcccggccaagctcggcaccaagttcggcatgcgttatcaactcagcggcaagcaggaaggcgatacgcctttgacgctgctctacctcaccccgggcgtggtcactccggatggtcagcggcatgacaagttcgaagtggtgcaaaaactggtgccgggcgcgccgaccgatgtcatggcctacgaattcaccgagccgcacgaagtggtgaagggcgaatggcggttgatggtgttccagggcgatcgcctgctggcggagaaatccttcgacgtgcgctga

SEQ ID NO: 9447 - DNA, 1092 bp, Pseudomonas aeruginosa
gacggcgcacggcatggtcagacgacgaagcgggtgaccatgttgttcaggtcgatggccagttgcgacagttcctggctggcggcggcggtctggttggagccggcggacgtctgcagcgagatgtcgcggatgttcaccaggttgcggtcgacctcgcgggccacctgggcctgctgctcggaggcgctggcgatcaccagggtacgctcgttgatctggccgacccgctccgcgatctcgttgagcgccaggccggcggcttcggcgatctccagcatgttgcgggcgcgtacgctgctgctgtccatggcgccgaccgcggcgccggtgccttcctggatgttggcgatcatctgctcgatctcgcgggtggattcctgggtgcgatgggcgagggcgcgaacctcgtcggcgaccacggcgaaaccgcggccctgctcgccggcgcgagccgcctcgatggccgcgttgagcgccaggagattggtctgttcggcgataccgcggatcacgtcgaggaccttggaaatgtcctgggccttttccgccaggccgccgaccagcgccgaggtattgtccacttcttcgctcatcaggcggatcgcctggaccgtctccagtacccgctggcgtccgttctgcgccgattgctcggaggcggacgaggcgtccgaggtggagctggcgttgcgcgccacttcctcgacggcggcggtcatctcgttgaccgcggtggcggccatctggatttcgtcgttctgctgggtcagcgagcggttgccctgctcggtgacggcgctgagttcctccgcggcggaggccagttgggtcgccgagctgccgatctgctggatggtctggcgcagttgtgcctgcatgccctggagggcgaccagcagcttggccggttcgtcgcggccagaggtgtcgatgcggctggtgaggtcaccggaagcgatcacctcggccactcgcagcgcctcgccgatcggttgggtgatgctgcgggtgaacagccaggccagtaccacggtagcgaggccggcgaccagcagtacgccgatcactgcggcgaaggcgctgtcatag

SEQ ID NO: 9448 - DNA, 1119 bp, Pseudomonas aeruginosa
gtcggccacttccgggtcgagttcgtcgatgttggcggagccggcgatgaagccgccctccatcatcagcaggcaatagatcgcctcgtgcacgccggcggcgcccagcgagtggccggacaggctcttcgtcgagctgatggccggcgccttgtcaccgaacacttcgcgcacgcctcggatctcggcgacgtcgccgaccggggtggaggtgccgtgggtgttcaggtagtcgatcggcgcgtcgacggtggccagcgcctgctgcatgcagcggatcgcgccttcgccgctcggggcgaccatgtcgtagccgtcggaggtggcgccgtagccgacgatctcggcgtagatcttggcgccgcgcttgagcgcatgctccagctcctcgaccaccaccatgccgccgccgccggcgatgacgaagccgtcacgcttggcgtcgtaggcgcgggaggccttttccggcgtgtcgttgtactgggtggagagggcgcccatggcgtcgaacaggcagctctggctccagtgttcctcttcgccgccgccggcgaagaccacgtcctgcttgcccaactggatctgttccatggcctggccgatgcaatgggcgctggtggcgcaggcggaggagatcgagtagttgacgcccttgatctggaacggtgtggccaggcaggccgatacggtgctgcccatggtgcgggtcacgcggtatgggccgatgcgcttgacgcctttctcgcgcagggtgtcgatggcttccatctggttcagggtggaagcgccgccggagccggcgatcaggccggtgcgggggttggaaatctgttccggagtcaggccggagtccttgatcgcctgctccatcgccaggtaggcgtaggcggcggcatcgcccatgaagcggaagaccttgcgatcgatcagctcttcgaggttcaggtcgaccgaaccggaaacgtggctgcgcaggcccatctcggcgtaggacggattgaagcgaatgccgggccgacccgcacggaggttggcggaaacggtgtctttgtcattgccgaggcaggaaacgatgcccagaccggtgataacgacgcgacgcatgcggataacccttag

SEQ ID NO: 9449 - DNA, 1314 bp, Pseudomonas aeruginosa
tcgccagcatgcgggtacggatgtcccagccgtggcgctggctcatggttcttctccttcggcgaggcgccggccgaggtcggcgtcgctggccaggtcgatacccagggaacgggctacctgccgattgccgagcaccttgaaatgccctggatagaggctgaggggccagtgcctgggcgcctggccgagcaattcgtcgagggtgtccagccaatcctcctggtcgctgtagctgctcgccaggctgccggccttgacgaaggctgcggtggggccgagcagcgcgcggttcttggcgtagctgccgagcagcaggctcttgatgctctgcgagttgtacagctgtttgtcgtcgatgccgagcagcaggtcactattgccgagcaggaactgcagcgggcgcgggtcgtcgttgccgctgctgctggcgacgaacagctggagcccctggctgcgggcctcgcggcgaagctcgtcgaggaggaattcgctgtccttgccgtagagcacgccgatgcgctggatgcccggcaggatcaggcgcgccaggcggagctggcgggacgccggcgggtcgctccagagtacgcagagacctccgacgccgtgtccgccatgtccgttggcgcctggcagcaggcgctggccatcgacccggttgagcagcagcgccagggtcggcggcgcccggtgctggcgcaggcgccaggccagggcctcggggccgagcaggagcaggcgggtgtcgtcggcgaagaccatcccctccgccagggccgcgggcgtgcgcagttccacctggtcctgcggccgtcgctgcgccagggcatcgcgaaaggcgttcaccgcggccccctggttggcgctgaccaagaccagttgcgcggcctcgccgacatgcgggagacagcagaagacgagcgcgagcagcgcctggaaagcccggcgggcggggcgcaagcgacgcatctagaacgtcacctcggcgctgaagtagagcaggtggcggctgtcgtagcggttgtcgggaaacgtcagcggttcgtcgtcgagacgctgctggagcacgccggccagttccagggcggccttgcccaggggaatgcgcttggccaggcgcaggtcgacgcgttcgaaacgatgtccattgagcgagtcgtcgccataatagaagagggcgctggaccagccttggccccagtcgtgcatccagccggccgagccgccgtggcgggcggtcaggcgccggtcgtagcgactggtggcgtcgtagtcgagataggcgtaggtggcgcgcaggcggtcgcgtag

SEQ ID NO: 9450 - DNA, 1026 bp, Pseudomonas aeruginosa
atcatgacagagcagcaaccgattgccgtgctcggcggcggcagtttcggcaccgccatcgccaacctgctggccgagaacggccaggcggtccgccagtggatgcgcgacccggagcaggccgaggcgatccgcagccgacgcgagaacccgcgctacctgaaaggggtcaaggtgcatcccggggtcgagccggtcaccgacctggagcgcaccctggccgattgccaactgatcttcgtcgccttgccctccagcgccctgcgcaaggtgctgcaaccacaccaggcggcattgacggacaagctgctggtgagcctgaccaagggcatcgaggcgcacaccttcaagctgatgagtgagatcctcgaggaaatcgccccgcaagcccgcatcggggtgatttccggcccgaacctggcgcgcgagatcgcagagcacgagctgaccgccacggtggtcgccagcgaggacgacgagctgtgcgcccgcgtccaggcggccctgcacggccgcaccttccgcgtctacgccagccgcgaccgcttcggagtggaactcggcggtgcgctgaagaacgtctacgcgatcatggccggcctggccgcggcgatggacatgggcgagaacacccgcagcatgctgattacccgcgcgctggcggaaatgacccggttcgccgtcaagctcggtgccaacccgatgacctttctcggcctcgccggcgtcggcgacctgatcgtcacctgttcctcgccgaagagccgcaactaccaggtcggccacgccctcggcgaggggctcagcctggaggaggcggtatcgcgcatgggcgagaccgcggagggtgtgaacactctcaaggtactcaaggaaaagtccgacgagatgcaggtgtacatgccgctggtcgccggtctccatgcgatcctcttcgaaggccgcaccctggcgcaggtcatccagctgctgatgcgcggcgagccgaagaccgacgtcgatttcattcccaccaccggcttctga

SEQ ID NO: 9451 - DNA, 816 bp, Pseudomonas aeruginosa
cgaggagaccgccatgtccgcagacccgcaagcacgcgaatcgatcgccatccgcatcctctggatgctgctgttcgtcctggtctggcaggtcgccgaactgctcctcggggcggtggtggtgatccaactggtctaccgactgatctacggcgcgccgaacggcagcctgatggctttcggcgacagcctcagccagtacctggcgcagatcggccgtttcggtaccttccacagcgacgagaaaccctggccgttcgccgactggccgagcgcccgcgccgccgagggcgaggccgcccacagcgtgccgcccgccgcgcacccggcgcgcgacgaagagccgaagttgtgaaactctggctgttgcgccacggcgaggccgaaccgcacgccagccgggattccgagcggcgcctgaccgcccatggacgcaaggaggtgctgcagagcgccgcgcggctggccgggttgccgctggacgggattctcgccagcccctacgtgcgcgcccagcagaccgccgagctggtgcgcgaggcactgggcctggtcgagccggtcggcaccgcgccctggttgacccccgacgacgatccgcgcgaggtgctcggtttcctcgacgagcgcagcgagcgcaatctcctgctggtcagccaccagcccctggtcggggcgctgggcggtctgctggtgcatggcaaccggcgcgatccgttgccgatgagcactgcctcgctggccgagctggaaggcgacttcgccgccgccgggctgatgaccctggtctcgctgcatcacccgcggcacggctag

SEQ ID NO: 9452 - DNA, 1731 bp, Pseudomonas aeruginosa
tggaatattcgaccaagcaagtgcttggtcgatctcccagaacaacaacaacggaggcggtacgtggtcactgcaaatcgtctgccgctcgaagtcttcttcgagcgcgaaaagcgtcatccgcaacggcgttacctggtgcagcccatcggtggcggccgggtcgaggagctgagctggggcgaggtgggcgaccaggcgcggcgtgcagccgcctggttgcgcagcctggatctccccgccggcagccgtatcgcgatcatctcgaagaactgtgcgcactggatcgtcactgacctggcgatctggatggccgggcacgtttccgtccccctctatcccaatctcaccgccgagtcggcgcgccaggtgctggagcattccgagtcggcggtggtcttcgtcggcaagctcgacgactggccggcgatggcgcccggagtccccgagggcataccgaccgtggccatgccgttgcacccggaagggcgtttcgaccgccagtggatcgacctgcatgcctgcgcgccgctcgaaggcgacacgccgaccgccgccgagcaactcgccaccctgatctacacctccggaaccaccggcgtgcccaagggggtgatgcacaacttcagcagtttcgccttcgccgccagccgcggcgtggaactgttcggcacccgcgaagacgaccggatgctctcctacctgccgctgtgccacgtggcggaacggatgttcgtcgagatggggtcgctctacgggggaaccacggtgttcttcgccgaaagcctggacaccttcgtcgaggacatgaagcgtgcgcggccgaccctgctgttcggcgtgccgcgcatctggaccaagttccagatgggggtgtattcgaagatgccggcgcagaagctcgaccgcctgctgaagctgccgatcctcggccgcatcgtcggtcgcaaggtgctcgccgggctaggcctggacgcggtgcgctacgcgctctgcggcgcggcgccggtacccgaggcgctgctgctctggtatcgccgcctgggcctggatgtgctcgaggtctacgggatgaccgagaacagcggttactcccacgtctgccggcccggccggcagaagaccggctggatcggccagaacagccccggcgtcgaggtacgcatcagcgacgagggcgaggtgcaggtgcgtagcggcgcgaccatggtcggctactacaaggagccggagaagaccgcagaggtgctcaccgccgacggtttcctgcgcaccggcgacaagggcgagcaggacgccgaaggcaacctgcgcctgaccgggcggatgaaggaaatcttcaagaccagcaagggcaagtacgtggcgccggcgccgatcgagaaccgcctggcggtacacgatcgcatcgagcaggtctgcgtggtcggcgagggcctcagcgcgccgttggggctttgcgtgctctccgaggtcggtcgccgggaggccctcaacgggacccgcggggcgctggaaagcagcctgcgggcgcacctggaacaggtcaacggtgcgcttgacaagcacgagcgcctggtcggcctggtcctggtgcaggaaacctgggcggtggacaacggtttcctcacgccgaccttgaagatcaagcgcaatatggtggaaggtgcctatggctcgcgcttccacgaatgggtggaacgccgcgaggccgtgctctggcacgaatga

SEQ ID NO: 9453 - DNA, 540 bp, Pseudomonas aeruginosa
ctcccaccgacgggaagcccttggcttcccccttgcgcaaggaattcccatgagcctctggcgacaaatgcccgacctggagcaactgaacgcctcgcagaagaacagcatcggcgacctgcttggcatccgcttcgaagccttcgacgacgagtcgctgaccgccagcatgccggtcgactcgcgtacccaccagccgttcggcctgctgcatggcggcgcctcggtggtcctcgcggaaagcctgggctcgatggccagctacctgtgcgtcgataccagccagtactactgcgtcggcctggaagtgaacgccaaccacctgcgtggcctgcgcagcggccgggtcaccgcggtggccagggcgatccacctggggcgcaccacccatgtctgggacatccgcctcagtggcgacgacggcaagccgagctgcatcgcccgcctgaccatggcggtggtgccattggcgggcagggcgggctgagcgcggtccgcaattttgtccaagatcgttccgtcccgcgggcggtagagtag

SEQ ID NO: 9454 - DNA, 531 bp, Pseudomonas aeruginosa
cctggtccgcgacgagcgtctgcagcagcgcctgcgtcagttgcacctgggcatgctcggcggagcggcggcgctggagaaccgtctggccctggaagagcacctctggcaggcgctggcctgcctgctcagcctgggcagcagcctgcgcctggaggagggcgaccgggaaggcttcggccagcgcgactggacgcggctgcgcgactggctggagtcgcgcctggagtacccgccgaacctggaggaactggccgccttctgcggcctgagcccctggcaggtgctgcggcgcttccgccgtcactgcggcctgccgccccaccagtggctgacccaactgcgcctggagcgcgccttgccgctggttctgcgcggcgagcagccattgagccaggtggcccagcagttcggtttctacgaccaggcgcacttcagccgtctgttccggcgcacctatgggttaccgccggcgcgcctgcgccagcgctgattcgcgttttcctttccgatccctttttcgtggagtag

SEQ ID NO: 9455 - DNA, 1101 bp, Pseudomonas aeruginosa
cgtgccgcacagcagtccggggcgtccacgacagttgcaggtgccgctggcgatggtgcgcgggcggcacagcaaggtggtgttgccgcaccacacccggctgatccgggcgatgccgcgcggcgagttcatgtcgctgcccggcggccacatgttcccgctggagcgcccgcgggaaaccgccgaactgctgaaaggcgtgttcgatcgctggtcgcgggcgaccgaggagcgttcggcatgagcctgcaggtcgaggaagtacgcatcagcctgccgcacatcgaactggccgcgcatctgttcggtccgccggacggcaagccggtgatcgccctgcatggctggctggacaacgccatgagcttctcgcgcctggcgccgaagctcgccgggctgcgtatcgtcgccctcgacttcgccggccacgggcattccgcgcatcgtgccgagggcgccagctacctgctctgggactacgcgctggacgtgctgatggtggccgagcaactgggctgggagcgtttttccctgttggggcactcgatgggcgccatcgtctcggtgctgctcgccggggccttgcccgagcgcatcgagcggctggcgttgatcgatggcctgattccctacactggcgaagccgacaaggcgccgcagaagctcggcgaagcgctgaaggcgcaactggcgctacgccacaagcgcaagccggtctatgccgagctggaaaaagccgtggaagcgcggatgcgcggggttggcgagatctcccgggaggccgccgaactgctcgcccagcgcggcctggaaccggtgcccggtggctatacctggcgcaccgacgcgcgcctgaccctaccgtcgccgctgcgcctgacccaggcccacgcgctgaacttcgtgcgcagcgtggaatgcccggtcagcctggtactggccgaacagggcatgctggcggtggagccgcgcatgcgggcgctgctggagaccctgccgttcgagcggcaccacctgccgggcgggcatcacctgcatctggacgatgaggccggggcgcaggcggtggccagggtcttcgcggccttcttcgcgcgctga

SEQ ID NO: 9456 - DNA, 738 bp, Pseudomonas aeruginosa
ggaacggatctacccgctaggggcgatcagtcgcatcagcggtcgcctgcgcatggagggcgaggtgcgcgccgaaggcgagctgaccgcactgacctaccgcttgccgcccgagcacagcagccaggaggcgttcgccgcggcgcgcaccgcgctgctcaaggccgacgccacgccgttgttctggtgcgagcgacgcgactgcggctccagcagcctgctggccaacgccgtgttcggcaatgccaagctgtacggcccggacgagcagcaggcctacctgctggtgcgtctggcggcgccgcaggagaacagcctggtggcggtctactcgatcacccgtggcaatcgccgcgcctacctgcaggccgaggaactcaaggccgatgcgccgctggcggaactgctgccgagcccggcgaccctgctgcgcctgctcaaggccaacggcgaactgaccctcagccatgtgccggcggagccggccggctactggttggagctgctggtgcggaccctgcgcctggataccggggtgcgggtcgagctgtccggcaagcacgcccaggagtggcgcgacgccctgcgcgggcagggcgtgctgaacagccgcatggagctgggccagtcggaggtcgagggcctgcacctcaactggctgcgttgaacgcgttcgcccgggcctgcgggcccgggcgatggcgaaaatgccttcggcaaggccgcccgccagagtag

SEQ ID NO: 9457 - DNA, 462 bp, Pseudomonas aeruginosa
gcaccggattgtgggcggcatcgaccatccgttggtggaagcggacgtcgtgctctatgtagtcctgcaggtcggcgctgccgtagcgctggcgcgaagcgtcgagatgttcgcgcaatgcgctcaggtcgctgtcgtcgcggcgaacggctgccaggcgcgccgcctcgatctcgatcatcccgcgtgcctccagggagtgctgcaccgcgctgcgcgccagcaccagcatggtttccagcggatcggcgcaggcgcgcacgtaggtgccgtcgccctggcggacttccagcacgccggagaaggtcagcacccgcaccgcttcgcgcacggtgttgcggctcatgccgagcagctcggcgagttccggctccggcggcaggcgctggccgagcggccaatggccggcgtcgatgcgctggcggatctgctccagggcgatgtccaccagggagcgcttga

SEQ ID NO: 9458 - DNA, 450 bp, Pseudomonas aeruginosa
atttgcgcgcaggatacctcggcagctgcaagcccggaaagcgtcgctcggggaaaaagcgttggcctggcggcgagacgcatgacgctgcgccgccaggtcgccgatgcgtcagcctacggcggcggtttcgccggcgcgcagggacatgcccagttgcgctcgtcggcgcagccagggactgggccggtagcgcgggtcaccggtaagcgtctgcaagcgctggagaatgctcagcaggcgccgcgggccgaggcggtcgccccattccagcgggccgtggggatagccgaggccgaggtgcaccgcctggtcgatatcctcgacgctggcaatgccctgctgggcgatgtcgcaggcgaggttgacgatcatcgccagtacccgctggacgacgaagccgggactgtcgcgcagcaccgtgaccccgacgccgtcgccagccagtag

SEQ ID NO: 9459 - DNA, 2043 bp, Pseudomonas aeruginosa
cgcgtgggcggcgtcgcgcatggccggggtagtcagtggcgagagcatcaggcagcgccggcgctcgaggtcgcagagcaggtcgatgccgacgctgcgctcggcgggacaggcgaagcgctgcacggcgctgctcaggtcctcgccccaggcggccagcaggcagagcgctgcggcggaagggcgttcgccggtttccggctcgacgccgaggcgatgcagcagttcggcgagcgtgcggcggtcgtcctcgttttcgcagcccagccacaccgggggccggatggcggcctgcggcaccggttgcggaccgggcttgtcctgcggctggccgtcgacgtagcgatagaagccctggccgctcttgcgcccgagacggccggcggcgagcaactggcgggtcagcgggtgcgggcggtagcgcggttcctggtagtactgctggtagatcgattccattaccgggtgcgacacgtcgaggccggtaagatcgagcagttcgaacggccccatgcggaagccggcgcactcgcgcagcacacggtcgatctcggcgcattcggcgacgccttcgccgaggatgcgcagggcctcggtgccataggcgcggccggcatggttgacgatgaagccggggctgtccttggtccgtacgccgcggtggcccaggcgcgcggcgagggcgagcagggcgtcgccgacttccggagcgctggccaggccgtcgaccacctcgaccacgcgcatcagcggcaccgggttgaagaagtgaaagccggcgacccgctgcggccgctcgcaggcggcggcgatggcggtgatcgacagcgacgaggtattgctggcgaggatggtctccggcgcgactatggcttccagccggcgcagcaattcctgcttggcctccaggcgctcgacgatggcctccaccaccagttcgcagtcgcccagttgttccaggcgttccgccacccgcagccggttttgcgcggcctcggcgtcggcggcgctcagcttgcctttgccgcacaggctctcgaaggtctgccgcaggcgctggcgtgcctcggcggcggcctcggcgcggctgtcgaacagccatacggtcaggccggcctgggcggcgatctgggcgatcccggtgcccatcgcaccggtaccgaccacggcgatacaacgaatatcgggcatcgtctatttcccctggtagttcggcgggcgtttctccaggaaggcctgcatgccttccttctggtcctgcgagtcgaacagcaactggaacgccttgcgttccagggccagggcactgtccagcggcaggtcggcaccggccaggaccacctccttgatctgcgccagcgccagagggggcaggcgggcgatctccatggccagttccagggcgcgcgccagcgtcgactcgtccgccaccacttcgctgaccaggcccatggccagcgcttgcggagccttcaccaggcagccggtgaacagcatgcgcagcgcctggaacttgcccaccgcccgtaccaggcgctgggtgccgccggcacccggcatcaccccgaccttgatctccggctgggcgaactgtgccgactcgccggcgacgatcaggtcgcagtgcatcgccagttcgcagccgccgcccagggcgaagccgttgaccgcggcgatcaccggcttcgggcagcgcgcgatggcttcccagtagcgctcgccgtggcggccgtacaggccgatcgccgtgctcgtcgagagatcgcggagatcggcgccagctgcaaagcagcgcgagtcgccggtgagcacgatgacgcggatcgccggatccgcgccgagcgtctggaagtggctggcgaggcgctggcgcacttcgtcgttcagcgcgttcctggcttgcggacgattgaggcgaagcagggctatatcggctgcgggaaattcgagcaggaccacgggcgaaggatcggcggacatggaagctccgatgaattgatatttcgctatgcgaaatatagtttcatgatttatcgaaaataa

SEQ ID NO: 9460 - DNA, 1791 bp, Pseudomonas aeruginosa
ccgttctggattggttgtccctggccctggccacgggactgttcgtctatttgctggtggcgctgctacgcgccgaccgtgcctaggggagggcacatgaacagccacgagattctcttgatcctggcctttttcgccctggtcctggtgcctgcaccgttcctcgggcgctactgcttcaaggtgatggaaggccaacgcaatctcctcagcgcgccgctggcgccactggagcgcgtctgctatcgcctgttcggcgtcgatccggcgagcgagcaggactggaagacctacaccctggcgctgctggcattcaacctggccggcctggtcctgctgttttcgatcctcatgctgcagggcagcctgccgctgaacccgcagcacctgccgggcctggaatggacactggcgttcaacaccgcggtcagtttcgtcaccaacaccaactggcaggcctacagcggcgaggcctcgctgagctacttcagccagatggtcggcctcacggtgcagaacttcgtcagcgcggcggtcggcctctgcgtgctggtggccctggcgcgcggcatcagccgccgctccacgcggcagctgggcaacttctgggtcgacctgacccgcggcaccctctacgtgctgctgccgctgtgcctgctgctggcgttgctgctggtctggcagggcgtgccgcagaccttattcgactatgtccatgccaccaccttgcaaggcgccgagcagaccatcccgctcggcccggcggccagccagatcgccatcaagcagctgggcaccaatggcggcggcttcttcggcgtcaactcgacccatccgttcgagaacccgagcgcctggagcaacctgttcgaagtggcctcgatcatcctgatcccggcggcgctggtattcaccttcggccattacgtgaaggacctgcgccagagccgcgcgatcctcggctgcatgctgctgctgttctgcctcggcctgggcttgtcgctgtgggccgaataccagccgaatccggcgctggcgcagttgccgatcgagcagggcgcgccgatggagggcaaggagagtcgcttcggcaccgccgccagcatgctctgggcgatcaccaccaccgccgcctcgaacggctcggtgaacgccatgcacgacagcctgagccccctgggcggcatgctgccgctgctgaacatgatgctcggcgaggtgatcttcggcggcgtcggcgccggcctctacggcatgctgctgttcgtcctgatcgcggtgttcctcgccggcctgatggtcgggaggacgccggagtacctgggcaagaagctcgaggcgaaggaggtccgcctgctggtattcaccctgctggtgatgcctgtcggcgtgttggtgctcggcgccatcgccgccagcctgccggggccggcctcggcggtgaccaatcccggcccgcacggattcagccaactgctctacgcctacacctcggggagcgccaacaacggctcggcgtttgccggtttcggtgccaacacgccattccacaacctgatgatcggcctggccatgctcatcggccgcttcggatacatcctgccgatcctcgccatcgccggcagcctggcggcgaagaaggccagcccggtggggccgaacagtttcccgacccatggtccgctgttcgtcagcctgctcaccgtgaccatcctgctggtcggcggcctgactttcctgccgaccctggccctcggcccgatcgctgaacaactgagcctcggcttctga

SEQ ID NO: 9461 - DNA, 657 bp, Pseudomonas aeruginosa
tgtatccgctgggatacgcgaaggaccaggacgcgcccgcgggcgcttaggaggaaaaggatggacaaggacgtatccggcgcgctgcgccgcctgttgctgctcgccatgctcggactgccgctggtggcggccgctgcggtcgaaccgcagcgactggtggatgcggcgcgtgcccaggtgggcgtgaccctgggctacgacccggcctaccggcaactggactatccgggcggcgacgtgccgctgcagaccggggtctgcaccgacgtagtggtccgtgcgctgcgcggacaggggctggatctacagaaggcggtgcacgaggacatgcgtcgccacttcgcggcctacccgcagcaatggggaatgaaaggtaccgaccgcaacatcgatcaccgccgcgtaccgaacctgatgacctggttcagccgccagggcctggccctggcgcctagccgcgacgcttccgcctaccgggccggagacatagtcgcctggcgcctggacaacggcctgctgcatatcggcgtgctttccgatcgcaggctggagggcaggccgctggtgttgcacaacatcggtgccggcgtgcgggaagaggacctgctgttccgctaccaggtcatcggccactaccgcttcccgcagggctga

SEQ ID NO: 9462 - DNA, 813 bp, Pseudomonas aeruginosa
atccaagtgggcaggcatcgaccggtaggggctggtgctcggaaaaggatgaaaggtatgcggttgcacaaacgctcgctggtctgggggctcgccttgagcgggctggccgtcgtgctggcggccgcctggtgggcgagccaggcgtcgcgggagccggctctgtggagcgagctgcgggtgccgccggcgtttgccatcccgcgcgatttcgacctgggcgaacaccgcttgagctggggcggcaagagcctcgccctgtcagtggcgggtagcgctcggccgccgttgtgggagagcgagggcggttttctcggggccgggcgggaaagcgccggtcgcctgcagttgcgctgccaggagcagagcctggagagcttcgaactggtcggtcgacgcttgtccctgaaggggcacctgcgctgcgccgatggccggctcagcgcctacgagctgtcgttcgagccgcgccagggcggcatggaggtgcgcgtcgcgctggcggacagcgagctgaaccgggtcgccctgtcctggcggcgtggagcgggggagcgcttgtccggtatcgtcgatgacgaggtggaaggtcgctcctgggtcttgccggccggggtcgccggctactggagttccgctggcaacgccttcctcggccactcgacggcggcgcaatccctcgacctgcgcgagccgggccgcgtgcaatggcgggcagcgacggagtcggccagggcctggctgttcgctgccggcaaccgcgagcagtggcagcttcgcagcgcgcgtctcgaggcggaaacgcgccgctga

SEQ ID NO: 9463 - DNA, 798 bp, Pseudomonas aeruginosa
gaagcgcgtatccaagcgttccgtcaacttcgcgccgaagaccgttccggcattcgaacccaaggttcggacttactaagggtgcccgccatgttgcaagtgagtgtttatcgttacaaccccgacaaagatgctgcgccgtacatgcaggatttccaggtcgacaccaacggcaaggacgtgatggtcctcgacgtgctggcgctgatcaaggaacaggacgagggcttctcctaccgtcgttcctgccgtgaaggcgtctgcggctccgatggcatgaacatcaacggcaagaacggcctggcctgcatcaccccgctgtcggccgccggcctgaagggcggcaagctggtgatccgtccgctgccgggcctgccggtcattcgtgacctggtcgtggacatgagcatcttctacaagcaatacgagaaggtgaagccgttcctgcagaacgatacgccggccccggccatcgagcgtctgcagaccccggaagagcgcgagaagctggacggtctgtacgagtgcatcctgtgcgcctgctgctcgacctcctgcccgtccttctggtggaaccccgacaagttcctcggtccggccgcactgctgcaagcctatcgtttcctggccgacagccgtgacaccaagaccgaagagcgcctggcttcgctggacgacccattcagtgtgttccgctgccgcggaatcatgaactgcgtgaacgtttgcccgaagggtctgaacccgaccaaggcgatcggccacgtgcgtaatatgctgctgcagagcggaacctga

SEQ ID NO: 9464 - DNA, 750 bp, Pseudomonas aeruginosa
ggccaaagaggccttcaaagtccatggtatcgaagccaagggcgtcaccatcgacgttccggcgatggttgcgcgcaaggccaacatcgtcaagaacctgaccggcggcatcgctaccctgttcaaggccaacggcgtgacctccttcgaaggccacggcaagctgctggccaacaagcaggtggaagtgaccggtctggacggcaagacccaggtcctggaagccgagaacgtgatcatcgcttccggctcccgcccggtggagatcccgccggccccgctgaccgacgacatcatcgtcgactccaccggcgccctggaattccaggccctaccgaagaagctgggtgtgatcggcgccggcgtcatcggcctggagctgggttcggtatgggcccgcctgggtgccgaggtgaccgtgctggaagccctggacaagttcctcccggctgccgacgagcagattgccaaggaagccctgaaggtcctgaccaagcaaggcctgaacattcgcctgggtgcccgcgtgaccgcttcggaagtgaagaagaagcaggtcaccgtgaccttcaccgacgccaacggcgagcagaaggaaaccttcgacaagctgatcgtcgcggtcggccgtcgcccggtgaccaccgacctgctggccgccgacagcggcgtgaccctggacgagcgtggcttcatctacgtcgacgaccactgcaagaccagcgttccgggcgtcttcgccatcggtga

SEQ ID NO: 9465 - DNA, 789 bp, Pseudomonas aeruginosa
cgtggttcgcggcgcgatgctcgcgcacaaggcctcggaagagggcgtgatggtcgccgagcgcatcgccggccacaaggcgcagatgaactacgacctgattccgtcggtcatctacacccacccggaaatcgcctgggtcggcaagaccgagcagaccctcaaggccgagggcgtcgaagtcaacgtcggcaccttcccgttcgccgccagcggtcgcgcgatggctgccaacgacaccaccggcctggtcaaggtcatcgccgatgcgaagaccgaccgcgtcctgggcgtccacgtgatcggcccgagcgccgccgagctggtacagcaaggcgcgatcggcatggaattcggcaccagcgccgaagacctgggcatgatggtcttctctcacccgacgctgtccgaagccctgcacgaagctgccctggcagtgaatggccatgccatccacatcgccaaccgcaagaagcgctgagtgatccgacgccccggttcacgccaggggcgtcacagcgacgcgggacgcgtcgtccgtcaggccaggacaggttcctggccttgtcgggtccgggttctgtagaatccacggtttgccgcctgcgtcgggatgccgcaggcggcagactttcagaagaaccacggcgggtgagcgccggcgaccgttgcgaggtggccgcgggcgtatgccgccggactgttttttcgcgagccgggtggttcgcgaaacgacggtcacaggtggtggggcgccacgagcgctccgccgaaatgcgcaatacctag

SEQ ID NO: 9466 - DNA, 849 bp, Pseudomonas aeruginosa
ccagggcaccttccactccgaacaggccatcgcctatggcaccaagatggtcggcggcgtgacccccggcaagggcggcaccacccacctcggcctgccggtgttcaacaccgtcaaggaagccgtggaagccaccggcgccgaagcctcggtcatctacgttccggctccgttctgcaaggactcgatcctggaagcggcattcggcggcatcaagctgatcgtctgcatcaccgaaggcatcccgaccctcgacatgctggacgccaaggtcaagtgcgacgagctgggcgtacgcctgatcggcccgaactgcccgggcgtgatcactcccggcgagtgcaagatcggcatcatgccgggtcacatccacctgccgggcaaggtaggcatcgtgtcgcgttccggcaccctgacctacgaagccgtgaagcagaccaccgacgccggcttcggccagtccacctgcgtgggcatcggcggcgacccgatcccgggctccaacttcatcgacatcctgaagctgttccaggaagatccgcagaccgaagccatcgtcatgatcggcgagatcggcggttccgccgaagaagaagccgcggccttcatcaaggccaacgtgaccaagccggtggtgtcctacatcgctggtgtgactgcccctccgggcaagcgcatgggccacgccggcgccatcatctccggcggcaagggcaccgcggacgagaagttcgccgccctgcaggacgccggtgtgaagaccgtgcgttccctggccgacatcggcaaggccctggccgagctgaccggttgggaagtgaagaaggcctgatttcccgggttttctga

SEQ ID NO: 9467 - DNA, 903 bp, Pseudomonas aeruginosa
acccgggtcgccttgtcgaccgggtcggaaaggtcatcacgccggtgctgctgtcggccctgctggtccttggcggcgcggcgatcttcgcgccggcgggagagatcggcagcagttccggcgagtaccagagcgcgcccctggtgcagggcttcctgcaggggctacctgaccatggataccctcggtgcgctggtcttcggtatcgtcatcgccaccgccattcgcgaccgcggcatcagcgacagccggctggtcacgcgctattccatgatcgccggggtcatcgccgccaccggcctgtccctggtctacctggcgctgttctatctgggcgccaccagccagggcatcgccggcgacgcccagaatggcgtacagatcctcaccgcctatgtgcagcagacctttggcgtttccggcagcctgttgctggcggtggtcatcaccctggcctgcctgaccacggcggtagggctgatcacggcgtgcggcgagttcttcagcgacctgctgccggtttcgtacaagacggtggtgatcgtgttctcgctgttcagcctgctggtcgccaaccagggactgacccagttgatcagcctttcggtaccggttctggtgggactctatccgctcgccatcgtgctgatcgccctgagcctgttcgaccggctctgggtgtcggccccgcgggtgttcgtgccggtgatgatcgtcgcgctgctcttcggcatcgtcgacgggctgggggcggccaagctgaacgggtgggtgccggacgtcttcgccaagcttccgctcgccgatcagagccttggctggctgctgccggtatccattgcgctggtcctggcagtcgtttgcgatcggctgctgggcaagccgcgcgaagcggtcgcctga

SEQ ID NO: 9468 - DNA, 837 bp, Pseudomonas aeruginosa
cgcgtcgttcttcgcctccagcacgctgatcatcctcgccggcatcctcaccctgctgggctccaccgatcgcgccgtctcggtactggccgacctgccgttcgtggaggaggccagccggggactgtcggaactgaagctgctgtgcctggcagtggtcttcgtctatgccttcttcaccttcagctggtgcatgcgccaatacaacttcgcggcgatcctggtcggctcggcaccgatgatcggcgagcgcaacgtcggcgagctggagcgcaaatcctttgccgagcgtgccgcccgggtcatctcgctggcggccaaccagttcaacttcggcttgcgctcgtactatttcggcctggccatgctcgcctggttcatcaattcctggttcttcatgctggtgacggccggcgtggtgctggtcctgtatcgccgcgaattccattcggacgtgctggaggtgatggtctacaccgagaccgcaatcgccgaaagcccgcgggaaggcgagggcgaggtgcccaggggctgaatcccgggcatgaaaaagcccgcttgcgcgggctctttcagggtacgtcaacgagaacttattgctggttctgttgcggttgctccggagtcggtgccggagtctgcggggttgccggagtgtcgctcgacggcgccggggcgctgggctcggcagggggagtatccggagcgctcggctgggtctcggtagccggagctgccggggccgctgccttgtcttcctctttcttgtcgcaagcggccaggccaaggctggcagcgagcagcagggcaagagttacggtctttttcatcgtttag

SEQ ID NO: 9469 - DNA, 510 bp, Pseudomonas aeruginosa
ttcgccctccagaaaactcccagcaaggtcgccgtcatgtcggaaaatcctctcctcgagcgcgcccggcgctttctctcggccttgcgtcattgccaggtgctggggttgacggtcgaggccgccgacgagaaaggactgaccctgcgcctgccctacagccaggcgatcatcggcaacccggaaagcggggtcgtccacggcggcgcgatcaccaccctgatggacaccacctgtggtatttccacggtctgcgtgctgccggacttcgagatctgcccgacgctcgacctgcgcatcgactacatgcatcccgccgaaccgcacaaggatgtctatggcttcgccgagtgctaccgggtcacgccgaacgtgatcttcacccgcggcttcgcctaccaggacgatccgggccagcccatcgcccatgtcgtcggcgctttcatgcgcatgggcggttcggcccgcgccggggcggccaggccggccgcgcagggaggtgcggcatga

SEQ ID NO: 9470 - DNA, 723 bp, Pseudomonas aeruginosa
ccccgacaaagcccgcttcggcgggctttgtcttttccaactctcgcaggagcagtacccatgagtgagattcgtgtagagccggtcgcctacgacatcgatgggcagccgtacgaaggtcaactggtgtacgacgccagccacgcggggccgcgcccgggcctgctgatggcgccgaactggatgggcgtgagcgccgccgcgctggacatcgcccggcaggtcgccggccgtgggcacgtggtgctggtggcggacctctacggcagggacgtgcgtccgcagaacggcgacgaggcgggcgcggcgatgatgccgctgaagaacgaccgggccctgctgcgcaagcgcatgcaggcagcgctggcggccttgcgcggacaggcgctcgcggctgtcgatacgacccgccaggctgccttcggtttctgcttcggcggttgctgcgcgctggagctggctcgcgacggcgccgagctgaaggccttcgtgtccttccatggcaccctggatacgccggacccggcgcatgccaggaacatcaagggcgcggtactggtcctcgacggcgcctccgatccgctggtgccgcgcgagcagttgccggccttcgccagggagatgaccgatgccggcgtcgactggcaactcaccatctacgggcggcgcggtgcattccttcaccgatccgaacgccaagctgccgggcaagatgcactatga

SEQ ID NO: 9471 - DNA, 435 bp, Pseudomonas aeruginosa
cgttcgacgaagcgcggtacctgttcgccgcttagcccgagcaggtcctcgctgaccagtacctggccgtcgcaggccggcgaggcgccgataccgatgcaggggatcgccagttcttcgctaaggcgacgggccagcggctcgcctacgccttcgatgaccaccgcgaaggcgccgccgcgctgcatggcgaggccgtcgcggcgtacccgttctgcgctttccgggtcacgcccctgggccttgaagccgcccatggcgttgacctgctgcggcatcaggccgatatgggcgagcaccggtatgccacggcgtaccaggaagtccacggtttcttccatttcctcaccgccttccagcttcaccgcctgggcgccgctgtcggccagcaggcgtgcggcgttgcggaacgcctgtcggggcgattcctggtag

SEQ ID NO: 9472 - DNA, 1524 bp, Pseudomonas aeruginosa
cgcgggtggccagcgaccttggctacgactccacctcggcgttcatcagcctgttccagcgtcatttcggccagacccccggttgcttcgcccgctccctgcgcttgcccaactgagccgcatgcttcagggcgccgcctgtcggcgcaggcttgccgccttggccgcgaggtccggccaggcgggcttgccggcgaaacgctcgcgcaggtagttggccagggcggcgacttgccggtcgtggaggctatggcggaagccgggcatatagccgaggtcgccggtggccgggctgtggatgccgtcgaggatgatccgcagcaggttgtccgggctgtccgcatgcacattgctgttcagcgccagggatggacgcacgccgaagaagcgcggtccgtcgccgtcatggtggcaggccaggcaggccccggcgaacaggcgcgcgccgctgccgctgggcggttgcacgcggccgtagccctgccggtcgaggcgttgcgcctgttgctgatcggtttccccggccggggcagcggcgtaggacgcaaggtaatgggccagggcccgcaggtcctcgtccgactgcttggccaggccttcgccgaccactggcgccatcggcccgctggcgaccccgtggtaggccgaatagccgtggcggaggtaggcgtagagggcctcctcgctccaggcgatgggcgccggcgaactggcgttcaaggctggcgcggtccagccctccgcctcgccgccggcgaagtgcgcgctgccggacttttccgcgccgagcgcattgcgcggcgagtggcaggcgctgcaatggccgaggccttcggcgagataggcgccgcggttccattgctggttgcgcgtcggctcgtcgcggtaggcgccgggctccaggaacagcaggttccagccggccatcagctggcgttggtcgaaggggaacggcagctggttggcaggcgtttcgctgtgcaccgccggctggctcatcaggtaggcgtacagggccttcaggtcttcgtcgcgagtcctggtgaaggcggtgtaagggaacgccggatacaggtagctgccgtcgcgggccacgccatgccgcatggcccgctcgaaggcggggtaggaccagccaccgatgccgctcgcgcgatccggcgtgaggttgctgctgtagatcgtcccgaacggcgtcggcaaggcccgtccgccggcgttgcgcgggccgccttcgcgagtgtggcagaccgcgcagtcgccgagggcggcgaggcgttcgccgcgggcgatctgctcggcgctgaagggaccgggtgtgccttccagtggcccgatggccggttgccaggcgtagccgagggcgatggcggcgagcgcgacgaggctgccggaggcccagaggccgatgcgtgttgccttcttcatctgtcagtcatccactgcgcggggcgccgcggcgccccggggaaaaggatcaggcctgcgcgctgcgcagcgccgcgagtacgcgttccggagtga

SEQ ID NO: 9473 - DNA, 552 bp, Pseudomonas aeruginosa
cctacggcgacgtgccgagggccaacaacgaggcgctggcgcgggtctatcacctggccgccgaattcgacctgccggtgttgctgcacgccaacgtcacttccaagcgcgaacgcaacccgctgtacctggcggaaatcgaggagcccctgcgcaatcacccgcatgtgcggttcatctgggcccatgccgggaccagcatggagatccatcgccaccagaagaaactggacttcctcctgccgacccttcgggcgtctgctacagcgctacccgaacctctacatcgacctgtcctggtcggtgttgcgcccgtacctgctggacgagcagggcaagcccgatccgcagtggctggcactggtcgagcggtttccgcaacgcttcatgctcggttccgatgtggtcggccagttcgacagcctgcccgagttgatggcgagcttcgatccgttcctcgacgccttgcccgagcaggtcgctcgccaggtggcgcgggacaactttctggcggtgctgccgcgccagcccgccgatccgcgaggcgaataa

SEQ ID NO: 9474 - DNA, 1083 bp, Pseudomonas aeruginosa
gaaatcgagaatgtcgttgatgaccttcagcaggtgttcggtggactcggtggccagcgccgtgtactcggcctgttcgcgggtctgctcggtggtttccagcagttgcagcatgcccagcacgccattcatcggggtgcgaagctcgtggctcatcatcgccaggaagtcggacttcgcccggttcgcctgctccgcttcctcgcgggcgctgatcaattggctgatcgcctgttcctgttcccggctcgcgcggtccagcccgctggcgagattgttgatgtgacgggccaggtcgccgatctcgccgtcgtcgaggatcggcaggctggtcttgtagtcgccgctctggatcgcctcgaccgcctggcccatggtgctgatcggcgccgacaggcgctgcgccaggcggcgcgcgacgaggaaggtgaggatcagggcgaaggcggccagcagggcggccttcaggaggatttcctgttgccgctggctgaaggcgtcgttggacatgccgaccaccacccggccgaggtagtcctcgccggactggccgtcgccttcgctggcgccatccagcagcgggtcgctggccagggcgatacgctggcgctggatggtggagtggaagatgtcgatcggcgcggcgttctgcaacgcgccgggcaactgttcgacgtacaccaggatattgtcgttgcggtcgcgtacctcgatgaagcgcacatgcggggtgtcgagggtggcctgcagcagcttctgcagcacgggcgtgttgccggcgatcacgccgtattcggcggccggcgccagctggtcggcgatcaactggccggtatgggtcagttcctggcgcaggtcctgcaggcgcgagtaggtgaagtaggcggtgagcaacagggtcagcagcagcgccgggcccaggctgatcgccagcatgcgggtacggatgtcccagccgtggcgctggctcatggttcttctccttcggcgaggcgccggccgaggtcggcgtcgctggccaggtcgatacccagggaacgggctacctgccgattgccgagcaccttgaaatgccctggatag

SEQ ID NO: 9475 - DNA, 408 bp, Pseudomonas aeruginosa
tgcgcggcgagccgaagaccgacgtcgatttcattcccaccaccggcttctgacgaggagaccgccatgtccgcagacccgcaagcacgcgaatcgatcgccatccgcatcctctggatgctgctgttcgtcctggtctggcaggtcgccgaactgctcctcggggcggtggtggtgatccaactggtctaccgactgatctacggcgcgccgaacggcagcctgatggctttcggcgacagcctcagccagtacctggcgcagatcggccgtttcggtaccttccacagcgacgagaaaccctggccgttcgccgactggccgagcgcccgcgccgccgagggcgaggccgcccacagcgtgccgcccgccgcgcacccggcgcgcgacgaagagccgaagttgtga

SEQ ID NO: 9476 - DNA, 576 bp, Pseudomonas aeruginosa
agatcaagcgcaatatggtggaaggtgcctatggctcgcgcttccacgaatgggtggaacgccgcgaggccgtgctctggcacgaatgactcccaccgacgggaagcccttggcttcccccttgcgcaaggaattcccatgagcctctggcgacaaatgcccgacctggagcaactgaacgcctcgcagaagaacagcatcggcgacctgcttggcatccgcttcgaagccttcgacgacgagtcgctgaccgccagcatgccggtcgactcgcgtacccaccagccgttcggcctgctgcatggcggcgcctcggtggtcctcgcggaaagcctgggctcgatggccagctacctgtgcgtcgataccagccagtactactgcgtcggcctggaagtgaacgccaaccacctgcgtggcctgcgcagcggccgggtcaccgcggtggccagggcgatccacctggggcgcaccacccatgtctgggacatccgcctcagtggcgacgacggcaagccgagctgcatcgcccgcctgaccatggcggtggtgccattggcgggcagggcgggctga

SEQ ID NO: 9477 - DNA, 834 bp, Pseudomonas aeruginosa
agtagcgggatggaacagatcacccatctcagcagcgggattcccggcgtacgcctgatagacgccgagcacaaccgcttttcctttccccggcacttccacctggagtaccacatcggcttgctgttgcagggccggcatcgctatgccgccggcggcgaacggcgcctggccggggccggcgacgcgttgctgatggcgccggaaagcatccacgacggcagcagcgccggcgaggagggctaccgtatccgcgtcctggcgctcgatgccgactggctggagcgcgccagccgtgacttcagcgacggccgtcggggggcgccgcgtctgaccagtagcctggtccgcgacgagcgtctgcagcagcgcctgcgtcagttgcacctgggcatgctcggcggagcggcggcgctggagaaccgtctggccctggaagagcacctctggcaggcgctggcctgcctgctcagcctgggcagcagcctgcgcctggaggagggcgaccgggaaggcttcggccagcgcgactggacgcggctgcgcgactggctggagtcgcgcctggagtacccgccgaacctggaggaactggccgccttctgcggcctgagcccctggcaggtgctgcggcgcttccgccgtcactgcggcctgccgccccaccagtggctgacccaactgcgcctggagcgcgccttgccgctggttctgcgcggcgagcagccattgagccaggtggcccagcagttcggtttctacgaccaggcgcacttcagccgtctgttccggcgcacctatgggttaccgccggcgcgcctgcgccagcgctga

SEQ ID NO: 9478 - DNA, 1596 bp, Pseudomonas aeruginosa
ttcgcgttttcctttccgatccctttttcgtggagtagccatgcaggaattgtctgtcttgctgaccctggcggcggtgttcgccatagccctggtcagccccggtcccgatgtcgccctggtggtgcgcacgtccctgcaccaggggcggcgggccggcctggccagcgcgctggggctggcctgcgggattctcctgcataccaccctggtgctgaccggcgtgtcgctgctgctcagccgtacgcctgtgctgttcgccatcctgcaggcgctcggcgcgctgtacctggcctggctcggcgtcggcgcgctgcgcgcctggctgcggcgcggcgacggccagccgggccggctcgacggggcactgccgccgtcgcccctggggccctggctgcgcggagtggcgaccaatctgttcaatcccaaggcgctggtgttattcatcgccttgctcggcagcctgattcccgcgcagatgtcgctcggcggcaaactggcggtggcggcgctgctgttcggcatgggcgcctgctggttcggcctgctcagcctgacccttacccgcccggccctgcaggcccgcctgttgcgcgcggtgccctggctggacgcggcctgcggggtggtgttcctgctggtggcggcggcgatcctcgagcatctcgtccgctctgcctgaggttttggccgcttcgccgtgcaaggcagccggcaaagccattgccgcctcggcgaggctgccggagaatccctggcatcagccctgtcgagacgtcgcgcatgtcgcaatcggttttcttcgcccacgccaacggcttcccgtcggctacctacgccaagctgttcgaggcgttggcgccggagtaccgggtggatcacctggaaatgcacgggcacgacccgcgtttcccggtgaacgacaactgggacaacctggtggacgaactgctgcaccacctcgccagcctggaacagccggtctggggcgtcggccattccctcggcggcgtgctgcactaccacgcggcgctgcgccggccggaactctaccgcggcgtggtgatgctcgattcgccggtgctgaccctcgccgaccgcctggtgatccgtgccgccaagcgcttcggcttcatcgaccggatcactccggccgggcgcaccctggggcgtcgcgaggcgttccccgacctggaagaggcgcgggcgtacttctccggcaaggcgctgttccgccgcttcgaccccgattgcctggaggcctacgtacgccacgggctggccgacagcggcggcggttccggcctgcgcctgcgcttcgatccggccaccgagatcagcatctaccgtagcgtgccgcacagcagtccggggcgtccacgacagttgcaggtgccgctggcgatggtgcgcgggcggcacagcaaggtggtgttgccgcaccacacccggctgatccgggcgatgccgcgcggcgagttcatgtcgctgcccggcggccacatgttcccgctggagcgcccgcgggaaaccgccgaactgctgaaaggcgtgttcgatcgctggtcgcgggcgaccgaggagcgttcggcatga

SEQ ID NO: 9479 - DNA, 945 bp, Pseudomonas aeruginosa
acttcgtgcgcagcgtggaatgcccggtcagcctggtactggccgaacagggcatgctggcggtggagccgcgcatgcgggcgctgctggagaccctgccgttcgagcggcaccacctgccgggcgggcatcacctgcatctggacgatgaggccggggcgcaggcggtggccagggtcttcgcggccttcttcgcgcgctgaaacaccggcttgccgttgtttccttgactattccgggtccagccgtaaggctggacggatcgttacggagagtcaccgcatgatcgatctctacaccgccgccacgccgaacggccacaaggtttccatcgccctcgaggaaatgggcctgccctacagggtgcacgcgctgtcgttcgacaagaaggagcagaaggctccggaattcctcaggatcaatcccaacggccgcatcccggccatcgtcgaccgcgacaacgacgacttcgccgtcttcgagtcgggcgcgatcctcatctacctcgccgagaagaccgggcaactgatgcccaccgacgtcaagggccgctcgcgggtgatccagtggctgatgttccagatgggcggggtcggcccgatgcaggggcaggccaacgtgttcttccgttatttcccggagaagttgcagggcgccatcgaccgctaccagcatgagacccggcgcctctacgaagttctcgacggtcgcctgggcgaggccgagtacctcgccggcgactacagcattgccgatatcgccacctatccctgggtgcgcatccacgactggtccggtgtcgccgtcgacgggctggacaacctgcagcgctggatcgccgccatcgaggcgcgtcccgcggtgcagcgcggactgctggtgccgcggcgggagaaggagggcgacgacgccatccgtaccgcccagtcgatgctgacccgttga

SEQ ID NO: 9480 - DNA, 816 bp, Pseudomonas aeruginosa
gggccggtatgcgagggttcctgttgctatcccctgggcgttttcagcttttcggcgctggccgccgaccttcccggcagccatgacctggacatcctgccgcgcttcccgcgcgccgagatcgtcgacttccgtcaggcgccgagtgaggaacggatctacccgctaggggcgatcagtcgcatcagcggtcgcctgcgcatggagggcgaggtgcgcgccgaaggcgagctgaccgcactgacctaccgcttgccgcccgagcacagcagccaggaggcgttcgccgcggcgcgcaccgcgctgctcaaggccgacgccacgccgttgttctggtgcgagcgacgcgactgcggctccagcagcctgctggccaacgccgtgttcggcaatgccaagctgtacggcccggacgagcagcaggcctacctgctggtgcgtctggcggcgccgcaggagaacagcctggtggcggtctactcgatcacccgtggcaatcgccgcgcctacctgcaggccgaggaactcaaggccgatgcgccgctggcggaactgctgccgagcccggcgaccctgctgcgcctgctcaaggccaacggcgaactgaccctcagccatgtgccggcggagccggccggctactggttggagctgctggtgcggaccctgcgcctggataccggggtgcgggtcgagctgtccggcaagcacgcccaggagtggcgcgacgccctgcgcgggcagggcgtgctgaacagccgcatggagctgggccagtcggaggtcgagggcctgcacctcaactggctgcgttga

SEQ ID NO: 9481 - DNA, 1083 bp, Pseudomonas aeruginosa
ggaaggcctgccttgatgttcgataacgatcggctgttgcttcgcgtgctgctgttcggtctgctcggtgccagtctctgggtgctggcgccattctggtcggcgctgttctgggccgcggtgctggctttcgccagttggccgctgatgcgcatgctcacgcgcctgctcggtggccgcgagtcgctggcggcgggcctgctgaccctgggctggatcgtcctggtggcattgccgctgatctggctcggcttcggcctggcggacaacgttcgctcgctgatggagctgctgaagaatctccaggtcgagggcctgccgccgccgccttcgtggatggccggcgtaccgctgatcggcgaccgcctgatcggctggtgggactccatcgaccaacagggcgtggcgttcttctacgtgctcaagccctatgtcggcgaggtcggcaactggctgctggcgcgcagcgcgaagatcggcggagggatcctggaactggtcctcagcctgatcctgatcttcttcttctaccgcgacgggccgcgcctggagtccatcgtccaccgtgccctggagcgcctgatcggcaaccgcgcggagcactatcgcgaccttgtcgccggcaccgtacagcgggtggtcaacggggtgatcggtaccgccgcggcgcaagccctgctggcctggatcggcttcatgatcgccggcgtaccgggagccatgctgctcggcctgctgaccttcgcctgcagcctaatgatggtcccgccgctggtttggggtccggccaccgcctggctgttcttcaagggcgactatggccacggggtgttcctcggcctgtggggcttcttcatcatcagcggggtggacaacatcctcaaaccctacctgatcagccgtggcggcaacctgccgctggtggtggtgctgctcggggtattcggcggcctgctggcgttcggcttcatgggcctgttcctcggcccgatcctgctggcagtggcctacaacctgctcagcgactggatcgccagcacgccgcggacgccgcccgccgaagggcgcggcccggatgcctga

SEQ ID NO: 9482 - DNA, 1218 bp, Pseudomonas aeruginosa
gtgacgaaggagaaaaagccccgcgatgcggggctttttgcgtctgcggggctacaggtgttcgctgcgggcccccacgtactggctgcgcccggcgccgaggccgaacagggtggcggcgatggcgacgccgatgaagatatagccgaccgcgttccagccgccggtcaggtcgtggaccacgccgaccatgaacggccccatggccgccagggtgtagccgacgccctgggccatgcccgacagatgcgaggcgacgtgggcgtcgcgcgagcgcaggacgatcagcgccagggcgatgctgaaggtaccgccctggccgaggccgagcaggaccgcccagccccagatggtctgcagcggcgcatagaggaagccgagcaggccggcgagggtggtcgccatcaccagcaccaccgccaggcgctggtccctggcgcgagcggcgagccagggcgcgagcagggcggtgatcagttgcagcatcaccgagccggacagcaccaggccggcttccaccgcagtcatgccgcggtcgatcaggatcgacggcagccaaccgaagacgatgtaggccagggacgattgcaggcccatgtacagcgtgacctgccaggccagcgggtcgcgccacaggccgatgacacggaaggcctggcgatgggcgtgctggccctggcgggtctgcggcagccagaaggcggcggcgaggatcgccggcagcgaccagaacgccagcgccagttcccagttgccgaagagcttctccagcggcgcggtagcgccggcggcgagcgctgcgcccaggcacagggccatggtgtagaccccggtcatcaccccggcctggcgcgggaagtcgcgtttgacgatgcccggcaggagcacgccgatgatgccgatgctggcgccggccaggacgctgccggcgaacaggccgaacaccgggaacaggctgcgcaggacgatgccgccggccaggcagaagaggatcagcagcacgctgcgctcggcgccgatacgccgggccaggcgcggcgcgagcggcgcgaacaaccccaggcagagtaccggcgcggtggtcagcaggccggcggcagcggccgagaggccggtatcgtcgcgcacctggttgagcaggggggcgaggctggacagcgccgggcgcaggttcagcgccaccagcaccaggcccagcaggagcagccaggggcgtag

SEQ ID NO: 9483 - DNA, 504 bp, Pseudomonas aeruginosa
ccgaggccgaggtgcaccgcctggtcgatatcctcgacgctggcaatgccctgctgggcgatgtcgcaggcgaggttgacgatcatcgccagtacccgctggacgacgaagccgggactgtcgcgcagcaccgtgaccccgacgccgtcgccagccagtagcgcgtgggcggcgtcgcgcatggccggggtagtcagtggcgagagcatcaggcagcgccggcgctcgaggtcgcagagcaggtcgatgccgacgctgcgctcggcgggacaggcgaagcgctgcacggcgctgctcaggtcctcgccccaggcggccagcaggcagagcgctgcggcggaagggcgttcgccggtttccggctcgacgccgaggcgatgcagcagttcggcgagcgtgcggcggtcgtcctcgttttcgcagcccagccacaccgggggccggatggcggcctgcggcaccggttgcggaccgggcttgtcctgcggctggccgtcgacgtag

SEQ ID NO: 9484 - DNA, 438 bp, Pseudomonas aeruginosa
aagccggcgacccgctgcggccgctcgcaggcggcggcgatggcggtgatcgacagcgacgaggtattgctggcgaggatggtctccggcgcgactatggcttccagccggcgcagcaattcctgcttggcctccaggcgctcgacgatggcctccaccaccagttcgcagtcgcccagttgttccaggcgttccgccacccgcagccggttttgcgcggcctcggcgtcggcggcgctcagcttgcctttgccgcacaggctctcgaaggtctgccgcaggcgctggcgtgcctcggcggcggcctcggcgcggctgtcgaacagccatacggtcaggccggcctgggcggcgatctgggcgatcccggtgcccatcgcaccggtaccgaccacggcgatacaacgaatatcgggcatcgtctatttcccctggtag

SEQ ID NO: 9485 - DNA, 504 bp, Pseudomonas aeruginosa
ttcggcgggcgtttctccaggaaggcctgcatgccttccttctggtcctgcgagtcgaacagcaactggaacgccttgcgttccagggccagggcactgtccagcggcaggtcggcaccggccaggaccacctccttgatctgcgccagcgccagagggggcaggcgggcgatctccatggccagttccagggcgcgcgccagcgtcgactcgtccgccaccacttcgctgaccaggcccatggccagcgcttgcggagccttcaccaggcagccggtgaacagcatgcgcagcgcctggaacttgcccaccgcccgtaccaggcgctgggtgccgccggcacccggcatcaccccgaccttgatctccggctgggcgaactgtgccgactcgccggcgacgatcaggtcgcagtgcatcgccagttcgcagccgccgcccagggcgaagccgttgaccgcggcgatcaccggcttcgggcagcgcgcgatggcttcccagtag

SEQ ID NO: 9486 - DNA, 891 bp, Pseudomonas aeruginosa
ttttttgaaaaagaggtccctactatgcgcggcaacgacgagcgccggagtccggcggaaggtgccagtacggaagcggaagtgtccgccttcgaagctgtgctgatcgacccgatgcaggagaaagacgaggaactcaaggaccgccagttcgtcaccgcgctggcccgcgggttggaattgctgcgctgtttcacgccacgggaaagcctgctgggcaaccaggaactggcgaagaagaccggcctgccgaagccgacggtgtcgcgtctgacccacaccctgacccggctgggctatctgcgtcacctgccgcatagcggcaagtatcaattggaagtgggggtgatgtcgttcggctacgcgatgctctcgaacctgtcgattcgcgcgctcgcccgccctttgatggaagagatggccggctacgccaaggccgcggtggccatggcggcccgcgaccggctgagcatggtctacctcgatgtggtgcatggcgaggccaacctgaccatgcgtcgccaggtcggcagccacctctcgctgcaccgcagcgcgatcggccgggcctgcctggcggcgatgccggaggacgagcgggaattcatcgtcgggcacatccgcaagcgccacccggaagactggccggaagtgcgcaaggggctggagcgggccttccgcgactatgccgactacggcttctgcctgtcgctcggcgagtggcaacgcgacgtcaacgcggtgggcgtggccttgcaccatgagagccatgggctgctggcgttcaattgcggcgggccgagtttccatctcaagcgcgagaaactggaggacgacatcggcccgcgcctgctgcacatggtccacaacatcgaggccgccacccgctga

SEQ ID NO: 9487 - DNA, 1173 bp, Pseudomonas aeruginosa
tggcctattggagtgagcatgattcgtgatccggaaaccctgaacctgctgctggacagcatccgccagttcgtccgcgaaagcctggtgcctcatgagcaggaagtggcggaaaccgaccgcatccccgaggcgatcatcgcccgcatgcgcgagatgggcctgttcggcctgtcgatcccggaggcctacggcggcctcggggtgaccatggaggaagaggtgagcatcgccttcgagctggggcggacctcgccggcgttccgttcgctgctgggcaccaacaacggcatcggctcccagggcatcgtcatcgacggcaccgaagaacagaagcggcgctacctgccgcgcctggcgtcgggcgaactgctcagttcgttctgcctcaccgaaccggactccggttccgacgccgcctcgctgaagaccacggcggtgcgtgacggcgagcactacgtgctcaacggtaccaagcgcttcatcaccaacgccccgcaggccggcatctacaccgtgatggcgcgcaccgacccggcgatccgtggcgccggcggaatctccgctttcgtcgtcgagcgcggtacgcccgggctgtccctgggcaagccggatcgcaagatgggacagaagggcgcgcatacctgtgacgtgatcttcgacgactgccgggtgcctgccagtcagttgatcggcggggtcgagggcgtcggcttcaagaccgcgatgaaggtgctcgacaagggccgcctgcacatcgccgcagtctgtgtgggggtcgccgagcggatgcttgaggatgcgttgcgctatgccctggaacgcaagcagttcggccagccgatcgccgagttccagttgatccaggcgatgcttgccgacagcaaggccgaagcctacgcggcgcgctgcatggtcatcgacgccgcgcggcagcgcgacgaaggccgcgatgtcggtaccgaggcgtcctgcgccaagctgttcgcctcggaaatgtgcggccgcgtcgccgaccgcgcggtgcagatattcggcggcgccggctatatcggcgactacgggatcgagcgcttctatcgcgacgtgcggctgttccgcatctacgagggcaccacgcagatccagcaactgctgatcgcccgcaacatgatccgcgccgcccagggctag

SEQ ID NO: 9488 - DNA, 525 bp, Pseudomonas aeruginosa
gcggcgcgccgacggcagtttcgagagcgtcgctgccagcagcctgcgcaagggcgacgtggtacgggtccaggccggcgagatgattcccggcgacggcgaagtcatcgaaggggtggcggcggtcaacgaggccgccatcaccggcgaatcggcgccggtgatccgcgagtccggcggcgatcgctcggcggtgaccggcaacacccaggtggtgtccgactggctgctggtacggatcggcgccaacccgggcgagtcgaccctggaccggatgatcgccctggtggaaggcgccaagcggcagaagacccccaacgaagtggcgctggacatcctgctgatcggcctgaccctgatcttcctgctggtagtggtgaccctcaagccgttcgccctgttcgccggcggcaacctgccgctggtgttcctggtggcgctgctggtgacgctgatcccgaccaccatcggcgggctgctctcgggcatcggcatcgccgggcatggaccgcctggtgcgcctga

SEQ ID NO: 9489 - DNA, 1224 bp, Pseudomonas aeruginosa
tcgccaattccgggtcccgccggtggaaggcggccgggggaccttccacgtgctggcgctcgacaagaccggcaccatcaccttcggcaaccgccgttgcagcgcgctgtacgccgcgccgggggtgagcggcaaggaactggccgagggcgcgttgctgggctcgctggccgacgacaccccggaaggcaagtcgatcgtcgaatacctgcgcatcctgcatccgatcgaggagccgcgccgcgaggaactgacgccgatcgctttcagcgcggaaacccgcctgtccggggtcgactggaacggccaggtgtaccgcaagggggcggtggatgcggcgctgcgcttcatcgacctgccgcgggagaagatgcccgaggtgctttcgcgggaggtggacaagatcgcccagagcggcggcaccccgctgctggtggtagccaacggccggctgctcggtgccattcacctgaaggacgtggtcaagccgggcattcgcgagcgcttcgccgaactgcgccggctgggcatccgcaccgtaatggtgaccggcgacaacccgctgaccgccgctgccatcgccgccgaggctggggtcgacgacgtgatcgccgaggctaccccggagaagaaactggcgcggattcgccaggagcagggcgaaggtcgcctggtggcgatgtgcggcgacggtgccaacgacgccccggcgctggcccaggccgacgtcggcatggccatgaacgacggcacccaggccgcccgcgaggcggccaacctggtcgacctggacagcgacccgaccaagctgctcgacgtggtccaggtgggcaaggagttgctggtcacccgcggcgcgctgaccaccttctccatcgccaacgacgtggccaagtacttcgccatcctgccggcgctgttcgtcggcatctacccgcagctcgacgtgctcaacgtgatgcgcttgcaaagcccgcagagcgcgatcctgtcggccatcgtgttcaacgcgctgatcatcgtcgcgttgatcccactggccttgcgcggcgtgcgggtgcaggcggcggacgcttcgcaactgctgcagcgcaacctgctgatctatggcgtcggcggcctggtggcgccgttcctcgggatcaaggcgatcgacctgctgctgaccgccgtcggcctggcatgaacaacggccttcgccgtcgggcgagggcctgggactga

SEQ ID NO: 9490 - DNA, 567 bp, Pseudomonas aeruginosa
agagaggatctgcacatgttcaagcaactccgtccggcactggcgtcactgctggtgctgagcatggtcaccggcgtggcctatccgctgctggtcaccggtatcgcccaactggcgttccccgagcaggccaatggcagcctgctgcgcgacgccgagggcaaggtgctcggctcgcggctgatcgcgcagaagttcgacggcgaggagtggttccattcgcggccttcggcgggcgactacgccaccgtttccagtgccgcgagcaacctggcgccgagcaacccggcactggccgagcgcatcgccagggacgccgcccaggagcgtatcgccgaccaggggccggtgccgctggcgctggtcactacctccggtagcggactcgatccgcagctgccgccgcaggccgcgcgttaccaggcgctgcgggtggccacggcgcgcgggctgccgctgcggctggtggaagacctggtggaaagccacaccgagcggccgctggtggggccggcggtggtcaacgtgctggcgctgaacatggcgctggcggggttgaagcgctag

SEQ ID NO: 9491 - DNA, 489 bp, Pseudomonas aeruginosa
cttctgatattgcgttgtcaggagtcgcctgcacatctggcgttacgccccgtcaattggtgcagtcgtcttctgaaaatgacaattgcgatcggccgcgcgcagcagaccgaaacctggctggcccggcacatggatgggctgatcgtgccggcgccgcccgaggacgggcttgaagcgctgacggccgaatggcgcgtacaggtcgcaggtacatgcggcgagggcgtgagcaagccgcttgggattgcgggctttctggacttggcggacaaccccgccgcgcccctggagcgcatccgcggtggcattcgcagcggcatcgatgggctggcggcctttctgcggcgcgcggccgatgccggtgtggctcatgtcgcactcaatccaaagatcagccgacggccctatgcggacgtcatggaagaactggccgaggcgcttgtgcggccggccagcaaggcgtccctcgagtctgcagtgcagtga

SEQ ID NO: 9492 - DNA, 759 bp, Pseudomonas aeruginosa
tcgccgccggcggatttgacaagccgcgcgcagaacaggcactgcaacgcggcgtgctcgatctcattggcttcggggccccgttcatcgccaatcccgatctcgtcgagcggcttgccaacgactggccgctggccgcggtcgatcgttcgaccctgtacggcctgcacggtgagcatggctacaccgactatcccccgtacgcaggcgatgccgcctgagcgggcatcccgacctcttcgctggaggaaaccatcgatgatcgaccttgacattcaacggatggcagatcttgaagctatacgctcgctgcgcatacgctacagccactacctggacggcaaccacatggacgaactggctgccctgttcgcgccggacgccttgtgcgatgcggggcgtggcctgtggcagggccgggagcagattcgcgctggcctgtcggctgcctttgaagcctacgaccatgacgtcgaaggctcgtacccgttcctgcatgcggtcactaaccactggatcgagttcctcgatgccgataccgcgcagggacgctgctatctgatcgacctggagaccatgagcaagcgcgagcgcgatccgtggctcttgctgggctcctacgccgatgaataccgccgcgttgatggccgctggttcatcacccgtacgcggctggacatcttttggccggagcgccaggccggcggcggactgccgggccgggatctgatcctgcctgaggcgtacccagcaagttga

SEQ ID NO: 9493 - DNA, 819 bp, Pseudomonas aeruginosa
caccaagacattagactgagaaaattcttacagcggagtcccaaggtgtcgccactcctcattaccgccctcatcatcggcgggatcgccctcctcatcgccattggctatatcaaccacgtggtggaaaacagcaagctggagaaagcgcgcctgaaggccgaactcaacgaccgggtccggcgctgcgcgcagatttccgagagccttcccggccagttcgtcagcccgtcgctgaagctgttgatgagccagatcgagctcagcctcagcgagcagcaactggcgctggagaagaaagccgatgccgggctcaaggctcgtatagaagagttgcgcgcgctggtcgccaagggcgagtcgatcccggtgcgcaatccgccccaggcgatcctgaccgaggacaaggccaaggaagtccgcttcctcttcgaagccctgcatgcccagctcacccgtttcacccaggacggccacctgccgcgcagcgaggcgcagatctgggtcaaggagattcgccacctcctggtgcgcctgcatatcgagttcttcggcaatctcggccagcaggccctgcagcagaacgaaccgcgccaggcgcgcctggccttcgaacgcggcgcccagtacctgcgcaagcagcccgagctggcgcgctaccaggcggagctgcagcagatggaagcgcagctggcccgcgccaacgcgatggtgctgaacaacagccagccggcgagcgaggagcccagcgaactcaacgagggattgaaggccctcgatgcagacgacctgtggaagaagaagaacgtctacgactga

SEQ ID NO: 9494 - DNA, 2511 bp, Pseudomonas aeruginosa
cgtcacggatcgatcatcggttgcgcccaggaaccccgacagacggtcgggatgggctatgctaggcggcagaacctcgccaaggctgatccccgcccccatggatatagcgctgactcatcgcctgtcgttcaaacaggccagcctcaccgtgctggtggcctttatcctgggaaccctgctcagcctgattcaggttggcgtcgattatgccagccaggacgcatccatcaatcgcgaagtgcgcgcgctgctggacgtcagccacaaccccgccgcgcgaatcgcctacaacatcgatgcggagctggcccaggagctggtcctcggcctgctgcgctcgcccgccgtggtccgcgcggaaatcatcgacacctccggcctgccgctggccagcgcctcgcgcgaacccgccgaaagccgcctgcggccgctcagcgacttcctcttcggccacaagcgggtctacgaggacccgttgcatgtcgaccatgcgccgggcgaggccctcggcgtactgcacctggaaatcgacaccttcgtgttcggcaacgacttcctccgtcgcgccggcatcaccctgctctccggcttcgtgcgcagcctgctgctgtcgctgatcctgctggtgctcttctataccctgctgaccaagcccctggtcagcctgatccaggccctcagcggacacgatccacgctcgccggcacgcatgcgcctgccctgccccaagggccacgaacgcgacgagatcggcgtgctggtggaagtcatcaaccgccagctcgggcgcatctcggtagagatcgaacagcgccgggaggcggagaaccgcctgacccagtacctggaggagctggaaagcatcgtcgccgcccgtaccgccgagctgaaggccgccaacgcgcgcctgacgctatccaaccaggaactcgaagaagcccgccagaccgctctcgatatggcccaggcccgcgccagcttcctggccaacatgagccacgagatccgcacgccgctgaacggcctgctcggcatgctctcgctgagcctcgacggcccgctcaccccggaacagcgccagcaactgtcgatcgcccacgactccggcaaggtgctggtggaattgctcaacgacgtgctcgacctctccaagttcgaggccgggcaactggtcctggaacagatcccgttcgacctgggcgtcctggtggaagacaccgccagcctcctctcgcagaacgccgcggccggcgtggagctgacctgcctggtcgaccccgccctgcccgcccaggtttccggcgacccgacgcggattcgccaggtcgtcagcaacctgctgtccaacgcgctgaagttcacccgcctggggcgggtcgacgttcgcgtggaagccaccgccgagggtgtgcgcatcagtgtgcgcgacaccggcatcggcatcgcccaggaggcgctggatcgcatcttccaaccgttcacccaggccgacgcgggtatcacccgccaatacggcggcacaggcctcggcctggccctcacgcgcaagctgtgcgaggccatgcagggcgagctgacggtggagtcgacggtcggcctgggcagcctgttcagcgtcggcctgccgctggcgccggtcagccctccgctgcaagcgctgccgctgcgcggccgggtgatcgcgcaatgctcggccaacagcgggctggcgcagctgctgcaaacctggctgccgcgctggggcctggagtacaagcgtctggagaccgacgacagcctgctcggccactcgctcgacgtactgatatcggattgcccggactgtctgatgggactgcgtccgagcatcggtacgccgatcctgctggtcaccgcctacggcagtttcctcgaaccggagctggcccgccgcctgtcgccgctgcgccaactggccaggccgctgagtcgcaaccagttgtaccaggccctgaaacacgtgctcgaacacactgccatagccccgtcgagcgcctcggacaccacgggagaacagcgcaacacccgggtcctgctggtggaggacaacccggtcaaccagttggtcgccaagggcctgctgcacaagctcggctgccaggtatggatcgccgaacacgggctgaatgccctgaagatgctggaggagcatcccatcgacctggtcctgatggactgcaacatgccggtgatggacggctacgaagcgacccggcagatccgcgacagcggacgctggggcggcctgccgatcatcgcgctgaccgccaacgccctgccggacgagcgcgaacgttgtcgtgccgccggcatggacgactacctggccaagcctttccaccgcgacgaactgaaagccatcctcgaccgttggtgcccgctcaccgcgagcgactagccggcctcgcgacgacggctagcctcctaccaccagacggaagcgcgacagcaatccgcccaggcgctggtgcaggtcgaacatctcgttga

SEQ ID NO: 9495 - DNA, 966 bp, Pseudomonas aeruginosa
ccccgcatgattatcaggagcccgttcgcccgccccggcggcctgcgaaccgcgctccgtgccttcagccgtgaggagaagctttacaccatgatgcgcatcctgttgttcctggccaccaacctggcagtcctggtgattgccagcatcaccctgaaactgctcggggtggaccgcttcaccggccagaattacggcagcctgctggtcttctgcgccgtgttcggtttcgccggttcgctggtctcgctgttcatctccaagtggatggcgaagatgagcaccggtaccgaagtcatcagccagccgcgcacccgtcacaaacagtggctgctgcaaaccgtcgaagagctgtcccgcgaagccggcatcaagatgccggaggtcggcatcttccccgcctacgaggccaacgccttcgccaccggctggaacaagaacgacgcgctggtcgcggtcagccagggcctgctcgaacgtttctcgcccgatgaggtgaaagccgtcctcgcccacgagatcggtcacgtcgccaacggcgacatggtcaccctggcattgatccagggcgtggtgaacaccttcgtgatgttcttcgcgcggatcttcggcaacttcgtcgacaaggccatcctgaagaacgaggacggcccgggcatcggctacttcgtcgcgaccatcttcgccgaactggtgctcggcatcctcgccagcatcatcgtcatgtggttctcgcgccgccgcgagttccgcgccgacgccgccggcgcccacctggccggcaccggcgcgatgatcgccgcgctgcaacgcctgcgttcggaacagggcgtgccggtgcagatgcccgacaccctgaacgccttcggcatcaatggcggcctcaagcacggcctggccggcctgctgatgagccacccgccgctggaagatcgtatcgaagcgctgcgcgccagcgcacgctga

SEQ ID NO: 9496 - DNA, 495 bp, Pseudomonas aeruginosa
tttcgcccgatgaggttcccatgcagatccgcgccgatttcgacagcggcaacatccaggtcatcgatgccagcgatccccgccggatccgcctggcgatccgtcccgacctggccagccagcatttccagtggttccacttcaaggtcgagggcatggctcccgccaccgagcaccgcttcaccctggtcaacgccggccagtcggcctacagccatgcctggagcggctaccaggcagtcgcctcgtacgatggcgaacgctggttccgcgtgccgtcgcaatacgacgccgacggcctgcatttccagctggaaccggaggaaagcgaagtccgcttcgcctacttcgagccctacagccgcgaacggcatgcccgcctggtcgaacgtgcgctcggcatcgagggcgtcgaacggctcgccgtcggcaccagcgtgcaaggccgcgacatcgaattgctgcgggtcaggcgccatcccgacagccacctga

SEQ ID NO: 9497 - DNA, 1053 bp, Pseudomonas aeruginosa
aggcaccgcgaacgcaatccagcaatgcagcgaacgcacgcctgggagaacgaaagactgcaccctgcgcatgccagcgtgcttatacttccactccatgcatcttcccgatctgaatctcctggtcgccctcaacgttcttctcgaagagggcagcgtggtcggagccgcgcgccgcatgcacctcagcccaccggcgatgagccgtaccctgtcacggatccgcgaggcggtaggcgacccgatcatggtccgcgccggccgcaagctggtgcccacgccccgtgccctggaactgcaggagcaggtccggcaactggtggaccaggcccgcgacctgttcaacactcgcgagaccatccaactggacaagctggagcgctgcttcaccctgcgttccaacaacaccctggtcggcggtctgtcgatacgcctgctggagatcttcgccgaggaggcgccgcgctgcaccctgcgcttcgtgcaggagtcggacatcgacgacgaggcactgcggcagaaccgcatcgacctctacatcggcgcctcgtcctggatggaacccgaggtcaagacccagcagttgctcaccacccgcttcgtcggcctggcccgccaggggcacccgatcttcgacggcgagatcactccgcagcgcttcgtcgcttttccgcatatcgccgtctcgcgtcgtggcctcaaccatggaccgctggaccaggccctgggagaactcggcctgaagcgcgacgtcaagctgatcagcccgaccttccactcggcgatcttcgccctgcccggctccgacctgctgctgccgatcgccgagcattccctgtggcgggccaaccgactgggcctgggcctgcgccagttcgacatcccggtgccgttgaagaccgtgatggtggtccaggcctggcatccacgcttcgacaacgatcccgcgcaccgctggttccggcaaacgatcaagcggatttgcgaggaagtgcagagcgatccccatccgctgcttggctccaactgaaacagatgcacaaaatgcactga

SEQ ID NO: 9498 - DNA, 1608 bp, Pseudomonas aeruginosa
actgcggcggaaatcagaagagtttccgcccatgccttgtttccccaccctcgccgtagcgaggtcgcgatgacttcgctcgccaccccgctcggccagccgacgccaaccgcagcccccgccgcccagcctttcggcgcgcgcatcgtggtcggcctgctcggcgtgctgctcgcctcgctcaccgccggtctcaatggtcatgtcaccgagatcgccatgaccgatgtgcgcggcgcactcgccattggccatgacgaaggcacctggctgaccgtgctctacgaagccacccaggtcgccgccatggcattcgcgccctggtgttcggtgaccttttccctgcgccgcttcacgctcttcgccatcggcggcttcgccctgctggccctgctctgtccgttcgcgccgaacctcgagagcctgctggtcctgcgcaccctgcaagggctgatggccggctgcctgccgccaatgctgatgaccgtggcgctacgcttcctgccacccgggataaagctctatggcctgggcgcctatgccctcaccgcgaccttcgggcctaacctgggcctgccactggcggcgttctggttcgaatacgtcggctggcagtgggtgttctggcaggtcattccactgtgcctggtggcgatggccgcggtgtcccatggcatcccccaggacccggtgcgcctggaacgcttccgccagttcgacggcatcggcctgctcaccggcttcccggcgatctgcgccctggtgatcggtctgctgcaaggcgaacgcctggactggttcgagtcgccgctgatctgcctgctgctgggcagcggcagcctcctgctggggctgttcctggtcaacgaatggagccacccgctgccgttcttccgcctgcagttgctgaagcgccgcaacctgaccttcgccctgatcaccctggccggcgtgctggtggtgctcggcgcgagcatgggcgtgccgaccgaattcctcgccgagatccgcggctaccgccccctgcagagcgtacccatggtgttgctggtggcccttccgcagctcgtcgcgctgccgctggtggcggccctctgcaacatcccgcgggtcgactgccgctgggtgctggcctgcggcctgtgcctgtgcgccggtgcctgcctgagcttcagccaactgacggcggactgggtgcgcgaggacttctacctgccgatgctgttactggtggtcggccagccgatggcggtgattccgctgctgatgctctccaccagcgtcatcgcgcccatcgagggacccttcgcctcggcctggttcaacaccgtccgcggcttcttccggggtagtccccaccgcggtgatcggcgccatcggcaccgcccgcgagcattaccattccaaccgcctggtggatcacctgggcaatgcgccccaggccgtcgaactgcgcttgcaacagatcgccggcctgcaaccgggcgccgactccggcgcgcactggcagcatttggccgaacaggcccgccaacaggcccaggtgctgggcaacgccgacgtgctgctggcaatggccggcctggcctgcgccctgctgatcactga

SEQ ID NO: 9499 - DNA, 405 bp, Pseudomonas aeruginosa
agatcgttctcgagccgcgccaggccatggcgggcaagttgcgtgtgggcatgtcggtggaagcacggatcgacaccgcgaccggcacccgctccgccgaggttgcccagcaatgaaaggcactccgctcctgcttattgccagccttgcgctcggcgcctgcagcctcggccccgacttcacccgcccggaccgccctgcgcccggcgaatggtcgctccaggccgctgccggcaaccccagccacctcgccgccgcgccgctcgcagcccaatggtggacgctgttcgacgacgcgcaattgaacgccctgctgcaacgggtccagcgtgccaacctcgacctgcgcagcgccgcggcgcgcctgcagcagagccgcgcgatccgtcgcagcctcggcggtga

SEQ ID NO: 9500 - DNA, 2082 bp, Pseudomonas aeruginosa
cgccctgccctcggtggacgccagcggcacctaccagcgccagcggaccaccagcgccggcctgttcgatccctccggcaaggccggcaaaggcaactacaaccacgccctggccggcttcgacgcctcctgggagctggacttctggggccgcgtgcgacgcgagctggaagccgccgacgcgacggtggaagccagcgagaacgaactgcgcgacgtgcaggtctcggtgctggcggaagccgcgcgcgactatatccagttgcgcggcgaacagaaccgtgcggcgatcatccgcgacaacctcgagaccgcacggcgcagcctggaactcacccgcacgcgcctggccaacggcgtcgccaccgacctcgaggtagcccaggcgctggcccaggtggccagcatggaggcacgcctgcccgaggtggaaaagaaccaggcgcacctggtcaacgccctcggctacctggtcggcgccagccccggcagcctgctcgccgaactcggcccggcgcgggcgattccgcgtccgccgggcagcgtgccggtcggcctgccgtccgaactggcccagcgccgccccgacatccgtcgtgccgaagcgcgcctgcacgccgctaccgccagcatcggcgtggccaaggcggacttctatccgcgcatcacgctcaacggcaacttcggtttcgaatccctgcaactgtccagcctgggcgactgggaccatcgccagttcgccatcggcccggcgttcagcctgccgatcttcgaaggcggacgcctgcgcggacgcctggagctacgcgaggcacagcagcaggaagccgccatcgactaccagcgcaccgtgctgcgtgcctggcaggaagtcgacgacgcgatgcacgactacgccgccaaccagcgccgccaggagcgcctcggcgaagccgtggcgcagaaccgccgcgccctgcagagcgcccgcgagcaataccgcgccggcgcggtggacttcctcagcgtgctcgacagccagcggcaactgctggacaaccaggaacagcaggtcgccagcgacgaagcggtgtcgctgaccctggtcaacctctacaaggcgctgggcggcggctggagcccaacgtccgacccggcgtcgggctgagacggcgccgggcgcggaccggcgaaggagttggaaatggacctgctgcaaggtatccggaccttcgtccgcgtggtggagcacggcagcttcacccaggccgcccaggcgctggggacctctccggcgaccgtttcgcgccaggtcgccgggctcgaacaggcgctctcggcgcgcctgctgcaacgcaatacgcgcagcgtcgtggtgacggaaagcggtctgcgctattacgagcattgcaagcagatcctacgcacggtcgccgccgccgcggcggacgtcgaagacagccagtcccacgccagcggtcgcctgcgcctccacgcggtgaccgaactgggcctcgagcacctgatgccgctactggtggactacctggacggccatccggacgtctccgtcgacctcacgctggcccagggcaccccggccctgctcgaggaaggcctggacgtgctgatcaccctcagccgaaccttgccggactcgaccctggtcgcccgcgatctcggccaggtgttcagcgtggtctgtgccgcgccggaatacctggcacggcatggcgtgccacgcacgccggaggacctgctgcggcatcgctgcctgaacgtggccgcgccgtcctgcccgcagggctgggccttcgtcggcgaacgcggcgaaacgctgctcgatctcgacgaggcgctcaaggtcaaccttcccgaggccgcctgcgccgccgccgcggccgggctcggcgtctgcctgctgcccggcttcgtcgccgcccgcgcgctgcaggaaggcagcctgttgcggctactgccgggccatcgactgcatgtccgcgaggtgttcgtgctgtactcctcgcggcgctacctggacgccaagatccgcacctgggtggacttcctcagggaacgcctgcccctggcgttcgagcgtga

SEQ ID NO: 9501 - DNA, 726 bp, Pseudomonas aeruginosa
ccgggcgatcctcgacgatcggcgctactgggcggaaagcccaaccggcgtagcgcgcgagaccgcgacctaacgcctgggtcgataggtatcctcaaaaacatatactggttttcgattgatcgagggaggaacatggctcatccgagtcacgaggtgaatcatgctaccgactctctatatttcccacggctcaccgatgctcgccctcgaaccgggcgccagcggcgtacaactgcgccgcctggctacagagctgccgcggccgaaggcgatcctggtggtttccgcgcactgggaaagcgacgacctgcgagtaaccggcgccgcggcgccggatatctggcacgacttctacggctttccgccgcccctctacgccgtgcgctacccggccaaaggcgagccggcgctggcgcagcggacgatcgaactgctccaggccgccggcctgccggcccaggccgacccacagcgaccattcgaccacggcacctgggtgccgctgagcctgatgtacccgcaggcggacatcccggtgctccagctgtccctgccgagccgcctcggtccggccctgcagagccgcgtcggccaggccctgcgccaactgcgcggggaaggcgtgctgctgatcggttccggcagcatcacccacaacctgggcgaactggactggcgcgccgggccggaagccatcgcgccctgggcgcgggagttccgtga

SEQ ID NO: 9502 - DNA, 672 bp, Pseudomonas aeruginosa
cggcgcaggcgcagggccttgccggcgacgcgggtgtccttgagcttggtcagcaggcgctcgagattggcctcgggcagctcgatcaggctgaaggtatcgcgaatctggatgcgaccgatgtcctcgcgggacaggccgccctcgttgaggatcgcgcccagcaggttcttcgccgcaaccccgtcgcgcgcgccgagggcagtgcggcagcgggcacggccttcgctcggcggcgccatcggacgacgctcgccgctgcgctccggacgctcgccgcgttcgccacggtcggcacgctcgcgcggtgccgatggggtcagcggctgttcgcggcgcaccgactccaggtccagcgccttgccggcggtcaggcgtgccagcaatgcggcggccagggtctcggcatcgcagccgaggcgacggcacagctcgtcgcgcaccgcgccgcgctgctcgacggcgctgtcgagcaagggcgtcaggctcgcggccaggcgcgccaggcgggcctccagtacggtctcggcatccggcaggcggacttcgccgaccttctgcccggtgacccgctcgatcacctgcagcatgcgccgctcgcgcggagtcaccagcaacagcgcgcgcccttcccggccggcacggccggtacggccgatgcggtgcacgtag

SEQ ID NO: 9503 - DNA, 453 bp, Pseudomonas aeruginosa
tcgagggtggcctgcttggtgcggacgaaggcgatcagcgcgtcgaactgctcgacttccagcaggcgctggatcgaaccggccttctggtcggcatggaccatcaggtggacctgctcgatgcgcgccacggtctgggtcttggcggcgatcttgacgtgcttgggctgcttcaggtggcgctcggcgatgccacggatggacgccggcagggtcgccgagaagagcacggtctggcgcgattcgggaagcgcctcgaagatcacttccaggtcgtccatgaagccgagcttgagcatctcgtcggcttcgtcgagcaccaggcgctggacggtggccagcagcttctcgtcgcggcgcaggtggtcgcacaggcggccgggggtagcgacgaggatctgtgcgccctggcgcagggccttcagctgcggccccatgggcgcgccgccgtag

SEQ ID NO: 9504 - DNA, 1005 bp, Pseudomonas aeruginosa
aggaaatccgcagagcggatacacagccagagcacagcgctccgaaaaatgcaggtcctgaacggggtcagttttgaccggcgcgcatcataccggaattttgacgtttgtgtgcgttttttccgacatgcgtcatcggagagactgacaatggacatcccgattccagacgtctataccgacgttgcccgccccccgccaggaaaccgccgcatgaacgacaccctcccaggacgcatcagccgcgaacggcgcggccacctgctgctgctcggcctcgaccgcgtggccaagcgcaacgccttcgacctgccgatgctcgacgacctggtcgccgcgctcggcgaatacgaggccgacgaccagttgcgctgtgccctgctcttcgcccacggcgagcatttcaccgccgggctggacctggccaatgtcggcgagaccttccgccagggctggaaactccccgaaggcgccgtcgatccctggggcaccttcggcggccggcgtccaagcaagccgctggtggtggccgtgcaaggctactgctacaccatcggcatcgaactgatgctggcggccgacatcaacctctgcgccagcaacgcgcgcttcgcccagctcgaagtgcagcgcggaatcctcccgttcggtggcgcgacactgcgcatgcaccaggtcgccggctggggcaacgccatgcgctggctgctcaccggcgacgaattcgacgcccacgaagcctatcgtctcggcctggtgcaggaagtcaccgccccggaggacctcctcgaccacgccatcgccctcgccgaacgggtcgcggcccaggcgccgctgggcgtgcgcgccaccctcggctcggcgcgccaggccctgctggaaggcgaagcggtcgccgccgctgcgttgccggaagccgccaggcgcctgctcgacagcgaggacgccaaggaaggcctgcgcgctctccaggaacgccgcccgggacgcttcgaaggacgctag

SEQ ID NO: 9505 - DNA, 249 bp, Pseudomonas aeruginosa
tcgccggactcgatgacccggatgaccccgtattcgtcgcgctcctcgaccagcagacgttcttcgctcaccactcacctccccccgccgcttcgccggctatcgccaggcgctccggcaaaagcaccgcagcatagcaaagccggcccgacgatggatttccgctattgcaacgatcgctggcggcgctgcggcgagctgctctaccatgccgcaatccgctttcccgagcattgccaagagtcgtag

SEQ ID NO: 9506 - DNA, 1347 bp, Pseudomonas aeruginosa
atgagccagtcctggagccccgagagctggagggccaagccgatccagcaacaacccgagtaccccgatgccgcgcacctggccagggtcgagcagaccctcgccggatacccgccgctggtcttcgccggcgaggctcgcgagctgcgccggcagttcgccgaagtcaccgccggacgcgccttcttgctccagggcggggattgcgcggaaagcttcgccgaattttccgcggcgaagatccgcgataccttcaaggtactgttgcagatggcggtggtaatgaccttcgccgccggctgcccggtagtgaaggtcgggcgcatggccggccagttcgccaagccgcgctcctccggcgacgaaacgcagaacggcgtgaccctgcccgcctatcgcggcgacatcgtcaacggcatcggcttcgacgagaagagccgcgtgccggacccggagcgcctgttgcaggcctaccaccagtccaccgccagcctcaacctgttgcgcgccttcgcccagggcggcttcgccgacctgcaccaggtgcaccgctggaacctcgatttcatcgccaactcggcgctggccgagcgctaccagcaactcgccgaccgcatcgacgagaccctcgccttcatgcgcgcctgcggcctggacagcgcgccgcagctccgcgaaacaagcttcttcaccgcccacgaagcgctcctgctgaactacgaggaagccctgacccgccgcgacagcctgaccggcgagtggtacgactgctcggcgcacatgctctggatcggcgaccgcacccgccagatcgacggcgctcatgtcgagatgctgcgcggcgtgggcaatccgatcggggtcaaggtcgggccgagcatggacagcgaggagctgatccgcctgatcgatattctcaacccggacaacgatccgggccgcctcaacctgatcgtgcggatgggtgccgacaaggtcggcgaccacctgccgcgcctgatccaggccatccagcgcgagggccgccaggtgctgtggagttccgatcctatgcacggcaataccatcaaggcctccagcggctacaagacccgcgacttcgcccgcgtgctcgccgaagtccgccagttcttcgaggtgcaccaggccgaaggcagctacgccggcggcatccacatcgagatgaccgggcagaacgtcaccgagtgcatcggcggttcgcgaccgatcaccgaagacggcctcagcgaccgctaccacacccactgcgacccgcggctgaacgccgaccagtcgctggagctggccttcctgatcgccgaaaccctgaagcaggtgcgccgctga

SEQ ID NO: 9507 - DNA, 1536 bp, Pseudomonas aeruginosa
gcgcgccgcggccgctcccgccgcccggcgggagcgctcgctagagcagcaccccgcgcaagcgtaccgccaactccccgcgcccctcgatcgccaccgtcgccaggcccagccaggcggccatgctgcgcagttgctcggccagctcgtgcagggcggcatcgtccatgccgttcgcctcggcatgcaacgcatgtaccgccaggcgctcgcgcgcccgctcggcgcggaggtcgacgcggccgaccagacggccgttgtacaggaatggcagcacgtagtagccgtacacgcgtttttccttcggcgtgtagatctccaggcgatagcggaaatcgaacaggcgctcggcccgcgcccgctcccagaccaacgagtcgaagggcgagagcaaggcactggcgcctagccgccgcggcacctgcggttcgccggggcagtaggccggctggctccagccctcgacccggaccggcagcagctcgccagcctccaccagttcggcgaggcgcgcgcggctctgcgccgggctcagccgatagtagtcgcgcaggtccttttcggtggccacgcccagggcgctcgccgccatccgcaacagctcgcgctgggcctgtgcctccgaaagctcggggcgcgccagcaattccgcgggaaacacccgctccggcaggtcatagagccgctcgaagccgcgccgtccggccaccgtcagctcgccggcggcgaacagccattccagcgcatgcttttccgcgctccagtcccaccagggaccggcccgctcctgccgcgtgctcaggctgccggcacctagcgcaccttgctcgcgcaccgcctgcaacacctggcggatcagtggctgctgttcccggccgaaacgtgccagttgctggtagatgccctggccgtcggcggcctggcgcatccgccagcgcatcaacgggtagtgttccagcggcagcagcgaggcctcgtgcccccagtattcgaacaactggcggtgacggccgacactccaggccgcctcgtcgagcagcgtcatggagtagggaccgagacgggaaaacagcggcaggtagtgcgagcgcaccagcgcattcaccgaatcgatctgcaacaggccaaggcgcgcgagcatttcgcgcagatgccgccgctgcacgctgcggcgcgtccgccggccgtcgaagccctgcgcggccagggccaggcggcgggcttcggcgagggaaagcgaaagactcatggagcgccccagtcgatgaaggagactgcgagtctatcgcgcctccgccgccgtgccagcctggcgcgccgctgcggttcgctcaatgccgacgcagcgggtcgtcccagaaatgccgctcgccctcctggaagatatccgcccgactcaggccgaggtccttcagcgcttcgtcgctcatcctcagcagttcccggcgctcgcgggccaactgcaaccagcgccgccagcgacgccacaacgacggcgcagcggtcgaggcgggatgggatgcagcgtggaagtga

SEQ ID NO: 9508 - DNA, 366 bp, Pseudomonas aeruginosa
tgcgcttcctcccggcgatcctgtcgcgcttcgccgaagcctatccgctggtgcaggtcgaggtgcattgcgacacctcgctcaacctgctggcgcgcaacgacctcgacctgtccatcgtcacccgcgagccgggcaccgagatcggccagttgctgcgccaggagcccttcgtctggatggccgccgagggcttctgcccccacgaccagcggccgatcccgctggccatgttcaacaccacctgcttttgccgggcctgggcctgcaacgccctggaggcggcggaactggactaccgcatcgcctacagcagccccagcctgtcggcgctgttcgcggtggtcagcgccggcctcgccgtga

SEQ ID NO: 9509 - DNA, 1611 bp, Pseudomonas aeruginosa
tgcgcaacccgcacagccagtcaccggtcaccgagaagctcgccgaatacatcggcgagggcttccgtctctgactcaaccgcgcaccagcaggagcaccgcgcacaatgcgaggaaggcgcagaaggccatgcgcaggctgcgctcgggcaaggcgtgggccagcctcacgccccaggaaatgctcagcaggccgcccagcgccagggggatccccatccgccagtcgacatggccgtgcatggcgtaggtccccagcgccaccgccgtgctcggcgcggccagggccagcgcgaggccctgggcgacgacctgggcgaggccgaacaccgaagtcagcaccggtgtcgccagcaccccgccaccgaccccgaaaagcccgccgagcgagcccgcgccaaggcccagcacgcccatccagggcaaaccgtagcgcggcgtcgcgccgccctgcggcgggcgccggaacaggcgccagaacatgtagccggccagcgccaggaggaagatcacgaacgcttcgcgcatccgcgccgcatcgatccgcgcggccacgctggacgccaggaacgcgcaaagcaggccggtcagggcaaggactccggcctggcgcggatcgatgcggttgcgctggtggtagcgccacaacgccagcaccacgttcggtaccaccatcaccagcgcggtaccctgcgccagttgctggtcgagaccgaagatcacccccagcgccgggatcgccagcaagccgccgcctatcccgaacagaccgcccaggcaaccgagcaccatccccagcaggaaatcgagaaatacatccagcatgtcagcccctctttcgacgcctccatgctaggcaagcgtggctggatgggaaacgcacaagaaagcacaatggctatgccaattacgcaaaggcatgagcatgttgcccgataccctcagcgaacagttcgttctctacctcgatgtcctcgatggcggcagcttctccgccgctgcgcgcaagcacccgctcaccccgtccgccgtggcgcgccggatggacgccctggaacgcgccgtcggcagcactctgctggtgcgcaccacccatgcggtgcgcgctactccggccggcctggccttcgccgaccgcgcccggcggatcgtcaccgaactgcgcctggcccgtgccgaagcggtgtccctgagcaccgcgccgcagggcctgatccgtatcgatgcgccggtgcccttcggccgccgccacctggccccggcggtcgccgacttcctcaaggccaaccccggcctcgacgtgcaattgcgcctgatcggcagcttcatcgacctgcagggcgaacatctcggcgaggtcgatctggtgttgcgcgccggcccgctacccgacagccgcctggtggccacctcgctggcgccgatggtgcgggtggtctgcgccagcccggaatacctgcgcgaacacggcgttcccgcatccccaggcgaactgccggagcatgccggcatcgattgggacaacctgtcgccaccctatgcctggcgcttccagcacgacggcaagctccagcacctgcggccgaaacgggcgcggctggccaccaataa

SEQ ID NO: 9510 - DNA, 858 bp, Pseudomonas aeruginosa
ccttcgtcggcgaggcgcttctgcaacagggcgacccagccctggctggtatccagtcccaaagcggcgctgatactatcgcccacgaccaacagcgtctgcgccgcggcctgctgggtcagcaggaccagggccaggcagccgctcaacagcaatgcacgcatcggaacctccatgagcgccagcattctcaacgcgcagaaccttagcaaggttgtcggtagcgcggaaggcaagttgaccatcctccacgacctctccctcgacctcgcccgcggcgacagcctggcgatcgtcggcagctccggctccggcaagtcgaccctgctcggcctgctcgccgggctcgaccagcccagcggcggcgaggtccgtctcgccgggcacgccctcggcgacctcgacgaggaccagcgggcgcgcgtccgcgcggcccatgtaggcttcgtgttccagtcgttccagttgctcgacagcctcgatgcgctggagaacgtgatgctgcccctggaactggaaggccgcgccgacgctcgccagcgcgccagagaactgcttgagcgagtcggcctcggccaacgcctgggccactatccgcgccagctctccggcggcgagcagcaacgggtcgccattgcccgtgccttcgcggcgcagccggacgtgctgttcgccgacgaacccaccggcaacctcgacagcgccaccggcgagcggatcagcgacctgctcttcgaactcaaccgcgaacgcggtaccaccctggtcctggttacccacgacgagcgtctggcgcatcgctgccggcgcctgatccgtctggaaagcggtcgcctgatcgaccgggtcgaaccctga

SEQ ID NO: 9511 - DNA, 444 bp, Pseudomonas aeruginosa
acctggccagcctggccgcggtgctgctcgccggcgtcgccgtggccctgtccgccgcccgtttcgctgcacggcgctacgacgccagcgcgctgctgcgctgcctcggtctgtcgcgcagcgaaaccctgctcctctacgcgctgcaactgttgctgctgggcctgctcgccagcgccatcggcgccctgctcggctggttggcacagctcggcctgttccgcctgctcgccacgctgctgccgccggacgtaccagccggcggcctgttccccgccttcgccggggtcgccaccggcctggtatcgctggccggcttcgccctcccgccgctggcagccctgggccgggtaccgccgttgcgggtcctgcgcagcgacctgctgccggtgccgatgcgcacctggatggcctacgcctgcgccctgctcgccctgggcctga

SEQ ID NO: 9512 - DNA, 339 bp, Pseudomonas aeruginosa
gccagctgcggagcatcctcgaccaggtcaccctggccgtggagtacgtgctggtgttcgttctcgcggcgggcttcgtggtgctcttcgccggtctccaggcgaccctcgacgagcgcgtgcgccagggtgccctgctgcgcgcgctgggtgccgagcgcgagttgctgcaacgtacccggcgggtcgagttcgccctgctcggcgcagtcagcggcctgctcgcggcgctcggctgcgaggcggtcagcctgctgctctaccgactggtcttcgacctgccgtggcaagcgcatccctggttgctcgcgctgcctctggtgggcgccgtgctggtag

SEQ ID NO: 9513 - DNA, 654 bp, Pseudomonas aeruginosa
ccggccactgcccggacgccaggtggcgacggcgaacctgcacctgaccctggccttcctcgggcaggtcccgtccgctcggctcgaggccctgctggacatggccgcggccatcgaggccgcgcccttcgacctgtatctcgaccgcctgctgcgctggagaaacggcatcctgctgctggcccccagccaaccgcccggcgccctcctgcgcctgcgccgcgccctgcgctccggccttgccgaactggagctgcccgtggaaacccgctcattcagcgcccatctgaccctggctcgcgatgccgcgccgctggaggacgccccgccacccccaaccttcgtatggcaggtcgaccatttcagcctgttttgctcgcaaaacgacgccgcgggcgtgcgctaccgcacactcggtcgctgggcgttgtgcggggaagattcaaacgagcgtttcgcgccgtaacaacccgcctcttccgctctgccacgcaggttatgaccggccgccaggaagccgcggatttcctggcctggaggaaaaaagccgaagctggcacggttcctgcgcaagggacagcgaagcggttctcccggaaggattcgggcgatggctggcaggacgcgcccctcggccccatcaacctgagatga

SEQ ID NO: 9514 - DNA, 798 bp, Pseudomonas aeruginosa
cggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccgcagggcgtccccacctcggcctgcggcgagggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtaggaccccggccggggcctcggccccggccctttcccggaagccccctcgcgtga

SEQ ID NO: 9515 - DNA, 738 bp, Pseudomonas aeruginosa
gcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctaccctcaggggtgcagccctggcgtggccggcgaggcggaaacctgtgctgcgcgccgcaacgaaaaagggcggccacccgaaggtgtccgccctttttcgtcgccagcccggttcagcgggacagcttgccgtccagcgagaacttgccggcgccatcgatcagcagcgccacgctgatcatcagaagggtcagggcatattcatagccgttgtcggtgatgaagaagccattgccgatgtgcacgctgaagatcgccacgatcatggtgaagcccaccaccaccgacgccggacgcaccagcaggccgatcaccagcgccaggccgccgaagaactcggcgctgccggccagggtcgccagcaggtagccaggggtcaggccgatggattcgaaccactgcgccatgccgttcaggccggcgccgccgaacatgccgaagagcttttgcgaaccgtgggacatcagggtaagaccggtgacgatacgcaggatggccaggccggcaccggcgttggtcgacaggatggtcttgatcagtggattcatggtgcgtcctcaggtgtgggataa

SEQ ID NO: 9516 - DNA, 555 bp, Pseudomonas aeruginosa
cccacgccagcttcgccccggaacgtgaagcactgctcgcccgcgcgcgcgccgccggggtggtacaaatggtcatcaccggcaccagcctggccgacagcgaacaggcgctgcagctctgcggcgaactcgacgagggcggccggctgtttaccaccgccggcgtccacccccacgaggccagccactggaacgccgacaccgctcgcggcctgcgcgccctgttcgacgacccgcgggtacgcgcggtgggcgaatgcggcctcgacttcaatcgcgacttctctccccgtccggcccaggaaaaggccctcgaggaacaactggcactggccgtcgagctacagcgtccggtgttcctccacgaacgcgacgccagcgagcgcctgctggcgatcctgcgcgacttccgcgatcgcctgccggccgccgtcgtacattgtttcaccggcgagcgccgggcgctgtatggctacctcgacctcgacctgcacatcggcatcaccggctggatcaacgacgagcgccgcggcacccacctgcatgatctggtag

SEQ ID NO: 9517 - DNA, 411 bp, Pseudomonas aeruginosa
aatacaagttctgggccgtcaacgcggtggccttcttcaccaccctgctgctggtgttgttcgccatgcagcaggaagccgccgggcgcaacgcttccgcccagcgcgccgccgccgccgagggcgagctggttcagagctggccagccggcagcgccctgcccgcccgcagcaacctgctgccgctggaacaggccgcgagcctgggcggcacagctgcccaggcgctgggcaaggggcagggttggatcgagttgtccggcgcgcgccagggcgataccccgctgctcggcgcctgggtcggccagaccggctccggccagcgcttcgccgtgctcgccccggccagcgacctgtggcaggtcttcgccgaccgtgccggcgcctacgccgtcgccgtgctggtgctga

SEQ ID NO: 9518 - DNA, 537 bp, Pseudomonas aeruginosa
cgcgacgctgccgatataatcgacggaatcctgtcgtggaccgacaacatgccgtcaacgcgtcaattaatcgtctttctctgttgcctggggctgcctcttgcccaggccgcggagcccgtgccgctgggcggacgtccgatcgtcaccctgcagcggtccggcgacgctcccgtacggctgaccctgtccgacctcgaagccctgcccagcgagaccctggaagcccagctccccggcgaggccaacgcccgctggcaaggcgtgcgcctcagcctgttgctgcgccacctggacctggcgccgcccacgcgcctgcgcgtgctggcgctgaacgactactcggcgatcatcccgtacagcgacctcgacagctaccagcccatcctcgcctatcgccgcaacggcgcctacatggcgatccgcgaacgcggaccgcttttcatcatctacccgatggcccgctatcctgagttgagaaaccaggtctactacaaccgtaccgtctggcaggtcagctccatcactcttgagtaa

SEQ ID NO: 9519 - DNA, 1587 bp, Pseudomonas aeruginosa
gtaacggacatgactgtgccgctgctcgatccgacaaagctgcgccggcaacgccagatcatggggctgttgctcggcctggtgctgctgatggcgctgatcgccggggctgcgctgtggctggcggtgcgccaggcccagcaactggcccagccgaacctgcacaacgagctgtggcagacctactcgctgcgcgccgaactggatcgcacgctggacgccgcgcggcacaccgagagcggcgaaggccaagccgacgacctggcgatccgtctcgaagtcctcgccagcctgatcgcgccgctgcgccgccagtcgttgttcaggcatctcgccgaaccgcgtccggaggtacaggccaccctgcaacgcctgatcgagctcagcgatcgctggtcgaaccaggccccctggggcgatcccgtcgccgcgcgccgcctggccgcggagatcgtccagcaggttccgcccttgctcgaaccgacccaccagatcgtcgtcgccagcaacatcgccctgaccaaccagttggacgtcgaccgcaagcgcctgcaccgggcgttctacgcgttgttctgggcgctgctcgggatcggtgccggcggtgccctgctggtgctgcgcctggtcaccgacttcaaacgcgcacagcaactggccgggcatctgatcgagcttaacgccaccctggagaaacgcgtcggcgagcgcacccgccagctcagcgaaggcaaggcgctgctgcatttcatcctcgaggccagcccgagcgacgtggtcctgctcagcgcctgcggcgccagcatccattacgtcagcccacgcctgctcaagcgcctgggttgccaggcccaggacgacttcaacctgccccggctgttcgccagcaccagcgaatacagccgcctgcagaacgccctggaggcgcgcggccaggtggatggctgggaagcccagctatgcggggaaacgccttgctgggcggtgatctgcgcgcgccacctggaaatcgacggcgagccggcgaccctgatctggtgctacgacatcagccggcgcaaggccatggagcaggaactgcgcctgctggccagcaccgataccctgaccggcctgcacaaccgccactcgttcctgcaccaggcggaactcatgctcaaggccgccgaacgcttccgccacccctgcgtggcgctgatgctggacatcgaccacttcaagaacatcaacgacagccacggccacctgaccggcgaccgcgccctgcaacgtgtcgccgagaccctgcgccagggcctgcgcgaggtggacctgctcggtcgcctgggcggcgaggaattcgccgcgctgcttccagaggtcagcctggaccaggcgctggacgtcgccgaacggctgcgcgccggcgtcgaggcgctacgggtgaacaatcccgacggcgaaccgctgcggatgaccgtgagcatcggcgtcgccctgcgcagggacgccggggacgacctggaaagcctgctggtgcgcgccgacagcgcgctctaccaggccaagagcggcgggcgcaaccgcaccgagtacgcgcccgcctga

SEQ ID NO: 9520 - DNA, 1899 bp, Pseudomonas aeruginosa
cccttcgccgggggaacggcgcaggccatgcatctccagcaggcgttcgaagcggcgcagttggcggctgcgcagatcgccacggccttgccagggcttgagcaggaacagcgcgagcagaccgaccgacaatatcgccgcggcaccgagcaacaggcccagtcgggtcggatcgagcccgccgaaccagcgctgcaggaaggcgccctgctgctcaccctggtaggccaggacccagcgttgccagccatagttcaggctgtcccaggccagacgcatgtcgttgagccagggcaggccacggtagcgcaacggcgacagcggtgcgtcggcgaggtactcgctgtccccggccagggcctgctccagcccctgttcgatccgttcgggcgccacctggtaggtcgggtcgacgctcagccagccctgctccggctgccagtattcgacccaggcgtgggcgtcgaactgatgcaccagcaggtagttgcccgccggattcagctcgccgccctggtagccggccaccactcgcgcaggaatgcccgcggcgcgcaggacgaaagccatcgccccggcgtaatgcgcgcagaagccgctgcgcgtgtcgaacaggaaatcgtccaccccgtcggcaccggtcgctggcggtttcagggtgtaggcgaagggctcgcggttgaagcgctgcaacagggccgcgaccagtgcctgcggttgcgcatgggcctggcgcagttgctcggccagggcgcgcgcgcgcggattgccgtgcatcggcaactgcaggttgcgccagcgcatgcgcggatcgatgctggactcgcgcagcgcctgtggccaggaactggctcggtagaacagacgttgctcgaccggctgccgccgctgcaggtggaaatcgctcatcaggcgcgtgtcggtctggtcggtctgcgccacgtcgagggcgaacagccagggctgcgaactgggctgcatgatcacgtcgtagcgcagctcggggccacgcttctgccagtgcatagcatcctcgcccgaccattgcggcgcctgagcccaacgtcgtccgtcgaaacgctccatggtcaaggcgcgccagtagagctgctcgcgcggcggcggtgcgccctcgaagcggacccggaacgccagttcggcggagcgcccaagctcggcgatatcccctggcgccatgctctccgagagtccggtgacccccttgttgccgggcatcggcaacgaccacagcggccccaggcgggggaagaacaggaacagcaggagcatcagcggcagcgcctgcagcaacagcccgccggccagccgcagggtcggccagggccggctggcgaaagcgctctgctgcaatccgatcagcgccgccagcaacgcggtcaccggcagcaggctgtacagcgcggcgaggaaaccgtcgtcgaacaggtagcccaccaccactgcgaagaaaccgaggaacaccagtaccagcgcatcgcggcgggtcttcatttccaccagcttgaggatgaacgcggcgatcagcagcaccgcccccgcgtccaggcccaccaggctgccgcgcgacaaccagaccccggccccggcgagcagcgccagggccagcttgacccaggcgcgcggatagccggcacgcatgcggaagacctgcacccgccaggccgcgcaaccgagccacatggccgcgatccacagcggcaggtaggccaggtgcggcaggatcaccagtacctgcgccaccagcagccagaccagcgcgacccgcggaatcgcgttcatcgcgccgctccgaacaacgccagcgcacgcaggcaggcctcgcgctgggcctcgccgctggccggttgcaggcgtgtgccgggcagcgccaggccatag

SEQ ID NO: 9521 - DNA, 660 bp, Pseudomonas aeruginosa
ttgatcgccgccagcagcatcaccagcagcgccaggccgaaagcgccgccctggcgggtcggcaggatgaatacgcgacgctggttcagctcgacgctgctcgccggcggtatccgccggttcagccagcgctgccagcgcggccagttgcgcaggcgcatcagagcgccgggacttcgcgcaacagccattgcaccagcgcgccgccaccgtgcccggtggggtccgcctggtcgcgcaggcgatgcccggcgaccgccggcaacaccgcctggacgtcttccggaatcacatagtcgcgtcccgccagcagcgcccaggcacgcgccgcggcgagcaacgccaggctaccgcgcggcgacaggccgagggcgaaggccggctgcgtgcgggtcgcttcgaccaggcgcagcacgtagtccaccagcgcatcgctggcgcggaccttcggcacttcggcctggaaagcggccagcgccgcgtggtcgagcaagggttccaggcgcggcagcagatcgcgccgggcttcgccgagcaacagcgagcgttccgccgcgcgcccggggtaacccagcgacaggcgcatcaggaagcgatccagctgcgattccggcagggagaaggtgccgccctggctggccgggttctgcgtggcgatga

SEQ ID NO: 9522 - DNA, 1155 bp, Pseudomonas aeruginosa
gggtggtcttgcccatccccggcaggtcttcgatcaacaggtgcccacgggccagcaggcaggccagggccaggcgcacctggcggtccttgcccaggagaatctcatcgaccgccttcaggcaggcttccagggtgttcagcatcccgacctcgcgtttccggggaaaacagcgatcctactggcctggggccagccggcaaggcacttgcaatttttcctcacgaaactgtgaaaccgttgccaccggtacttgccggagtgcccgctacaagcctagacgctgggggagggacaggcgcccccctgggcgccggcgcggatgatgcctgcgccagtccggctcgacacggcgcgcgacggtcgccgacggcaggcgtgggggaagccgcctcagcccagttcggcgacgatcgccgccagcgccttggccgggtcggcggcctggctgatcggccggccgatcaccaggtaatcggagccggcgtccagggcctggcgcggggtgaggatgcgccgctggtcgtcctgggcgctgccggccgggcggatgcccggcgtgaccagttgcaggcccggatgggcggccttcagcgccggcgcttcctgggccgagcagaccaggccgtccatgccggccttctgcgccagggcggcgaggcgcaacacctgctcctggggctcgatgtcgaggccgatgcccgccaggtcctcgcgctccatgctggtcagcacggtcacgccgatgagcaacggcctgggcccgctgaaggcctccagcgtctcgcggcaggcggccatcatgcgcaggccgccggagcagtgcacgttgaccatccacacgcccatctcggcggcggccttcaccgccatcgccgtggtgttcgggatgtcgtggaatttcaggtcgaggaacacctcgaagcccttgccacgcaaggtctcgactatacccgcggcacaactggtgaagagttccttgccgaccttcacccggcacagtttcgggtccagctgatcggccagcgccagggcggcctcacgggtggggaaatccagggcgacgatgatgggggactggcaggcggacatgggctctctcgcggcgaatcgaaaacggcgcgcattgtcgcagaatccggccgtttgccgtag

SEQ ID NO: 9523 - DNA, 1614 bp, Pseudomonas aeruginosa
  unsure (250): Identity of nucleotide at the above locations are unknown.
cccggaacgcgccggggagatgaacgtcgtggactaaaggcgggcgcggagcagttgctccagccagtcgacgaatgccctgacccgccgcgacagatgccgccggtgcggatacagggcgtacgccggcatcgcttcggcccgccactgcggcagcacctcgcgcagctcgccgcgttggaggtgctcgcgcacgtcgtaggcagggatctggatcaggcccagtccggacaggcagcaggcgatgtanctttccgcattgttcaccgtgacccggctgcgcaacgcgcgggtcagggtgcgcccatcctcgcgatactcccagggcaacacccggccgctgctgggcgaggcatacttgaccgcccagtgccggtcgaggtcggctggcgtccgtggctcgccatgctcttccaggtaggcgggactggcgcaattgatcagttgcatctcgccgaggcgtcgcgccaccaggctgctgttgcccaactggccgacccgcaggacgcagtcgacgccctcctgcaccaggtccaccgaacggtcgctggaacccagttccagttcgatgtccggatgctggcggaagaattccggcagcgccggggcgatcagcagtcgcgccacccggctcggcacgtcgaccttgagccggccgctggcgcggctgccgtcgtggaacaggctctccagctcctccatgtcttccagcaggtggcggcaacgctccagcaccacgctgccgtcgtgggtcagctggacctgccgggtggtgcgatgcagcagccggctgccgagttgcgcttcgagctgctggaccgccgccgagaccgtcgcccgcggcatgtccagcaggtccgcggccttggtgaagctgccggtttcggcaacgcgcaggaacacgcgcatgctgtccagacgatccatgggcaggccccttctctctattcgggatggctggacagtctatccatgccacctacgtttatccaaagaacccggaccaatagcctggagtccctactctacttcctggatccgcagatgccccatgcagcgcttttgcttcctcccagcgcgtccccgctgccggaagtggtcgggttctggcgcgatgccggccctaccctctggttcgccaggaacgccgatttcgaccggcgcttccgcgagcgcttcgcccacctctacgagcttgcctgcgccaacgcgctgcgcccggctgccgatgaagccgaggaccatctcggcctgctgttgctgctcgaccagtacccgcgcaacgccttccgtggaaccccgcgcatgtacgccagcgacgcccaagcgcggcgctgggcggagcgggctctgggacaaggcctcgaccgccaggtcggggacgcgctgcggctgttcttctacctgccgttcgcccatgccgagaaccttgccgaccaggatcgctcggtagcgctgaaccacggactcggccagcccttcctcgcccacgctcgtgagcatcgcgagatcatccgtcgcttcgggcgctttccccatcgcaatccgatcctcggtcgcccgtccagcgccgaggaactcgccttcctcgccgccggcggcttcgccggctga

SEQ ID NO: 9524 - DNA, 417 bp, Pseudomonas aeruginosa
ctgatcgacaggccgagcccggtgccctgccccaccggcttggtggtgaagaacgggtcgaagatccggccgaggacctcggcgggcatgcccttgccgttgtcctgcacggagaggaacacctggcgctcgtcggcccagctcttcagcaggatgcggccgaaacgctccatggcctgcgcggcgttggtcagcaggttcagcagcacctggttgatctgcgacggcgcgcaggcgataagcggcagctcgccgagctggctgctgatctcggccttgtccttgatggcggtgcgggcgatcagcacggcgttgcgcacgcagtcgttgaggtcgacctcctcgctgaaggcgcggtccaggcgggcgaagtccttgagcccggaaaccagctcgccgatctggccgaggccgtag

SEQ ID NO: 9525 - DNA, 1635 bp, Pseudomonas aeruginosa
aggaccaggaggactgacatgcccgcgatccagtcggaactcgacgtcaacggcgaggacttcgcccgcaaccgcgaggccatgctcgccgccgtggccggcttccgcgagttggagcagaaggtcctggacaaggccgccgaggccaggccgaagttcgagaaacgcggccagctgctgccgcgcgaacgcctggcgctgctgctcgacccgggcgcgccgttcctcgaactgtcctcgctggccggctacaagctgcacgacgacaaggacggcacccaggccggcggcgggatcatcgccgggatcggctacatcgccggggtgcgctgcctggtcagtgccagcaacagcgcgatcaagggcggcaccatctccccgaccgggctgaagaagaccctgcgcctgcagcagatcgccatggagaacaagctgccggtggtgaccctcaccgaaagcggtggcgccaacctcaactacgcggcggagatcttcgtcgaaggtgcgcgcggcttcgccaaccaggcgcggatctccgccatgggcattccccaggtcaccgtggtgcatggttccagcaccgccggcggtgcctaccagccggggctgtcggactacgtggtggtggtgcgcggcaaggccaagatgttcctcgccgggccgccgttgctcaaggccgccaccggcgagatcgccagcgacgaggagctcggcggagccgaactgcacgcgcaggtcgccggcaccgcggaatacctggcggaaaacgacgccgacggcgtgcgcctggcccgcgagatcgtcggcatgttgccgtggaacgcacaactgccggcgcgcccggcgcgttcctggcgtgaaccgctgtacccggtggaggagctgctcggggtggttccggccgacccgaagaagccctacgacgtccgcgagatcgtcgcgcgcatcgccgacggctccgagttcctcgacttcaagaacgagttcgacggccagaccgtctgcggccacctgcgcatcgagggccacgcctgcggcctgatcggcaacaacggaccgatcaccccgcagggcgcggccaaggcggcgcagttcatccagctctgcgaacagagcaacacgccgctgctgttcctgcacaacaccaccggcttcatggtcggcaccgagtcggagcgccagggcgtgatcaagcacggctcgaagatgatccaggcggtggccaacgcccgcgtgcccaagctgaccctggtggtcggcggctcctacggcgccggcaactacgcgatgtgcggacgcggcctcgacccgcgcttcatcttcgcctggccgaacagtcgcaccgcggtgatgggcggtgcccaggccggcaaggtgctgcgcatcgtcaccgaggagaaacacgccaaggaaggcaaggaagccgatccgaagatgctcgagatgctggaaaccgtcaccgcgcagaagctcgacagccagtccaccgcgctctacggcaccgccagcctgtgggacgacggcctggtcgacccgcgcgacagccgcaggctgctcggctacctgctggatatctgcgcggaagccgaggcgcggccgctgaagggcaacagcttcggggtcgcgaggttctga

SEQ ID NO: 9526 - DNA, 408 bp, Pseudomonas aeruginosa
tcttcacccaggaacacgaggaactccgccgcaccgttcgcagcttcgtcgagcgggaaatcaaccccaacgtcgaccagtgggaaaaggacggccgcttcccgatccacgagatcttccgcaaggccggcgaactcggcctgctgggcatctccaagccggagaagttcggcggcatgggcctggactacagctactcgatcgtcgccgccgaggaattcggcagcatcacctgcggcggcatcccgatggccatcggcgtgcagaccgacatgtgcaccccggccctggcccgcttcggttccgacgagttgcgcgaggagttcctccgcccggccatcgccggcgagatggtcggctgcatcggcgtctccgaggtcggcgccggctccgacgtcgccggcctga

SEQ ID NO: 9527 - DNA, 594 bp, Pseudomonas aeruginosa
cgtgcgggcgctggtgctgcgcggcgccggcgggcacttctgcgccggcggcgacatcaaggacatggccggtgcccgcgccgccggggcggaagcctaccgcacgctgaaccgcgccttcggcagcctgctggaggaagcccaggccgccccgcaactgctggtggcgctggtggaaggcgcggtgctcggcggcggtttcggcctggcctgcgtgtcggacgtagcgatcgccgccgccgatgcgcagttcggcctgccggaaaccagcctcggcattctcccggcgcagatcgcgcctttcgtggtccgccgcatcggcctgacccaggcccgccgcctggccctcaccgccgcccgcttcgacggccgcgaggcgctgcgcctgggcctggtgcatttctgcgaggccgacgccgatgccctcgaacagcgcctggaggaaaccctcgagcaactgcgccgctgcgcgccgaacgccaacgccgccaccaaggccctgctgctggccagcgaaagcggcgaactcggcgccctgctggacgatgcggcgcgacagttcgccgaagcggtgggcggcgccgaaggcagtga

SEQ ID NO: 9528 - DNA, 2592 bp, Pseudomonas aeruginosa
actgggctaccgcagcgttgccgtgtacagcgaggcggacgccgacgcccgccatgtgcaactggccgacgaggccgtgtgcatcggcccggcagcggtggcgcagtcctacctgaatctcgaggcgatcctcgacgccgcccgtcgcagcggcgccgaggcgatccaccccggctacggcttcctctccgagaacgccgaattcgcccgtgcctgcgaagccgccgggattgttttcatcggcccggatgcggaagccatccacctgatgggcagcaagcgcctgtcgaagatcgccatgctcgccgccggggtgccgtgcatccccggctacgaaggcgccgaacaggacgacgcgaccctgcggcgcgaggccgaacgcatcggctacccactgatgatcaaggccagcgccggcggcggcggccgcggcatgcgcctggtggaggaacccgaccaactgctggaccagttgcgcaccgcacgctcggaagcgctgggcgccttcggcagcgccgaactgatcctggagaaggccgtgctgcgcccgcgccatgtggagatccaggtgttcggcgaccgccacggcaacctgctctacctcggcgaacgcgactgctcggtgcagcgccgccaccagaaggtcatcgaggaagctccctgcccggtgctcgatgccgacctgcgtcgcgccatgggcgaggcggcggtgaaggccgcggcttcggtcaactacgtgggcgccggcaccgtcgagtttcttctcggcgaggatggccgcttctacttcctggagatgaatacccgcctgcaggtcgaacacccggtcaccgaactggtcaccggccaggacctggtggcctggcagatccgcgtcgccgagggccatccgctgccgctgcggcaggaacaggtggaactgcgcgggcatgccatcgaggtccgcctctacgccgaggacgccggtcgcggcttcctgccgcagaccggcacggtgctgcgctgggacccggaactgctgcccggcgtacgcatcgaccatggcctggtcgaggggcaggcggtgacgcccttctacgacccgatgctggccaagctgatcgcctacggggcgacccgcgacgaagcccggcgcaagctgatccgcgcgctggagcgctgcgtgctgctgggggtcgacggcaaccagcggttcctcgccaacctcctggcgcatccggacttcgccgccggcgaggcgaccaccgccttcatcggcgaacgcttcgccgaagaccccagcctgcaaccgcgccagccgggcgccgaggaactggccctggccgccgccctgctctaccaggccggcgccgaggccagtgcgcaccagcccggcctggccggctggcgcagcgccgccggggcaccgtggaagatcgtcctgaagcacgccgaacagcgcgtggagatcggcctggacgtcctcgaaagcggtcgccggccgcgactgctggcgcgcctggagcgacgcgagatcgccgtgcgcctgctcgactgcgacggacgctgggccagcgccgaactcgacggcattcgccgccgccacgcgtaccacgtggacggcgggcgcctctgggtatacggccacggcggcaacctcgaactggtagaggtcacccacgccggcgccagcgcccaggtcggcgccagttccggcacgctcaaggcgccgatggacggcgccatcgtcgaggtgctggtcggcgagggcgaacgggtcggcaagggccaactgctgctggtgctggaggcaatgaagatggaacacccgctgaaggccggagtcgacggcgtggtccgccgcgtccaggtcggccgtggcgagcaggtgcgcaaccggcaggtgctggtcgaggtggaagccgacgcctgagacaccccgccgctcatccgcaacgacaacgacaagaaaacggagacgcccatgtcactgcacggcaagaccctgttcatcaccggcgccagccgcggcatcggccgggagatagccctgcgcgccgcgcgcgatggcgccaacctggtgatcgcggcgaagagcgccgagccgcatccgaagctggaaggcaccatcttcagcgtcgccgccgaggtcgaggccgccggcggccaggccctgccgctgcaactcgacgtgcgcgacgagcaggccgtggcggcggccatggcccgcgccgccgaacgcttcggcgggatcgacgcgctggtcaacaacgccggggcgatccgcctggtcggggtggagaagctggagcccaagcgcttcgacctgatgtaccagatcaacacccgcgcggtgctggtctgcagccaggccgccctgccctacctgcgcaggagcgccaacggccacatcctcagcctgtcgccgccgatcaacctggccggcaggtggttcgcccagcacggcccctacacggtcaccaagtacggcatgagcatgcttaccctggggatgcacgaggagttcgggaaatacgccatcagcgtcaacgcgctgtggccgaagaccatgatcgccaccgccgccatcgagttcgagctgggcagccgtga

SEQ ID NO: 9529 - DNA, 2184 bp, Pseudomonas aeruginosa
cgccttccgccgcgcgcgcaccccggcgatcatggccgacgccgcgcacgccattctcaccagcgaggggcgcagcctcagcgggcgcctgctggtcgacgaggaattgctgcgcgagcgcggccagagcgatttcgagcagtaccgctacgacccggagggtggcgcgctggtgcccgacctgttcctcgactgaggtctccgacgaaaggcgcgcggcgctctggggcgggcttccgggctatttgccgaagtgccccggggcgaccgcgcaacggtcatagccgaggcggcggctgcggtctagagtcgcgggagcgtcctacgccccgcacaacaacgactagcgcgagagccatgacccacgccgacctgatcactttcaaccgtttcgttgcccgcctgcctgccaccttcggccgcgtgccgcgcatgctgcgcggcctgtactacaccgcgatccgtaaccgcgagaagagcctgtccctgggctgggcgctggagcgcgcggcacgcctgtacccggacaacccggcggtgctcgacggccatcggcggatcagctacgccctgttcaacggctgggccaatcgcctggcgcgcgccttcaaggccgagggcgtaggccacggcagcgtggtcgcggtgatgctggaaaaccgcgtcgagctgctggcgatcctcgccgccctggccaagctcggcgccatcggcgcactggtcaacaccacccagcgcggcaaggtcctggtgcacagcctgaacctggtgaagcccggccacttcgtggtcggcgaagagttgcgcgaggtgttcgaggaagtccgccaggaggtgctcggcaacgccggccattgctactgggtcgacgacggcgacaccctcggcgatcccggctcgccgccgatgggctggcgcaacctgatgcgcctggcccagggacagacctcggagaacctcgaggacaccggcagggtgcggctcaaggactcctgcttctacatctacacctccggcaccaccggcctgccgaaagcctcgatcatgagccacggcaagtggatcaaggcctacggcggcttcggccattccggcctgggcctgggccgcgacgacgtgctctacctgaccctgccctgttaccacaacaacgccgtgaccgtctgctggagcgcggcgctcgccggcggcgcggccatggccctgcgccgcaagttctccgccagcggtttctggaaggacgtgcaacactaccgggcgacctgcttcggctacatcggcgagctctgccgctacctgctgaaccagccaccgtgcgccgaggaacgcggcaatagcctgacctgcatgatcggcaacggcctgcgcccgtcgatctgggccgagttcaagcaacgcttcgagatccagcggatcaccgagttctacgcttccagcgaaggcaacatcggcttcaccaatgtattcaatttcgacaatacggtgggcttctccccagccacctacgccatcgtccgctacgacctggagaacgaccatccggtgcgcgacgccaagggcttcatggagaaggtcggcaagggcgaggtcggcctgctgatcagcgagatcagtgcgaagtggccgttcgacggctacaccgatccggccaagagcgaagcggtgatcctccgcgacgtgttcaagaagggcgacgcctggttcaacaccggcgacctgatgcgcgacatcggtttcaagcacacccagttcgtcgaccgtctcggcgacaccttccgctggaagggcgagaacgtttccaccaccgaggtggaaaacgccctcggcgccttcgacggggtcgaggatgcggtggtctacggcgtggagattcccggcaccaacggccgctgcgggatggccgcgctgcgcctggccgatggcgtcgaactggaccgcgacgctctcgccgcgcacctcgaccgcgagttgccggcctatgccacaccggtgttcctgcgcctgctgcgcgaagtcgagaccaccggcaccttcaagtacaagaagaccgacctcaagcgcgacgcctacgatcccgcgcgggtcagcgacaaactcttcgtcaggttgcccggcagcgccggctaccagccgctggacgcggagctgtaccaggcgttgcaggagcagcgctaccgcttctga

SEQ ID NO: 9530 - DNA, 504 bp, Pseudomonas aeruginosa
ggcggaagtcgctgtcgtccttttcctcgaacatcggcggcaacagcggcttgggcttatgggtctcttccgtgccgggcggcgccatcttctgcaccagttccttcggcaggcgcaggtccagcttggcgctcggcagcggcttgcgtacctcggggtcgagacgagcggtggaagcgcgcttcgccggcgccggcttgtccttggcgaccggcctgctggccggcttcggcggcgcagccgcaggcttcggcttggccggcggcttgggttcggcaacctgctccgcggctggcgcgaccttcttcgaagctgttttcggcgcggcaggcacggcaggcgctggctccgctcgtgcaggcttcactggcttggcaggggcgcgctgctcctgcggcggtgcttccggggctttcttttccggtgccttggagccgtcatcgcaggccgccaggaagcaaccgaaaagaacaacgacgcaaattcggcaaagacgtttcatag

SEQ ID NO: 9531 - DNA, 609 bp, Pseudomonas aeruginosa
cggcagactgcaaccaaggcaaggggtcactatcgtcatcctggcactctctctgttgttcgccccatgtctaacctgtcatgcgcggataaccgcttgatgtcagcccgcgacgccgccgccgcgtcgcgggccatggtcgtcacggccgtttcttggcgctcgcggctatcgtcgcgaggcgttccagtcgttccaccaggttctctccggggaaacgtttctgcagctcggccaactgggtcgcggcctgctccgtcttgccctgctcacgcagggcaaggaccgccccgagcgcctcgtcgagcacctccggcttcaccgcaaccgccttgcccctggcctgggcgacgaagtcgccggccagcgccgcctggaccttcgcctgctgcgcggcctgggccggcggtcggtcggccagggcagccggagccggcggcgcggcctcggccatcagttgcggcgcctccccggacgatgcgtagctggccagcaaggccgggggctccgacatctcgccggacagcggagccggcgccgccggcgcgcgcatggcccgcttcgccgcagcggccccggcgactccgtcgcgcaggggcacatcgctga

SEQ ID NO: 9532 - DNA, 1062 bp, Pseudomonas aeruginosa
ccagccccagcaccagcgccacgcccagcaggctggcgaaagccgcctgccaacgcggcctgcgggaggcttccagccagcgccgccaccaggaccgggcgggttcgacatgcgccgcctggcgtcgcgcggcggcgaggatcgcctggtccagcgccggcgccggctgctgcggcgcgtgggcgcggaaatgcgccagcatctgctcttcggcgacgctcgcggaatgcttctgtgggttcataccgccacctcctcggccagcagccggcgcagcttctgcaccgcgtagcggaaacggctcttcaccgtctccagcggcgactgggtgagcgtggcgatctcggccagttccagttcgccgtgggcgcgcatcaggaatacctcgcgctgttcctcgggcagggtctccagcgcgctctgcaagcgctcgccgtcgcggctcaggctgagctgctgctcggggccggcgccctggtcgggttgcgcgtgcaactgttcgtcgtagctgtcctgcaacggctggcgctggccatgcttgcgccaatgatcgatcaagcggttgcgggcgatctggtagagccaggtgcggaagctcgcccggccctgcggctggctctcgctgcggatcaggctgagccaggtttcctggtagatctcgtcggccagttcggtctgtccggccaggccgcagagaaaacggtagagaccttgccgatggcgctggtagagcacctcgaaggccgcgctgtcgcccttgcggtaacgcgccagcagcgtttcgtcgctgccggcggccgtcgtggcgctggtggaggcatgcatgccgctggtcgactcctgtcctgtgtcaaaggcgaccgagagcaggctcatcggccacatccttcgcggcacgcatcggcgtcgccacgaaacgcccgggccgtcgccagaagcgcggccggagcggctatcggtagacattttccagcgtcggacagttcggcgaaagtgccggtccggatggaagccgggaaaaacatcgagacgacctcgtcgtgcagcggagatacccgctga

SEQ ID NO: 9533 - DNA, 3654 bp, Pseudomonas aeruginosa
ctggacaggcgttcggcgcgggccagcgattcgccggcgcggatcacatccttgggcgccgcgcggagcacgtcggaatcttccttgacctggtcgaactcgctctgcgccttggccagcgactgttcgctgagcttgtggtcggcgcagccagccagcgcggcgcaggccagcagggtggcgaagagagtcgctttgcccggcatcagtcggtctcccccagttgcttgcgcagacgtttcaggctcttgtccagctcgccgagctggtccttgctcttctgcgtcagcaccttggactcggcgaggcgtgcgtccagctcggcctgctcggccaacaggcgcgccttcttgtaggactccgcggtcatcgcgatctgcgccgcggcgtacttgtcctgggccagtttcagctcggccacgtcgtcggtggcacccaccgccttggcctgctccagcgcctgttcggtcaggcgcatctgctccagcggagccgggtcgttgctcgcacaaccgctcagggtcagcgcggcgaggcctgcggccatcatccatcgaatgctcacaagtcactttcctgcgtagtcgaactggcgccggaagccggcaattgctgggctttccagcgttcgagattgtcctgcaagagcgttacgggaacgccggcagccgacaattctgtcatctttttcgccagttgtccgcgcagccacggatcgttgcaggcggagttgtgcgacagcgtcaggtacagcccctcgctgctcagcaccggttccagcgcctccaggtcgtcggccatgcccagcgcctcgacctgggcctgcccgggcaacgcctggtagaggaggaactcgctgcgcttgagcatcaggtcctgcaagccctgggtcaggctcggcaccggcttcaggtcgagactggccttggcgaagcggtcgaactcctcgcccaggctgctgccggccagcacgctgcccttgtgcccgatcaggtcgtcgcggccgatgaacgggaacgcggcgtccttgttcacccagaccaccccgctggtcatcaggaacggcggatgcacatagtccatgctgccgagccgtgccagggtcaggtaagccccggcgagcaggtcggcgcgaccgctggtcacctcttcctgggccttctcccaggagccgctgtagagcacgtcgatgcgcacgccgagctccttgcccaggcgctgcaacaggtcggcattggctccgatcaggcgcttcggatcctgcgggtcgcgccacaggtagggggggtactccgggttgccggtggccaccaggcgctcgcaggagccggccgccgcggccagccccggaacgaacagcgccgccagcaggatgccggccaggcggcacggggaacagcgaaaggacatggattcaggctccgcggtacagggatgcgcgcagcagtctgccacatttccgcgcgcgctcccgccccgctattccgatgggtaccagcgcggcgtgtagacccaggcttcgccgtcggcgcgcgggaagctgcgggtagtggacgagccgatgatcaccagggtgcgcatgtccacctgctccgcacgcagctcgcccagggtggtgcgcagcaggcgctcaccgggccgcccgatgtcgcgaccgagcaccaccagggtctgcggcgaacgatggcgggcgacgatctccagcgcccgtcccagttgccagggccgcgcccgcgagatcggattgtagaaagccatcgccaggtcggcggcgccggccaggtccaggcgccgctcgatcacctcccagggcttgaggttgtcggacagcgacagcacgcagaaatcgtggcccagaggcgcccccgccctggccgcggtggccagggccgccgagacgccagggaagatccgcagctcgaccgcgtcccaggccggctcgccagcgccatgcagggcttccagcaccgcggcggccatggcgaacacgccggggtcgccggacgataccagcaccaccgccctgcccgtcgccgccagttcgaaggcatgccgggcgcgctgcaattcctcgcggttgtcgctgccatgcagcacctgtccggcgcggaagggtccggccatgtcgacgtaggtctggtaaccgaggatgtcctcggcctcgtccagtgcccgccgcgccgcaggcaccatcagctcggcgcagccgggccccaggccgatcactgtgagtcggccgcgacgctggccgatgcggtccatcgccaagggcgcggcggccaccgccagccggtcgccgacctgctcggcggcgggcaaggcctggcgcaggcgcgcagcgggatcggcctgcggcaggaagcgcagcggtacgccgagcgcatcggcggcggcctgcaggcgcggatcggccatccgcgcgctgtcggccagcaagccgccgagcgccgccgcggccaggccggcatcgaccagcgcctggcgcaccgcgtccgccgccgcgtcggcaggttcgagcgccgccagcacgcagcgcggatggatcagcagttcctcggcccgcggcgcacgcgccgagggcgtcacgtgaatcgccagcgctgcctccgggtcgcgcggcaaacgggccgcgtcgagccagtcggcggcaccctcgacgcgcaccggctggccaccgagcaaatcggcaacgaagcgcttgccctgctccaggtcggccaggacataaccggcgggcgggttgagcacgcaggtgccgaagcgcagctcgccgctggtggtgatcgccggcgccacggccagcacctcgccgatttcccgcgccagccggttgaccccggccagcccgccgagcagcggcaccaccgcgctaccgtcctcggccagggccagcaccggcggctccgctcccttgcgttgcaacaacggcgccaggctgcgaatgacgatgccggcggcgcacagggcgacgattgggcggtcggcgcaatacagttcgcgcagggtgtcgccgaagtccgtataggaacggtcggcctccacccgcccggcgagcccgtggaccagcgccccgggatagcgcgcctggacccgccgcgcggtatccagcgcgccctggccgaggatgacgatggccggaacctgctgggcgtcactcaccgccggcccctccctgccacttgtcgccggggacgacgatcagcgagaagtacggcgaggccatcggctccacccgttccaacggcacgatccgctggttggccatggtcgcccgctcgacgtacagcgcgcggcgctcgaggccaagctcgaccagcacgcggcggaccttgtcgaaattgcggccgagcttcatcaccaccgccgcgtcggcatccgccaggcgccggcgcaactcctcctcgggcagcactccggagagcaccgagaggctctggttgcggtacaccagcggcgcaccgagcaccgccgcgccgccgagcatcgagcagacgccaggcaccacttcgctttcgtagcgcgtcgccaggcggtcgtgcaggtacatgtaggaaccgtagaagaacgggtcgccctcgcagatcaccgccacgtcgcggccggcgtccaggtgcgcggccagctgttcggcggcggtgtcgtagaaatcgctga

SEQ ID NO: 9534 - DNA, 657 bp, Pseudomonas aeruginosa
tcagttcgggatcgccgggcccgacgcccaggcccagcaggcggcccttcacgacactcatcattcgcgctccgtggccagggcgttcaccgccgcggcggccatggcgctgccgccacggcgaccgcggacgatcacgtaaggcaccccgcggctatcggcggcgagcatctccttggattccgcggcgccgacgaagccgaccgggaagcccaggatcagcgccggtttcggcgcgccggcgtcgagcatttccagcaggtagaacagcgcggtcggcgcgttgccgatcaccaccacgctgccctccaggtgctcgcgccagtgctccaggggcccaccgccgagcgggtattgccgagttccgtggcgagcgccggcacgtccgcttcgttgagggtgcagatcacccggttggcggcgggcagccgcgagcgggtcacgccttcggcgaccatccgcgcgtcgcagaggatcgccgcgccggcggccagcgcggcgcggccggcggcgccggcgccgggcgagaagcgcaggtcgtcgaccacgtcgaccatgccgcaggcgtggatcaccctgaccgcgagcttttccaggtcggccgggatgccggcgaggttcgcttcggcgcggatggtggcgaacgactggcgatag

SEQ ID NO: 9535 - DNA, 882 bp, Pseudomonas aeruginosa
gcggcgcgcggtgggcagcggcgcaggaccgttcgcagccgcacaggtgcagttgcggcaggtcgctgcgcgggccgaggcgttcggccaggcgcaaggcgtcgcccttggtgtcggccaggcctctggcgcaggcgctggaaccgctgcaggcgatcagccgcgccaacggcgcatcgggctcggtcagcaggccgagtccgcgcaggccgagcagcgcctggtcggcctcggcgtgcgccaggttcggcaggagcacgccttgccagggggtcaggcgcaggctgccgtcgccatggcgttcgaccagctcggccaggccttccaggcaagcgctgtcgagccggccgagcggcgccgccgcgccgaccatcaccaggcccggctggcgttgcggctggacgccgagatgactccacggacgccccggcgaacgccgccaggccgccacccgctcgtcacgccgcagagggaaatccaggcgcgcctgcaaggcctccagcaaggttctccggccagctcctgcaacaggtggcgcattcgccgtctgttgcggctgggcgcgctcgaggaacaggtcgagcagcgccagcaccagggactcgccccgctccgccggcaacgccgccagggggcggtcgcgggccgggcagccggcgagtccgaagaccagcgtcgcggtcggcgccgcgggcatcggcgagagccagatgtcatggggatgttcgagcatcgccaggtcttcgccgccgtccagctggatggcgaacttggccgacagcgcgtggtagcggctgtccgcctggagccgcagcaacagccgagcggccagcgggcgcacgtccagcgacaggtgcggatcgagcccggcggccgggctga

SEQ ID NO: 9536 - DNA, 1680 bp, Pseudomonas aeruginosa
tgcggcagatgccgccgtccagcgcctggacgatacgcagcaggccgggacagggcgacggacgtggtacgggcaggggcgccggggtctggtcgtcgttcaaaaacgctactcgaatcggcgtcgcggcgaccgcaccgctgtcccccagggacagaccacggcatcggtacaccccgcccgatgttggcactcgcgactggtttcggcggcaggtctcctggctcgcagcccggcgttccacccgggggaggaacctccgcttcgcgccgccttcccggtaatccagtggcgaatggcgcgaatacaggctgcatacagttgcgggggcagccacggctaggcccgggcttcgaaaagaccgcggctccgtgttccctcttcggccctcgttggccccgcgctaacgcgaaagggccgggcaccgacgaacgcgctattatgccgcccagcccggggccgggaaaacccattccgtccggaagccgtcgcgggcccttcacagacgcatttcaggagtatcggaaccgtgtcatcggcagactcgacgccgccctggctgaccctggtgggcatcggcgaggacggttatcccggcctcggcaagcaggcccggcgtgccctgctgcaagccagccggatcgtcggcgcggcgcgccagctggaactgctgccgccgtgcatcggcgccgcccgcgaaacctggccgacgccgttctccctggaaccattgctggcccggcgcggccagccgacctgcgtgctggccagcggcgacccgatgctgttcggcgtcggcgccagtctcgcccggcaactgccggcgaccgaactgcgggtcctgccggcgccctcctccctctcgctggccgccgcccgcctcggctgggccctgcaggaggtcgcctgcctgtcgctggtggcgcgcccgctggcggcgctgcaggcacaggtccacgacggccggcgcctgctggtcctcagcaacgacggcgacagcccggccgccatcgcccgcctgttgaacgcccgtggcttcggcgccagtcgcctgagcgtgctggaacacctcggcgggccgctcgagcgccgtctcgacggcctcgccggcgactggtcgctgccgcgcgccgccgatctcaacctggtggcggtggaatgccgcgccggcgccggcgccgtgcgcctgccgctgaccccgggcctggccgacgaagcctatcgccacgacggccagttgaccaagcgcgacgtccgcgccgtgaccctggcgcgcctggcgccctgccccggcgagctgctctgggacgtcggcgccggttgcggctccatcggcatcgaatggatgcgcgcgcaccccagttgccgggcgatcgccatcgaagccaacgacgagcgccaggaacatatccgccacaaccgcgacgccctcggcgtaccgaccctgcacctggtcgccggcagcgccccggaggcgctgctggaactgcccgagccggacgccattttcatcggcggcggagtcaccgccgagggcgtgctggaaacctgctgggagcgcctgcggcccggcggccgcctgttcgccaacgcggtcaccctgcagagcgaacgggtgctgctcgactggcagcaacgcctgggtggcgacctccacccgctcttcaccaaacgggaatc

SEQ ID NO: 9537 - DNA, 738 bp, Pseudomonas aeruginosa
gcaagccgcttgggattgcgggctttctggacttggcggacaaccccgccgcgcccctggagcgcatccgcggtggcattcgcagcggcatcgatgggctggcggcctttctgcggcgcgcggccgatgccggtgtggctcatgtcgcactcaatccaaagatcagccgacggccctatgcggacgtcatggaagaactggccgaggcgcttgtgcggccggccagcaaggcgtccctcgagtctgcagtgcagtgatccattcttgatgttgaggactttcatggaaatgcttttttcaacctatgacctggccggcctgccgctttccaaccgcatggtcatggcaccgatgacgcgcgcgcgcggtcaacgacgtaccggatgcggcgacggtgacctattaccgccagcgcgcatcggccggcctgatcgtcagcgaaggggttccggtctcgcgcgagggcatgggctacttgttcacgcctggcttgtatacggagcagcaggtcgcgggctggcggctggtgaccaacgcggtgcacgaggccggcggccgcatcttcgcccagctctggcatgttggacgcatctcgcacgtctcgctgcaggaggcaggcgcgtctcccgtgtcttccgtcgcccggcgagcagagaattcgcaggcttacgcctggatcgtgcaaggcctggccggccaggtgccggcaagcgccccgcgcgccttggccgaggatga

SEQ ID NO: 9538 - DNA, 1488 bp, Pseudomonas aeruginosa
cacctccggctctggcgcatgcgtcgggggcggtggtacctgcgacagtcgctggaatgtgattcccccgtcgtttggcgtcacgacgatgggttcggccaccacaggcggaacggatgccgcagaagcagcagcgacgatggtgttgggcttgtcctcctctgccatggccggcacgccctcgatatggatcgtgaggtgcgcgctggccgcttccacttggccctgttcgagcagatcgagacgatccgcccagtcctgcatcatccggcggcgcggctcaacatacttggcgtggttgtaggccgaactcaccttgttcgggtccgagtgcgaaagctgcgcgtccacccaaatcttgggatagccgatctcgttgagcgccgtcgagatggttccgcggatgccgtgaccggtcagttgatcctcgtagcccattcgtttcaaggccgcgttgagggtgttctcgctgatgcgcttcttgagttcgctgcggtgcgtgagcagatggacctgagccggcctcatcacacccaacaggtagcgcacgatctcgatggcctgcacggacaacggcacgatgtagggcggaacgtcctgcgggcgcttgccggccttgcgcatctcgtcctggagttgcttgacgatctgcggcgggatgatccacaggccacggtcgagatcgaactggtccggggtcgccagccgcagctcgccggtacgcacgccggtcaggaacagcagccggatgccgagttgggtctgccaaccacgagggttgtagagcctgagcttgtgcaggaaatcgggaagctccggaagatgcaggtaggggttgtggttcaccgggggcttgggctcggccaccacgtccaggtcggaggccggattggcttccagcccctccacgatgacgagggcatagcggaacaactgccccagccaggtgcggaccttctcggcagtggtgaacgccttgcgctcctcgatcctcgccaggacgcccaggagttggggccggcgaatgtcgtagatcgacatctgcttgaggctaggcagcacgtccttgttgaagatccgcaggatctgcgacagcgtgctgttcctgccctccttgatctccttgcggcgatgctcgacccacgcatcgaagacggccttgaaggtgtagtcggccgcaagcttgaccgcgtgtcgcttctgtttccgatcggtatgggggttgacgccctttgccagaagcgcccgggcttcgtcgcgcaaggtgcgcgcttcgcgcaaaccgatctcggggtagttccccagggagatgcgcttttgcttgccgagccagtaatagcgcaaatgccacgacttgccgccggtgcgggcgaccaccaggccgaggccatcggtgtcggggatgctgtaggttttctcggcggccttggcttgccgcacggtcagatcagagagtgtcatcatcaagctcctaagtcttggacttag

SEQ ID NO: 9539 - DNA, 693 bp, Pseudomonas aeruginosa
cccaggctcatatcgaccgaggaaatcgttatgagcctgacactctacggagccccgctgtctccgttcgtccgcaaggtccgcctgctcctggccgaaaagggcctcgactaccagttggaagcgatcgcccctttcggccagccggcctggtatcgcgagatcagtccgctgggccgcatcccggcgttgcgcgacggcgacctggccctcgccgactccagcgtgatctgccagtacctggaagaacgctatcccgaaccgccgaatctccagggcgacgcccccgccagccgcgcagcggtgcgctggctagaaaaatacgccgactacgagatcgctcccctggccacgctgacgatcttccgcaaccggatactcaagccggcgatgggccaggcctgcgaggagaacgaagtgcgtcgcgcgctggaggaaaagctgccagcgcacttcgattacctggaaaaccatctcgacggccgggccttcttcgtcggcgagcgactgaccctcgccgacctggcgatcgccagccagttggtcaacctgcgtcacgccggcgaaaacctggacgagcaacgctggccggccctcgccgcgcatttcgcgcggatgctcgaacgcccggcgatgcaagcgctgctgccgggggaacgacggaccctcgacaagctcgcagcgaaagcctga

SEQ ID NO: 9540 - DNA, 528 bp, Pseudomonas aeruginosa
acgcgtcgctcagcagtccgtcaggcgcaggaatatctccaccaggccttcgatcccggcctggtcctcggcgctgaagcgtcccacgctcgggctgtccagatcgagcacagcgaccaggcggccgtccttgagcaggggcaccaccagttcgctgctggaagcgctgtcgcaggcgatgtggccgggaaacgcgtggacgtcgtcgacccgctgggtcagccgggtacgcgccgcggcgccgcagacgcccttggagaaggggatgcggacgcaggcgaccttgccctggaacggtcccaggaccagttcctcgttgcggttcagatagaagccggcccagttcaggtcgcccagctcatggaagagaaaggcggagaactgcgcggcgttggcgatgaaatcgcgctcgtcggcgaacagcgcctcggcctgcgccgccagcagggcgtagccggccagcccggcgccagattgctgcagatcgatcatgcctggcgctccagcagttgcttgcccacccagtag

SEQ ID NO: 9541 - DNA, 2583 bp, Pseudomonas aeruginosa
ccgctacggccgtcgcggtgccagcgcgccgccaggctgcgctcccagtcgacggcttcgcgtacggccggcagcagcggctccaggcgcgcgagcacgctttcggcgcgggcaagaaaatcgctcaatcgggaatccactctgttctcctcggatcggactgacgtcacggatcgatcatcggttgcgcccaggaaccccgacagacggtcgggatgggctatgctaggcggcagaacctcgccaaggctgatccccgcccccatggatatagcgctgactcatcgcctgtcgttcaaacaggccagcctcaccgtgctggtggcctttatcctgggaaccctgctcagcctgattcaggttggcgtcgattatgccagccaggacgcatccatcaatcgcgaagtgcgcgcgctgctggacgtcagccacaaccccgccgcgcgaatcgcctacaacatcgatgcggagctggcccaggagctggtcctcggcctgctgcgctcgcccgccgtggtccgcgcggaaatcatcgacacctccggcctgccgctggccagcgcctcgcgcgaacccgccgaaagccgcctgcggccgctcagcgacttcctcttcggccacaagcgggtctacgaggacccgttgcatgtcgaccatgcgccgggcgaggccctcggcgtactgcacctggaaatcgacaccttcgtgttcggcaacgacttcctccgtcgcgccggcatcaccctgctctccggcttcgtgcgcagcctgctgctgtcgctgatcctgctggtgctcttctataccctgctgaccaagcccctggtcagcctgatccaggccctcagcggacacgatccacgctcgccggcacgcatgcgcctgccctgccccaagggccacgaacgcgacgagatcggcgtgctggtggaagtcatcaaccgccagctcgggcgcatctcggtagagatcgaacagcgccgggaggcggagaaccgcctgacccagtacctggaggagctggaaagcatcgtcgccgcccgtaccgccgagctgaaggccgccaacgcgcgcctgacgctatccaaccaggaactcgaagaagcccgccagaccgctctcgatatggcccaggcccgcgccagcttcctggccaacatgagccacgagatccgcacgccgctgaacggcctgctcggcatgctctcgctgagcctcgacggcccgctcaccccggaacagcgccagcaactgtcgatcgcccacgactccggcaaggtgctggtggaattgctcaacgacgtgctcgacctctccaagttcgaggccgggcaactggtcctggaacagatcccgttcgacctgggcgtcctggtggaagacaccgccagcctcctctcgcagaacgccgcggccggcgtggagctgacctgcctggtcgaccccgccctgcccgcccaggtttccggcgacccgacgcggattcgccaggtcgtcagcaacctgctgtccaacgcgctgaagttcacccgcctggggcgggtcgacgttcgcgtggaagccaccgccgagggtgtgcgcatcagtgtgcgcgacaccggcatcggcatcgcccaggaggcgctggatcgcatcttccaaccgttcacccaggccgacgcgggtatcacccgccaatacggcggcacaggcctcggcctggccctcacgcgcaagctgtgcgaggccatgcagggcgagctgacggtggagtcgacggtcggcctgggcagcctgttcagcgtcggcctgccgctggcgccggtcagccctccgctgcaagcgctgccgctgcgcggccgggtgatcgcgcaatgctcggccaacagcgggctggcgcagctgctgcaaacctggctgccgcgctggggcctggagtacaagcgtctggagaccgacgacagcctgctcggccactcgctcgacgtactgatatcggattgcccggactgtctgatgggactgcgtccgagcatcggtacgccgatcctgctggtcaccgcctacggcagtttcctcgaaccggagctggcccgccgcctgtcgccgctgcgccaactggccaggccgctgagtcgcaaccagttgtaccaggccctgaaacacgtgctcgaacacactgccatagccccgtcgagcgcctcggacaccacgggagaacagcgcaacacccgggtcctgctggtggaggacaacccggtcaaccagttggtcgccaagggcctgctgcacaagctcggctgccaggtatggatcgccgaacacgggctgaatgccctgaagatgctggaggagcatcccatcgacctggtcctgatggactgcaacatgccggtgatggacggctacgaagcgacccggcagatccgcgacagcggacgctggggcggcctgccgatcatcgcgctgaccgccaacgccctgccggacgagcgcgaacgttgtcgtgccgccggcatggacgactacctggccaagcctttccaccgcgacgaactgaaagccatcctcgaccgttggtgcccgctcaccgcgagcgactag

SEQ ID NO: 9542 - DNA, 468 bp, Pseudomonas aeruginosa
cgcttcaccactggcccatcgcgcccgatcaggaacttggtgaagttcccacttgatgccctggctgccgagcaggcccggcgcgcgcttcttcaggctgacgaacaacgggtgggcgccggcgccgttgacctcgatcttcctgaacagcgggaagctcaccccgtagttcagttcgcagaactgcgaaatctcgccctcgtcgcccggttcctgcttgccgaactggttgcaggggaacccgagcaccaccagtccgcgctcacggtatttttcccacaaggcctccagcccctggtactgcggggtgaagccgcacttgctggcggtgttcaccaccagcagcgccttgccgccgaagtcggccagggtcttctgttcgcccttgatggtggtgcagggaatgctcagcagcgaatcgctcatggcttgtcttccttgttgagggtgggtctcgaaacaaagtag

SEQ ID NO: 9543 - DNA, 462 bp, Pseudomonas aeruginosa
ttgaatgaaaaacgacccgaaccaaagacgggtcgtcgctctctagctctcccgcggcaccagcttcagcgaggccgagttgatgcagtaacgcaacccggtgggccgggggccatccgggaagacgtgccccaggtgggcatcgcagcggccgcagcggacttcgatgcgatgcatgccgtggctgaagtcgtccagttcgcggaccgcctcggcgtccaccggctggaaatagctcggccaaccgctgccggagtcgtacttggcgtcggagtcgaacaacgccgtgccgcagcaggtgcaatgatagatcccgggggtcttggtggcgtggtattcgccactgaaggcgcgttcggtaccgcccaggcgacagatgtggaactgctcttcggtcaactcctcgcgccaggagtccaggggtttgtcgatcttgctcatcggctctacctcgcgatctga

SEQ ID NO: 9544 - DNA, 1677 bp, Pseudomonas aeruginosa
cattcgcgggccggtgctcaagcacgccaaacgcctagaggaagagggtcaccgcatcctcaagctgaatatcggcaacccggcgccgttcggtttcgaagctcccgaggaaattctccaggacgtcatccgcaacctgccgaccgcccagggctacagcgactccaagggcctgttcagcgcgcgcaaggcagtgatgcagtattaccagcagaagcaggtggaaggcgttggcatcgaggacatctacctcggcaacggcgtgtcggaactgatcgtgatgtccatgcaggcgctgctgaacaacggcgacgaggtgctgatccccgctcccgactacccgctgtggaccgccgcggtcagcctcgccggcggcaaggcggtgcactacctgtgcgacgagcaggccaactggtggccggacctggaagacatcaaggcgaagatcacgccgaacaccagggcgatggtgatcatcaacccgaacaaccccaccggcgcggtgtattccagggaagtgctggaaggcatggtcgaactggcccgccagcacaacctggtgctgttctccgacgagatctacgacaagatcctctacgacggcgccgtccacgtctccaccgcctcgctggcgccggacgtgctctgcctgaccttcaacggcctgtccaaatcctaccgggtggccggcttccgctccggctgggtggcgatctccgggcccaagcagcgggcacagagctatatcgaaggtctcgacatcctcgccaacatgcgcctgtgcgccaacgtcccggcgcagcacgcgatccagaccgccctgggcggctaccagagcatcaacgatctggtcctgccgccggggcgcctgctggagcagcgcaaccgcgcctgggaactgctcaacgacatccccggcgtcagctgcgtgaagccgatgggcgcgctgtacgccttcccgcggatcgacccgaaggtctgcccgatccacaacgacgaaaagttcgtcctcgacctactgctctcggaaaaactgctgatcgtccagggcaccgccttcaactggccgtggcccgaccacttccgggtggtcaccctgccccgcgtcgacgacctggagcaggcgatcctgcgcatcggcagcttcctcaagggctaccagcagtaacccccccgctcccgcggcgccgctggcgccgccctgcccggcgacccatccatggacctgcagatcgacgacttccacaaggacgccgctggcggcctcctgcttctctaccaggcgtttccgcgcaagaccgcgctctacgtcgaagacctgatcggccgcgaggcgccggacgagttcggcctgccgagcaaacgtcaccaaagttgtctgggcgcgttgctctggctcgccgaggaaggctacctgcgcttcgccaacaccattcattacgaggctctcgaccaggcggtgctcagcgaaaaggccttcctaagacttacccgtatcgtcccccgggccgcggcggcgctggccgaggcgccggccagcgtgcgccgcgaacaggccagcctggccaaccagttgcgccaggcgctggcgcagggcgacggcgaacgcctggccgggctgacccgcctgctgttcgagggcaacctgggcgcgcaaggcgacacagtttgaaatag

SEQ ID NO: 9545 - DNA, 1188 bp, Pseudomonas aeruginosa
ggttcccatgcagatccgcgccgatttcgacagcggcaacatccaggtcatcgatgccagcgatccccgccggatccgcctggcgatccgtcccgacctggccagccagcatttccagtggttccacttcaaggtcgagggcatggctcccgccaccgagcaccgcttcaccctggtcaacgccggccagtcggcctacagccatgcctggagcggctaccaggcagtcgcctcgtacgatggcgaacgctggttccgcgtgccgtcgcaatacgacgccgacggcctgcatttccagctggaaccggaggaaagcgaagtccgcttcgcctacttcgagccctacagccgcgaacggcatgcccgcctggtcgaacgtgcgctcggcatcgagggcgtcgaacggctcgccgtcggcaccagcgtgcaaggccgcgacatcgaattgctgcgggtcaggcgccatcccgacagccacctgaagctgtgggtcatcgcccagcagcatcccggcgaacacatggccgaatggttcatggaaggcctgatcgagcgcctgcagcggccggacgatacggaaatgcagcgcctgctggaaaaggccgacctgtacctggtgccgaacatgaacccggacggcgcgttccacggcaacctgcgcaccaacgccgccggccaggatctcaaccgggcctggctggagccgagcgccgagcgcagcccggaagtctggttcgtccagcaggagatgaagcgccatggcgtcgacctgttcctcgacatccacggcgacgaggaaatcccccacgtattcgccgccggctgcgagggcaacccgggctatacgccccgcctggaacggctcgagcaacgcttccgcgaggaactgatggcgcgcggcgaattccagatccgccatgggtacccacgcactgcgccgggccaggccaacctggcgctggcctgcaacttcgtcgggcagacctacgactgcctggcgttcaccatcgagatgccgttcaaggaccacgacgacaacccggagcccgggaccggctggtccggcgcccgctccaagcggctcggccaggacgtcctgagcacccttgcggtgctggtcgacgaactccgctgaaaatggacggggcgccgcgcggcgccccgtttcagcctctctccagcaggtag

SEQ ID NO: 9546 - DNA, 1071 bp, Pseudomonas aeruginosa
agcgtgcaccggcattcttcggcagccaccggtgcgcgtaaaggcaccgcgaacgcaatccagcaatgcagcgaacgcacgcctgggagaacgaaagactgcaccctgcgcatgccagcgtgcttatacttccactccatgcatcttcccgatctgaatctcctggtcgccctcaacgttcttctcgaagagggcagcgtggtcggagccgcgcgccgcatgcacctcagcccaccggcgatgagccgtaccctgtcacggatccgcgaggcggtaggcgacccgatcatggtccgcgccggccgcaagctggtgcccacgccccgtgccctggaactgcaggagcaggtccggcaactggtggaccaggcccgcgacctgttcaacactcgcgagaccatccaactggacaagctggagcgctgcttcaccctgcgttccaacaacaccctggtcggcggtctgtcgatacgcctgctggagatcttcgccgaggaggcgccgcgctgcaccctgcgcttcgtgcaggagtcggacatcgacgacgaggcactgcggcagaaccgcatcgacctctacatcggcgcctcgtcctggatggaacccgaggtcaagacccagcagttgctcaccacccgcttcgtcggcctggcccgccaggggcacccgatcttcgacggcgagatcactccgcagcgcttcgtcgcttttccgcatatcgccgtctcgcgtcgtggcctcaaccatggaccgctggaccaggccctgggagaactcggcctgaagcgcgacgtcaagctgatcagcccgaccttccactcggcgatcttcgccctgcccggctccgacctgctgctgccgatcgccgagcattccctgtggcgggccaaccgactgggcctgggcctgcgccagttcgacatcccggtgccgttgaagaccgtgatggtggtccaggcctggcatccacgcttcgacaacgatcccgcgcaccgctggttccggcaaacgatcaagcggatttgcgaggaagtgcagagcgatccccatccgctgcttggctccaactga

SEQ ID NO: 9547 - DNA, 2910 bp, Pseudomonas aeruginosa
tgctctccaccagcgtcatcgcgcccatcgagggacccttcgcctcggcctggttcaacaccgtccgcggcttcttccggggtagtccccaccgcggtgatcggcgccatcggcaccgcccgcgagcattaccattccaaccgcctggtggatcacctgggcaatgcgccccaggccgtcgaactgcgcttgcaacagatcgccggcctgcaaccgggcgccgactccggcgcgcactggcagcatttggccgaacaggcccgccaacaggcccaggtgctgggcaacgccgacgtgctgctggcaatggccggcctggcctgcgccctgctgatcactgattccgatcctgccgcaacgggatctacccgccccgcccggtcgctcccacacactgaaaggtcgctgtatgtcgttcatcacttcgcgcaagggcatcctgctgctcgccgccctgctggtcctgaccctactggtctacctgctgttccacctgctcgccccacgggtcgtgcagagcaccgacgacgcctatgtgcacgccgatttcaccctggtcgcgccgaaagtcgccggcttcgtccaggacgttctggtcgaggacaaccagccggtcaaggccggccagttgctcgcccgcctcgacgaccgcgacttccgcaccgccctggccgccgccgaagccgacgtgctcggtgccgaggccaacctggccaatgccgaggccaacctgcaacgccagcaggcgctgatcgaacaggcgcgggccaaggtccgcgccgagcaggccgagctggtcttcgcccgtcacgagcaaagccgctaccagaccctcgccagcaagggcgccggcagcctgcagaacgcccagcaggcgcaatcgcggatcgataccgccagcgcccggctggccgagggccaggccgcagtggatgccacgcgcaagcaggtgagcgtcctcgaagcccgcgtcggccaggcccgtggcgacctgcaacgcatgcaggcgcgacgcgaccaggcccgcctggacctctcctactgcgaactccgcgcgcccttcgacggccaggtcggccgccgccaactgcgcgtcggcgcctatgtcacgccgggcagcgcgctgctggcggtggtgcccctgcagcaggcctacgtggtcggcaatttccaggaaacccaactgacccacgtctctcccggacaggccgtggaaatccgcgtcgataccttccccggcgaggttctgcgcggccatgtcgacagcatcgcaccggccaccggcctgagcttcgcgccgatcgccccggacaacgccaccggcaacttcaccaaggtggtccagcggatcccggtgaagatcgttctcgagccgcgccaggccatggcgggcaagttgcgtgtgggcatgtcggtggaagcacggatcgacaccgcgaccggcacccgctccgccgaggttgcccagcaatgaaaggcactccgctcctgcttattgccagccttgcgctcggcgcctgcagcctcggccccgacttcacccgcccggaccgccctgcgcccggcgaatggtcgctccaggccgctgccggcaaccccagccacctcgccgccgcgccgctcgcagcccaatggtggacgctgttcgacgacgcgcaattgaacgccctgctgcaacgggtccagcgtgccaacctcgacctgcgcagcgccgcggcgcgcctgcagcagagccgcgcgatccgtcgcagcctcggcggtgacgccctgccctcggtggacgccagcggcacctaccagcgccagcggaccaccagcgccggcctgttcgatccctccggcaaggccggcaaaggcaactacaaccacgccctggccggcttcgacgcctcctgggagctggacttctggggccgcgtgcgacgcgagctggaagccgccgacgcgacggtggaagccagcgagaacgaactgcgcgacgtgcaggtctcggtgctggcggaagccgcgcgcgactatatccagttgcgcggcgaacagaaccgtgcggcgatcatccgcgacaacctcgagaccgcacggcgcagcctggaactcacccgcacgcgcctggccaacggcgtcgccaccgacctcgaggtagcccaggcgctggcccaggtggccagcatggaggcacgcctgcccgaggtggaaaagaaccaggcgcacctggtcaacgccctcggctacctggtcggcgccagccccggcagcctgctcgccgaactcggcccggcgcgggcgattccgcgtccgccgggcagcgtgccggtcggcctgccgtccgaactggcccagcgccgccccgacatccgtcgtgccgaagcgcgcctgcacgccgctaccgccagcatcggcgtggccaaggcggacttctatccgcgcatcacgctcaacggcaacttcggtttcgaatccctgcaactgtccagcctgggcgactgggaccatcgccagttcgccatcggcccggcgttcagcctgccgatcttcgaaggcggacgcctgcgcggacgcctggagctacgcgaggcacagcagcaggaagccgccatcgactaccagcgcaccgtgctgcgtgcctggcaggaagtcgacgacgcgatgcacgactacgccgccaaccagcgccgccaggagcgcctcggcgaagccgtggcgcagaaccgccgcgccctgcagagcgcccgcgagcaataccgcgccggcgcggtggacttcctcagcgtgctcgacagccagcggcaactgctggacaaccaggaacagcaggtcgccagcgacgaagcggtgtcgctgaccctggtcaacctctacaaggcgctgggcggcggctggagcccaacgtccgacccggcgtcgggctga

SEQ ID NO: 9548 - DNA, 1008 bp, Pseudomonas aeruginosa
gacggcgccgggcgcggaccggcgaaggagttggaaatggacctgctgcaaggtatccggaccttcgtccgcgtggtggagcacggcagcttcacccaggccgcccaggcgctggggacctctccggcgaccgtttcgcgccaggtcgccgggctcgaacaggcgctctcggcgcgcctgctgcaacgcaatacgcgcagcgtcgtggtgacggaaagcggtctgcgctattacgagcattgcaagcagatcctacgcacggtcgccgccgccgcggcggacgtcgaagacagccagtcccacgccagcggtcgcctgcgcctccacgcggtgaccgaactgggcctcgagcacctgatgccgctactggtggactacctggacggccatccggacgtctccgtcgacctcacgctggcccagggcaccccggccctgctcgaggaaggcctggacgtgctgatcaccctcagccgaaccttgccggactcgaccctggtcgcccgcgatctcggccaggtgttcagcgtggtctgtgccgcgccggaatacctggcacggcatggcgtgccacgcacgccggaggacctgctgcggcatcgctgcctgaacgtggccgcgccgtcctgcccgcagggctgggccttcgtcggcgaacgcggcgaaacgctgctcgatctcgacgaggcgctcaaggtcaaccttcccgaggccgcctgcgccgccgccgcggccgggctcggcgtctgcctgctgcccggcttcgtcgccgcccgcgcgctgcaggaaggcagcctgttgcggctactgccgggccatcgactgcatgtccgcgaggtgttcgtgctgtactcctcgcggcgctacctggacgccaagatccgcacctgggtggacttcctcagggaacgcctgcccctggcgttcgagcgtgaccgggcgatcctcgacgatcggcgctactgggcggaaagcccaaccggcgtagcgcgcgagaccgcgacctaa

SEQ ID NO: 9549 - DNA, 774 bp, Pseudomonas aeruginosa
atcatgctaccgactctctatatttcccacggctcaccgatgctcgccctcgaaccgggcgccagcggcgtacaactgcgccgcctggctacagagctgccgcggccgaaggcgatcctggtggtttccgcgcactgggaaagcgacgacctgcgagtaaccggcgccgcggcgccggatatctggcacgacttctacggctttccgccgcccctctacgccgtgcgctacccggccaaaggcgagccggcgctggcgcagcggacgatcgaactgctccaggccgccggcctgccggcccaggccgacccacagcgaccattcgaccacggcacctgggtgccgctgagcctgatgtacccgcaggcggacatcccggtgctccagctgtccctgccgagccgcctcggtccggccctgcagagccgcgtcggccaggccctgcgccaactgcgcggggaaggcgtgctgctgatcggttccggcagcatcacccacaacctgggcgaactggactggcgcgccgggccggaagccatcgcgccctgggcgcgggagttccgtgactggatggtggaaaagctccaggccgacgacgaggccgcgcttcacgactaccgccggcaggcgccctgggcggcgcgcaaccaccccagcgacgagcacctgctgccactgttcttcgcccgcggcgcgggcggcggcgggatgcgcgtcgagcacagcggctttaccctgggctcgttggggatggatatctatcgcttcgattga

SEQ ID NO: 9550 - DNA, 699 bp, Pseudomonas aeruginosa
tgctggcggccgacatcaacctctgcgccagcaacgcgcgcttcgcccagctcgaagtgcagcgcggaatcctcccgttcggtggcgcgacactgcgcatgcaccaggtcgccggctggggcaacgccatgcgctggctgctcaccggcgacgaattcgacgcccacgaagcctatcgtctcggcctggtgcaggaagtcaccgccccggaggacctcctcgaccacgccatcgccctcgccgaacgggtcgcggcccaggcgccgctgggcgtgcgcgccaccctcggctcggcgcgccaggccctgctggaaggcgaagcggtcgccgccgctgcgttgccggaagccgccaggcgcctgctcgacagcgaggacgccaaggaaggcctgcgcgctctccaggaacgccgcccgggacgcttcgaaggacgctaggccgggcccttgtccgcgcgccctggctactgggccgggcgcaggctgtcgatatagccctgcaacgaatagccgagttgcggctccagcgccgcggcacgcgtccgcagggcttcctggtcgagttcgagggccaggttcgccggcaccagcatcaccacgttgccctcggccaccggacactcccagtaatgatggtgatagcgcccgcgcagcagcggcgcgcccagcggcttgccatcggtgccgctccactggttga

SEQ ID NO: 9551 - DNA, 426 bp, Pseudomonas aeruginosa
agcaggtgcgccgctgagcgcgccgcggccgctcccgccgcccggcgggagcgctcgctagagcagcaccccgcgcaagcgtaccgccaactccccgcgcccctcgatcgccaccgtcgccaggcccagccaggcggccatgctgcgcagttgctcggccagctcgtgcagggcggcatcgtccatgccgttcgcctcggcatgcaacgcatgtaccgccaggcgctcgcgcgcccgctcggcgcggaggtcgacgcggccgaccagacggccgttgtacaggaatggcagcacgtagtagccgtacacgcgtttttccttcggcgtgtagatctccaggcgatagcggaaatcgaacaggcgctcggcccgcgcccgctcccagaccaacgagtcgaagggcgagagcaaggcactggcgcctag

SEQ ID NO: 9552 - DNA, 408 bp, Pseudomonas aeruginosa
ccgccgcggcacctgcggttcgccggggcagtaggccggctggctccagccctcgacccggaccggcagcagctcgccagcctccaccagttcggcgaggcgcgcgcggctctgcgccgggctcagccgatagtagtcgcgcaggtccttttcggtggccacgcccagggcgctcgccgccatccgcaacagctcgcgctgggcctgtgcctccgaaagctcggggcgcgccagcaattccgcgggaaacacccgctccggcaggtcatagagccgctcgaagccgcgccgtccggccaccgtcagctcgccggcggcgaacagccattccagcgcatgcttttccgcgctccagtcccaccagggaccggcccgctcctgccgcgtgctcaggctgccggcacctag

SEQ ID NO: 9553 - DNA, 1080 bp, Pseudomonas aeruginosa
gatcaatccaacgaatcattcttatgcaatgcatcttggagattgatgaatgagctaccagcccggcatcgatacggaattgctccgcaccttcgtcgccatcgccgagcacggtggtttcacccgcgccgcggaggcggtgaatcgcacccagtcggcggtcagcatgcagatgaagcggctcgaagaggacgtcctgcagcgctcgctgttcgagcgcgacggaaggcagacccgcctcaccgccgaaggccaggtgctgctcggctatgcccggcggatcctcaagctgcacggcgaggtgttcaacaccctgcgccgcccgcacatggtcggctcggtgcgcatcggcaccccggacgactacgtgatgcgcttcctcccggcgatcctgtcgcgcttcgccgaagcctatccgctggtgcaggtcgaggtgcattgcgacacctcgctcaacctgctggcgcgcaacgacctcgacctgtccatcgtcacccgcgagccgggcaccgagatcggccagttgctgcgccaggagcccttcgtctggatggccgccgagggcttctgcccccacgaccagcggccgatcccgctggccatgttcaacaccacctgcttttgccgggcctgggcctgcaacgccctggaggcggcggaactggactaccgcatcgcctacagcagccccagcctgtcggcgctgttcgcggtggtcagcgccggcctcgccgtgaccgtgcaactgcgcagcctgctcaccggcaacctgcgcatcctcgacgagagcgagggcctgcccgccctgccctcggccagcatcatgctgatgcgcaacccgcacagccagtcaccggtcaccgagaagctcgccgaatacatcggcgagggcttccgtctctgactcaaccgcgcaccagcaggagcaccgcgcacaatgcgaggaaggcgcagaaggccatgcgcaggctgcgctcgggcaaggcgtgggccagcctcacgccccaggaaatgctcagcaggccgcccagcgccagggggatccccatccgccagtcgacatggccgtgcatggcgtag

SEQ ID NO: 9554 - DNA, 1026 bp, Pseudomonas aeruginosa
gcaagcgtggctggatgggaaacgcacaagaaagcacaatggctatgccaattacgcaaaggcatgagcatgttgcccgataccctcagcgaacagttcgttctctacctcgatgtcctcgatggcggcagcttctccgccgctgcgcgcaagcacccgctcaccccgtccgccgtggcgcgccggatggacgccctggaacgcgccgtcggcagcactctgctggtgcgcaccacccatgcggtgcgcgctactccggccggcctggccttcgccgaccgcgcccggcggatcgtcaccgaactgcgcctggcccgtgccgaagcggtgtccctgagcaccgcgccgcagggcctgatccgtatcgatgcgccggtgcccttcggccgccgccacctggccccggcggtcgccgacttcctcaaggccaaccccggcctcgacgtgcaattgcgcctgatcggcagcttcatcgacctgcagggcgaacatctcggcgaggtcgatctggtgttgcgcgccggcccgctacccgacagccgcctggtggccacctcgctggcgccgatggtgcgggtggtctgcgccagcccggaatacctgcgcgaacacggcgttcccgcatccccaggcgaactgccggagcatgccggcatcgattgggacaacctgtcgccaccctatgcctggcgcttccagcacgacggcaagctccagcacctgcggccgaaacgggcgcggctggccaccaataacgccgaagcgatggtcgacgcggcgctggccggcctcggcatcgcccacctgccgacctggttgtgcagcgagtacctgctgcgcggcgaactgcaggcgctgttctgcgacgacggcttgcccgccgccgagcccacctgcatttatgccctgcgcctggaacgcgaagccagttcgcgaacccgtctgctgctggctttcctccgcgagcgcttcggctttccgccgccctgggaccaggccctgcagcagcgtctcggcgagcgctga

SEQ ID NO: 9555 - DNA, 465 bp, Pseudomonas aeruginosa
tgttggcaacctggccggcgcggaactcttgagcggttttcatacgaatatccgatggatgaaagacaaaaaatcaggccgcgtatcatagccaatctgcgtaaaattgcaccagccttgccgcaagatccggacgcatgccctgttcgtcggcccagcgctgcgcttcccgacgccactcgggcagttgcctctccagcccctcccaggccccggcaagtccaccgccggcgttccacgccagccagaaggtgcgcaggttttccgccaggtcggcgggcaggccggcgcaatagagttcgaggaatgcctcgagcttcgccaggtgcgcctcctcttcctgtctatagatgtgccagagcagcggccgtcccgcccactgcgcgcgaacgaaggaatcctcgccgcgcaccgcgttcaggtcgcagcaccacaacaggcgatcgtagtcgtcctgcgccatga

SEQ ID NO: 9556 - DNA, 759 bp, Pseudomonas aeruginosa
ccacccgcagccaatcggcgacatccgccagcacccgcccctccggcaccagcagcaggctcggctggcgggcgtcgcgcagttgttccagccaaccaggcagcgccgggttttcgtaggcaaacagcgaaatcagtcgctcgccaaccttccgccgcacgccgagggaggcgagaaactcatcctgcgccgagacggaggcctggaaacggcgccgacgttccagcaggccggcctcgcgcaacaggccgccactgggctcgcggaacccgggaaagaagaagtacttggaaagcccgcacgcctgcagcgacggcaatgcgtggcaactgccgatccattcctcggcactcaggtactccaggttcagccacagggacggccgcttgcgctcgcgcatggcctgccggtgcgcctccggcagttcgcagggcgaaggcctctatcaccacatcggcggccgccaccggtgcccacggccgggccccaggcacgcacttcgaccccatccaggcactgcacgtgcgccaccgggtccgcccgcggacagatccgggcgaaggcctgcggctcgtccacccacaggcgcacggcctgaccgtgctcggcggccagttggcgagccaggcgccaggtgacgccgatgtcgccatagttgtcgaccacgctacagaaaatgtcccagctcgccatccgcctctcctcttcgtgcccggcagtttaccaaggcaccccgcggactttcctccgacgacctaa

SEQ ID NO: 9557 - DNA, 774 bp, Pseudomonas aeruginosa
caccccgccaggtttcaccgggagggctcagaccaaccaggacaggcgctccccgcgcttttccgcctccagttgtttccggcaatcgggacacagcagccggtcgcgcagacgcgcccgttccagcggctgccagcgcggctgggccggcagcagcttgccacaaagcgtgcggtccgccggggtatccagctccagctgacgcgccaccacatgcacccggacctcgcgacaggcgaacaggtccagctgatcgtcgggctcgatcagttgataggcgtagagggtccaggcgggacgcggcatggggggctcctgagggtgcgcaaccttagccgaaagcggtatcccggggaagtctcaaagcagcggtttcagcgtcggccagacattttccaggagccttcgggtgggcggcgagcgccggatggatgccatccgcctgcatcatcccctggaccccgccgaccccttcgaggaaaaacggcaccagggcggtcttttcctgcgccgcgaccgcgccgtagaccttggaaaaggcctcgatgtagcgcgggccgtagttcggcggcaactggatacccagcagcagcaccttcgccccttccgcccgggccttttgcgccatgctggcaagattctgttgcaattgcgccggcgccattccgcgcagcccgtcgttgcctcccagctcgatcaccaccagcgccggcttctcctcggcaagcagcgccggcaggcgcgccaggccacccgcggaggtgtcgccgctga

SEQ ID NO: 9558 - DNA, 2658 bp, Pseudomonas aeruginosa
tcgaccgggtcgaaccctgatgaagccggtgcccctctcccgcctgctgagcctcgccggtcgccaattgttccgcgagtcgcgcagcggcgagctgcgcgtgctgttcttcgccctgctgatcgcggtcgcctcgagcaccgccatcggctatttcagcgcccgcctgaacggcgccatgctcgcccgcgccgccgagttcctcggcgccgacctggtgctcaacggtacccagccggcaagcgccgaacagatcgaacgcggcacccgtctgggcctgcgccacgccgacagcgtcgagttttccagcgtgatcgccaccgaccagggcatccagctcagcagcatcaaggcggtcggcgaccgctaccccctgcgcggccagctcaagagcgctgccgcgccgttcgccgccgagcaggccggcggtcgtccgcaggcgggcgaggtatgggtcgaatcgcgcttgctggtcagcctcgacctgaaggtcggcgacagcatcgagatcggccgcaagccgctgcgcatcgcgcgcatccttacctacgagccggaccgcgccggcgacttgtacagcctgacgccccgcgccatgatgagcctggccgacctcgatgccaccggggtggtccagccgggcagccgggtgcgctaccgcgatctgtgggaaggcccgccggaagccctccaggcctatcgccagcaggtcaagggcagcctcgccgccaaccagcgcctgcaggatgcccgcgacggcaaccgccaggtgggcgatgccctcggccgtgccgagcgctacctgaacctggccagcctggccgcggtgctgctcgccggcgtcgccgtggccctgtccgccgcccgtttcgctgcacggcgctacgacgccagcgcgctgctgcgctgcctcggtctgtcgcgcagcgaaaccctgctcctctacgcgctgcaactgttgctgctgggcctgctcgccagcgccatcggcgccctgctcggctggttggcacagctcggcctgttccgcctgctcgccacgctgctgccgccggacgtaccagccggcggcctgttccccgccttcgccggggtcgccaccggcctggtatcgctggccggcttcgccctcccgccgctggcagccctgggccgggtaccgccgttgcgggtcctgcgcagcgacctgctgccggtgccgatgcgcacctggatggcctacgcctgcgccctgctcgccctgggcctgatcatgtggcggttgagtctcgacctgaagctgaccctcgccctgctcggcggcggcctggtcgccacgctggtgctcggcgccctcctgctgctcggcctgaacggcctgcgccgggcactggcgcgtgccagcctgccatggcggctgggactcggccagttgttgcggcacccgctggccgccgccggacagagcctggccttcggcctgatcctgctggctatggccctgatcgccctgcttcgcggcgaactgctggatacctggcaggcccagttgccgccggacgcccccaaccatttcgccctgaacatcctgccgacggaaaaggacgccttcgaacgtcgcgtgcaaaagctctcccccggcgccgagccgctgttccccatggttcccgggcgcctggtagcggtgaacggcaagccggtccaggcgctcgacgaagacgtgcgcagcgagcgtgccctgcagcgcgacctcggcctgacctggtcagagcgactgccctccggcaaccagctcaccgccggacgctggtggagcgcgccgcagccgggggccctgccgggcgtgtcggtggaagagaagctggccgccaacctgcgtatccaggtcggcgaccggctcaccttcagcgtcgccgggcagaatcgcgaggtccaggtccagagcctgcgcaaggtgaagtgggacaatttccagccgaacttcttcatggtcttccagcccggcaccctgaccgacctgccggtgacctacctgaccagcttctacctgccggccagccaggaacgcgacctgatcgaactggcccgcgccttccccaccgtcaccctgctgccggtagacgccctgctgagccagctgcggagcatcctcgaccaggtcaccctggccgtggagtacgtgctggtgttcgttctcgcggcgggcttcgtggtgctcttcgccggtctccaggcgaccctcgacgagcgcgtgcgccagggtgccctgctgcgcgcgctgggtgccgagcgcgagttgctgcaacgtacccggcgggtcgagttcgccctgctcggcgcagtcagcggcctgctcgcggcgctcggctgcgaggcggtcagcctgctgctctaccgactggtcttcgacctgccgtggcaagcgcatccctggttgctcgcgctgcctctggtgggcgccgtgctggtaggcggcgccggcctgctgggcacccgtcgcgccctcaacagcagcccgctgcgggtcctgcgcgagggctgatcggatacactggcaggctttcatccgttcatttgtggaaccacccgaaccatgagtcgctatcgtccaccgcgcaccgccggcaccccgctgatcactccggagggcgccgcgcggttacgcgcagagctgcatga

SEQ ID NO: 9559 - DNA, 591 bp, Pseudomonas aeruginosa
aaaagccgcatggagactgtcaagaaacacgcggaggcgcccatgcccgatcgctttcttcgcctgttcttcgccctgccctgcccacctcccctcgccgagcggatcggccggtggcgcgatgaccggccactgcccggacgccaggtggcgacggcgaacctgcacctgaccctggccttcctcgggcaggtcccgtccgctcggctcgaggccctgctggacatggccgcggccatcgaggccgcgcccttcgacctgtatctcgaccgcctgctgcgctggagaaacggcatcctgctgctggcccccagccaaccgcccggcgccctcctgcgcctgcgccgcgccctgcgctccggccttgccgaactggagctgcccgtggaaacccgctcattcagcgcccatctgaccctggctcgcgatgccgcgccgctggaggacgccccgccacccccaaccttcgtatggcaggtcgaccatttcagcctgttttgctcgcaaaacgacgccgcgggcgtgcgctaccgcacactcggtcgctgggcgttgtgcggggaagattcaaacgagcgtttcgcgccgtaa

SEQ ID NO: 9560 - DNA, 948 bp, Pseudomonas aeruginosa
gatgagaacaacatgaagaagaagtctctgctccccctcggcctggccatcggcctcgcctttctcgctgccagccctctgatccaggccagcacctacacccagaccaaataccccatcgtgctggcccacggcatgctcggcttcgacaacatcctcggggtcgactactggttcggcattcccagcgccttgcgccgtgacggtgcccaggtctacgtcaccgaagtcagccagttggacacctcggaagtccgcggcgagcagttgctgcaacaggtggaggaaatcgtcgccctcagcggccagcccaaggtcaacctgatcggccacagccacggcgggccgaccatccgctacgtcgccgccgtacgtcccgacctgatcgcttccgccaccagcgtcggcgccccgcacaagggttcggacaccgccgacttcctgcgccagatcccaccgggttcggccggcgaggcaatcctctccgggctggtcaacagcctcggcgcgctgatcagcttcctttccagcggcagcaccggtacgcagaattcactgggctcgctggagtcgctgaacagcgagggggccgcgcgcttcaacgccaagtacccgcagggcgtccccacctcggcctgcggcgagggcgcctacaaggtcaacggcgtgagctattactcctggagcggttcctcgccgctgaccaacttcctcgatccgagcgacgccttcctcggcgcctcgtcgctgaccttcaagaacggcaccgccaacgacggcctggtcggcacctgcagttcgcacctgggcatggtgatccgcgacaactaccggatgaaccacctggacgaggtgaaccaggtcttcggcctcaccagcctgttcgagaccagcccggtcagcgtctaccgccagcacgccaaccgcctgaagaacgccagcctgtag

SEQ ID NO: 9561 - DNA, 1332 bp, Pseudomonas aeruginosa
gaccccggccggggcctcggccccggccctttcccggaagccccctcgcgtgaagaaaatcctcctgctgattccactggcgttcgccgccagcctggcctggttcgtctggctggaaccttcccccgcccccgagacggcgcccccggccagcccgcaggcgggcgcagaccgcgccccgccagcagcctccgcgggagaagcggtgccggccccccaggtcatgccggccaaggtcgcgccgctgccaacctccttcaggggcaccagcgtcgatggcagtttcagtgtcgacgccagcggcaacctgctgatcacccgcgacatccgcaacctgttcgactacttcctcagcgccgtcggcgaagagcccctgcagcaaagcctggaccgcctgcgcgcctacatcgccgccgaactccaggagccggcgcgcggccaggcgttggcgctgatgcagcaatacatcgactacaagaaggaactggtgctgctcgaacgcgacctgccgcgcctggccgacctcgacgccctgcgccagcgggaagccgcggtgaaagccctgcgcgcgcggatcttcagcaacgaagcgcacgtggcgttcttcgccgacgaggaaacctacaaccagttcaccctggagcgcctggcgatccgccaggacggcaagctcagcgccgaggaaaaggccgccgccatcgaccgcctgcgcgccagcctgccggaagaccagcaggaaagcgtgctgccgcaactgcaaagcgaactgcagcagcagaccgccgccctccaggccgctggcgccggcccggaagccatccgccagatgcgtcagcaactggtgggcgccgaagccaccacccgcctggagcaactcgatcggcaacgctcggcctggaagggccggctggacgactatttcgccgagaagagccggatcgaaggcaataccgggctgagcgaagccgaccgccgcgcggcggtcgaacgcctggccgaggagcgcttcagcgaacaggaacgcttgcgcctgggcgcgctggaacagatgcgccaggccgagcagcgctgaccggcacggaaacgccgagaacgcggcgaagggcgcttcggcggataacgctaccctcaggggtgcagccctggcgtggccggcgaggcggaaacctgtgctgcgcgccgcaacgaaaaagggcggccacccgaaggtgtccgccctttttcgtcgccagcccggttcagcgggacagcttgccgtccagcgagaacttgccggcgccatcgatcagcagcgccacgctgatcatcagaagggtcagggcatattcatag

SEQ ID NO: 9562 - DNA, 519 bp, Pseudomonas aeruginosa
agcactgctcgcccgcgcgcgcgccgccggggtggtacaaatggtcatcaccggcaccagcctggccgacagcgaacaggcgctgcagctctgcggcgaactcgacgagggcggccggctgtttaccaccgccggcgtccacccccacgaggccagccactggaacgccgacaccgctcgcggcctgcgcgccctgttcgacgacccgcgggtacgcgcggtgggcgaatgcggcctcgacttcaatcgcgacttctctccccgtccggcccaggaaaaggccctcgaggaacaactggcactggccgtcgagctacagcgtccggtgttcctccacgaacgcgacgccagcgagcgcctgctggcgatcctgcgcgacttccgcgatcgcctgccggccgccgtcgtacattgtttcaccggcgagcgccgggcgctgtatggctacctcgacctcgacctgcacatcggcatcaccggctggatcaacgacgagcgccgcggcacccacctgcatga

SEQ ID NO: 9563 - DNA, 453 bp, Pseudomonas aeruginosa
gcaggaatcattcgccgcgctgccgcaccccgcctagactcgacgacatgcaaggatccgccccgcgggtcgccgtcacggagtaccgagaacatgggcaaacgtcatcccaacctgctcgcctggcaatggcgcggctatgccgccaaccaccgcaacccgaccaacctggtcctgcacctgatcgccgtgccgctgttcatcgtcgctgcgatcctgctgctcggcggcctgttcggcctggacctgctgcaggtggtgctcggtgtcatcggcatcggcgccggcctggcgatccaggccaagggacacgcgctggaggaacaggcacccgagccattcagcgatcggcgcgacgctgtcagtcgcctgctcgtcgagcagttcgtcaccttcccccgcttcgtcctcagcggcgcctggtggcgggcttggcgcgaacggcataagtga

SEQ ID NO: 9564 - DNA, 765 bp, Pseudomonas aeruginosa
gccaggtgcggcaggatcaccagtacctgcgccaccagcagccagaccagcgcgacccgcggaatcgcgttcatcgcgccgctccgaacaacgccagcgcacgcaggcaggcctcgcgctgggcctcgccgctggccggttgcaggcgtgtgccgggcagcgccaggccatagggctgctgccgcgcggagagttccaggactgcatggcacaagcggcccaggcgactttcgagatccccgccgaggcgctcgaattccagccacaggtcttccccaccgagcgcggcgaagtccttcaccagcagcccctggccacgggaaaacgccttccaatgcaggcgccgccgcgagtcgcccggctggtaggcgcgcagtccctggtagtcgtcgacgcccgtgcttgccagcgcgcgcccctggtcctcggcatcctccgcgcccggcgcgaggaatggctcgccggccagcggccgagggtagaccagcgcctgctggcgcaggtcgacccagctccaggccaccagcaggccgaggggaaagcgactctccacccgcaggcgccccggccgcagccagccgcgtcgctcggtcgggtggaacagcagcacctcggcagccgcgtcgcctgccaggtcggcgtattccagcggccgctccggccagccgacggcgatggcctggcgcgcccgccgcgggctttccaggcgcacccggaaaccggcgcgctcgccggcgaacaccgggtccgctcccaacgcggtga

SEQ ID NO: 9565 - DNA, 1032 bp, Pseudomonas aeruginosa
gcgggactggcgcaattgatcagttgcatctcgccgaggcgtcgcgccaccaggctgctgttgcccaactggccgacccgcaggacgcagtcgacgccctcctgcaccaggtccaccgaacggtcgctggaacccagttccagttcgatgtccggatgctggcggaagaattccggcagcgccggggcgatcagcagtcgcgccacccggctcggcacgtcgaccttgagccggccgctggcgcggctgccgtcgtggaacaggctctccagctcctccatgtcttccagcaggtggcggcaacgctccagcaccacgctgccgtcgtgggtcagctggacctgccgggtggtgcgatgcagcagccggctgccgagttgcgcttcgagctgctggaccgccgccgagaccgtcgcccgcggcatgtccagcaggtccgcggccttggtgaagctgccggtttcggcaacgcgcaggaacacgcgcatgctgtccagacgatccatgggcaggccccttctctctattcgggatggctggacagtctatccatgccacctacgtttatccaaagaacccggaccaatagcctggagtccctactctacttcctggatccgcagatgccccatgcagcgcttttgcttcctcccagcgcgtccccgctgccggaagtggtcgggttctggcgcgatgccggccctaccctctggttcgccaggaacgccgatttcgaccggcgcttccgcgagcgcttcgcccacctctacgagcttgcctgcgccaacgcgctgcgcccggctgccgatgaagccgaggaccatctcggcctgctgttgctgctcgaccagtacccgcgcaacgccttccgtggaaccccgcgcatgtacgccagcgacgcccaagcgcggcgctgggcggagcgggctctgggacaaggcctcgaccgccaggtcggggacgcgctgcggctgttcttctacctgccgttcgcccatgccgagaaccttgccgaccaggatcgctcggtag

SEQ ID NO: 9566 - DNA, 1824 bp, Pseudomonas aeruginosa
cgccagggtcacccgtggctccgagccgccggcgagcagcgcggcgacccggcgcaggcggtcggatgcgccgaggacctcctcgacccgtcccagcagggtgcgtccggcctcggtcagttgcggctggcggccactgcgatcgaagagttccaggccgaggtcgatctccagccgggcaatggcctcgctgacggtcgactggctcttgcccagcttgcgcgcggcggcgctgaaggagccgagggaaacggcctggacgaaggcctcgagggattcgggcgacaaatgcatatcggtttttccgattgtatccaacttaaccctatcccaaagaccgatgacaatacagcccgacttcaacgacgaaccgggagcgttcgccatgacccacacccacaccgccctcgacaagactctcaaggagcggatcttccacgccctggccttcgagggcctggccgtcctcctcaccgcgccggtgctgtcgctggtgatgaacaagcccctggcgcacatgggtgcgctgacgctgatgttctccaccgtggcgatgctctggaacatgcttttcaacagcctcttcgaccgcgcccagcggcgcatgggcttccagcgcaccctgcaggtccgggtgctgcatgcgatgctcttcgagctggggctgatcgtggtgctggtaccgctggccgcctggtggctgtcgatcggactggtcgaggcgttcctcctcgacatgggcctgatcctgttcttcctgccctacaccatggccttcaactggagctacgacgtcctccgcgcacgcctggtggaaagccgccaggccaaggccgccggttgcgacgccggctaggccggcgttcaggccgtcagccgctcgcgcaggcggccgagcatgccgagcaggctgccgacccgttccttctcgcgctcgtcgcgcggcacctcggccagccggtcaacctccggcaggcttcgcccgcgccacagcaaggcctgctcggcggccgccttcaggcctttctcgaacaatcccctgcggatcggcttgggcaggtagcggaatatctgcgcctggttgatcagttcgagcagggcctgggtgtcgcggaacggcgtaaccaccaggctgagcaggcgcggatgggcctgggccagggatttcagcagcggcgcggtatgctccccggccagcttcaggtcgctgaccagcacctccaccggttcggtgttcagccacaccagcgcctcggccaggttgcgcgcgcgcagcaggcgatgcccgccggcatggcagaaggccccgacgcagtccagggtttccgggtcgtcgtcgagcagcagcacgctcagcggcgccgccagcgtggccgcgggcggcgccggcaggccctggcggctggcgatctccgccgcctggcgcagggtgaaggccatttcctggggattccagggcttggtcaggtagcggaagatgccaccgtcgttgagcgcgtcgacggcggcatcgaggtcggaatagccggtgaggagaatccgcagggtctccggatagcgctcgcgagcctgcgccagcagttcggcgccgctcatctgcggcatgcgctggtcgctgaccagcacctgtatccgttccgtcttcaggcgctccagggcgcgccgcgggtcgctctcggtgagcacctcgtaatggcggcggaactgcatggccaggctgcgcaggatgcgctcctcgtcatcgacgaagagaatgcggacgggagatgggctcatgtcaggcgctccgtttcagttcgcgggcctgctctcgcggcaggctga

SEQ ID NO: 9567 - DNA, 195 bp, Pseudomonas aeruginosa
acattcatatcgatgagggagaacaacatgccctggtacgcctggttgatcatcgtcctcgccctgggctccatcgtcggcggactcctgctgctgcgcgactcggcgaagaagctgccgttgagcgaggaacagctcaaacgcatccatgaacgcaacgccgagctggacgcgcaggaggcgaaggaccgctga

SEQ ID NO: 9568 - DNA, 777 bp, Pseudomonas aeruginosa
acgggaggctgcatgctcgggcgtctgataccgcttctacccattctgttcctgctcgggggcttcttcaccgggcacatcgcgctgctgacggcggtcatcgtcctgctctacatcatctgggtgacctacgccgagcgctggctgccgaccctgctctggtggccggtgagcctcgccgccagcgccctgatcgccatccactacctgcccggcttcattcccctgcgcctgttcccctgggaccttgccagcgccagcccgccgatccagatgatctggctgccctgggacaaggccctggtcgcccttaccctgctcgcctggtggctacgccggccgaagcagccgctggtgtcgctggatatcaccgcgctggccttctgcctgaccttcttcgtggtgccgctgctgtcgatcatgaccaatgccgcgagctggcagccgaagtggccggatgccttctggtggtggctggtactgaacgtcggggtggtctcgctggccgaggaggcgttcttccgcggcctgctgcaaagccagttgatccgctggttcggcgcctggccgggaatcatcgtcgcgaccctcgcctacgccgcgctgcacctgctggtgaacccggtgtacgcgctgctggccgggatcgccgggctgggctacggcatggtcctgcacttcagcgggcggctgtccctggcggtgctgctgcacgcctcgatcaacaccctgcacttcctcctgctgagctacccgttccgcctgatctccgagtga

SEQ ID NO: 9569 - DNA, 3162 bp, Pseudomonas aeruginosa
tgtcgccccacacttccgccgtcacgggtcaagaacaatgcaaaagaccgtacgcatcggctgcgcctcggccttctggggcgacacctgcaccgcggccgcccagttggtgcgcggcgcgccgctggactacctggtgttcgactacctggccgagatcaccatgtcgatcatggccggcgcccgcctgaaacagccggacgccggctacgccaccgacttcgtcgaggtcctcgcaccactgctgggcgagatcgccgagaagaagatccgcgtcatcagcaacgctggcgggatcaatccgcaggcctgtgccgccgccctcgccgcggcctgcgagaaggccggggtgcagctgaagatcgccgtgctccatggcgacaacctgcaagcgcgccaggccgaactggccaaggccggcatccgcgagatgttcagcgacgcgcctttcccgccgatgtgcgtctcgctcaacgcctacctcggcgcgccgggcatcgtcgaggccctgcgcctgggcgcggatatcgtgatcaccggccgggtggtcgacagcgcggtggtcagcgccgccctggtgcacgagttcggctgggcctgggacgactacgaccgactggcccaggccgccctcgccgggcacatcgtcgaatgcggcgcgcaatgcaccggcggcaatttcaccgactgggagcaggtgccggactacgagcacatcggtttccccatcgtcgaggtcgaggccgacgggcgcttcgtggtgaccaaggcgcccggcaccggtggcctggtcagcgaactgagcgtcggcgaacagatgctctacgagatcggcgacccacgcgcctacctgctgcccgacgtggtctgcgacttcaccgaggtgcgcctgcgccaggtcggacccgaccgggtcgcggtggaaggcgcgcgcggcctgccgcccaccgaccggtacaaggtcagcgccacctatccggacggtttccgctgcaccgccagttgcctgatcgccggcatcgatgcgctgaagaaggccgagcgggtcagccaggcgatcatcgccaggaccgaggaaatcttcgccgagcgcggctgggagccctaccgcgaggtcaatgtcgaactgctcggcagcgaagccacctatggtccccatgggcgacggcaggacagccgcgaagtggtggtcaagctggccgtccggcatccgcgcaaggaagccctggtgctgttctcccgcgagatcgcccaggccgccaccgggatggcgcccggcctgaccggcatcgtcggcggccggccgacggtgtatccggtgatccgcctgttctctttcctgatcgacaaggcgcaatgcgcgttgagcgtagagatcgacggccagcgccatccgctggaactgccggtcctcgaagccttcgacccggcacgattggccgaggcgcgccagccgccacgcccggtgcagcccgccagcgccagcgtgccgctggtgaagctagcggtggcgcgctccggcgacaaaggcaaccacagcaacatcggggtcatggcgcggcgcccggagtacctgccgtggatcgccgaggcgctggaggaaggcgcggtggtggactggatgcagcatgtgctcgacccgcagaccggccgggtcggccgctggtacctgccaggcagccacagcctgaacttcctgctggagaacgccctcggcggcggcggcgtcgccagcctgcgcatcgacccgcagggcaaggcctttgcccagcagttgctggagttcccggtggcggtgccgcaggcgctcgccgacgcgctggaaacgcaaggcagataaccacaaccaggaacggcgaatgcggcgttccgctgcccctctacgggattcatcggagtcaccagaacaatgagctacgactcgatcttccgacctggcctgttcgacggccagaccatcatcgtcaccggcggcggcagcggcatcggccgctgcaccgcccacgagctggcggccctcggcgcccacgtggtgctggtcggacgcaaggcggaaaagctggagaagaccgccggcgagatcgtcgaggacggcggcagcgtcagctggcacgcctgcgacatccgcgaggaggaagcggtgaagacgctggtggcgaatatcctggccgaacgcgggaccatccatcacctcgtcaacaacgccggcggccagtatccctcgcccctcgcctcgatcagccagaagggcttcgagaccgtgctccgcaccaacctggtcggcggcttcctggtcgcccgcgaagtgttcaaccagtcgatgagcaagaccggcggcagcatcgtcaacatgctcgccgacatgtggggcggcatgcccggcatgggtcactccggcgccgcacgctcgggcatggagaatttcaccaggaccgccgccgtcgagtggggccatgccggcgtgcgggtcaacgcggtggcgccgggctggatcgcgtccagcggcatggatacctacgaaggcgcgttcaaggcggtgatcccgaccctgcgcgagcacgtgccgctcaagcgcatcggcagcgagtcggaagtcgccgccgccatcgtcttcctgctctcccccggcgccgccttcgtcagcggcaacacgatccgcatcgacggcgccgccagccagggcagccgcgccttcccgctattcaagggcaagccgggacagagccgcgcgtacaacggcttccaccgcgcctacctgcccgacgtactgaaggaccaggaggactgacatgcccgcgatccagtcggaactcgacgtcaacggcgaggacttcgcccgcaaccgcgaggccatgctcgccgccgtggccggcttccgcgagttggagcagaaggtcctggacaaggccgccgaggccaggccgaagttcgagaaacgcggccagctgctgccgcgcgaacgcctggcgctgctgctcgacccgggcgcgccgttcctcgaactgtcctcgctggccggctacaagctgcacgacgacaaggacggcacccaggccggcggcgggatcatcgccgggatcggctacatcgccggggtgcgctgcctggtcagtgccagcaacagcgcgatcaagggcggcaccatctccccgaccgggctga

SEQ ID NO: 9570 - DNA, 669 bp, Pseudomonas aeruginosa
tgcccaggaggaaagacaacccatgatcttcacccaggaacacgaggaactccgccgcaccgttcgcagcttcgtcgagcgggaaatcaaccccaacgtcgaccagtgggaaaaggacggccgcttcccgatccacgagatcttccgcaaggccggcgaactcggcctgctgggcatctccaagccggagaagttcggcggcatgggcctggactacagctactcgatcgtcgccgccgaggaattcggcagcatcacctgcggcggcatcccgatggccatcggcgtgcagaccgacatgtgcaccccggccctggcccgcttcggttccgacgagttgcgcgaggagttcctccgcccggccatcgccggcgagatggtcggctgcatcggcgtctccgaggtcggcgccggctccgacgtcgccggcctgaagaccaccgcgcgcaaggacggcgacgactatgtgatcaacggcagcaagatgtggatcaccaactcgccgtcggccgacttcatgtgcctgctcgccaatacctccgacgacaagccgcacgtcaacaagtcgctgatcgtggtcccgatgaagaccccgggcattaccctcagtccgcacctggacaagctcggcatgcgcagttcggagaccgcccaggtgttcttcgataa

SEQ ID NO: 9571 - DNA, 1329 bp, Pseudomonas aeruginosa
cgtccgcgtaccgcagcgcaaccgcatcggcgcggaaggcgccggcttcatgatgcagatgctgcagttccaggaagaacggctgttcggcgcggccaacatgatcaagggcctggagcactgcatcgacgtcaccatcgagtattgcaaggagcgcaggaccttcggccagccgctgatcgacaaccaggtcatccactttcgcatggccgagatgatgaccgaggtcgaggcgctgcgcgccctggtctaccaggccaccgagctgtacgtgaaaggcagggacgtgacgcgcctggcttccatggccaagctcaaggccggccgcctcggccgcgaggtcagcgacgcctgcctgcagtactggggcggcatgggcttcatgtgggacaacccggtctcccgcgcctaccgcgacacccgcctggtatccatcggcggcggtgccgacgagatcatgctcggcatcatctgcaagctgatgggcatcctgccgggcaagaagaaaggctgacgttccaggaggaaaccggcatgagcctgccgcattgcgagaccctgctgctggaacccgtcgagggcgtcctgcggatcaccctgaaccgcccgcaaagccgcaacgccatgagcctggcgatggtcggcgaactgcgcgcggtgctcgccgccgtgcgcgacgaccgtagcgtgcgggcgctggtgctgcgcggcgccggcgggcacttctgcgccggcggcgacatcaaggacatggccggtgcccgcgccgccggggcggaagcctaccgcacgctgaaccgcgccttcggcagcctgctggaggaagcccaggccgccccgcaactgctggtggcgctggtggaaggcgcggtgctcggcggcggtttcggcctggcctgcgtgtcggacgtagcgatcgccgccgccgatgcgcagttcggcctgccggaaaccagcctcggcattctcccggcgcagatcgcgcctttcgtggtccgccgcatcggcctgacccaggcccgccgcctggccctcaccgccgcccgcttcgacggccgcgaggcgctgcgcctgggcctggtgcatttctgcgaggccgacgccgatgccctcgaacagcgcctggaggaaaccctcgagcaactgcgccgctgcgcgccgaacgccaacgccgccaccaaggccctgctgctggccagcgaaagcggcgaactcggcgccctgctggacgatgcggcgcgacagttcgccgaagcggtgggcggcgccgaaggcagtgaaggcaccctggccttcgtacagaaacgcaagccggtctgggcccagtga

SEQ ID NO: 9572 - DNA, 2031 bp, Pseudomonas aeruginosa
gccacgaccgcgaaacagggcaacagcctccaggagccgaacgacatgcccagcttcaacaagatcctcgtcgccaaccgcggtgaaatcgcctgccgggtgctgcgcaccgcccatgaactgggctaccgcagcgttgccgtgtacagcgaggcggacgccgacgcccgccatgtgcaactggccgacgaggccgtgtgcatcggcccggcagcggtggcgcagtcctacctgaatctcgaggcgatcctcgacgccgcccgtcgcagcggcgccgaggcgatccaccccggctacggcttcctctccgagaacgccgaattcgcccgtgcctgcgaagccgccgggattgttttcatcggcccggatgcggaagccatccacctgatgggcagcaagcgcctgtcgaagatcgccatgctcgccgccggggtgccgtgcatccccggctacgaaggcgccgaacaggacgacgcgaccctgcggcgcgaggccgaacgcatcggctacccactgatgatcaaggccagcgccggcggcggcggccgcggcatgcgcctggtggaggaacccgaccaactgctggaccagttgcgcaccgcacgctcggaagcgctgggcgccttcggcagcgccgaactgatcctggagaaggccgtgctgcgcccgcgccatgtggagatccaggtgttcggcgaccgccacggcaacctgctctacctcggcgaacgcgactgctcggtgcagcgccgccaccagaaggtcatcgaggaagctccctgcccggtgctcgatgccgacctgcgtcgcgccatgggcgaggcggcggtgaaggccgcggcttcggtcaactacgtgggcgccggcaccgtcgagtttcttctcggcgaggatggccgcttctacttcctggagatgaatacccgcctgcaggtcgaacacccggtcaccgaactggtcaccggccaggacctggtggcctggcagatccgcgtcgccgagggccatccgctgccgctgcggcaggaacaggtggaactgcgcgggcatgccatcgaggtccgcctctacgccgaggacgccggtcgcggcttcctgccgcagaccggcacggtgctgcgctgggacccggaactgctgcccggcgtacgcatcgaccatggcctggtcgaggggcaggcggtgacgcccttctacgacccgatgctggccaagctgatcgcctacggggcgacccgcgacgaagcccggcgcaagctgatccgcgcgctggagcgctgcgtgctgctgggggtcgacggcaaccagcggttcctcgccaacctcctggcgcatccggacttcgccgccggcgaggcgaccaccgccttcatcggcgaacgcttcgccgaagaccccagcctgcaaccgcgccagccgggcgccgaggaactggccctggccgccgccctgctctaccaggccggcgccgaggccagtgcgcaccagcccggcctggccggctggcgcagcgccgccggggcaccgtggaagatcgtcctgaagcacgccgaacagcgcgtggagatcggcctggacgtcctcgaaagcggtcgccggccgcgactgctggcgcgcctggagcgacgcgagatcgccgtgcgcctgctcgactgcgacggacgctgggccagcgccgaactcgacggcattcgccgccgccacgcgtaccacgtggacggcgggcgcctctgggtatacggccacggcggcaacctcgaactggtagaggtcacccacgccggcgccagcgcccaggtcggcgccagttccggcacgctcaaggcgccgatggacggcgccatcgtcgaggtgctggtcggcgagggcgaacgggtcggcaagggccaactgctgctggtgctggaggcaatgaagatggaacacccgctgaaggccggagtcgacggcgtggtccgccgcgtccaggtcggccgtggcgagcaggtgcgcaaccggcaggtgctggtcgaggtggaagccgacgcctga

SEQ ID NO: 9573 - DNA, 876 bp, Pseudomonas aeruginosa
gacaccccgccgctcatccgcaacgacaacgacaagaaaacggagacgcccatgtcactgcacggcaagaccctgttcatcaccggcgccagccgcggcatcggccgggagatagccctgcgcgccgcgcgcgatggcgccaacctggtgatcgcggcgaagagcgccgagccgcatccgaagctggaaggcaccatcttcagcgtcgccgccgaggtcgaggccgccggcggccaggccctgccgctgcaactcgacgtgcgcgacgagcaggccgtggcggcggccatggcccgcgccgccgaacgcttcggcgggatcgacgcgctggtcaacaacgccggggcgatccgcctggtcggggtggagaagctggagcccaagcgcttcgacctgatgtaccagatcaacacccgcgcggtgctggtctgcagccaggccgccctgccctacctgcgcaggagcgccaacggccacatcctcagcctgtcgccgccgatcaacctggccggcaggtggttcgcccagcacggcccctacacggtcaccaagtacggcatgagcatgcttaccctggggatgcacgaggagttcgggaaatacgccatcagcgtcaacgcgctgtggccgaagaccatgatcgccaccgccgccatcgagttcgagctgggcagccgtgacgccttccgccgcgcgcgcaccccggcgatcatggccgacgccgcgcacgccattctcaccagcgaggggcgcagcctcagcgggcgcctgctggtcgacgaggaattgctgcgcgagcgcggccagagcgatttcgagcagtaccgctacgacccggagggtggcgcgctggtgcccgacctgttcctcgactga

SEQ ID NO: 9574 - DNA, 1203 bp, Pseudomonas aeruginosa
tgcgcgacatcggtttcaagcacacccagttcgtcgaccgtctcggcgacaccttccgctggaagggcgagaacgtttccaccaccgaggtggaaaacgccctcggcgccttcgacggggtcgaggatgcggtggtctacggcgtggagattcccggcaccaacggccgctgcgggatggccgcgctgcgcctggccgatggcgtcgaactggaccgcgacgctctcgccgcgcacctcgaccgcgagttgccggcctatgccacaccggtgttcctgcgcctgctgcgcgaagtcgagaccaccggcaccttcaagtacaagaagaccgacctcaagcgcgacgcctacgatcccgcgcgggtcagcgacaaactcttcgtcaggttgcccggcagcgccggctaccagccgctggacgcggagctgtaccaggcgttgcaggagcagcgctaccgcttctgagcaccgtggcggcctactggcggaactcgaactgcaactcggccccttccaggggccgcgacacgcccagttcgcggtcgcgatagagcaactggccgttgaggcggaagtcgctgtcgtccttttcctcgaacatcggcggcaacagcggcttgggcttatgggtctcttccgtgccgggcggcgccatcttctgcaccagttccttcggcaggcgcaggtccagcttggcgctcggcagcggcttgcgtacctcggggtcgagacgagcggtggaagcgcgcttcgccggcgccggcttgtccttggcgaccggcctgctggccggcttcggcggcgcagccgcaggcttcggcttggccggcggcttgggttcggcaacctgctccgcggctggcgcgaccttcttcgaagctgttttcggcgcggcaggcacggcaggcgctggctccgctcgtgcaggcttcactggcttggcaggggcgcgctgctcctgcggcggtgcttccggggctttcttttccggtgccttggagccgtcatcgcaggccgccaggaagcaaccgaaaagaacaacgacgcaaattcggcaaagacgtttcatagtcacgcaggtatggccaattgcggcaatgctgacggcagactgcaaccaaggcaaggggtcactatcgtcatcctggcactctctctgttgttcgccccatgtctaacctgtcatgcgcggataaccgcttga

SEQ ID NO: 9575 - DNA, 1539 bp, Pseudomonas aeruginosa
tccccgggaaaattcttcgcggactgtcgcggggcgcccctcagccaggggagcgcctcgcgctcaggcggcgataaggccttcctggcaaagctgcccggcaagcatgccgagggtcatgatcgcccgctccgcctcgcggttccagggaatcccgcaggtcagccgcaggcagttgttgaactgctcggtgttgctgaagatcagccccggggcgatgctgatgccctgctccagggcccgcacgtggagttccttggtgttgaccttggccggcaggctgacccagaggatgaagccgcccttgggccgggtcatctgcgtaccttccgggaagtactgctgcaccgccaactggtaggcggtcatgttcttccggtactcctggcggatgtagcgcaggtggcggtcgtagccgccgttctccaggtaggcggcgacgcccatctgggtcacggtgcaggccgaatgggtggtgaaggtctgcaagcgacggatctcctcctggtagcgctcggcgatgatccagccgatgcgtacgccgggcgagatggtcttggagaaactcgagcagtagatcacccggccgtcgcggtcgtgggacttgagcgagcgcgcctggccctggtcgaacatcagttcgccgtagatgtcgtcctcgaccaccccgatgttgtgttcggcggtcagtttcagcagttgcttctggcgatcctcgggaatcgtcccgccgaagggattgctcagccgcgcggtcagcaccaaggccttgatcgaccactggttggccgccagttgcagcgcttcaaggctgatcccggtgcgcgggtcgctggggatctcgatgaccttcaggcccagcacgtcggcgagttgcagcaggccgtagtagctcggcgactcggtggcgatcaggtcgccgggacgggtcagcacccgcagggccatgtggatcgcatccacgcagccgtgggtgatggtcacctgcgacgggtcgaccaccacgccggcgtcgcgcatgcggatcgccacctgccgccgcagcggctcgaaaccggggctgaacatgtagctgaacgcccgggggctctggaagcgggtgaccttggccagttgctggtgcaaggcgcgcaccggcaggtagtccacgtgcggcaccgccgcgccgagcgggaataccccttcgcggcgggactcggcgagcacctggttgatgatgctgctgcgggtgaccaggccgggacgctcgacccgcgcgatatccggggtcggcgcggtcagcgccggggtgcggtggacgtagaagccggattgcggacgggcgcggatcagtccctggtcctcgagggtggcgtacgcctgcagcacggtggcgtggctgacgttcaactgggtactgagcttgcgcaccgacggtacccgctcgcccggctggtagacgccacggcgaatgtcctcggccaactgctgggcgatgcgttggtaaagcagcagattggtcatggcgggttttcctcggcgattgaaccgaaacagtag

SEQ ID NO: 9576 - DNA, 447 bp, Pseudomonas aeruginosa
ccgaggatgtcctcggcctcgtccagtgcccgccgcgccgcaggcaccatcagctcggcgcagccgggccccaggccgatcactgtgagtcggccgcgacgctggccgatgcggtccatcgccaagggcgcggcggccaccgccagccggtcgccgacctgctcggcggcgggcaaggcctggcgcaggcgcgcagcgggatcggcctgcggcaggaagcgcagcggtacgccgagcgcatcggcggcggcctgcaggcgcggatcggccatccgcgcgctgtcggccagcaagccgccgagcgccgccgcggccaggccggcatcgaccagcgcctggcgcaccgcgtccgccgccgcgtcggcaggttcgagcgccgccagcacgcagcgcggatggatcagcagttcctcggcccgcggcgcacgcgccgagggcgtcacgtga

SEQ ID NO: 9577 - DNA, 1716 bp, Pseudomonas aeruginosa
ccgcgagcttttccaggtcggccgggatgccggcgaggttcgcttcggcgcggatggtggcgaacgactggcgatagatcgcctggccatcgcggatgtagtcaatcatgcgggttttccggaagtgggctgggaaggcagggccgccaggtagtcggcggccgtggcgaaagtcaggcggctggccagcaactggccgaatccggggtggcatgggtcgtgccggtacaggtcgtagaacccgccgctgcgcgccagcagggtgagcggcgcgcggtgggcagcggcgcaggaccgttcgcagccgcacaggtgcagttgcggcaggtcgctgcgcgggccgaggcgttcggccaggcgcaaggcgtcgcccttggtgtcggccaggcctctggcgcaggcgctggaaccgctgcaggcgatcagccgcgccaacggcgcatcgggctcggtcagcaggccgagtccgcgcaggccgagcagcgcctggtcggcctcggcgtgcgccaggttcggcaggagcacgccttgccagggggtcaggcgcaggctgccgtcgccatggcgttcgaccagctcggccaggccttccaggcaagcgctgtcgagccggccgagcggcgccgccgcgccgaccatcaccaggcccggctggcgttgcggctggacgccgagatgactccacggacgccccggcgaacgccgccaggccgccacccgctcgtcacgccgcagagggaaatccaggcgcgcctgcaaggcctccagcaaggttctccggccagctcctgcaacaggtggcgcattcgccgtctgttgcggctgggcgcgctcgaggaacaggtcgagcagcgccagcaccagggactcgccccgctccgccggcaacgccgccagggggcggtcgcgggccgggcagccggcgagtccgaagaccagcgtcgcggtcggcgccgcgggcatcggcgagagccagatgtcatggggatgttcgagcatcgccaggtcttcgccgccgtccagctggatggcgaacttggccgacagcgcgtggtagcggctgtccgcctggagccgcagcaacagccgagcggccagcgggcgcacgtccagcgacaggtgcggatcgagcccggcggccgggctgagcataaggttgcgcacgtcgtcggcgccggccagggacccatgccggggaccgaggccggcgtccagcaggcggcggacaagccgctcttcctcgccgcgacggacgccgcgcaattgcaggttggaacggttggtcgcctcgatcacgccgctggcgcaatcccgcgccgcggccgccacggcgcgtgcctgggcggcgtccaggcggccggcgtcgagcttgatgcggcagatgccgccgtccagcgcctggacgatacgcagcaggccgggacagggcgacggacgtggtacgggcaggggcgccggggtctggtcgtcgttcaaaaacgctactcgaatcggcgtcgcggcgaccgcaccgctgtcccccagggacagaccacggcatcggtacaccccgcccgatgttggcactcgcgactggtttcggcggcaggtctcctggctcgcagcccggcgttccacccgggggaggaacctccgcttcgcgccgccttcccggtaatccagtggcgaatggcgcgaatacaggctgcatacagttgcgggggcagccacggctag

SEQ ID NO: 9578 - DNA, 1335 bp, Pseudomonas aeruginosa
gcccgggcttcgaaaagaccgcggctccgtgttccctcttcggccctcgttggccccgcgctaacgcgaaagggccgggcaccgacgaacgcgctattatgccgcccagcccggggccgggaaaacccattccgtccggaagccgtcgcgggcccttcacagacgcatttcaggagtatcggaaccgtgtcatcggcagactcgacgccgccctggctgaccctggtgggcatcggcgaggacggttatcccggcctcggcaagcaggcccggcgtgccctgctgcaagccagccggatcgtcggcgcggcgcgccagctggaactgctgccgccgtgcatcggcgccgcccgcgaaacctggccgacgccgttctccctggaaccattgctggcccggcgcggccagccgacctgcgtgctggccagcggcgacccgatgctgttcggcgtcggcgccagtctcgcccggcaactgccggcgaccgaactgcgggtcctgccggcgccctcctccctctcgctggccgccgcccgcctcggctgggccctgcaggaggtcgcctgcctgtcgctggtggcgcgcccgctggcggcgctgcaggcacaggtccacgacggccggcgcctgctggtcctcagcaacgacggcgacagcccggccgccatcgcccgcctgttgaacgcccgtggcttcggcgccagtcgcctgagcgtgctggaacacctcggcgggccgctcgagcgccgtctcgacggcctcgccggcgactggtcgctgccgcgcgccgccgatctcaacctggtggcggtggaatgccgcgccggcgccggcgccgtgcgcctgccgctgaccccgggcctggccgacgaagcctatcgccacgacggccagttgaccaagcgcgacgtccgcgccgtgaccctggcgcgcctggcgccctgccccggcgagctgctctgggacgtcggcgccggttgcggctccatcggcatcgaatggatgcgcgcgcaccccagttgccgggcgatcgccatcgaagccaacgacgagcgccaggaacatatccgccacaaccgcgacgccctcggcgtaccgaccctgcacctggtcgccggcagcgccccggaggcgctgctggaactgcccgagccggacgccattttcatcggcggcggagtcaccgccgagggcgtgctggaaacctgctgggagcgcctgcggcccggcggccgcctgttcgccaacgcggtcaccctgcagagcgaacgggtgctgctcgactggcagcaacgcctgggtggcgacctccacccgctcttcaccaaacgggaa

SEQ ID NO: 9579 - DNA, 1029 bp, Pseudomonas aeruginosa
cgcgcgcgcgcggtcaacgacgtaccggatgcggcgacggtgacctattaccgccagcgcgcatcggccggcctgatcgtcagcgaaggggttccggtctcgcgcgagggcatgggctacttgttcacgcctggcttgtatacggagcagcaggtcgcgggctggcggctggtgaccaacgcggtgcacgaggccggcggccgcatcttcgcccagctctggcatgttggacgcatctcgcacgtctcgctgcaggaggcaggcgcgtctcccgtgtcttccgtcgcccggcgagcagagaattcgcaggcttacgcctggatcgtgcaaggcctggccggccaggtgccggcaagcgccccgcgcgccttggccgaggatgaggtgccgcgggtcacgcgcgacatcgtggctgccgccaggggcgcgatcacggcgggcttcgacggcattgagctgcacgcagccaacggctacctgttcgagcagttcatcaatggcgagctgaacacgcgcctggatcgctacggtggctcgatcgccaaccggttgcgctttttgctcgatacggtggacgccttggccgaggcgattggcgcgcaacgggtcggcgtccggatttcgccgttcggccgcctgaacgacatgcgggccttcgacgatgaagcgcagacatggttgactgcggcaaacgagctaagcaaacggaacctggcgtatgtccatctgagcgaccagtgcaccattggcggcagccctgtcggcgatttcttgcaggctttccgcgacgcttaccgcggcaccttgatcgccgccggcggatttgacaagccgcgcgcagaacaggcactgcaacgcggcgtgctcgatctcattggcttcggggccccgttcatcgccaatcccgatctcgtcgagcggcttgccaacgactggccgctggccgcggtcgatcgttcgaccctgtacggcctgcacggtgagcatggctacaccgactatcccccgtacgcaggcgatgccgcctga

SEQ ID NO: 9580 - DNA, 870 bp, Pseudomonas aeruginosa
actgagaaaattcttacagcggagtcccaaggtgtcgccactcctcattaccgccctcatcatcggcgggatcgccctcctcatcgccattggctatatcaaccacgtggtggaaaacagcaagctggagaaagcgcgcctgaaggccgaactcaacgaccgggtccggcgctgcgcgcagatttccgagagccttcccggccagttcgtcagcccgtcgctgaagctgttgatgagccagatcgagctcagcctcagcgagcagcaactggcgctggagaagaaagccgatgccgggctcaaggctcgtatagaagagttgcgcgcgctggtcgccaagggcgagtcgatcccggtgcgcaatccgccccaggcgatcctgaccgaggacaaggccaaggaagtccgcttcctcttcgaagccctgcatgcccagctcacccgtttcacccaggacggccacctgccgcgcagcgaggcgcagatctgggtcaaggagattcgccacctcctggtgcgcctgcatatcgagttcttcggcaatctcggccagcaggccctgcagcagaacgaaccgcgccaggcgcgcctggccttcgaacgcggcgcccagtacctgcgcaagcagcccgagctggcgcgctaccaggcggagctgcagcagatggaagcgcagctggcccgcgccaacgcgatggtgctgaacaacagccagccggcgagcgaggagcccagcgaactcaacgagggattgaaggccctcgatgcagacgacctgtggaagaagaagaacgtctacgactgattccggcctgcctacggcagccgtgctataacccaggctcatatcgaccgaggaaatcgttatga

SEQ ID NO: 9581 - DNA, 513 bp, Pseudomonas aeruginosa
ccctcgccgacctggcgatcgccagccagttggtcaacctgcgtcacgccggcgaaaacctggacgagcaacgctggccggccctcgccgcgcatttcgcgcggatgctcgaacgcccggcgatgcaagcgctgctgccgggggaacgacggaccctcgacaagctcgcagcgaaagcctgaacgcgtcgctcagcagtccgtcaggcgcaggaatatctccaccaggccttcgatcccggcctggtcctcggcgctgaagcgtcccacgctcgggctgtccagatcgagcacagcgaccaggcggccgtccttgagcaggggcaccaccagttcgctgctggaagcgctgtcgcaggcgatgtggccgggaaacgcgtggacgtcgtcgacccgctgggtcagccgggtacgcgccgcggcgccgcagacgcccttggagaaggggatgcggacgcaggcgaccttgccctggaacggtcccaggaccagttcctcgttgcggttcagatag

SEQ ID NO: 9582 - DNA, 429 bp, Pseudomonas aeruginosa
ttcaggttggcgtcgattatgccagccaggacgcatccatcaatcgcgaagtgcgcgcgctgctggacgtcagccacaaccccgccgcgcgaatcgcctacaacatcgatgcggagctggcccaggagctggtcctcggcctgctgcgctcgcccgccgtggtccgcgcggaaatcatcgacacctccggcctgccgctggccagcgcctcgcgcgaacccgccgaaagccgcctgcggccgctcagcgacttcctcttcggccacaagcgggtctacgaggacccgttgcatgtcgaccatgcgccgggcgaggccctcggcgtactgcacctggaaatcgacaccttcgtgttcggcaacgacttcctccgtcgcgccggcatcaccctgctctccggcttcgtgcgcagcctgctgctgtcgctga

SEQ ID NO: 9583 - DNA, 1527 bp, Pseudomonas aeruginosa
atcccgggggtcttggtggcgtggtattcgccactgaaggcgcgttcggtaccgcccaggcgacagatgtggaactgctcttcggtcaactcctcgcgccaggagtccaggggtttgtcgatcttgctcatcggctctacctcgcgatctgaaaaatgcccggcgctcccttttccgggggacgggccgcacgtatcatgcgtgctccttatagacgccagtctgtcatccgcgttacagcctgccaagccgcgatccagcgggcttttcgcagcctgttccacggtgttcgctcacttcgggactcgacacatcatgcaggtcagcaaatcgaacaagctcgccaacgtctgctatgacattcgcgggccggtgctcaagcacgccaaacgcctagaggaagagggtcaccgcatcctcaagctgaatatcggcaacccggcgccgttcggtttcgaagctcccgaggaaattctccaggacgtcatccgcaacctgccgaccgcccagggctacagcgactccaagggcctgttcagcgcgcgcaaggcagtgatgcagtattaccagcagaagcaggtggaaggcgttggcatcgaggacatctacctcggcaacggcgtgtcggaactgatcgtgatgtccatgcaggcgctgctgaacaacggcgacgaggtgctgatccccgctcccgactacccgctgtggaccgccgcggtcagcctcgccggcggcaaggcggtgcactacctgtgcgacgagcaggccaactggtggccggacctggaagacatcaaggcgaagatcacgccgaacaccagggcgatggtgatcatcaacccgaacaaccccaccggcgcggtgtattccagggaagtgctggaaggcatggtcgaactggcccgccagcacaacctggtgctgttctccgacgagatctacgacaagatcctctacgacggcgccgtccacgtctccaccgcctcgctggcgccggacgtgctctgcctgaccttcaacggcctgtccaaatcctaccgggtggccggcttccgctccggctgggtggcgatctccgggcccaagcagcgggcacagagctatatcgaaggtctcgacatcctcgccaacatgcgcctgtgcgccaacgtcccggcgcagcacgcgatccagaccgccctgggcggctaccagagcatcaacgatctggtcctgccgccggggcgcctgctggagcagcgcaaccgcgcctgggaactgctcaacgacatccccggcgtcagctgcgtgaagccgatgggcgcgctgtacgccttcccgcggatcgacccgaaggtctgcccgatccacaacgacgaaaagttcgtcctcgacctactgctctcggaaaaactgctgatcgtccagggcaccgccttcaactggccgtggcccgaccacttccgggtggtcaccctgccccgcgtcgacgacctggagcaggcgatcctgcgcatcggcagcttcctcaagggctaccagcagtaa

SEQ ID NO: 9584 - DNA, 504 bp, Pseudomonas aeruginosa
cccccccgctcccgcggcgccgctggcgccgccctgcccggcgacccatccatggacctgcagatcgacgacttccacaaggacgccgctggcggcctcctgcttctctaccaggcgtttccgcgcaagaccgcgctctacgtcgaagacctgatcggccgcgaggcgccggacgagttcggcctgccgagcaaacgtcaccaaagttgtctgggcgcgttgctctggctcgccgaggaaggctacctgcgcttcgccaacaccattcattacgaggctctcgaccaggcggtgctcagcgaaaaggccttcctaagacttacccgtatcgtcccccgggccgcggcggcgctggccgaggcgccggccagcgtgcgccgcgaacaggccagcctggccaaccagttgcgccaggcgctggcgcagggcgacggcgaacgcctggccgggctgacccgcctgctgttcgagggcaacctgggcgcgcaaggcgacacagtttga

SEQ ID NO: 9585 - DNA, 1185 bp, Pseudomonas aeruginosa
cagccgcgagccagccccggaacatgcgggtccgtgatttcgcccgatgaggttcccatgcagatccgcgccgatttcgacagcggcaacatccaggtcatcgatgccagcgatccccgccggatccgcctggcgatccgtcccgacctggccagccagcatttccagtggttccacttcaaggtcgagggcatggctcccgccaccgagcaccgcttcaccctggtcaacgccggccagtcggcctacagccatgcctggagcggctaccaggcagtcgcctcgtacgatggcgaacgctggttccgcgtgccgtcgcaatacgacgccgacggcctgcatttccagctggaaccggaggaaagcgaagtccgcttcgcctacttcgagccctacagccgcgaacggcatgcccgcctggtcgaacgtgcgctcggcatcgagggcgtcgaacggctcgccgtcggcaccagcgtgcaaggccgcgacatcgaattgctgcgggtcaggcgccatcccgacagccacctgaagctgtgggtcatcgcccagcagcatcccggcgaacacatggccgaatggttcatggaaggcctgatcgagcgcctgcagcggccggacgatacggaaatgcagcgcctgctggaaaaggccgacctgtacctggtgccgaacatgaacccggacggcgcgttccacggcaacctgcgcaccaacgccgccggccaggatctcaaccgggcctggctggagccgagcgccgagcgcagcccggaagtctggttcgtccagcaggagatgaagcgccatggcgtcgacctgttcctcgacatccacggcgacgaggaaatcccccacgtattcgccgccggctgcgagggcaacccgggctatacgccccgcctggaacggctcgagcaacgcttccgcgaggaactgatggcgcgcggcgaattccagatccgccatgggtacccacgcactgcgccgggccaggccaacctggcgctggcctgcaacttcgtcgggcagacctacgactgcctggcgttcaccatcgagatgccgttcaaggaccacgacgacaacccggagcccgggaccggctggtccggcgcccgctccaagcggctcggccaggacgtcctgagcacccttgcggtgctggtcgacgaactccgctga

SEQ ID NO: 9586 - DNA, 411 bp, Pseudomonas aeruginosa
tctcgtccaggtggaagccgatctggttgttcgcccagcgggcgtgccaaaaatccgcctgcatcctgtcctccgcattcgtgggaaaaaccgcaaggtggcgacaatcggccggcaggtcaactcccctgcgcatctccctcgcgcacttccaccagcaccggacacggcgcctcgcggatcacccggtcgccgaccgaaggatcgagcaggcgctccagccgtcccaggtgccgatggccgatgatgatcagctcgcagcccaggcgccgcgcctcgcccaggatcacctgcaccgggtcgccggcacgcagctcggcccgtacctccagctcgcacccggctagcagcgcacaagcctcgtcgagcacctgccgggcctcttcgcactcgtgcgcggcgggcggatag

SEQ ID NO: 9587 - DNA, 507 bp, Pseudomonas aeruginosa
gcgacccgatcatggtccgcgccggccgcaagctggtgcccacgccccgtgccctggaactgcaggagcaggtccggcaactggtggaccaggcccgcgacctgttcaacactcgcgagaccatccaactggacaagctggagcgctgcttcaccctgcgttccaacaacaccctggtcggcggtctgtcgatacgcctgctggagatcttcgccgaggaggcgccgcgctgcaccctgcgcttcgtgcaggagtcggacatcgacgacgaggcactgcggcagaaccgcatcgacctctacatcggcgcctcgtcctggatggaacccgaggtcaagacccagcagttgctcaccacccgcttcgtcggcctggcccgccaggggcacccgatcttcgacggcgagatcactccgcagcgcttcgtcgcttttccgcatatcgccgtctcgcgtcgtggcctcaaccatggaccgctggaccaggccctgggagaactcggcctga

SEQ ID NO: 9588 - DNA, 786 bp, Pseudomonas aeruginosa
cctgggcctgccactggcggcgttctggttcgaatacgtcggctggcagtgggtgttctggcaggtcattccactgtgcctggtggcgatggccgcggtgtcccatggcatcccccaggacccggtgcgcctggaacgcttccgccagttcgacggcatcggcctgctcaccggcttcccggcgatctgcgccctggtgatcggtctgctgcaaggcgaacgcctggactggttcgagtcgccgctgatctgcctgctgctgggcagcggcagcctcctgctggggctgttcctggtcaacgaatggagccacccgctgccgttcttccgcctgcagttgctgaagcgccgcaacctgaccttcgccctgatcaccctggccggcgtgctggtggtgctcggcgcgagcatgggcgtgccgaccgaattcctcgccgagatccgcggctaccgccccctgcagagcgtacccatggtgttgctggtggcccttccgcagctcgtcgcgctgccgctggtggcggccctctgcaacatcccgcgggtcgactgccgctgggtgctggcctgcggcctgtgcctgtgcgccggtgcctgcctgagcttcagccaactgacggcggactgggtgcgcgaggacttctacctgccgatgctgttactggtggtcggccagccgatggcggtgattccgctgctgatgctctccaccagcgtcatcgcgcccatcgagggacccttcgcctcggcctggttcaacaccgtccgcggcttcttccggggtag

SEQ ID NO: 9589 - DNA, 1140 bp, Pseudomonas aeruginosa
tcactgattccgatcctgccgcaacgggatctacccgccccgcccggtcgctcccacacactgaaaggtcgctgtatgtcgttcatcacttcgcgcaagggcatcctgctgctcgccgccctgctggtcctgaccctactggtctacctgctgttccacctgctcgccccacgggtcgtgcagagcaccgacgacgcctatgtgcacgccgatttcaccctggtcgcgccgaaagtcgccggcttcgtccaggacgttctggtcgaggacaaccagccggtcaaggccggccagttgctcgcccgcctcgacgaccgcgacttccgcaccgccctggccgccgccgaagccgacgtgctcggtgccgaggccaacctggccaatgccgaggccaacctgcaacgccagcaggcgctgatcgaacaggcgcgggccaaggtccgcgccgagcaggccgagctggtcttcgcccgtcacgagcaaagccgctaccagaccctcgccagcaagggcgccggcagcctgcagaacgcccagcaggcgcaatcgcggatcgataccgccagcgcccggctggccgagggccaggccgcagtggatgccacgcgcaagcaggtgagcgtcctcgaagcccgcgtcggccaggcccgtggcgacctgcaacgcatgcaggcgcgacgcgaccaggcccgcctggacctctcctactgcgaactccgcgcgcccttcgacggccaggtcggccgccgccaactgcgcgtcggcgcctatgtcacgccgggcagcgcgctgctggcggtggtgcccctgcagcaggcctacgtggtcggcaatttccaggaaacccaactgacccacgtctctcccggacaggccgtggaaatccgcgtcgataccttccccggcgaggttctgcgcggccatgtcgacagcatcgcaccggccaccggcctgagcttcgcgccgatcgccccggacaacgccaccggcaacttcaccaaggtggtccagcggatcccggtgaagatcgttctcgagccgcgccaggccatggcgggcaagttgcgtgtgggcatgtcggtggaagcacggatcgacaccgcgaccggcacccgctccgccgaggttgcccagcaatga

SEQ ID NO: 9590 - DNA, 480 bp, Pseudomonas aeruginosa
acgccctgctgcaacgggtccagcgtgccaacctcgacctgcgcagcgccgcggcgcgcctgcagcagagccgcgcgatccgtcgcagcctcggcggtgacgccctgccctcggtggacgccagcggcacctaccagcgccagcggaccaccagcgccggcctgttcgatccctccggcaaggccggcaaaggcaactacaaccacgccctggccggcttcgacgcctcctgggagctggacttctggggccgcgtgcgacgcgagctggaagccgccgacgcgacggtggaagccagcgagaacgaactgcgcgacgtgcaggtctcggtgctggcggaagccgcgcgcgactatatccagttgcgcggcgaacagaaccgtgcggcgatcatccgcgacaacctcgagaccgcacggcgcagcctggaactcacccgcacgcgcctggccaacggcgtcgccaccgacctcgaggtag

SEQ ID NO: 9591 - DNA, 699 bp, Pseudomonas aeruginosa
cccaggcgctggcccaggtggccagcatggaggcacgcctgcccgaggtggaaaagaaccaggcgcacctggtcaacgccctcggctacctggtcggcgccagccccggcagcctgctcgccgaactcggcccggcgcgggcgattccgcgtccgccgggcagcgtgccggtcggcctgccgtccgaactggcccagcgccgccccgacatccgtcgtgccgaagcgcgcctgcacgccgctaccgccagcatcggcgtggccaaggcggacttctatccgcgcatcacgctcaacggcaacttcggtttcgaatccctgcaactgtccagcctgggcgactgggaccatcgccagttcgccatcggcccggcgttcagcctgccgatcttcgaaggcggacgcctgcgcggacgcctggagctacgcgaggcacagcagcaggaagccgccatcgactaccagcgcaccgtgctgcgtgcctggcaggaagtcgacgacgcgatgcacgactacgccgccaaccagcgccgccaggagcgcctcggcgaagccgtggcgcagaaccgccgcgccctgcagagcgcccgcgagcaataccgcgccggcgcggtggacttcctcagcgtgctcgacagccagcggcaactgctggacaaccaggaacagcaggtcgccagcgacgaagcggtgtcgctga

SEQ ID NO: 9592 - DNA, 378 bp, Pseudomonas aeruginosa
acgtggccgcgccgtcctgcccgcagggctgggccttcgtcggcgaacgcggcgaaacgctgctcgatctcgacgaggcgctcaaggtcaaccttcccgaggccgcctgcgccgccgccgcggccgggctcggcgtctgcctgctgcccggcttcgtcgccgcccgcgcgctgcaggaaggcagcctgttgcggctactgccgggccatcgactgcatgtccgcgaggtgttcgtgctgtactcctcgcggcgctacctggacgccaagatccgcacctgggtggacttcctcagggaacgcctgcccctggcgttcgagcgtgaccgggcgatcctcgacgatcggcgctactgggcggaaagcccaaccggcgtag

SEQ ID NO: 9593 - DNA, 1107 bp, Pseudomonas aeruginosa
gcggcggatcagggcctcggtatgtgcaggtctgacatgcacgacgtggtgcctgccctggcggctgggcgagtcctttgtttccttcaggacgcttgccaaagggactcgcccggggtgacgaaacgagaagccggggcaggcgcgaaaaacagtctggccagcaaacatcaagcccatgaaaaagccccgccgaagcggggcttttgttcatcgcgctggacctcagtcctcgcgatagcggcgcaggcgcagggccttgccggcgacgcgggtgtccttgagcttggtcagcaggcgctcgagattggcctcgggcagctcgatcaggctgaaggtatcgcgaatctggatgcgaccgatgtcctcgcgggacaggccgccctcgttgaggatcgcgcccagcaggttcttcgccgcaaccccgtcgcgcgcgccgagggcagtgcggcagcgggcacggccttcgctcggcggcgccatcggacgacgctcgccgctgcgctccggacgctcgccgcgttcgccacggtcggcacgctcgcgcggtgccgatggggtcagcggctgttcgcggcgcaccgactccaggtccagcgccttgccggcggtcaggcgtgccagcaatgcggcggccagggtctcggcatcgcagccgaggcgacggcacagctcgtcgcgcaccgcgccgcgctgctcgacggcgctgtcgagcaagggcgtcaggctcgcggccaggcgcgccaggcgggcctccagtacggtctcggcatccggcaggcggacttcgccgaccttctgcccggtgacccgctcgatcacctgcagcatgcgccgctcgcgcggagtcaccagcaacagcgcgcgcccttcccggccggcacggccggtacggccgatgcggtgcacgtaggactcggggtcgtagggcatgtcgatgttcagcacgtgggtgatgcgcggtacgtccaggccccgggcggcaacgtcggtggcgatgacgatgtccagcgaaccgtccttcagcgactcgatgacccgctcgcgctgggcctgcggcatgtcgccgttgagcgcggcggcgcggtagccctggcgctcgagtaa
